United States Patent 10,760,091 (GENES AND USES FOR PLANT ENHANCEMENT) - sequence listing, part 15

SEQ ID NO: 62972 - protein, 322 aa, Vibrio vulnificus YJ016
MSMIKKIGVLTSGGDAPGMNAAIRGVVRTALGAGLEVYGIYDGYLGLYEGRIKQLDRSSVSDVINRGGTFLGSARFPEFKEVAVREKAIENLKAHGIDALVVIGGDGSYMGAKKLTEMGYPCIGLPGTIDNDIAGTDYTIGYLTALNTVIESIDRLRDTSSSHQRISIVEIMGRHCGDLTLMSAIAGGCEYIITPETGLDKEKLIGNIQDGISKGKKHAIIALTELMMDANELAKEIEAGTGRETRATVLGHIQRGGRPTAFDRVLASRMGNYAVHLLMEGHGGRCVGIVKEQLVHHDIIDAIENMKRPVRNDLFKVAEELF

SEQ ID NO: 62973 - protein, 250 aa, Thermoanaerobacter tengcongensis MB4
MFFMDSKNLFKKAAELIKSSQKTMVLTGAGISTESGIPDFRSPGTGLWENMDPTEVLSTKVLFNSPEEFYRVGFKILSSMRNAEPNEAHYILSEMEKEGIIAGVITQNIDNLHQKAGSKKVYEVHGNTREGSCLRCGEKVSFELLEEKVAKEEIPPRCDRCGGMLRPDVVLFGDPMPHAFDLALKEVQESDLLIVIGSSLVVAPVNFLPGMVDGLIIINATETPYDYKADVVIREKASYALRNIWNLIKS

SEQ ID NO: 62974 - protein, 372 aa, Arabidopsis thaliana
MTRDSSRNSSLKPWPRKSFLFPSVVIVIVGIIVAFTYQSKLKPPPPKLCGSSGGPPITAPRIKLQDGRYLAYKEHGLPREKANRKIVFIHGSDCCRHDAVFATLLSPDLVEELGVYMVSFDRPGYCESDPHPSRTPRSLVSDIEELADQLSLGSKFYVLGYSMGGQAAWGCLKYIPHRLAGVTLVAPVVNYYWKNLPLNVSTEGFNFQQKRDQLAVRVAHYTPWLIYWWNTQKWFPGSSIANRDHSLLAQPDKDIISKLGSSRKPHWAEVRQQGIHESINRDMIVGFGNWEFDPLDLENPFLNKEGSVHLWQGDEDMLVPAKLQRYLAHQLPWVHYHEVPRSGHFFHYTKGVVDDIVKSLLTSGVRASRVCI

SEQ ID NO: 62975 - protein, 795 aa, Colwellia psychrerythraea 34H
MQENVLWYQSLGMNDVDRVGGKNASLGEMISNLANVGVQVPTGFATTSFAFNEFLEQSGINEKIYQLLDDLDVDDISALGKCGAIIRQWIIDTPFLPQMQTDIEAAYAQLAGDFSDDASFAVRSSATAEDMPDASFAGQQETFLNVRGFDSVMVAIKHVFASLFNDRAISYRVHQGYDHRGVALSAGIQQMVRSDISASGVMFSIDTESGFDQVVFITSSFGLGEMVVQGAVNPDEFYVHKPTLAKGKPAVVRRNIGSKAIKMVYSDSQEHSKQVEIVDIDEADSNRFSLTDAEVEELAKQAVIIENHYGHPMDIEWAKDGLDGKLYIVQARPETVRSRENANVMEQFQLKADNNLEVVCEGRSIGHKIGSGEAKVLSSLAEMDKILPGDVLVTDMTDPDWEPIMKRASAIVTNRGGRTCHAAIIAREMGIPAVVGCGNATELIKAGDNITVSCAEGDTGFIYRGKLDYDVKTSEINDMPELPLKIMMNVGNPDRAFAFARLPHAGIGLARLEFIINKMIGIHPKALLNFDTQPAELQDEINDIIVGYESPVEFYIAKLTEGISTLAAAYSPEKVIVRMSDFKSNEYANLVGGEAFEPHEENPMIGYRGAARYISKDFRDCFALECEAIKRVRNDMDLTNVEVMIPFVRTLGEAAAVIDILAEHGLKRGENGLRIIMMCELPSNALLADQFLDYFDGFSIGSNDLTQLTLGLDRDSGLIAHLFDERDPAIKILLAMAIKACKARGKYVGICGQGPSDHEDFAAWLVEQGIDSVSLNPDTVLPTWLYLAEQLAKKS

SEQ ID NO: 62976 - protein, 273 aa, Zea mays
MGSSLSPSSVAALTTAAHGHRYHLSSSSSSDYYEDDGFEFTPLLPRPRRRHSARTERPRTVAQAAATTAAQPQPPQLCARRGAPSVVAATPAAPPTPRKQQVRWHDMAFGSARVPAAMDMGEIRRRLRARQLALAGGPAGNERPPSSRGVGAVEAHTVAQLQGPRARGGCRGAGEAGGGGGGGGGTSGRCPVDALKLGVCANLLNGLINATLGTPPRTPCCTLIQGLADLEAAVCLCTVLRANVLGINLNLPINLSLLVNYCGRRVPSGFQCF

SEQ ID NO: 62977 - protein, 405 aa, Oryza sativa (japonica cultivar-group)
MDFSGGSGGGGVASGRVQAERWLEIAGKLLAARDLVGCKRFAERAVEADPLLPGADELLAVTDVLLASQSVLPSGQADPLAVLQLPPSTNPADHAAVSRAYRRLALLLRQDTNPHPGADVALSLVHDAYAILSDPNRRPPPPVAVAVPHAHPGAASHPAAPAAAESPEFWTACPFCSYVHQYQRELVGRALKCPNESCRKGFVAIEISTPPTIVPGTEMYHCAWGFFPLGYPTSADLNGNWKPFYKMFPWNNAPAGGAGSGGRGGYGGRGGGSAGRQPQNGSARGGSSRGRVKKTTARKKVGAGLKRRSFGGVESGIEPMDGQDGWGEGEEGGDGQAEEVRGININEEAQSTDGATRGHVHARGNVSGGVVDMGTFHLDVDPSEDILGNLQNLPFLRVDNLGRML

SEQ ID NO: 62978 - protein, 120 aa, Glycine max
  misc_feature (37)..(37): Xaa can be any naturally occurring amino acid
  misc_feature (63)..(63): Xaa can be any naturally occurring amino acid
  misc_feature (97)..(97): Xaa can be any naturally occurring amino acid
AISMIFTPAATTVNRAGAGMVAPFTGLKSMDGFPTKXTNNDITSIASNGGRVQCVHVWPSVGXKKSETLYYLPYLDDAQLAKEVEYLLTKGWIPCLXLQWEHGYLYRDHNRSPRYYRWTL

SEQ ID NO: 62979 - protein, 376 aa, Listeria innocua Clip11262
MAKRDYYEVLGISKSASADEIKKAYRKLSKQYHPDINKEAGADEKFKEISEAYEALSDPQKRAQYDQYGHVDPNQGFGGGAGGGFGGGGFSGFEDIFDTFFGGGGRQQDPNAPRQGSDLQYTMRLKFKEAIFGKDAEIEIPREENCDTCHGSGAKPGTTPEKCSHCGGKGSINVEQNTPFGRVVNKRTCQYCNGTGKEIKEKCPTCHGKGRVTKTKKIKVKVPAGVNDGQQMRVSGEGEAGINGGPNGDLYVVFVVIPDEFFEREADDIYVEVPITFVQATLGDEIDVPTVHGKVRLKIPSGTQTGTTFRLRGKGVPHLRGNGTGDQHVIVKVIVPKKLDDKQKEILREFASTTGDKVDEQTSGFFDKMKRAFKGD

SEQ ID NO: 62980 - protein, 539 aa, Gibberella zeae PH-1
MAVMSKLLNFPSLTLAACIEGFFAIKLFPNYYSTQSHLAAVVTILLINYAFGVVFWAVLYPRLFSPLRRIPGPKAYLSAAHHSLVVKGRPSGDLFLDLAKEYPGKDVIMLNSFRNQLCIMNPQLLADLLVHNCYDFAKPKRISGFLRHVLGDGLIIVEGEQHKFLRKNSTPAFHFRHIKELYPMMWTKSETLTKAIAQDITASRSPVVELNGWASKVTLDIIGIAGLGRKFDAVEKKIDPLADIYEQLLEPDREKLIFAMLSLAIGLPIIRMIPWKMNDLFNYLTGSLNDLCYPMIKEKKAAIIEKGDDHFDVLSLLIKSNNFSDEALKDQLLTFLAAGHETTASALTWACYLLTQYPDIQSKLRDEVRDSLPADVDCNTPDLASILEQMPYLNGVMHETLRLYPTVPLTMRSALRDTRIGDQYIPEGTDVIVSIWYINRAPEIWGPDAAEFRPERWMTEDGKPNQNGGASSNYNFLTFLHGPRSCIGQGFAKAEMRCLLANMVKSFEWTLAMDNKLVLPRGVITIKPENGMYLNMKAI

SEQ ID NO: 62981 - protein, 811 aa, Mannheimia haemolytica
MTNHWVDIKNSDLVIVMGGNAAEAHPVGFRWAVEAKKQNGAKLMVVDPRFNRSAAVADIYIPLRPGTDIAFLLGAVNYLLKNDKIQHEYVKHYTNATFLLNEGFKFEDGLFTGYDEATRTYKDKSTWAYQLDEQGQPKRDMTMQDPRCVINMLKDHVSRYTPEMVERITGTPQKDFLIFCEEIAKTSAPDKAATFLYALGWTQHTVGAQNIRSMAIIQLLCGNIGVSGGGVNALRGHSNVQGITDLGLFPHMLPGYIRLPTEADATLESYLNAIAPKTLVAGQVNYGQNNPKFAVSMLKTFYGDKATKENEFGYHYLPKYPKGGTDHFRFIEQMYQGKVNGYFCQGMNPIASYPNSQKLIKALSNLKYLVIFDPLITDTSEFWKNHGEFNNVNPSEIQTEVFRLPTTCFAEEDGSIANSGRWLQWHWKAADAPHEAKPDVDILSEIRAELIHLYHKEGGKAPLEPLEAMTWNYMNPLEPKPEEIAKENNGYALEDLKDADGNIIVKKGELLSSFTQMRDDGTTSGGCWIYCGQWTPKGNQMANRDNSDPSGLGNTLGWAFSWPVNRRILYNRASADLSGKPWNPKRQLVKWNGKNWNYVDVADYGTAPPNSPVTPFIMQPEGVSGLFVRERMQDGPFPEHYEPFETPIGTNPLHPNVISSPVARILPSDKEDLGTSDEFPYVGTTYRLTEHFHYWTKNALINVIAQPEQFVEIGEKLAEEKGIKNGDKVRVWSKRGEIKAVAVVTKRIRSLVSDGKPIHTIGVPIHWGFAATTGAKKGYFANNLTVRTGEPNSNTPESKCMLLNIEKIVGA

SEQ ID NO: 62982 - protein, 140 aa, Oryza sativa (japonica cultivar-group)
MGRLRGKVFPACFALNAACTAASAAAFAWLHRPPWPPAERRQLAVLLVAAGYDLANLLIFTPRTLEAMRERHKVERSLGIGGDGSFVGWRQNARAARSSSTLAAENARFWVAHSFSAVALVISAAGLFSHFCYLSGKIVI

SEQ ID NO: 62983 - protein, 109 aa, Glycine max
SLVACSLRKLRGKDDGINAGVAGCCTGLALSFPGAPQTLIQSCLTFGTFSYIIEKLNKQQPALALPPATGVMDPKAGQSVLPPFTLPPLDAMDEFCKFQNFLSSKFRGN

SEQ ID NO: 62984 - protein, 266 aa, Zea mays
  misc_feature (222)..(222): Xaa can be any naturally occurring amino acid
MATARALRLVLTSSSVPAAKDGFLVAARRRLLSASTEAGGAGDAAVQSGDAPSDDYTDRPPRFSGAEEATSAGGRVGKHPGGKAAERVPPFAPSGKKPPLAGSEHELADPAGAASFTQKRRLSCSSSSSSREREPREAATPGGPESAARKVREEDREYYRTHKPSPLAEVEFADTRKPITRATDGSAADRYADAQGRTVEDTVDDSLARAEAMFREAAARGXPSGRTPARSPRCWRDASWGRTLLPLPAATPAGAAEWTRPTQKQC

SEQ ID NO: 62985 - protein, 535 aa, Nicotiana tabacum
MMQHSSSVTQEPTNPFGFVSQVGSFVFNNSCSRVSKSNFTLDSYSNLLSNYLYFDCNVKKDSLNHKNKPKASPLLSLSISNKSASSFSRVLFQFNKAIRFHCEKIPLGFASVGVNCGESNGVREEGSVVENEGIPDNGVESEPPKKVLILMSDTGGGHRASAEAIRSAFNEEFGDKYQVFITDLWTEHTPWPFNQLPRSYNFLVKHGSLWRMTYYATAPRLVHQTNFAATSTFIAREVAKGLMKYQPDIIISVHPLMQHVPLRILRSKGLLKKIIFTTVITDLSTCHPTWFHKLVTRCYCPSEEVAKRALRAGLKPYQLKVYGLPVRPSFVKPVPPKVELRKELGMEEHLPAVLLMGGGEGMGPIEATARALGDALYDEIHGEPIGQVLVICGRNKKLFNRLTSVQWKIPVQVKGFVTKMEECMGACDCIITKAGPGTIAEAVIRGLPIILNDYIAGQEAGNVPYVIENGCGKFSKSPKKIANIVAQWFGPRQDELRIMSQNALRLARPDAVFKIVHDMHELVRQRNFEPQCCPA

SEQ ID NO: 62986 - protein, 316 aa, Bacillus cereus ATCC 10987
MKNRVNPVLLPGLEMYPDQDLRPECLPTMREEASKVFPPTIIDETLSVTNEVIEGPDANPLRLKIYRPKSNNESLPALLWIHGGGYILGSINDNDDLAVKIAKEANCMVVSVDYRLAPEHPYPAPIEDCYAALKWIADNAETLNIDSNRIGVAGVSAGGGLTAALTLLARDRQYPSICFQMPLYPMIDDRNNTPSANEIKKGFVWNQKSNEAGWKMYLGKLHGTDHIPAYAAAARAEDYRNLPRTYTCVGQLDPFRSETLTYVTKLAEAGVDVEFHLYPGAYHGFEMMHPDADISVHAWNDYVRAVKTGFAKKELR

SEQ ID NO: 62987 - protein, 503 aa, Burkholderia pseudomallei K96243
MQFNDILAALDVDLSRWQGRALTARSPVDGATLATLAADAPADAERKIDAAHQAFLKWRTVPAPVRGELVRVFGNVLREHKAALGRLVTLEAGKIASEGLGEVQEMIDICDFAVGLSRQLYGLTIASERPGHRMMETWHPLGVCGVISAFNFPVAVWSWNAALAFVCGDPVVWKPSEKTPLTAIACHTLFAKAVREFDKTHPGVVPEGLHQLVLGGRDVGEALCASPKVPLVSATGSVRMGIEVAQVLSRRLARSILELGGNNGMIVAPSADLDLVVRAVTFAAVGTAGQRCTTLRRLIVHRSVADQLLPRLEKAFASVKVGDPLEAGTLVGPLIDRASFDAMQKALGDAREQGGEVKGGERVELGRADAYYVRPALVRMPRQTAVVTRETFAPILYVLVYDDFDEALAIHNGVPQGLSSAIFTNDMREAERFMSAAGSDCGIVNVNIGTSGAEIGGAFGGEKETGGGRESGSDAWKSYMRRATNTINYSRELPLAQGVKFDV

SEQ ID NO: 62988 - protein, 439 aa, Methanosarcina acetivorans C2A
MFEVKYNSGNYMGRESELKRDLSLLEITLVGIGDILGAGIYVLMGKAAGLAGNMVWASFLFAGFTASLSALSYMELSSMYPRAGAEYVFARKAFGERIGLFVGLLVIYYVAITASAVALGFGRYFSNIFGGGILIGAISLYILLSLVMVYGIKESARLAILMTFIELSGLMIIIYVGIPYLGTVNYFETPSLSGVFEASALIIFAFLGFEDIVRLSQETKDAEKTTPKALLISIFFTIFLYICVAVASVSVLDFQVLGISEIPLAEVAAVAFGEKAFVLLSWIALFSTMNTVLVVMLGGSRIVYGMANSGSLPKILARVHQKLKTPWTAICGIAFFSSLFVFLGDIATVANIANFMIFIVFFIVNISLIKLRYTDPERKRPFRVPVSIGRFPIFPALGALSAVFLFSQIGKEVMLYGFFLAGISALLVLLKTRKRENEL

SEQ ID NO: 62989 - protein, 371 aa, Oryza sativa (japonica cultivar-group)
MWAASPAFRRRLFLLRSLSPSPCAALPGNAACSSSPSPSTSIRVNAMSASGPVYEADAEAVVRRITPPLDRARHKGQAGKIAVIGGCREYTGAPYFAAISALKVGADLSHVFCTRDAATVIKSYSPELIVHPILEESYSVSDGERESVSSRILTEVAKWMERFDCIVVGPGLGRDSFLLDCVSNIMRHARQANIPTVVDGDGLFLITNNLSLVEGNLLAILTPNVYEYKRLVQKVLNCEVNEENASEQLTALCQKIGGITIMRKGKADIISDGKTVTQVSTFGSPRRCGGQGDILSGSVAVFASWARHFLLTNEYPTEKSVNPMMLGCIAGSLLLRKAASHAFEKNKRSTVTTDIIELLGKSLEDICPAGH

SEQ ID NO: 62990 - protein, 270 aa, Aspergillus fumigatus
MDATGLSPCSKVVICSPSATASPPATSAPLLPSSLQKASSPIFTAISYFEKSHLHLRNTAYGAPSSDTAFRKTWDREEYAKKAADEEAKRKEEGKARYEAKLLGKKWHAPVDYSSLEATTSRKQRLDVASMVGKTTIVPAGSAVGKRGRGAGFYCSDCDLTFKDNLQLVEHLNSKQHLIATGQSGEVVRASLEDVRQRLRFLAHQKRVREEEERRAWQLDLGQRLKEREEQEAKEREEKRRKRNEKRRKNGENGIKQEEDSWEGRLGIIA

SEQ ID NO: 62991 - protein, 169 aa, Ralstonia solanacearum GMI1000
MIVVVMGVSGCGKSTVGRMIAERLGCAFRDGDEFHSEANRAKMHAGIPLNDDDRKPWLETIRAYMDETTAGGRSLVVACSALKERYRDVLRGPSGSTAFVYLKGDFELLQNRLAARQDHFFNPVLLRSQFDALEEPADAIVVDIALPQETVAQQAVEQLQARMAHRPAA

SEQ ID NO: 62992 - protein, 82 aa, Arabidopsis thaliana
MQYIQFLQEQVKVLSAPYLQATPSTTEEEVEEYSLRSKGLCLVPLEYTSEVAQTNGADIWAPVKTPTSSHAFNLSSSNSPFQ

SEQ ID NO: 62993 - protein, 316 aa, Triticum aestivum
MAQPSVILATASYDHTIRFWEAKSGRCYRTIQYPDSQVNRLEITPDKRFLAAAGNSHIRLFDVNSNSPQPVISYDSHTSNVMAVGFHCDGNWMYSGSEDGTVRIWDLRTATCQREYESRAAVNTVVLHPNQKELISGDQNGNIRVWDLAANSCSCELVPEVDTAIRSLTVMWDGSMVVAANNRGTCYVWRLLKGTQTITSFEPLHKLQAHDGYILKCLLSPEFCDPNRYLATASSDHTVKIWNVDGFKLEKTLVGHQRWVWDCVFSVDGAYLITASSDTTARLWTMSTGEAIRVYQGHHKATVCCALHDGAESAPS

SEQ ID NO: 62994 - protein, 429 aa, Thermoanaerobacter tengcongensis MB4 [sequence omitted]

SEQ ID NO: 62995 - protein, 248 aa, Thermoanaerobacter tengcongensis MB4
MRRPIIAGNWKMHKTPSEAVKLVEELIPLVKDAKAEVVVIPPFVDLTEVARVIKGTNILLGAQNMFWEEKGAYTGEISPVMLKEIGVTYVVIGHSERRQYFKETDEMVNKKVLSALSHDLKPIVCVGESLSQREEGKTYDVVLTQTREALKGVSEEDITKVVIAYEPVWAIGTGKNATPQDANEVIKAIRNTIAELYGKDKAEMVRIQYGGSVKPDNISGFMAESDIDGALVGGASLVAEDFAKIVNY

SEQ ID NO: 62996 - protein, 523 aa, Bordetella bronchiseptica RB50
MPENAQPHAVIPAADLQLSAQNPQWRVFAAAAAGASLVARPLRVIEAAGIYVDLSMQRHSSALAQAGLALLQARDVLGARAALFAPGAPDAAHGRYPVLRAGYGAHPEEQCDIEVEIEYARMLEFVRELDRGGACPAVLYLGGGAGQWALRLALQAFGGPAQRRQLRFVSGGDAAALHEALAGLDPRRTLVVAASRGFEPSETLDNARAAIDWLRRAGIDDVSAHLVAVTGNESAARALGVAAARVFRLPSWLQPRHELWSVGALPVALALGVDMLKALRSGAAAMDQHFLQAAPTVNAPMQMALAAVANTSAMHWPTHALAVYSARLAALPACVQQLEMTLAGRAPASLPAYPVVWSPAGAPGPGAFFEWLHRAPAGAPVDFIAGLDEYPASPPAHRALLANCLAQREALLRGLPAGPGQPAAGGGRPSTLVVLRQVDPRAVGALLALYEHKAFVQAALWGAALGGADQAQACQRLAQDIARQLAVPPAAGPVDWGHDSSTAFWIDRYREQGGAGAAAGRTA

SEQ ID NO: 62997 - protein, 462 aa, Streptococcus agalactiae NEM316
MAVEIIMPKLGVDMQEGEILEWKKQVGDVVNEGDVLLEIMSDKTNMEIEAEDSGVLLKITHGNGDVVPVTETIGYIGAEGEEVTEASSSENTSVEENATQVTSEPEKVEETSEPSVPAATSGEKVRATPAARKLAREMSIDLALVSGTGANGRVHREDVESFKGAQPRITPLARRIAEDQGVDIAEITGSGIRGKIVKNDVLAAMSPQAAEAPVETKATPTTEEKQLPEGVEVIKMSAMRKAISKGMTNSYLTAPSFTLNYDIDMTEMMALRKKLIDPIMAKTGLKVSFTDLIGMAVVKTLMKPEHRYLNASLINDAQEIELHNFVNIGIAVGLDDGLIVPVVHNADQMSLSDFVIASKDVIKKTQEGKLKSAEMSGSTFSITNLGMFGTKTFNPIINQPNSAILGVGATIPTPTVVDGEIVARPIMAMCLTIDHRIVDGMNGAKFMVDLKNLMENPFGLLI

SEQ ID NO: 62998 - protein, 372 aa, Zea mays
MENSAAAAAERPRLTRAAAKRSAVVTAVAVAAKRKRVALSQLPTLPNAVLGAHDDDDDKPVRKQRLLPAAKPKPKPKAAPAPAAPAAADDTDDDIQLCKPYASDIYSYLRSMESQAKRRLAVDYIAAVQIDVTPNMRGILIDWLVEVAEEYKLVSDTLYLTVSYIDRFLSAKVLNRQKLQLLGVSAMLIASKYEEISPPNVEDFCYITDNTYTKQEVVKMESDILNVLKFEVGSPTAKTFLRMFIRSAQEDNKKYPSLQLEFLGSYLSELSLLDYGLIRSLPSLVAASAVFVARLTLDPHTHPWSKKVQTLTGYKPSELKDCVAAIHNLQLNRTCQSMVAIREKYRQHRFKGVSALLPPVEIPASYFNTLKE

SEQ ID NO: 62999 - protein, 1018 aa, Arabidopsis thaliana
MSSTLLEQTRSNHEEVERLERLVVEDLQKEPPSSKDRLVQGHRVRHMIESIMLTTEKLVETYEDKDGAWDDEIAALGGQTATGTNVFSEFYDRLKEIREYHKRHPSGRLVDANEDYEARLKEEPIIAFSGEEGNGRYLDLHDMYNQYINSKFGERVEYSAYLDVFSQPEKIPRKLKLSRQYMKYMEALLEYLVYFFQRTEPLQDLDRILSKVCSDFEEQYADGIVEGLDNELIPSQHTVIDLDYYSTVEELVDVGPEKLKEALGALGLKVGGTPQQRAERLFLTKHTPLEKLDKKHFARPPHNGKQNGDAKSTHESENAKEIALTEAKVKKLCNLLDETIERTKQNIVKKQSLTYEEMEGEREGEEANTELESDDEDGLIYNPLKLPIGWDGKPIPYWLYKLHGLGQEFKCEICGNYSYWGRRAFERHFKEWRHQHGMRCLGIPNTKNFNEITSIEEAKELWKRIQERQGVNKWRPELEEEYEDREVQRPHSMTSVKLSSASAFQLRRLTYPPLDLKFNHLTATDEIPKNMTVGIEPLAPPPLHKQRSLPIFVTIAETLYEREISRLRNKKSKNHWESDHGDESKRAPLVDGLKIQNKNGAVKSRRALGDIGNLVSVPGVQGGKAQPPINRPITRSFRAQLLANAQLERKPINGDNKVPALGPKRQPLAARNPEAQRAVQKKNLVVKQQTKPVEVIETKKEVTKKEVAMSPKNKKVTYSSVLSARSKAACGIVNKPKIIDIDESDKDNHLAAVEYVDDMYSFYKEVEKESQPKMYMHIQTEMNEKMRAILIDWLLEVHIKFELNLETLYLTVNIIDRFLSVKAVPKRELQLVGISALLIASKYEEIWPPQVNDLVYVTDNAYSSRQILVMEKAILGNLEWYLTVPTQYVFLVRFIKASMSDPEMENMVHFLAELGMMHYDTLTFCPSMLAASAVYTARCSLNKSPAWTDTLQFHTGYTESEIMDCSKLLAFLHSRCGESRLRAVYKKYSKAENGGVAMVSPAKSLLSAAADWKKPVSS

SEQ ID NO: 63000 - protein, 273 aa, Listeria innocua Clip11262
MEKYVVIGNPIRHSLSPAMQNRIFQELGMNAEYNSVLIEEDTFETEIKKLMDSGVRGFNITTPFKERILPFLDELEDLAAASGAVNTVLRKDGKWYGFNTDGKGYLEGLEEIRSITKDDSILITGAGGASKAIYLALKSHTEAKITVANRTTEKAIEMTKDNDNHHAMTLEQAEKELADFTIIIQTTSIGLEASKNKSPISLSNLTKGTICSDIIYNPAETAFLKEAKKNGAITQNGLPMFVNQGALAFEIWTGIKPERSMMKEAVLEQLGGN

SEQ ID NO: 63001 - protein, 534 aa, Methanothermobacter thermautotrophicus str. Delta H
MLCLGIEGTAEKTGVGIVDEAGNVLSLRGKPLIPEKGGIHPREAAEHHAKWIPRLIAEACRDAGVELGEIGLISFSRGPGLGPALRTVATAARTLALSLDVPIVGVNHCIGHIEIGRLTTGASDPVSLYVSGGNTQVIAFNEGRYRVFGETLDIAVGNMLDQFARESGLGHPGGPVIEQLALKASEYIELPYSVKGMDISFSGLLTAALRKMEAGASLEDLAYSIQETAFSMLVEVTERALAYTEKNQVLLCGGVAVNRRLRDMLREMCQEHHVEFHMPPPEYCGDNGAMIAWLGQLVYKYRGPDALEDTTVVQRYRTDEVDVPWMRESEAGIELPPDILAKGAEANIYRGQWIGRPCIIKERISKGYRIPEIDQKLRSSRTRREARLINQAKGAGVHTPVLFDVDPDGGVMVMEEVRGTPFRDAVEDTELCSRIGEAIGRLHHAGIIHGDLTGSNIIIRGGDVVFIDFGLGRFSDEIEDMGVDLLVLKKSLESTHYALAGECFSRVLEGYGKIIDADIQSKIREIESRGRYTD

SEQ ID NO: 63002 - protein, 882 aa, Desulfitobacterium hafniense DCB-2
MSKKFVYLFREGQASMRDLLGGKGANLAEMTNIGLPVPPGFTITTEACNDYYALGRNLPEGLWEQIGPALGDIEKATGKKFGDKDNPLLVSVRSGAKFSMPGMMDTILNLGLNDETVEGLAASTQNARFAYDSYRRFIQMFGDVVLEVEHHEFERILEEAKEKQNVNYDSELTAESLKGVVEGYKRLIQRRTGSPFPLEPMKQLEQAILAVFRSWNNDRAIVYRRINSIPDNIGTAVNVQSMVFGNMGNDSGTGVAFTRNPSTGERVLYGEYLMNAQGEDVVAGIRTPQPIKSLEDENQAIYAQFVKTSNSLEAHYRDMQDIEFTIERGRLYILQTRNGKRTAPAAIRVAVELCREGVISKEEAIARIEPGQLDQLLHRRMDSEAKLEVIAKGLPASPGAASGKIVFDADEAERLGHTGEKVLLVRTETTPDDIHGILAAQGILTSRGGMTSHAAVVARHMGKPAVCGCEALRIDYAHNTVTIDGVTYPEGTLFSIDGTTGRVIKGAVPMIDPELSEEFKELLGWADEIRTLKVLANADNPRDAQKARDFGAQGIGLCRTEHMFMDPARIPIVQEMILAQTLPEREVALAKLLPMQEEDFYGILKVMAGFPVTIRLLDPPLHEFLPNVEELVVDITKLKLQGDREEELNEKEVLLRKVRALSEMNPMLGHRGCRLGITFPEIYAMQARAIFQAAARLVKEGYEIYPEVMIPLVIHVKELAKLRKVTEEAAQTVMAEQGVTFAYTIGTMIEVPRAALTADEVATAADFFSFGTNDLTQTTLGFSRDDAEGKFLPAYLEQNILEHNPFAVLDRIGVGKLMKMGVQLGREANPGLKVGICGEHGGDPSSIEFCHQIGLNYVSCSPFRVPIACLAAAQAAVSSKGQ

SEQ ID NO: 63003 - protein, 329 aa, Oryza sativa (japonica cultivar-group)
MIQLKDMVMKLSGTSRHHGQQRRGGSPPPRGRTTSVYRSGYYRPGMVQDDMAVPPATYLGGGGTSMSSASSTPAWDFARPAEGEAREWVAQVEPGVQITFVSLAGGGGNDLKRIRFSREMYDKWQAQKWWGENNERIMELYNVRRFSRQVLPTPPRSDDGERESFYSQVGSTRGSPAATPSPAPLTPDRVTSWSAFVRPPSASRQQQQHSFRPLSPPPPSSSNPSERAWQQQQQPQRAGKSPAAASDAMDAARTTSCSSRDEVSISNASELEVTEWVIQDEPGVYITVRELADGTRELRRVRFSRERFAELNAKLWWEENKERIQAQYL

SEQ ID NO: 63004 - protein, 487 aa, Burkholderia sp. 383
MTIKHWIGGREVESRETFTTLNPATGDVITDVASGGEAEVDAAVRAAKEAFPKWASTPAKERAKLMRKLGELIEKNVPNLAALETQDTGLPIAQTSKQLIPRASENFNFFAEVCVQMNGRTYPVDDQMLNYTLYQPVGVCALVSPWNVPFMTATWKTAPCLALGNTAVLKMSELSPLTADQLGRLALEAGIPPGVLNVVQGYGATAGDALVRHPDVRAVSFTGGTVTGKRIMERAGLKKYSMELGGKSPVLIFDDADFDRALDASLFTIFSINGERCTAGSRIFVQRTIYDRFVQEFARRANNLIVGDPSDPATNLGAMITRQHWEKVTGYIRIGEQEGARVVAGGADKPAGLPDHLRNGNFVRPTVLADVDNRMRVAQEEIFGPVACIIPFEDEDDGLRLANDTAYGLASYIWTQDVGKVHRLARGIEAGMVFVNSQNVRDLRQPFGGVKESGTGREGGEYSFEVFAEIKNVCISMGSHHIPRWGV

SEQ ID NO: 63005 - protein, 375 aa, Pseudomonas putida KT2440
MAEAKVLSGAGLRGQVAGQTALSTVGQAGAGLTYRGYDVRDLAAGAEFEEVAYLLLYGELPTQAELADYKRKLKGLRDLPQALKEVLERIPRDAHPMDVMRTGCSVLGTLEPELTFEAQRDKTDRLLALFPAVMCYWYRFTHHGVRIDCTTDEDTLGGHFLHLLHGKKPSELHVKVMNVSLILYAEHEFNASTFTARVCASTLSDLYSCVTAAIGSLRGPLHGGANEAAMELIERFQSPQEATAELLRMLERKDKIMGFGHAIYKESDPRNEVIKGWSKQLADEVGDKVLYPVSEAIDKTMWEQKRLFPNADFYHASAYHFMGIPTKLFTPIFVCSRLTGWAAHVFEQRANNRIIRPSAEYVGVEQRQFVPIEQR

SEQ ID NO: 63006 - protein, 811 aa, Oryza sativa (japonica cultivar-group)
MASLPHCLSARPLVVAAAPGRPGPGPGPWLPGGARRRNSAFSAGNPGRRVGFRRSVASAVEVGVGEDEEEGVEEEEEEVEAVVMPERYALGGACRVLAGMPAPLGATALDGGVNFAVYSAGASAASLCLFTPDDLEADEVTEEVPLDPLFNRTGNVWHVFIEGELHNMLYGYRFDGMFAPHCGQYFDVSNVVVDPYAKAVISRGEYGVPGPGGDCWPQMAGMIPLPYSTFDWQGDLPLRYPQKDLVIYEMHLRGFTKHSSSNVEHPGTYIGAISKLDYLKELGVNCVELMPCHEFNELEYFSCSSKMNFWGCSTINFFSPMIRYSSGGIRNCGRDAINEFKTFVREAHKRGIEVIMDVVFNHTAEGNEKGPILSFRGIDYSTYYMLAPKGEFYNYSGCGNTFNCNHPVVREFIVDCLRYWVTEMHVDGFRFDLASIMTRGCSLWDPVNVYGSPVEGDMTTTGTPLATPPLIDMISNDPILGDVKLIAEAWDAGGLYQVGQFPHWKIWSEWNGKYRDIVRQFIKGTDGFAGGFAECLCGSPHLYQAGGRKPWHSINFVCAHDGFTLADLVTYNKKYNSSNGEDNRDGENHNLSWNCGEEGEFAGLSVKRLRKRQMRNFFVSLMVSQGVPMFYMGDEYGHTKGGNNNTYCHDHYVNYFRWDKKEESSDLQRFCSLMTKFRKQCESLGLADFPTAQRLHWHGHQPGKPDWSETSRFVAFSTKDETKGEIYVAFNASHLPAVVGLPERPGYRWEPLVDTGKPAPYDFLTDDLPDRATPSTCSLISSTPISTPCSATPPSSLNCSLMIERTKYSIV

SEQ ID NO: 63007 - protein, 112 aa, Zea mays
AQGYTNQQQGKFSHSTLFYAGNIWLPATGGKGLCKDGSNRHRKVLRDNIQGITKPAIRRLARRGGVKRISGLIYEETRGVLKIFLENVIRDAFTYTEHARRKTVTAMDVFYA

SEQ ID NO: 63008 - protein, 297 aa, Brassica napus
GHASFAEKMVKSTANEIFPDEKICDLLISGWCAAEKLDEATRFAGEMARGGFEIGTLAYNVILDCVCKLCRKKDPFRLQSEVEKVLLEMETRGVPRNTKTFNVLINNLSKIRRTEEAMELFGRMSEWGCQPDAETYLVLIRSLYQAARIGEGDEMIDKMKSAGYGKALDKKEYYGFLKILCGIERLEHAMSVFKNMKADGCKPGIKTYDLLMGKMCANNQLTRANGLYKEAARRGVAVSPKEYRVDPRFLKKKSKEVDSNVKKRETLPEKTARKRRRLKQINMSFVKKPHNKMRRRM

SEQ ID NO: 63009 - protein, 394 aa, Thermoanaerobacter tengcongensis MB4
MKKKTVRDIDVSGKRVLVRVDFNVPMDENKNITDDRRIREALPTIEYLINHNAKVILVSHLGRPKGKFNPDYSLKPVAKRLSELLKKPVIMAEDVIGEDAKVKAAALKEGEVLLLENVRFHAEEEKNDPEFAKELASLADIYVNDAFGTAHRAHASTAGVAKYLPAVAGFLIEKELSIMGEALENPKRPFVAILGGAKVSDKIGVITNLLEKVDSLLIGGGMAYTFIKAKGYEIGKSLLEEDKIELAKEIMEKAKQKGVNFMLPVDTVIAKELKSGVPYEVVDIDKMPEDQIGVDIGPKTIEEYSKVIKHAMTVVWNGPMGVFEIPEFAKGTKAIAKALSECKGTTIVGGGDSAAAIEQLGYADKVTHISTGGGASLEFLEGKVLPGIDILNDK

SEQ ID NO: 63010 - protein, 335 aa, Thermoanaerobacter tengcongensis MB4
MGVRVGINGFGRIGRNVFRAALKKNADLEFVAVNDLTDAKTLAHLLKYDSVLGKFEGEVSYTDDSLIVNGKEIKIFKETDPGKLPWGDLGVDIVIESTGRFTNKEDAIKHIHGGAKKVIITAPAKNEDVTIVMGVNEHMYDPANHHVISNASCTTNCLAPIAKVLNDKFRIKKGMMTTVHSYTNDQRILDLPHSDLRRARAAAVSIIPTTTGAAKAIHLVIPELKGKMNGFAMRVPTPNVSVVDLVAEVEIPTTVEEVNAAMKEASETYMKGILGYSEDPLVSVDYKGDDRSSIVDAPLTMVVEGTLVKVVSWYDNEWGYSNRVVDLALYIAERM

SEQ ID NO: 63011 - protein, 528 aa, Triticum aestivum
MATEGLRMLLADAARSPWSLAGAAAAVALLWFAAWVLEWAWWTPRRLGRALRAQGIRGTRYRLFTGDIPENARCNAVARSRPMPRGDHDIAPRVLPMFSNAIKEHGKVSFTWFGPTPRVMIPDPELVREILSNKFGHFGKQRSTRIGKLLANGLANHEGEKWAKHRRILNPAFHHEKIKRMLPVFSACCEEMITRWENSMSADGSCEIDFCPEFQNLTGDVISRTAFGSNFQEGMKIFQLQGEMGERLIQAFRTFFIPGYWFFPTKNNRRMRAIDREIRMILRGIIGKKERAIKNGEASSDDLLGLLLESNMQQSNGKAKLGLSIEDIIQECKLFYFAGMETTSVLLTWTLIVLSMHPEWQEQAREEVLHHFGRTTPDFENLGRLKIVTMIFYEVLRLYPPITFLTRRTYKAMELGGIKYPAGVNLMLPILFIHHDPDIWGKDAREFNPQRFADGISNAAKHPAAFFPFGGGPRICIGQNFALLEAKMALSIILQRFSFELSPSYVHAPYTVITLQPQHGAQIRLKKI

SEQ ID NO: 63012 - protein, 527 aa, Streptococcus thermophilus CNRZ1066
MQKERVIMTNISTLNDVQKIIVLDYGSQYNQLIARRIREFGVFSELKSHKITADEVRAINPIGIILSGGPNSVYAEDAFGIDEEIFELGIPILGICYGMQLLTHKLGGKVVPAGEAGNREYGQSTLRLRAQSELFAGTPEEQVVLMSHGDAVTEIPEGFHLVADSVDCPFAAMEDTKKNFYGIQFHPEVRHTVYGNDILKNFAFSICGAKGDWSMANFVDMQIAQIRETVGDRKVLLGLSGGVDSSVVGVLLQKAIGDQLTCIFVDHGLLRKGEGDQVMEMLGGKFGLNIIRVDASKRFLDLLAGVDDPDKKRKIIGNEFVHVFDDEASKLKGVDFLAQGTLYTDIIESGTETAQTIKSHHNVGGLPEDMQFELIEPLNTLFKDEVRALGTELGMPDEVVWRQPFPGPGLAIRIMGEITEEKLETVRESDAILREEIAKAGLDRDVWQYFTVNTGVRSVGVMGDGRTYDYTIAIRAITSIDGMTADFAKLPWEVLQKISVRIVNEVDHVNRIVYDITSKPPATVEWE

SEQ ID NO: 63013 - protein, 392 aa, Stigmaphyllon puberum
DLEPVNPVDVPVTAAGALKSYKLAAKAISRLQSLPSGNISLLCDVLVKEVRDLTGYDRVVVYKFHEDEHGEVVSECRISDLESYLGLHYPATDIPQASRFLFMKNKVRMICDCLAPPVKVIQDERLPQPLSFCGSTLRSPHGCHAQYMTNMGTIASLVMSVTINEDDDTMDGDQQQMTRKLWGLVVCHHNSPQFVPFPLRYACEFLIQVFGVQINKEVELAAQVREKHILQIQTMLCDMLLRDAPVAIITQSPNVMDLVKCDGAALYFKNKIWLLGVTPSKEQIRDIAQWLLEYHSGNTGLSTDSLMEAGYPGASALGDAVCGMAAVSITSRDFLFWFRSHTAKAVKWGGAKHDPDDKDDLRKMHPRSSFKAFLEVVKWRSMPWEDVEMDAI

SEQ ID NO: 63014 - protein, 512 aa, Rhizobium leguminosarum bv. viciae 3841
MTIAVLDLATETAKLLAELGVDASRYHGGTLSVTSPVTGKEIGKLREHSVSETKAAIEAAHRAFLEWRAVPAPKRGELVRLLGEELRASKAALGRLVSIEVGKITSEGLGEVQEMIDICDFAVGLSRQLYGLTIATERSEHRMMESWHPLGVIGIISAFNFPVAVWSWNAALAMVCGNSTVWKPSEKTPLTALAVQALFEKALKRFVAEGGTAPANLSTLIIGGREVGEVLVDHPKIPLVSATGSTAMGRAVGPRLSQRFARAILELGGNNAAIVCPSADLDLTLRGVAFSAMGTAGQRCTTLRRLFVHESVYDQLVPRLQKAYGSVTIGNPLETGTLVGPLIDGQAFKNMQAALGEAKSAGGTVTGGDRVETGSTEAFYVRPALVEMPDQTGPVEHETFAPILYVMKYSDFDEVLALHNAVPQGLSSSIFTNDMREAETFVSARGSDCGIANVNLGPSGAEIGGAFGGEKETGGGRESGSDAWKAYMRRSTNTINYGRTLPLAQGVKFDVE

SEQ ID NO: 63015 - protein, 632 aa, Triticum aestivum
MSKLLAIALLLLPLINQGIYLATAWDDQDFFKYCPPSQCSQDGPEVRFPFCLESSNTSAAAAASCGCAGRSIRKLACSGRDTILFHPVLGPYNVSAIDYGRSSMKLIPLVDPCFVLQQKLVISRSSSSPQADVINYEMPSLYLRNSSLVRCLREFAPGAADEIAGPVSCLSNTTNFFYLVNGYEDMSILPLDCKVVPLSDGVGGGLIPMYEFDDPIVSFKERTERMLSFAETTVYWYGSYCARCEGSGRRCAFSSQRNRTFCMPGPHGSRIKVIAATSSVAAFVVLLLTVATVLYLSLKTRYNAEIHMKVEMFLKTYGTSKPTRYTFSEVKKMARRFKEKVGQGGFGSVYKGKLQNGVPVAVKMLENSTGEGEAFINEVATIGLIHHANIVRLLGFCSEGMRRALIYEFMPNESLEKYIFSDDSNIFQNLLVPDKLLDIALGIARGMEYLHQGCNQRILHFDIKPHNILLDYNFNPKISDFGLAKLCARDQSIVTLTAARGTMGYIAPELYSRNFGGVSYKSDVYSFGMLVLEMVSGRRNSDPRIGSQDDVYLPEWIYEKVINGEELALTLETTQEEKEKVRQLAMVALWCIQWNPRNRPSMTKVVNMLTGRLQSLQMPPKPFVSYENEPMP

SEQ ID NO: 63016 - protein, 489 aa, Bordetella bronchiseptica RB50
MTQLTQPLSRAELLRDACYIDGKWVGAGNGPSIPVDNPSTGKTIISVPKLGRKEAEQAIDAAEAALPAWSARTGKERAAILLKWAQLMMENQQDLAVIMTSEQGKPVAEAAGEIAYAASFLEWFAEEAKRIDGDILQSPKGGQRLMVLKQPIGVTAAITPWNFPAAMITRKVGPALAAGCTMVVKPAQQTPLTALALAVLAEQAGVPAGVFQVVTGSSREIGAALCESEVVRKLSFTGSTEVGRTLMEQCAPTIKKLSLELGGNAPFIVFDDADLDRAIDGILASKYRNAGQTCVCANRIYVQAGVYEEVAKRLVEKVNAMKVGDGFEQGVTQGPLIDTAAVAKVQEHIADATAHGAKVIAGGQPHALGGSFFQPTVVRDVTQSMRFAVEETFGPVAPLFKFESEDEVIGMANNTIFGLAAYFYTRDYARIWRVSEALEYGIVGINTGIISNEVGPFGGVKQSGLGREGSKYGIEDYLELKYLCVDLGA

SEQ ID NO: 63017 - protein, 162 aa, Triticum aestivum
  misc_feature (58)..(58): Xaa can be any naturally occurring amino acid
  misc_feature (78)..(78): Xaa can be any naturally occurring amino acid
  misc_feature (81)..(81): Xaa can be any naturally occurring amino acid
  misc_feature (94)..(94): Xaa can be any naturally occurring amino acid
  misc_feature (100)..(101): Xaa can be any naturally occurring amino acid
  misc_feature (124)..(124): Xaa can be any naturally occurring amino acid
  misc_feature (136)..(137): Xaa can be any naturally occurring amino acid
  misc_feature (141)..(141): Xaa can be any naturally occurring amino acid
MAPTVMASSATSVAPFQGLKSTAGLPISRRSSSAGLSSVSNGGRIRCMQVWPIEGIKXFETLSYLPPLSTGGLLKQVXDYXIRSKWVPCLRFSXVGFVLXXEHNTPPGYYDVHTGKCWELPMFXGCTDAHKCQQVXXVKKXYLTLFPLIFTAPSACLRLHRF

SEQ ID NO: 63018 - protein, 392 aa, Mascagnia dipholiphylla
DLEPVNPADVPVTAAGALKSYKLAAKAISRLQSLPSGNISLLCDVLVKEVRDLTGYDRVMVYKFHEDEHGEVVSECRRSDWESYLGLHYPATDIPQASRFLFMKNKVRMICDCLAPPVKVIQDERLPQPLSLCGSTLRSPHGCHAQYMTNMGTIASLVMSVTINEDDDMMDGDQQQMTRKLWGLVVCHHAGPRFVPFPLRYACEFLIQVFGVQIHKEVELAAQVREKHILQIQTMLCDMLLRDAPVVIITQSPNVMGLVKCDGAALYFKNKIWLLGVTPAEEQIRDIAEWLLKYHSGNTGLSTDSLMEAGYPGASVLGDAVCGMAAVSITSRDFLFRFRSHTAKEIKWGGAKHDPDDKDDGRKMHPRSSFKAFLEVVKWRSTPWEDIEMDAI

SEQ ID NO: 63019 - protein, 421 aa, Bordetella bronchiseptica RB50
MKNRDLNTRRTLATPRGVGVMCDFYAVRAENSTLWDAEGKEYIDFAGGIAVLNTGHRHPKVKAAIAAQLDNFTHTAYQIVPYEGYVSLAERINAVAPIEGLKKTAFFTTGVEAVENAVKIARAYTGRSGVVAFSGAFHGRTMMGMALTGKVAPYKLAFGPMPGDVFHVPFPNATQAISVADSLKALDLLFKVDIDPKRVAAIIIEPVQGEGGFNVTPPELMQALRKVCDEHGILLIADEVQTGFARTGKLFAMQHHSVQADLITMAKSLGGGMPISGVVGRAEVMDGPAAGGLGGTYAGNPLAVAAAHAVLDVIAEEKLCERAAELGKRLMDRLEGLRAKCPAIADVRGLGSMVALELNDPATGKPDAEAVKRIQQQAIERGLILLSCGVYGNVLRFLYPLTIPDDQFARALDILAETIAA

SEQ ID NO: 63020 - protein, 649 aa, Triticum aestivum
MSKLLVIALLLLPLINQGIYLATAWDDQDFFKYCPPSQCSQDGPEVRFPFCLESSNTSAAATASCGCAGRSTRKLACSGRDTILFHPVLGPYNVSAIDYGRSSMKLIPLVDPCFVLQQKPVISRSSSSPQADVINYEMPGLYRWNSILVRCSREFAPGAADGIAGPVSCLSNTTNFFYLVNGYEDMSILPLDCKVVPLSDGVGGGLIPMYIFDKPMSDTLPVSFKESTERLLSFAEMTVYWYGYTCRQCEVYWYGYTCRQCERSGGRCAFSSQRDRQFCMPGPHGSRIKVIAATSSVAAFVVLLLTVATVLYLSLKTRYNAEIHMKVEMFLKTYGTSKPTRYTFSEVKKMARRFKEKVGQGGFGSVYKGELPNGVPVAVKMLENSTGEGESFINEVATIGLIHHANIVRLLGFCSEGMRRALIYEFMPNESLEKYIFSDDSNIFQNLLVPEKLLDIALGIARGMEYLHQGCNQRILHFDIKPHNILLDYNFNPKISDFGLAKLCARDQSIVTLTAARGTMGYIAPELYSRNFGGVSYKSDVYSFGMLVLEMVSGRRNSDPRIGSQDDVYLPEWIYEKVINGEELALTLETTQEEKDKVSQLAMVALWCIQWNPSNRPSMTKVVNMLTGRLQSLQMPPKPFVSYENEPMP

SEQ ID NO: 63021 - protein, 825 aa, Hordeum vulgare subsp. vulgare
MAFSPRSPWSRSKKPDIYSTVVVHDDEDDAHGGGAARAEDDDDDDPSALPPLLQRLPKDFGGASFDDDDDPYSSDLDDASLSATVVIKRGAPASTSSSSRSPFLDLRRSSPRAAEADPYSTFVVHGTARSGGASSPRESVSGTFIRHSGGPPSPRESVSGTFIRHTRGSSSPRESYSGTFIHHTSGASSPRDPASGAGAGFGSSFMTPSTGQAEEDRQPSLLMQQQQSRRQASMSSVPDSVTREDPSTKYELLHELGKGSYGAVYKARDLRTQELVAVKIISLTEGEEGYEDIRGEIEMLQQCSHPNVVRYFGSYQGEEYLWIVMEYCGGGSVADLIGITEEPLDEPQIAYICRETLKGLAYLHTIFKVHRDIKGGNILLTEQGEVKLGDFGVAAQLTRTMSKRNTFIGTPHWMAPEVIQESRYDGKVDVWALGVSAIEMAEGMPPRSTVHPMRVIFMISSEPAPMLEDKEKWSLLFHDFIAKCLTKDARLRPAAIEMLKHKFIEKCNTGASKMLAKIKEAKIIRETAVQNQLPDSDDAMDATVRINEDYGETVPTNSQSTHETKNDGSGGDFGTMIVHPEDGDEAVESSIFPRAEFIPGLGSINSFTHDPKRAELISKFWAENTADSDATKGRDLDGLPDTQEPKAMPRSIGTFKHHKGVEGTVLRHDNTASPGVASTMTKLSSSPSRKAFSVQDKLWSIYAAGNTVPIPFLKAIDISPLALVSDSVAGNGPAGSSTTDALEAVRELFSGDGQAKKGRKGQNEVPLPPGVHDRLTTSPTLMNLAQALAYHKTCYEDMPLQDSQATEEQQTIQNLCDTLRTILRL

SEQ ID NO: 63022 - protein, 263 aa, Oryza sativa (japonica cultivar-group)
MASSSSWWVVMLLMVVAAAGWGGVAAATAAEAAHEVLRAHGLPRGLLPAGIADFRHDEGSGRFEAALGESCTAQFEVGLRYNATVAGVISYGRIASLSGVSAQDLFLWFPVRGIRVDVPSSGVIYFDVGVVFKHFPLAVFEAPPPCTPDPLLLLTQLVTNELVGGKGQDSMFRIALGSELVKLHRNSERQRGGEDQASDCVFCITGEGEMGGLEEQRHVLWGKANDGKETSVSTAAPSCSCRVGGVGDDHPRLGGSGMPARGK

SEQ ID NO: 63023 - protein, 1063 aa, Moorella thermoacetica ATCC 39073
MVIGSGPIIIGQAAEFDYAGTQACRALKEEGMEVVLVNSNPATIMTDRDMADRVYLEPLTLDFVAKIVRQERPDGLIPTLGGQMGLNLAMELAEAGVLEETGVELLGTPLTAIQRAEDREQFKEMMLAIDEPVPESRIVNRVEEALEFAREIGYPVIVRPAYTLGGTGGGVAHNEAELRSIALKGLKLSLIQQVLVERSVAGWKEIEYEVIRDSNDNCITVCNMENIDPVGIHTGDSIVVAPSQTLSDREYHLLRRSALKIIRALGIEGGCNVQFALDPGSMRYYVIEVNPRVSRSSALASKATGYPIARVATKIALGLTLDEIPNAVTRETKACFEPALDYVVVKIPRFPFDKFSLAERILGTQMKATGEVMAIDRTFSGALLKAVRSLELKLDGLKVAAFQRFSDSALRRKMAEADDERLFVVAEALRRGWTIASIHEITGIDPYFLGEIEAIVAMEEKLVAAGPALDAATLKRAKAMGFSDGEIANFTGLPPADITRLRQEEGIRPTFKMVDTCAAEFEAVTPYYYSCYDVEDEVHPLEGRKVAVLGAGPIRIGQGIEFDYCSVHAAWALRRAGVHPIMINNNPETVSTDFDTSDRLYFEPLTPENVLNVLEKEQPEGVIVQFGGQTAINLAQTVAGAGFPVLGTAVVDIDRAEDREKFDALLNELGIPRPRGGTATSVGEVVKIAKELGFPVLVRPSYVLGGRAMEIVHSEGELLEYATTAVRVAPEHPVLVDKYLPGTEVEVDAVSDGETVLIPGIMEHVERAGVHSGDSIAIYPAHSLPPGVTEKIVAYTEQLARALRVRGLLNIQFVIHRGEVYVLEVNPRSSRTVPYLSKITGVPMVALATNVMLGKSLPEQGYRGGLMPPPDFTAVKVPVFSFGKLLQVDTSLGPEMKSTGEVMGIDPVFERALYKGLVAAGCSIPHHGTLLATIADKDKAEAVPIIKGFAELGFQVVATAGTAGALAAAGLFVERVGKIREGSPHIIDYIREGKVHFVLNTLTRGKMPGRDGFKIRRAAAELGIPCLTSLDTARALLKVLQSLKSGDGFNLKPLQEYVPLSRP

SEQ ID NO: 63024 - protein, 255 aa, Prosthecochloris aestuarii DSM 271
MSYTLITGASTGIGKAFALEFARCGHNLVLVARTKGRLEELASEIRRCNPVNVRICIMDFSDPASAEQVYRFCRKHALEVDVLVNCAGFGYAGGFDSMPLSAIEEMMQVNMLALAKLTRLFVQHMVAGGVGSVINIASMGGFQGVAFIGLYAATKSFIITLGEALHEEFRDKGIRVVTVCPGYIKTDFHARSGQNPSLSMLPVYDTSVVVRASIKGLAKNRVLVFPTLLDFLLVFLQRFTPRQIVLKIAAFLAPL

SEQ ID NO: 63025 - protein, 422 aa, Oryza sativa (japonica cultivar-group)
MVEGPKFAGMMGGVVGGAGGHDDIGGNFCDMAYYRKLGESSNMSIDSLNSLQTSTHGGGSVAMSVDNSSVGSSDSHTRMLNHPGLRGHVAANYSVGHSIFRPGRVSHALSEDALARALMDPRYPTETLKDYEEWTIDLGKLHMGMPFAQGAFGKLYKGTYNGEDVAIKLLERPEADPERAGLMEQQFVQEVMMLATLRHPNIVKFIGACRKPMVWCIVTEYAKGGSVRQFLMKRQNRSVPLKLAVKQALDVARGMAYVHALGFIHRDLKSDNLLISGDKSIKIADFGVARIEVKTEGMTPETGTYRWMAPEMIQHRPYDQKVDVYSFGIVLWELITGMLPFANMTAVQAAFAVVNKGVRPAIPQDCLPVLSEIMTRCWDPNPDVRPPFTEVVRMLEHAEVVILSTVRKARFRCCISQPMTTD

SEQ ID NO: 63026 - protein, 437 aa, Prosthecochloris aestuarii DSM 271
MPLITNVIARQILDSRGNPTVEVDVLTESSFGRAAVPSGASTGIHEAVELRDGDREVYLGKGVLKAVENVNTVINDALEGMLVTEQTEIDKLLLSLDGTPNKSKLGANALLGVSLACAKAAAEYSGLPLFRYIGGTLANTLPVPMMNVLNGGAHADNNVDFQEFMIMPIGFSSYSDALRCGAEVFHALKALLKSKGLSTAVGDEGGFAPDLASNEEAIELVIEAVGKAGYKAGSPTNAGGLGDAHVMIALDPASSEFYDTDKKKYIFKKSSGQELDSAEMASYWENWAGKYPIISIEDGMAEDDWEGWKILTDKIGSRVQLVGDDLFVTNSIRLADGIERKVGNSILIKVNQIGTLTETLQAIDLAKRNGYTSVISHRSGETEDSTIAQIAVATNAGQIKTGSLSRSDRMAKYNELLRIEEELGDEACYPGIRAFRV

SEQ ID NO: 63027 - protein, 573 aa, Ustilago maydis 521
MTQPSSKFSIPLGPYTIYDPNTGIYASRLPPPQAASKTVFDFCLGSVSFDDAGTAITDCSTGRSISYGELRLQSQRFGLGLITKAQLKPGDTILVALHSSIDFAVSVMAAQFAGLRVALANPDYARKELRHVYRLVKPKKVIMHSTYLGRAAAANVKTFTVILTDTKLGRGGVLSIGELLADEALAKAAKPFLPDDLNTTAYLPSSSGTTGLPKAVEISHRNVVSMLSMNLNTPGFVPDELKGEQMRMLTFLPFFHAYGLVGQLHLILALRGQLFILRPFTAQAFCDAVPAHKINMLNFVPPALTKLIKHAGIDRNVFATVKRARCGAAPLDAETEAKFAELTGVQVKQGWGMTELTLAGLDPSSGQQKAGSVGCLIAGTLAKVVDVSSGEPVQTGQRGELLIKGDQVFRGYLANPQETEAAFTADGFFRTGDVVIVDPHTGEFTVVDRLKELIKYQGFQVAPAELEGVLVTHPKIAAAAVVGRLDQSKATELPCAFVQLSDQAKQHAASSTDDLAKEIDQYVRSKVSHHKFLRGGIHFVDQIPVSASGKILRKDVRALLETLPQLSSPRANL

SEQ ID NO: 63028 - protein, 493 aa, Kluyveromyces lactis NRRL Y-1140
MLRFNSTRSFSSSALLKTVTKKHDLVVIGGGPGGYVAAIKAAQLGYDVACVEKRGRLGGTCLNVGCIPSKALLNNSHLYHQMKTDAKQRGIDINGEININVAQFQKAKDTVVKQLTGGIEMLFKKNGVTYYKGLGAFETDKSVKVLPVEGLEGSVTEDHLLESDRIIVATGSEVTPFPGITIDEERIVSSTGALSLKEIPKKLAIIGGGIIGLEMGSVYSRLGSKVTVIEFQPQIGATMDGEVAQTTQKILKKQGLDFKLSTKVLSASRNGDVVDIEVEGAKNGKKESLQADVLLVAVGRRPYVAGLNAEKIGLEVDKRGRLVIDEQLSTKFPHVKVIGDVTFGPMLAHKAEEEGIAAAEYFKVGHGHVNYGNIPAVMYSHPEVAWVGKTEEQLKEAGIQYKIGKFPFIANSRAKTNMDTEGFVKILIDAESERLLGAHIIGPNAGEMIAEAGLALEYGASAEDIARVCHAHPTLSEAFKEANLAAYAKPINF

SEQ ID NO: 63029 - protein, 217 aa, Thermus thermophilus HB27
MLKSVLKAVLFDLDGTLADTDPLHLLAWREVLAPYGLKVDPAFYRERISGRLNPEIVRDLLGLEGKEAERLIAAKEARFRALAQGLRPTPGLPEFLERIREKGLLWGVVTNAPKENARHVLEALGLRPPLLVLAEEVGRGKPDPLPYQLALRRLGVAPEEALAFEDSPSGVRSAVGAGIPTYGLLTGHEAEALIREGASGVIRNFTEFAWPEYTSEK

SEQ ID NO: 63030 - protein, 920 aa, Ustilago maydis 521
MDPKPQPILSPTESSTAASASVAFTSGTFQPTAQAQVSQPLSLVPTDQQDTLPPTSTSTEAANHSMQASVSTTSAAAPPSAVLHRSDATPPQATPDQNKTTLQYLTTSQPTQSEQTSAPMDVADHSSTTPVASAVDGASTTAPGQPDLVAPANETTQAAPTLTQAVAAVSPNTSQYPAPATRPASPAAPLPTSEPKDPPPALEPSSAPAPPAADPLTSESVTTKTANSVISDNKTSTETATAPAPEPTKPSQTQESAHETSVSISHPSASATQPTATTAATASIESASTNANAATDSAPQLQPQATAPAPSDEAAAKDHGKSDHVLSPKQDQVDPSKATASDQPKGVASAAKEQAAPSPLSVENVDAAPAVKAVPPTQAATASAPASAPATPERRSPVVGTSVGGTSVGQSGESVPTTPARESRVALILRINKELIRLCVDLQSKDLTMDPIYREAAVRLQANLGYLASIADQAGKSVDPSGRAPTSGALPRLEPFPRSEHAPSSPIPALFDKLIALFSAACPSSSPLPDGRKRSRDSTADLGSDDPRKRAVGKDIDPSQDNSAAATPSYVSNQPLPTDAPTTTASEPVSSSTSAGQQSQQLAASASQAAQHQPHQSSKGPDLSLAPPVPIAPPAAAQNIANNPQAQALIQAFGPNALVNLHALQSHIRGQGTHPWVTFMEANISGYKAMPLQVQLQHMTSLQNAALQRQKAMGSHASTGSTSTVGSPATMPNGAQAGISSPATTQPVSRHSDSPSQALASPSASAYGAAVPGRAGTPLGGGQGAFQTRPGSSGSVGSMTSVGGRNRTGSSNLGFDASQMQSASSPATLGSMGEFAAQQQFGFQPPGLQQASPAASAASPTPQQQQGAAIGMPMSGVPNFQNLPPHLQHQIRQQYMAHMQAQAQAQGVNSHQIGFNPQQQ

SEQ ID NO: 63031 - protein, 303 aa, Pseudomonas syringae pv. syringae B728a
MPTSPVEPTVESILYDELNCWRICHGEAELLVAQQGAHILSYQVAGQQPLVWLNEEAVFKRGKPIRAGMPICWPWFGNLERNPQSVQAMRDSSEPAKAHGEVRALDWQLLGIGADGDALLVEFVLPEAEGHLPGWPHNVALKLSIRLDHALNVSLVSYNCGTEPVVISQALHTYFAVSDVRQVSVEGLDGLRYIETLANWEEREQSGDLTFTGETDRIYKDTPGVLSIVDPEWQRRIHIRSTGSNSAILWNPWIEKTGKFTDMAADGWQRMVCVETANVLDDVVTLAPDQMHVLGVSIWSEAL

SEQ ID NO: 63032 - protein, 292 aa, Xanthomonas campestris pv. vesicatoria str. 85-10
MSEDDSSQSPETPEKRRSWLERLSAAFSGEPHTRDELVALLRTAEQDGLIAADTLRMMEGAISVSELTVGDVMISRSQMVSLPVEARFIDLMKQVVESGHSRFPVHGENKDEVLGILLAKDLLRGVVADNGPGNVRELLRPAVLIPESKKLNVLLKEFRLSRNHMAIVVDEYGGVAGLVTIEDVLEQIVGEIDDEHDDAEEENSLIAIQADGRYVVDALTPIEDFNERFGAEFPDDEYDTVGGLVTDAIGHLPETGEELTLGRFAFRVAKADARRVHAFHVTILPPDPQDDA

SEQ ID NO: 63033 - protein, 115 aa, Bacillus licheniformis ATCC 14580
MQKLIEEITKEQLRTDLPAFRPGDTLRVHVKVVEGNRERIQVFEGVVIKRRGGGISETFTVRKISYGVGVERTFPLHTPKIAKIEVVRHGKVRRAKLYYLRELRGKAARIKEIRR

SEQ ID NO: 63034 - protein, 370 aa, Bradyrhizobium sp. BTAi1
MATHKLLLLPGDGIGPEVMAEVKRLIGWLNGKGLASFETEEGLVGGAAYDAHGASISEADMDKAKAADAIIFGAVGGPKWDGVPYEVRPEAGLLRLRKDLGLFANLRPAVCYPALADASSLKREIVEGLDIMIVRELTGGVYFGEPKTITDLGNGQKRAVDTQVYDTYEIERIARVAFDLARKRRNKVTSMEKRNVMKSGVLWNEVVTAVHNREYKDVTLEHQLADSGGMNLVKYPKMFDVIVTDNLFGDMLSDIAAMLTGSLGMLPSASLGEVDAKTHKRRALYEPVHGSAPDIAGKGLANPIAMLTSFGMALRYSFDLGALADKLDAAIAAVLASGLRTADIKAEGSTPASTAQMGEAIIKELEKLTA

SEQ ID NO: 63035 - protein, 534 aa, Kluyveromyces lactis NRRL Y-1140
MDNIVVSQTSNATQVASEASVKLFSLANAQQLVETVQQMSYFKLFCTLVAIVIVWDQVSYQIQKGNIAGPKWKVWPVIGPFLESFDPKFEEYLAKWNSGPLSCVSIFHKFVVIASTRDLARKIFQSPQYVKPCVVDVAVKILRPSNWVFLDGKEHVDYRKSLNGLFTKQALAKYMPSQELLMDKYIEKFIELSKENKYEARVFFHDMREIMCALSLKAFCGDYITEDQIRKVADDYYLVTAALELVNFPIIIPYTKTWYGKKTADMTMKIFEQCAQMAKDHIAAGGESTCVLDAWCSLMHEAKNKDDADSKLYHREFTNREMSEAIFTFLFASQDASSSLACWIFQIIADRPDVMANIREEQLRVRNNDPNVKLSMDLIDEMKYTNMVVKETLRYRPPVIMVPYYVKKSFPVVPTYSAPKGSMLIPTLYPALHDPEVYEDPDEFIPERWVEGSAANQAKKNWLVFGCGPHVCLGQTYVMQTFTGLIGKFAMFSDWEHKVTPLSEKIKVFATIFPKDDLLLSFKKRDPLTGEVEL

SEQ ID NO: 63036 - protein, 195 aa, Mannheimia haemolytica
MQISRRKFFKVCAGGMAGTSAAMLGFAPATALAAPREYKLLRAKETRQTCTYCAVGCGMIMYSLGGEAMNSKGKLIHIEGDSDHPVSRGALCPKGAGALDYVNSDRRVHYPEVREAGSSEWKRISWHEAIERIARHMKNDRDENFVTHNEAGLEVNRWMTAGFLAGSACSNETGIVTQKFIRSLGMIFTDNQASI

SEQ ID NO: 63037 - protein, 197 aa, Glycine max
DAWADAWADAWADVAEFPGRPTRPYGCEKTTEGHRTSIILSHLRKSIFCLLCVFFLSQSFSMARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 63038 - protein, 295 aa, Staphylococcus pasteuri
VLGVSKSASKDEIKKAYRKLSKKYHPDINKEEGADEKFKEISEAYEVLSDDNKRANYDQFGHDGPQGGFGSQGFGGGDFGGFSGGGFEDIFSSFFGGASRQRDPNAPRKGDDLQYTMTITFDEAVFGGKKEISIRKDVTCHTCDGEGAKPGTKKKTCSYCNGAGSVSVEQNTILGRVRTEQVCPKCEGSGQEFEEPCPTCHGKGTENKTVKLEVTIPEGVDNEQQIRLAGEGSPGVNGGPSGDLYVVFRVKPSEVFKRDGDDIYYDLNISFPQAALGDEVKIPTLNSNVVLTIPS

SEQ ID NO: 63039 - protein, 349 aa, Zea mays
MGGLTMDQAFVQAPEHRPKPIVTEATGIPLIDLSPLAASGGAVDALAAEVGAASRDWGFFVVVGHGVPAETVARATEAQRAFFALPAERKAAVRRNEAEPLGYYESEHTKNVRDWKEVYDLVPREPPPPAAVADGELVFDNKWPQDLPGFREALEEYAKAMEELAFKLLELIARSLKLRPDRLHGFFKDQTTFIRLNHYPPCPSPDLALGVGRHKDAGALTILYQDDVGGLDVRRRSDGEWVRVRPVPDSFIINVGDLIQVWSNDRYESAEHRVSVNSARERFSMPYFFNPATYTMVEPVEELVSKDDPPRYDAYNWGDFFSTRKNSNFKKLNVENIQIAHFKKSLVLA

SEQ ID NO: 63040 - protein, 525 aa, Ralstonia solanacearum GMI1000
MTRLFRLCKIIFVILYHGLDQLALSGFKSRRIRALVWVLTLGRRQTRPRGERLRLALEQLGPIFVKFGQVLSTRRDLLPPDVADELAKLQDRVPPFDPKIAAAIVERSLGKPLSALFHRFDHHPVASASIAQVHFATLRGGPDDGREVAVKVLRPGMLPVIDSDLALMRDVATWMEKLWADGKRLKPREVVAEFDKYLHDELDLMREAANASQLRRNFAKSELLLVPEVFWDWCTSEVFVMERMHGVRVSHADELRAAGVDTHKLARDGVEIFFTQVFRDGFFHADMHPGNILVSVAPESLGRYIALDFGIVGALSEFDKNYLAQNFLAFFQRDYHRVALLHVESGWAPEETRVEELEGAIRACCEPYFDRPLGEISLGLVLMRLFQTSRRFNVEVQPQLVLLQKTLLNVEGLGRQLDPDLDLWKTAKPFLERWMHEQIGWRGLVDRLKIEAPQWANMLPDFPRLAHQILERHARDNGSAQTATLSALLAEQRRTNRLLSAALLFIGGFAVGIIATHVLAWLARH

SEQ ID NO: 63041 - protein, 392 aa, Aspidopterys elliptica
DLEPVNPADVPVTAAGALKSYKLAAKAISRLQSLPSGNISLLCDVLVKEVRDLTGYDRVMVYKFHEDEHGEVVSECLRSDLESYLGLHYPATDIPQASRFLFMKNKVRMICDCVAPPVKVIQDERLPQPLSLCGSTLRSPHGCHAQYMTNMGIIASLVMSVTVNEDDDMVDGDQPQMARKLWGLVVCHHTSTRFVPFPLRYACEFLIQVFGVQINKEVELAAQVREKHILQIQTMLCDMLLRDAPVAIITQSPNVMDLVKCDGAALYFKNKTWLLGVTPTEEQIRDIAEWLLEYHSGNTGLSTDSLMEAGYPGASALGDAVCGMAAVSITSRDFLLWFRSHTAKEIKWGGAKHDPDDKDDGRKMHPRSSFKAFLEVVKWRSMPWEDIEMDAI

SEQ ID NO: 63042 - protein, 293 aa, Staphylococcus vitulinus
VLVFQDASKDEIKKAYRKLSKKYHPDINQEEGADAKFKELSEAYEVLSDENKRAQYDRFGHNGPQQGSGGSQGFGGQDFSGFGGFEDIFGSFFGGGGARRDPNAPRQGDDLQYSMTLTFEEAVFGTEKDITVRKDVECDTCHGNGAKPGTKKKTCTYCSGQGHVTVEQNTILGRMQTQKVCPECEGSGQVFEEKCSDCHGKGTQNKKVTITVKVPEGVDNDQQIRLAGKGGPGINGGPAGDLYVVFRVKPHSNFRREGDDIFYDLNLSFPQAALGDEITVPTLTGNVSLSVPA

SEQ ID NO: 63043 - protein, 392 aa, Caucanthus auriculatus
DLEPVNPADVPVTAAGALKSYKLAAKAISRLQSLPSGNISLLCDVLVKEVRDLTGYDRVMVYKFHEDEHGEVVSECHRSDLESYLGLHYPATDIPQASRFLFMKNKVRMICDCVAPPVKVIQEERLPQPLSLCGSTLRSPHGCHAQYMTNMRIIASLVMSVTVNEEDDMVDGDQPQMARKLWGLVVCHHTSTRFVPFPLRYACEFLIQVFGVQINKEVELAAQVREKHILQIQTMLCDMLLRDAPVAIITQSPNVMDLVKCDGAALYFKNKTWLLGVTPTEEQIRDIAEWLLEYHSGNTGLSTDSLMEAGYPGASALGDAVCGMAAVSITSRDFLLWFRSHTAKEIKWGGAKHDPDDKDDGRKMHPRSSFKAFLEVVKWRSMPWEDIEMDAI

SEQ ID NO: 63044 - protein, 290 aa, Staphylococcus saccharolyticus
VLGVSKSASKDEIKKAYRKLSKKYHPDINKEEGADEKFKEISEAYEVLSDDNKRANYDQFGHEGPQGGFGNQGFGGGDFGGFEDIFSSFFGGGSRQRDPNVPRKGDDLQYTMTVNFEEAVFGTKKGISIRKDVTCHTCNGEGAKPGTSKKTCSYCNGSGRVSVEQNTILGRVRTEQVCPKCEGSGQEFEEPCPTCHGKGTENKTVKLEVTVPEGVDNEQQIRLAGEGSPGTNGGPHGDLYVVFRVQPSDTFERDGDDIYYNLNISFSQAALGDEIKIPTLNSNVVLTIPA

SEQ ID NO: 63045 - protein, 392 aa, Malpighia stevensii
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCVAPPVKVIQDDRLPQPLSLCGSTLRSPHGCHAQYMTNMGIIASLVMSVTVNEDDDMVDGDQPQMARKLWGLVVCHHTSTRFVPFPLRYACEFLIQVFGVQINKEVELAAQVREKHILQIQTMLCDMLLRDAPVAIITQSPNVMDLVKCDGAALYFKNKTWLLGVTPTEEQIRDIAEWLLEYHSGNTGLSTDSLMEAGYPGASALGDVVCGMAAVSITSRDFLFWFRSHTAKEIKWGGAKHDPDDKDDGRKMHPRSSFKAFLEVVKWRSMPWEDVEMDAI

SEQ ID NO: 63046 - protein, 296 aa, Staphylococcus saprophyticus subsp. bovis
VLGVAKSASKDEIKKAYRKLSKQYHPDINKEEGADEKFKEISEAYEVLSDENKRANYDQFGHDGPQGGFGGQGFGGQDFSGFGGGGFEDIFSSFFGGGRQQRDPNAPRKGDDLQYTMTVTFDEAVFGSEKEISIRKDVACHTCDGEGAKPGTKKKTCHYCNGSGHVSVEQNTILGRVRTEKVCPVCSGSGQEFEEPCPTCHGKGTENKNVKISVTIPEGVDNEQQIRLAGEGAPGENGGPQGDLYIVFRVKPSEKFERDGDDIYYSLDISIAQATLGDEVKVPTLKGSVMLTIPAG

SEQ ID NO: 63047 - protein, 392 aa, Madagasikaria andersonii
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCVAPPVKVIQDERLPQPLSLCASTLRSPHGCHAQYMTNMGIVASLVMSVTVNEEDDMVDGDQPQMARKLWGLVVCHHTSTRFVPFPLRYACEFLIQVFGVQINKEVELAAQVREKHILQIQTMLCDMLLRDAPVAIITQSPNVMDLVKCDGAALYFKNKTWLLGVTPTEEQIRGIAEWLLEYHSGNTGLSTDSLMEAGYPGASALGDAVCGMAAVSINSRDFLLWFRSHTAKEIKWGGAKHDPGDKDDGRKMHPRSSFKAFLEVVKWRSMPWEDMEMDAI

SEQ ID NO: 63048 - protein, 390 aa, Moorella thermoacetica ATCC 39073
MQEARRIRELPPYLFARIEKKIAEARERGVDIISLGIGDPDMPTPSHVIDKLVAEAHNPENHRYPTSEGLLAFRQAVADWYQRLYGVDLDPRREVVTLIGSKEGIAHISLCYVDPGDINLVPDPGYPVYNIGTLLAGGESYFMPLTAANGFLPDLGAIPSDVARRAKLMFINYPNNPTGAVADLKFFQEVVEFARSYDLIVCHDAAYSEITYDGYRAPSFLQAPGAKEVGIEFNSVSKPYNMTGWRLGWACGRADVIEALARIKSNIDSGAFQAVQYAGIAALTGPQEGLAEVRRVYQERRDIIVEGFNSLGWHLEKPKATFYVWAPVPRGYTSASFAEMVLEKAGVIITPGNGYGNYGEGYFRIALTISKERMQEAIERLRRVLGKVEF

SEQ ID NO: 63049 - protein, 341 aa, Yersinia pseudotuberculosis IP 32953
MKALSKLKAEEGIWMTDVPQPELGHNDIMIKIRKTAICGTDVHIYNWDEWSQKTIPVPMVVGHEYVGEVVAIGQEVKGFNIGDRVSGEGHITCGHCRNCRGGRTHLCRNTVGVGVNRPGSFAEYLVIPAFNAFKIPDNISDELAAIFDPFGNAVHTALSFDLVGEDVLVSGAGPIGIMAAAVCKHVGARHVVITDVNEYRLDLARKMGVTRAVNVSKENLNDVMTELGMTEGFDVGLEMSGAPPAFRSLLNSMNHGGRIAMLGIPPSDMSIDWNQVIFKGLFIKGIYGREMFETWYKMAALIQSGLDLTPIITHRFPIDEFQQGFDAMRSGKSGKVVLSWD

SEQ ID NO: 63050 - protein, 92 aa, Arabidopsis thaliana
MAFFMLSSDPVDTWADQATMVAPFTGLKSSAAFPVTRKTNMDMTSIVSNWGRVSCMNVWPPIVKKNVETLYYLPDRRDGELANEVDYSFLNK

SEQ ID NO: 63051 - protein, 268 aa, Glycine max
MCIAVFMWQTHPKYPLILLHNRDEFYSRPTEPLAWWEGETILGGKDALGGGTWLGSTRDGRIAFLTNFREVEMLSNPKTRGDLPLRFLQGNKSPEEFAEQVVKEADEYNGFNLVLADICTSSMVYVFNRPNQDHLSLAQVVVTPGIHVLTNAALDAPWPKAERLRHNFKEFIDQYGESDFPIKEMVEKLMTNTVKDEECMLPGIHPPEREQPLSSIFVEAELSSSGHYGTRSSSALFVKSNKEVTFYEKYLEKKQWKDKMVTYKISER

SEQ ID NO: 63052 - protein, 103 aa, Zea mays
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFAG

SEQ ID NO: 63053 - protein, 515 aa, Yersinia pseudotuberculosis IP 32953
MSSTKKPLVLTILDGYGHREEQQDNAILNAKTPVMDVLWQQQPHTLIAASGLDVGLPDGQMGNSEVGHVNLGAGRIVYQDLTRLDKEIKEGDFFTNPTLTAAVDNAVKTGKAVHIMGLLSAGGVHSHEDHIMAMVELAAKRGATAIYLHAFLDGRDTPPRSAESSLKRFTAKFAELGNGRIASIIGRYYAMDRDNRWDRVQLAYDLLTQAKGEFTADNAVAGLQAAYARGENDEFVKPTVIQATGEADAAMNEGDTLIFMNFRADRARQITRTFVNADFDGFKRDKVVNFGDFIMLTEYAADIKVACAYPPASLTNTFGEWLMKHDKTQLRISETEKYAHVTFFYNGGVEEPFKGEDRILINSPKVATYDLQPEMSSAELTEKLVSAIGSGKYDVIICNYPNGDMVGHTGDYDAAVKAVETLDNCIEQVVAAVKAADGQLLITADHGNAEQMRDPATGQAHTAHTSLPVPLIYVGNKAVKAVEGGKLSDIAPTMLSLMEMEIPQEMTGKPLFIVE

SEQ ID NO: 63054 - protein, 138 aa, Streptococcus agalactiae NEM316
MEQTFFMIKPDGVKRGFIGEVISRIERRGFSIDRLEVRHADADILKRHYAELTDRPFFPTLVDYMTSGPVIIEVISGEEVISTWRTMMGSTNPKDALPGTIRGDFAQAPSPNQATCNIVHGSDSPESATREIAIWFNN

SEQ ID NO: 63055 - protein, 321 aa, Oryza sativa (japonica cultivar-group)
MVGRMERQSASSSASCSPSSSAAGTSSSSSACGGKKRPDILNMIRSATCLNSSSTDTGKGRSKQSSNKVTHGFHLVEGKSGHDMEDYHVAEYKYDKSHELGLFAIFDGHLGDSVPSYLKANLFCNILKEPIFWTNPQEAIKNAYRSTNKYILENAKQLGPGGSTAVTAIVVDGKDMWVANVGDSRAVVCERGAANQLTVDHEPHTTNERQRIEKQGGFVTTFPGDVPRVNGQLAVARAFGDQSLKAHLSSEPDVRHVPINSSIEFVILASDGLWKVMKNQEAVDLVKSIKDPQAAAKRLTTEALARKSKDDISCIVIRFRC

SEQ ID NO: 63056 - protein, 123 aa, Brassica napus
  misc_feature (95)..(95): Xaa can be any naturally occurring amino acid
  misc_feature (122)..(122): Xaa can be any naturally occurring amino acid
MRTMVDLGKQRGRHHMQTINTATTVDCASELRHRRTLRSFIECMLPYCCTYQQPSPSYQNDTVSVSSSSSSSSSSDHSSSSSHSNSIVSGTFFGXRRGKVSFCLQEDASVGSSPLLLLELAXP

SEQ ID NO: 63057 - protein, 221 aa, Oryza sativa
  misc_feature (34)..(34): Xaa can be any naturally occurring amino acid
RPGLRFLSPSPSSSSLSSPLRRCRCCCVLLSSPXSSPPRARPLAGRRRKRRLRPEFWLAGSGSPRPWGLQEARTRQLRFLSPSPSSSSLSSPLLSAAAAAAACSSHPRLFPLRARRPLAGRRRKRRPSPEFVLAGSGSPQSMSEEAGRPLPKFGEWDVNDPASADGFTVIFNKARDEKKGGNGQDTDSPCKETRTERVESYAPKTNSKKWFCCVTSSPTQS

SEQ ID NO: 63058 - protein, 360 aa, Oryza sativa
  misc_feature (219)..(219): Xaa can be any naturally occurring amino acid
  misc_feature (252)..(252): Xaa can be any naturally occurring amino acid
MATAGKVIKCKAAVAWEAAKPLVIEEVEVAPPQAMEVRVKILFTSLCHTDVYFWEAKGQTPVFPRIFGHEAGGIVESVGECAHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGXCTEFVNPKDHDKPVQQVLAEMTNGGVDRSVECXTGNINAMIQAFECVHDGWGVAVLVGVPHKDAEFKTHPMNFLNERTLKGTFFGNYKPRTDLPNVVELYMKKEVEVEKFITHSVPFSEINTAFDLMHKGEGIRCIIRMEN

SEQ ID NO: 63059 - protein, 591 aa, Oryza sativa (japonica cultivar-group)
MCGILAVLGVADVSLAKRSRIIELSRRLRHRGPDWSGIHCYQDCYLAHQRLAIVDPTSGDQPLYNEDKSVVVTVNGEIYNHEELKANLKSHKFQTASDCEVIAHLYEEYGEEFVDMLDGMFAFVLLDTRDKSFIAARDAIGICPLYMGWGLDGSVWFSSEMKALSDDCERFISFPPGHLYSSKTGGLRRWYNPPWFSESIPSTPYNPLLLRQSFEKAIIKRLMTDVPFGVLLSGGLDSSLVASVVSRHLAEAKVAAQWGNKLHTFCIGLKGSPDLRAAKEVADYLGTVHHELHFTVQEGIDALEEVIYHVETYDVTTIRASTPMFLMSRKIKSLGVKMVLSGEGSDEIFGGYLYFHKAPNKKEFHEETCRKIKALHLYDCLRANKSTSAWGVEARVPFLDKNFINVAMDIDPEWKMIKRDLGRIEKWVLRNAFDDEEKPYLPKHILYRQKEQFSDGVGYSWIDGLKDHANEHVSDSMMMNASFVYPENTPVTKEAYYYRTIFEKFFPKNAARLTVPGGPSVACSTAKAVEWDAAWSKNLDPSGRAALGVHDAAYEDTLQKSPASANPVLDNGFGPALGESMVKTVASATAV

SEQ ID NO: 63060 - protein, 509 aa, Azoarcus sp. BH72
MFAPAQPICPVAGIRAIEKTLIPSARPSLMERAGRAAAEDAVRLLIDRPGPVLVACGPGNNGGDGFVMARQLLQAGREVTVAFAGTADALPPDAAKAYADFVAAGGTWIPELPPVPARGWALVVDALFGIGLGRPVTGRLAAWIQTLNAQCAPRMALDIPSGLDADAGRLMGETFRATHTTTFIALKPGLLTLDGPDHCGEISLQRLEIDAPSWAPDVGWEITPSLFAKQLQPRPRNTHKGRYGDAAVLGGDSGMAGAALLAGRAALWLGAGRVYCGLLDPAAPSVDVLRPELMLRRAEALPEALSALAVGPGLGRSGAAADLVAQAIERDIPLLIDADGLNLVAESAELEGRLVKRTAPTLLTPHPAEAGRLLDCDTAEVQQDRVASARELARRYRATVVLKGCGSIIATADGRWYINGTGHPGMATAGMGDVLSGLVVSLLAQGWPPTDAMIAGVHLHGAAADRLAREGVGPVGLGAGEVVEAARGVFNGWLVARSRSPGWGAAGLS

SEQ ID NO: 63061 - protein, 214 aa, Bradyrhizobium sp. BTAi1
MVSFPQRLLDGYRAFTTQRLPTEQSRYLELSERGQSPDVMVIGCCDSRVSPEVIFDVGPGELFVLRNIANLVPIYQPDANAHGVSAALEYAVTVLKVKHIVILGHAQCGGIRAFVDKAAPLSPGDFIGRWMSMFIKPGEVVEQRNHESFQDFVTRIEKAAVFRSLENLMTFPFVRSRVEAGDLQLHGAYFGVAEGSLFVLDTATKEFKSARSGE

SEQ ID NO: 63062 - protein, 373 aa, Arabidopsis thaliana
MPGESNIIEWPASRVRVISGASWSRNGQILSGRCKANNGTWFGITKGGRVAFLVNTSLLLDRVKSYSGSELYPVRFLEGNMSPEQFANEVKVHEKETNERHAYSLVVADMTSSSMVHILKPSDTKSDVVIETVPFGVHTLSSYEGLDSTDSARDLLLRRLFTQMVGNLGNVQQRQMEEIAGRFMYDAQAGRDAVFYHSRDEHPNGKLGTQRFGTTSTTALVVKRTREVMLFEKYMEQNGAWNTNNFAFNIQKQQKLYPNLDKEALKRVGVFALEEVNNHEHDIHPDLMPSFFEDDMLKVKFNEMIARHAKLPPIKNIVEDLMMKSPFFIDSVDGAGKKVRYRTVRTLGMDIKANRPQGRFYERHLNDNGEWVG

SEQ ID NO: 63063 - protein, 455 aa, Xanthomonas campestris pv. vesicatoria str. 85-10
MDPSVLKALQRLDAAHHLHPFNDNAALAHKGTRILTRGEGVYVWDADGNQFLDAFGGLWCVNVGYGREELAQAAARQMEQLAYYNSFFQCTTEPTIRLAAKLAALAPGDLNHAFFANSGSEANDTILRLVRHFWAVQGQPQKRIFIGRHDGYHGTTMAGASLGGMKGMHRQGGLPIADIHHIAPPYHFGDGGQMDPEDYGLLAARRLEDKILELGPEHVAAFIGEPIMGAIGVYIPPRSYWPEIERICRRYDVLLVADEVICGFGRTGEWFGAEYFGFQPDVMTLAKGITSGYIPLAAAMFNDRVAGVLKTQGGELAHGGTYAGHPVCAAVALENLRLLQDEGIVETARTQVAPYLAQRWAALGEHRLVGEARIAGLVGALELVPDKQRRGAYFPGRGRVGAMCRDFALRRGLILRATYDAMLLSPPLIITREQVDELFDKAWAALDDTAHALGR

SEQ ID NO: 63064 - protein, 461 aa, Xanthomonas campestris pv. vesicatoria str. 85-10
MSIRTRSRKTPSKQPESALRRWLKERSITEVECLVPDITGNARGKIIPADKFSHDYGTRLPEGIFATTVTGDFPDDYYALTSPSDSDMHLRPDASTVRMVPWAADPTAQVIHDCYTKDGQPHELAPRNVLRRVLDAYAQAKLQPVVAPELEFFLVQKNTDPDFPLLPPAGRSGRPETARQSYSIDAVNEFDPILDLMYDYCDAMELDVDTLIHESGAAQLEVNFTHADPMSRADQVFLFKRTMREAALRHGVYATFLAKPMETEPGSAMHIHQSLLHAGTGKNVFSGKREGGFSDTFAHYLGGLQKYIPMAMGLLAPNVNSYRRLMFGEVSPSNVLWGFDNRTCGLRVPIDAPQNMRVESRFAGSDANPYLAMAATLACGLLGIGEKLEPTAPISSNGKEQGYDLPRSLGEALDELEGCEALQEMLGRRFVRAYISVKRKEYETFFRVISSWEREFLLLNV

SEQ ID NO: 63065 - protein, 818 aa, Desulfitobacterium hafniense DCB-2
MSPSFGRGAMTNSWTDMQNTKCFLIAGSNCAENHPIAMRWINKAKENGAKVIVVDPRFTRTASQADIFAQVRPGADIAYLNAIINYILENKLYDQDYVLNHTNGLYKISKDFKFADGLFSGFDPETKKYNFDSWAYQLDAENKPVKAESLDDPDCVFGKLKEHFSRYTLEVGADISGIPAEKIKEIADTFCNTRPGSILYALGMTQHTTGVQGIRSYAIIQLLLGNVGKAGSGIQALRGEPNVQGSTDMANLFNNLPGYLPAPVHTDKDLRSYLVRSGSAFERHIISQLKAWFGENATKENDYCFNYLPKYNSGKNYSMVKLWEAANSGQFKMLLNFGSNSMVSIPNRQIVREGLAKLDMLVIADVYEVETAQFWREKDPTTGELLVNPAKINTEVILLPAAFVYEKGGTLSNSGRWIQWKDAALKPPGEAKPDLDILDHIYHKLKELYAGSTDPKDEPILKARWDYGHEPDPLKVLQEISGYDETTGKVLPTLADYLKAPIGSASSGCWIYAGVTGNGNLAARRDNSDPSGLGLYRNWSFSWPGNIRILYNRGSCDMNGQPLDENRKLIWWDAAKNSWEGNDGADVPDKTKGPDTPEGKQVFRMNPEGVGRLFTAKYFSGIPATPAADGLPHIGVRPAGQCNDGPLPEFYEPVESPTVNSLHPDVSSNPTVPIPNFLPGVTNHGSKEDFPYVLTTYALVEHFCAGGITRNIPMLNELMPQPFAEISKNLAQKIGVKEGDMVEVSSARGKVQVVALVTDRIQTLKINGQDSETIGMPWSWGFASLSPGPTTNNLTISAIDPTAGTPEYKCCLVNIRRA

SEQ ID NO: 63066 - protein, 265 aa, Kluyveromyces lactis NRRL Y-1140
MPSLPELTKGLKTAFEGKQYETCLRLLLPIKIELIKAKLLIPDIKSAKENQSYLQDLNIAKKILEIGALSSIYCEDFETFMNYYSQLSAFYFSDVKELSDSDSKFKLISLYLLILLAQNDYTKLHSEFEFLSRYVTNLEESSYLSYPVKLERLLMEGSYQKAWDLLQTGSKVEEFNVFTKTLKEAIREEIALNSEQAYSSLPLFNAKTLLFFENEKEMEAFAKERDWSVNHGVITFGNDSTPDRIESGDTVDMAIDYAVHLESIV

SEQ ID NO: 63067 - protein, 296 aa, Staphylococcus saprophyticus subsp. saprophyticus
VLGVSKSASKDEIKKAYRKLSKQYHPDINKEEGADEKFKEISEAYEVLSDENKRANYDQFGHDGPQGGFGGQGFGGQDFSGFGGGGFEDIFSSFFGGGRQQRDPNAPRKGDDLQYTMTVTFDEAVFGSEKEISIRKDVACHTCDGEGAKPGTKKKTCHYCNGSGHVSVEQNTILGRVRTEKVCPVCSGSGQEFEEPCPTCHGKGTENKNVKISVTIPEGVDNEQQIRLAGEGAPGENGGPQGDLYIVFRVKPSEKFERDGDDIYYSLDISIAQATLGDEVKVPTLKGSVMLTIPAG

SEQ ID NO: 63068 - protein, 420 aa, Solanum demissum
MGNCVGSSARVEATLSSTTPSAYEASRFPDRKSNSSVPSSLSIPSYGRKSSSESLPTPRSESEILFSPNVKSFSFNELKNATRNFRPDSLLGEGGFGCVFKGWIDAQTLTASKPGSGIVIAVKKLKPEGFQGHKEWLTEVNYLGQLRHPNLVKLIGYCIDGDNHLLVYEFMPKGSLENHLFRRGPQPLNWATRIKVAIGAARGLAFLHDAKEQVIYRDFKASNILLDAEFNSKLSDFGLAKAGPTGDRTHVSTQVMGTQGYAAPEYVATGRLTAKSDVYSFGVVLLELLSGRRAVDNTKVGIEQNLVDWAKPYLGDKRKLFRIMDTKLEGQYPQKGAYTAANLAWQCLSNEPKLRPKMSEVLTALEELQSPKGVSKLSHTEHRAIPSPVAVSPMRHHRSPLHMTPSASPFQAYQKSPRGR

SEQ ID NO: 63069 - protein, 84 aa, Glycine max
  misc_feature (65)..(65): Xaa can be any naturally occurring amino acid
  misc_feature (75)..(75): Xaa can be any naturally occurring amino acid
  misc_feature (81)..(81): Xaa can be any naturally occurring amino acid
MATLDSDVNMIPAGESSSSVVASSSSKKAKRFEVKKWSAVALWAWDIVVDNCAICRNHIMDLCIXCQANQASATXEECTVXLGG

SEQ ID NO: 63070 - protein, 294 aa, Staphylococcus delphini
VLGVSKSASKDEIKKAYRKLSKKYHPDINKEEGSDEKFKEISEAYEVLSDENKRAQYDQFGHSGPQGGFGQGFGGQDFSGFGGGGFEDIFSQFFGGAQRQRDPNAPRRGDDLQYTMTVTFDEAVFGTKKEISIRKEVTCHTCDGEGAKPGTKKKTCSYCHGAGHVSVEQNTILGRVRTEKVCPECNGTGEEFEEPCPTCHGKGTELKNVKLEVTVPEGVDNDQQIRLAGQGGPGENGGPAGDLFVIFRVQPSDKFTREGDDILYNHNISFAQAALGDEVKIPTLKGHVMLTVPE

SEQ ID NO: 63071 - protein, 603 aa, Xylella fastidiosa Ann-1
MTVIEIKVPDIGDYSKVPVIEVLVTVGDHVVKNQGILTLESDKATLEVPSMNNGIVKELKVNVGDLLSQGDVILLLETEDTTAPPSPSNAATSDTTSPPPPSPQPAASKATAPDQQHSDIKCRMVVLGAGPGGYTAAFRAADLGLDTVLVERYPNLGGVCLNVGCIPSKALLHAAAVIDEAAHASTFGIDFGKPKITLDTLREYKQNVVNKLTAGLAGMAKQRKVRTVTGIAHFVSPNTLDITAADGSTQRLHFQQCIIATGSHPVKLPNFPWDDPRIMDSTDALELAEVPKKLLVVGGGIIGLEMATVYNALGSHVTIVEFMDQIIPGTDKDLVKPLADRMKKQGIEIHLNTKASHVKADKKGITVSFEAPTQGTQPTLKTSTYDRVLVAVGRTPTGNNIGAEKAGVNVTERGFIPVDRQMRSNVPHIFAIGDIVGNPMLAHKATHEGKLAAEVAAAETESGKHREWVARVIPSVAYTNPEIAWIGMTETEAKAKSLNIGVAKFPWAASGRAIGIGRTEGFTKLIFDEDTHRIIGGAIVGVHAGDLLAEIGLAIEMGTEAEDISHTIHAHPTLSESIAMSAEVYDGTITDLYLPKKPATSAK

SEQ ID NO: 63072 - protein, 336 aa, Legionella pneumophila subsp. pneumophila str. Philadelphia 1
MSYEELSNTMEQMLHEGKGILAADESNSTIGKRFASINTENTEENRRDYRLLLATTPDLEQYINGVILFEETFTQTDEHGTPIPELFANKGIIPGIKVDKGLVDLANTEHEKVTQGLDGLTERLLHFKKLGAKFAKWRNVYSISEYTPSLTAIKTGAENLGRYAAACQSVGIVPIVEPEVLMDGNHSIEHCAEVCEMVLHELFHTLFIHQVELEHIILKPSMVTCGKEVAPFSDPEEVADYTISVFRNNVPASVPTINFLSGGQTPQQATANLNAINQIGHQPWLLSFSFGRALQEDCLKEWCGNKANIAKAQEALIKRARLNSMACLGEYQNDME

SEQ ID NO: 63073 - protein, 293 aa, Staphylococcus schleiferi subsp. coagulans
VLGVSKSASKDEIKKAYRKLSKKYHPDINKEEGADAKFKEISEAYEVLSDDNKRANYDQFGHSGPQGGFGQGFGGQDFSGFGGGFEDIFSSFFGGAQRQRDPNAPRKGDDLQYTMTISFEEAVFGTKKEISIRKEVTCHTCGGEGAKPGTKKKTCSYCKGKGHITVEQNTILGRVRTEKVCPECNGTGEEFEEPCPTCKGKGTEIKNVKLEVTVPEGVDNDQQIRLAGQGSPGENGGPAGDLFVVFRVKPSDKFQREGDDILYHHDIGFAQAALGDEVKIPTLNGHVMLTIPE

SEQ ID NO: 63074 - protein, 529 aa, Zea mays
MVLGALASAVASTGLLIVYGVLGALLLWKAARLLDRLWWEPRRLERALRAQGLRGTSYRFLTGDLREYRRSKEEAGARPLPLRCHDIAGHVEPFIHGAVLEHGKTCFTWFGPVPRVTVVDPDLARDVMANKFGHFEKPKFPALTKLFSDGVANHEGEKWVKHRRILNPAFHLEKLKLMLPAFSACCEELVSRWAQSLGPDGSCELDVDPELQTLTGDVISRTAFGSSYLEGRKIFQLQAEQAERLMSIIDKFAVPGYMSLPTKNNRRMRQIKSEIDSILRGLIGKRMQAMKQGESDKDDLLGLLLESNARETGDQSGQPGQGLTMEEVMEECKLFYFAGMETTSVLLTWTMVLLSMHPEWQDRAREEVLGLFGKKNQPGYDGLSRLKTVTMILYEVLRLYPPAIAFSRKTYKEMVVGDVTYPAGVTLELPVLFIHHDPDIWGSDAHEFRPERFAEGVARASKDRLAFFPFGWGPRICIGQNFALLEAKMALSMILQRFQFELAPTYTHAPRRVIMLRPMHGAQIKLRAI

SEQ ID NO: 63075 - protein, 851 aa, Fusobacterium nucleatum subsp. vincentii ATCC 49256
MKQVYEFKDGGKEMVALLGGKGANLAEMAKIDLPIPKGIIISTTACNDYFKNDKKLSSVLEEEILTNIRVLEYETGKKFQSTKPLLVSVRSGAPVSMPGMMDTILNLGFNDYVAEKMLEITKDEKFVYTSYLRFVQMFSEIAKGINRKKFMHLKATDYKAQIIESKNIYREECGEMFPENYKAQILIAVKSIFDSWNNDRAILYRKLHNIDNNMGTAVVIQEMVFGNFNDKSGTGVLFTRNPSTGENKIFGEVLLNAQGEDIVAGIRTPDNIELLKTSMPNIYNELADTVKKLEKHNRDMQDVEFTIEDSKLYILQTRNGKRTAEASLKIAMDLVKEGIITKEEAILKVEPASLNKLLNGDFEEKYLKEATLLTKGLAASSGVAVGRIMFDAKRVKIREKTILVREETSPEDLQGMALAQGIVTLKGGATSHGAVVARGMGKCCVTGCSEIKIDEINKTMTVGKHTLKEGDFISVSGHTGEIYLGKIPLKENSFSDELKEFVSWASEIKRMGVRMNADTPEDVKQGKAFGAKGIGLCRTEHMFFKKDKIWTIREFILSDRGEEKEKALKKLHNLQKEDFLNIFKILNGDEANIRLLDPPVHEFLPKTLEDKKKMAEILSISLEDIEKRIYRLKDENPMLGHRGCRLGVSYPELYRIQARAIVEAAYECEKKGIKVHPEIMIPFIMESKELAYLRKEIEEEIESFFKEVGATVEYKLGTMIEIPRACLLANEIAEYADFFSFGTNDLTQMSMGLSRDDSVKFLDDYREKGIWEGEPFYSIDTKSVTKLVEIGVKNGKTTKPNLQIGVCGEHGGDPKSIEFFEGQKFDYVSCSPFRVPTAILAAAQSYLKLKR

SEQ ID NO: 63076 - protein, 283 aa, Oryza sativa
MKLHSLKRREIETSRLQPYMAMATTSSKNERWSLAGATALVTGGSKGIGRAIVEELASLGATVHTCARTEAPLNRCREELTAKGLAVTVSVCDVSLRADREALAGTVRELFGGKLSILVNCAGMSFLKPAVELTPDDCSQVMGMNFESCFHLSQLAYPLLKASQRGCIINISSIASVVAFCSLPNAVYSAAKGAMNQVTRNLAAEWANDGIRVNCVAPGFIRTPLLSEFVEGNELGRAEFSRVPMGRLGEPEDIASLVAFLSMPASSYITGQVICADGGRCLS

SEQ ID NO: 63077 - protein, 294 aa, Staphylococcus sciuri subsp. carnaticus
VLGVSKDASKDEIKKAYRKLSKKYHPDINQEEGADAKFKEISEAYEVLSDENKRAQYDRFGHSGPQQGFGGSQGFGGQDFSGFGGFEDIFGSFFGGGGARRDPNAPRQGDDLQYSMTLTFEEAVFGTEKDITVRKDVECDTCHGNGAKPGTKKKTCTYCNGQGHVTVEQNTILGRMQTQKVCPECEGSGQVFEEKCSDCHGKGTQNKKVTIKVKVPEGVDNDQQIRLAGKGGPGINGGPAGDLYVVFRVKPHSKFRRDGDNIFYDLNLSFPQAALGDEITVPTLTGNVSLTVPA

SEQ ID NO: 63078 - protein, 433 aa, Ralstonia solanacearum GMI1000
MSNVASPSTLQHAIPSYLPADNLGPWGIYLQQVDRVTPYLGSLARWVETLKRPKRALIVDVPIQMDDGRIAHFEGYRVQHNTSRGPGKGGVRFHQDVTLSEVMALSAWMSVKNAAVNVPYGGAKGGVRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDVKGARIVVQGFGNVGSVAAKLFQDAGAKVIAVQDHKGIVFNGAGLDVDALIQHVDHNGSVDGFKAETLSADDFWALECEFLIPAALEGQITGKNAPQIKAKIVVEGANGPTTPEADDILRDRGILVCPDVIANAGGVTVSYFEWVQDFSSFFWTEDEINQRLVRIMQDAFRAIWQVAQDNKVTLRTAAFIIACTRILQARQERGLYP

SEQ ID NO: 63079 - protein, 587 aa, Triticum aestivum
MAMVDEPLYPIAVLIDELKNEDIQLRLNSIRRLSTIARALGEERTRKELIPFLSENNDDEDEVLLAMAEELGVFIPYVGGVEHAHVLLPPLETLSTVEETCVRDKAVESLCRIGAQMKENDIVDYFIAVVKRLAAGEWFTARVSSCGLFHIAYPSATDPLKTELRTIYGQLCQDDMPMVRRAAASNLGKFAATVEQSHLKTEIMSIFDDLTQDDQDSVRLLAVEGCAALGKLLEPQDCVAHILPVIVNFSQDKSWRVRYMVANQLYELCEAVGPEPTRADLVPAYVRLLRDNEAEVRIAAAGKVTKFCRILSPQLAIQHILPCVKELSSDSSQHVRSALASVIMGMAPVLGKDATIEQLLPIFLSLLKDEFPDVRLNIISKLDQVNQVIGIDLLSQSLLPAIVELAEDRHWRVRLAIIEYIPLLASQLGVGFFDDKLGALCMQWLEDKVFSIREAAANNLKRLAEEFGPEWAMQHIIPQVLEKINNPHYLYRMTILQAISLLAPVMGAEITCQKLLPVVINSSKDRVPNIKFNVAKVLQSLVPILDQSVAEKTVKPCLVELSEDPDVDVRYYANQALQACDQIMMSS

SEQ ID NO: 63080 - protein, 575 aa, Oryza sativa
MASSALICDTEQWKGLQIGRAHYDFVFWCGEQAHVGEIQKTHLRHLMHDVERCKAMTACLLIDSEYEGIYLDYSRQRATGETMEKLFKLAEAAKLKEKIEKMFRGDKINSTENRSVLHVALRAPRDEVINSIGSMWSRSWGVKDKIKQFSETFRSGSWVGATGKALTNVVSVGIGGSFLGPLFVHAALQTDPEAAESAKGRQLRFLANVDPVDVARSIKDLDPETTLVVVVSKTFTTAETMLNARTLKEWIVSSLGPDAVAKHMIAVSTNLELVEKFGIDPKNAFAFWDWVGGRYSVCSAVGVLPLSLQYGFPIVQKFLEGAASIDKHFRSSSFEKNIPAILPYSQALEKFAPHIQQLSMESNGKGVSIDGVQLPFESGEIDFGEPGTNGQHSFYQLIHQGRVIPCDFIGVVKSQQPVYLKGEIVSNHDELMSNFFAQPDALAYGKQFTGYFQTPEQLHSEKVPEHLIPHKTFQGNRPSLSLLLPSLSAYEIGQLLAIYEHRIAVQGFLWGINSFDQWGVELGKSLASQVRKSLHASRVEGKPVLGFNSSTTSLLTRYLAVEPSTPYNTTTLPKV

SEQ ID NO: 63081 - protein, 335 aa, Bordetella parapertussis 12822
MPKTPSDASPKTRQAADRTAERQREIQREQDQRDQRKPAAGRPGEAPRTGARDHPEPPMPRQHLAKPGNEADMALQPQFLAPAYRGSGKLEGLAALVTGGDSGIGRAVAVLYAREGADVAIVYLQEHEDARETARHVEAEGRRSLLIAGDVRDPVFCEEAVARTLREFGKLDILVNNAAYQEHASSLQDITDERLDETFRTNIYGYFHMARAALPHLKEGASIVNTGSVTGLRGHPKLLDYSSTKGAIHAFTWSLAANVAERGIRVNAVAPGPVWTPLNPADQAPEQIKDFGAKTALKRAAQPEELSPAYVFLASPACASYITGIVLPVTGTPGE

SEQ ID NO: 63082 - protein, 402 aa, Triticum aestivum
MLSVSSPRVHMSRNVVDLGLLAACRCRRWAARPAPRRRAPCVCFVAAPSQTGLAAIDVPAAETIASAAAGTARLPERVSIASLLDVVSDDLLKLNNNLKSLIGAENPVLVSAAEQIFGAGGKRLRPALVFLVSRATAEVAGLSELTTEHKRLAEIIEMIHTASLIHDDVIDDSGMRRGKETIHQLYGTRIAVLAGDFMFAQSSWFLANLENIEVIKLISQVIKDFASGEIKQQSTLFDCDVTLDDYLLKSYYKTASLLASSTRSAAIFSGVSTAVCEQMYEYGRNLGLSFQVVDDILDFTQSAEQLGKPAGSDLAKGNLTAPVIFALQESPELREIIDSEFCDTGSLSAAMELVHRSGGIRRAQELAKEKGDLALQNLQCLPRSHFRTALENMVKYNLERID

SEQ ID NO: 63083 - protein, 190 aa, Desulfitobacterium hafniense DCB-2
MEVTRRGFLKLSGASLFALASGLGFDPQIAQAQGFSLRIEGTTKIPSICHFCSGGCGLLLHIKDEKLVYLDGDPDNPVNSGALCPKGASLGHVANAKDRVTKPRYRAPGSSDWQDISWDEAINKIASKIKEVRDTTWMATEEIGGTAYNVNRADGIAVLGSAEVDNEESYLIKKLSELIGTPYNEHQARI

SEQ ID NO: 63084 - protein, 248 aa, Bradyrhizobium sp. BTAi1
MGPSLHSIQGEGTMMRMKDQRAGLARRLSLAAAALFLLAGASSRPALAMSPVSPGVGSRAQAPSDALTIQVRGPGGHGGGGGFHGGGGFHGGGGFHGGGGFHGGGGGFHAGPAFHGGGAMFRGGGGPAFHGGHAFGGGGPRPVFHGGGPVFHGGGGPRPIFHGGGYHHHPHYAYRPYFHHHRRHFYGYRSYYYPTYTTGYYYPYRRCRVVWTHYGPRRICHYRHWRGHHWRHHHRWHHRHHRHHWRYY

SEQ ID NO: 63085 - protein, 755 aa, Pseudomonas putida KT2440
MTGAFSIMTADNSLADAMERCAQEPIQVPGSIQPHGFLLVLDATDLRVLQASENVEHWLGLPARELIGCHFADLVHEGFDLHAHLTRLPEDEVFPFHIGDVRLRQGAPISALLHMLVHCHDQVLIAEFEPPRLPADLVGQGDYYPLVRSFVASLQVASSIEDLLQQTVLQLKRITGFGRVKAYRFDAEGNGQVLAEVVDPGYPSYAGLCFPAADIPRQARELYRVNRIRVIEDANYQPSPLLPATNPRTGKPLDMSFAALRSVSPVHLQYMRNMGTLASMSLSIVVDGQLWGLISCHHQQPRPVDLRTRTACELLASVLSLQIESRESHASTRKLLTLRQHIVRMISSMADHDSVSDGLRDLPEVLLAFADAQGAAVISAERCDLIGQTPPEAQVTALVHWLGQRDEDKVFHSDNLRRDITELPELANHAGGVLAVAISQIHSHYLLWFRPEQIRTVNWAGQPTKQVGPQGNLDPRHSFERWQEEQRGYSQAWDPLVIEGVIELRAAVLGIVLRKAEELAQLAGELRRSNKELEAFSYSVSHDLRAPLRHIAGYTELLGEIEGQGLSERGKRFLQHIGEAAHFAGSLVDNLLNFSQMGRSALRLSDVDLNALVEAIRSELAPDYEGRAIVWDIAPLPKVIGDPAFINMALHNLIANAIKYTRGRTPARIEISAVQHPEETEVCIRDNGVGFDMAYANKLFGVFQRLHRMEDFEGTGIGLASVRRIIERHDGRVWATGQVDQGASFHFTLPRNTAT

SEQ ID NO: 63086 - protein, 127 aa, Bradyrhizobium sp. BTAi1
MNLIQQLEKEQFDKLSANKTIPEFGPGDTVIVNVKVVEGDRTRVQAYEGVCIGRSGGGINESFTVRKISYGEGVERVFPILSPMIDSIKVVRRGKVRRAKLYYLRQLRGKSARIVEKQDRQQAAVNE

SEQ ID NO: 63087 - protein, 1287 aa, Streptococcus pneumoniae
MRKTPSHTEKKMVYSIRSLKNGTGSVLIGASLVLLAMATPTISSDESTPTTNEPNNRNTTTLAQPLTDTAAGSGKNESDISSPGNANASLEKTEEKPATEPTTPAASPADPAPQTGQDRSSEPTTSTSPVTTETKAEEPIEDNYFRIHVKKLPEENKDAQGLWTWDDVEKPSENWPNGALSFKDAKKDDYGYYLDVKLKGEQAKKISFLINNTAGKNLTGDKSVEKLVPKMNEAWLDQDYKVFSYEPQPAGTVRVNYYRTDGNYDKKSLWYWGDVKNPSSAQWPDGTDFTATGKYGRYIDIPLNEAAREFGFLLLDESKQGDDVKIRKENYKFTDLKNHSQIFLKDDDESIYTNPYYVHDIRMTGAQHVGTSSIESSFSTLVGAKKEDILKHSNITNHLGNKVTITDVAIDEAGKKVTYSGDFSDTKHPYTVSYNSDQFTTKTSWRLKDETYSYDGKLGADLKEEGKQVDLTLWSPSADKVSVVVYDKNDPDKVVGTVALEKGERGTWKQTLDSTNKLGITDFTGYYYQYQIERQGKTVLALDPYAKSLAAWNSDDAKIDDAHKVAKAAFVDPAKLGPQDLTYGKIHNFKTREDAVIYEAHVRDFTSDPAIAKDLTKPFGTFEAFIEKLDYLKDLGVTHIQLLPVLSYYFVNELKNHEHLSDYASSNSNYNWGYDPQNYFSLTGMYSSDPKNPEKRIAEFKNLINEIHKRGMGAILDVVYNHTAKVDIFEDLEPNYYHFMDADGTPRTSFGGGRLGTTHHMTKRLLVDSIKYLVDTYKVDGFRFDMMGDHDAASIEEAYKAARALNPNLIMLGEGWRTYAGDENMPTKAADQDWMKHTDTVAVFSDDIRNNLKSGYPNEGQPAFITGGKRDVNTIFKNLIAQPTNFEADSPGDVIQYIAAHDNLTLFDIIAQSIKKDPSKAENYAEIHRRLRLGNLMVLTAQGTPFIHSGQEYGRTKQFRNPAYRTPVAEDKVPNKSHLLRDKDGNPFDYPYFIHDSYDSSDAVNKFDWTKATDGKAYPENVKSRDYMKGLIALRQSTDAFRLKSLQDIKDRVHLITVPGQNGVEKEDVVIGYQITAPNGDIYAVFVNADEKAREFNLGTAFAHLRNAEVLADENQAGSVGIANPKGLEWTEKGLKLNALTATVLRVSQNGTSHESTAEEKPDSTPSKPEHQNEASHPAHQDPAPEARPDSTKPDAKVADAENKPSQATADSQAEQPAQEAQASSVKEAVRKESVENSSKENISATPDRQAELPNTGIKNENKLLFAGISLLALLGLGFLLKNKKEN

SEQ ID NO: 63088 - protein, 556 aa, Coccidioides immitis RS
MSINSVPIAPFSDQKAGTSGLRKKVTVFQQPHYTESFITSILTSIPEGAEGAFLVIGGDGRYYNTEVIQLIAQIGIAYGVKKLVIGQNGILSTPAASHVIRKRKATGGILLTASHNPGGPNADFGIKYNLSNGAPAPESVTNKIYEVSKSLAVYNIVSLPKIDLTKIGTGNYEGLEVEIIDSTADYVEMMKEIFDFDLIRSFLRSHGHFKVLFDALHGVTGPYGKAIFIKELGLPESSCQNCEPKPDFGGGHPDPNLTYARSLVEKVDKEEIQFGAASDGDGDRNMIYGAKTFVSPGDSLAIIAHHAQLIPYFKKHGVHGLARSMPTSGAVDLVAKAQGLQCYEVPTGWKFFCALMDTNKMSICGEESFGTGSNHIREKDGVWAVVAWLNIIAGVGQANPEKPASIAAIQTEFWKTYGRTFFTRYDYENVDSTGANKVIEHLRELITTKKDDFVGSTVSGRKVLGADDFAYTDLDGSVSKNQGIFIKFDDGSRIVVRLSGTGSSGATIRLYVERHESDEKEFSKDAQDYLKENIDLAVKLLKLKEYVGREEPTVKT

SEQ ID NO: 63089 - protein, 177 aa, Glycine max
  misc_feature (58)..(58): Xaa can be any naturally occurring amino acid
VSSMISSPAVTTVNRAGAGMVAPFTGLKSMVGFPTRKTNNDITSIASNGGRVQCMQVXGQPIGKKKFETLSYLPDLDDAQLAKEVEYLLRKGWIPCLEFELEHGFVYREHNRSPGYYDGRYWTMWKLPMVGCSEALQVMNELLAVKTVYPTGFILLIVSDNVRQVLCIIFIYYNSAS

SEQ ID NO: 63090 - protein, 450 aa, Xanthomonas campestris pv. vesicatoria str. 85-10
MPHHLPSDAADALQAPTQLDAFWMPFTANRQFKSRPRLLASAQGMHYRDVHGRQILDGTAGLWCCNAGHGRERIVAAIREQAGTLDFAPTFQMGSPLPFVLAQRLAAIAPPGLGHVFFTNSGSEAVDSAMKIVLAYHRLRGEGQRTRFIGREKAYHGVGFGGMSIGGLPNNRKWFGPLLSGTDHLRHTLDLQRNAYARGLPAHGAELADDLERLITLHDASTIAAVFVEPVSGSAGVILPPEGYLQRLRAICDRHGIVLVFDEVITGFGRVGNAFAAQRFGVTPDIITAAKGLTSGTVPMGAVLVADAIFDAFMHGPQNAIELFHGYTYSGHPLACAAAIATLDTYAEEELFTRAITLGLQWEDALHGLRGSPHVIDIRNIGLIGAIELAPRDGAPGARGYEVFERCFHEGGLLVRVTGDVIALSPPLIVTPEQIGQMVETLGKMLRQVD

SEQ ID NO: 63091 - protein, 377 aa, Brassica napus
MAEADDIQPIVCDNGTGMVKAGFAGDDAPRAVFPSVVGRPRHHGVMVGMNQKDAYVGDEAQSKRGILTLKYPIEHGVVSNWDDMEKIWHHTFYNELRIAPEEHPVLLTEAPLNPKANREKMTQIVFETFNSPAMYVAIQAVLSLYASGRTTGIVLDSGDGVSHTVPIYEGFSLPHAILRLDLAGRDLTDYLMKILTERGYMFTTTAEREIVRDIKEKLSFVAVDYEQEMETSKTSSSIEKNYELPDGQVITIGAERFRCPEVLFQPSFVGMEAAGIHETTYNSIMKCDVDIRKDLYGNIVLSGGTTMFSGIADRMSKEITALAPSSMKIKVVAPPERKYSVWIGGSILASLSTFQQMWISKAEYDEAGPGIVHRKCF

SEQ ID NO: 63092 - protein, 294 aa, Staphylococcus sciuri subsp. sciuri
VLGVSKDASKDEIKKAYRKLSKKYHPDINQEEGADAKFKEISEAYEVLSDENKRAQYDRFGHSGPQQGFGGSQGFGGQDFSGFGGFEDIFGSFFGGGGARRDPNAPRQGDDLQYSMTLTFEEAVFGTEKDITVRKDVECETCHGNGAKPGTNKKTCTYCNGQGHVTVEQNTILGRMQTQKVCPECEGSGQVFEEKCSDCHGKGTQNKKVTIKVKVPEGVDNDQQIRLAGKGGPGINGGPAGDLYVVFRVKPHSKFRRDGDNIFYDLNLSFPQAALGDEITVPTLTGNVSLTVPA

SEQ ID NO: 63093 - protein, 294 aa, Staphylococcus simulans
VLGVSKDASKDEIKKAYRKLSKKYHPDINKEEGADEKFKEITEAYEVLSDENKRANYDQFGHNGPQGGFGGQGFGGQDFSGFGGGFEDIFSTFFGGGGAQRDPNAPRKGDDLQYTMTISFEEAVFGAEKEISIRKEVKCETCDGSGAKPGSKKKTCHYCNGAGHVSVEQNTILGRVRTEKVCPVCNGTGEEIEEPCPTCHGKGTQTKNVKIKVKVPKGVDTDQQIRLAGEGAPGHNGGPQGDLYVVFRVKPSDKFIREGDDIFYNLKISFPQAALGDEVKVPTLDGEVILTVPE

SEQ ID NO: 63094 - protein, 294 aa, Staphylococcus succinus
ILGVSKDASKMKLKRLTVNYQNNIIQILIKKKVPTRNSKEISEAYENLSDDNKRANYDQFGHNGPQGGFGGQGFGGQDFSGFGGGGFEDIFSSFFGGGRQRDPNAPRKGDDLQYTMTVTFDEAVFGSEKEISIRKDVSCHTCHGEGAKPGTKKKTCEYCSGSGHVSVEQNTILGRVRTEKVCPVCSGSGQEFEEPCPTCKGKGTENKSVKISVTIPEGVDNEQQIRLAGEGAPGENGGPQGDLYVVFRVKPSETFERDGDDIYHSLNISIAQASLGDEVKVPTLKGVVMVTIPS

SEQ ID NO: 63095 - protein, 327 aa, Yersinia pseudotuberculosis IP 32953
MVKKIGVLTSGGDAPGMNAAIRGVVRAALSAGLDVFGIEDGYLGLYENRMKKLDRYSVSDMINRGGTFLGSARFPEFRDPEVRKVALKNMHERGIDGLVVIGGDGSYAGADLLTKEGGIHCVGLPGTIDNDVAGTDYTIGFFTALETVVEAIDRLRDTSSSHQRISIVEVMGRYCGDLTLAAAIAGGCEFIAIPEVEFKRDDLVAEIKAGIAKGKKHAIVAITEKLDDIDSLAKYIEKETGRETRGTVLGHIQRGGAPVAYDRILASRMGSYAVDLLLQDHDYKKGGFCVGVQNEKMVHELISVCIAPENKKSKFKEDWYDTAKKLF

SEQ ID NO: 63096 - protein, 505 aa, Mesorhizobium loti MAFF303099
MNKVEFSRPVKAPFDKRYGNFIGGKWTEPRSGRYFENHSPVNGQLLCEVARSDADDIEAALDAAHAAKDAWGRTSVAERSLILNRIADRMEENLDLLACAETWDNGKPIRETTVADLPLAIDHFRYFASAVRGQEGSLSQIDDDTVAYHFHEPLGVVGQIIPWNFPLLMACWKLAPALAAGNCVVLKPAEQTPAAILLWADLIGDLLPPGVLNIVNGFGLEAGKPLASSPRIAKIAFTGETTTGRLIMQYASQNLIPVTLELGGKSPNIFFKDVVAEDDDFFDKAIEGFVMFALNQGEVCTCPSRALIHESIYDRFMERALKRVEAIVQGDPLDPATMIGAQASSEQLEKILSYIDIGRQEGAEVLTGGARNVLPGDLAGGYYVKPTVFRGHNKMRIFQEEIFGPVVSVTTFKDDDEALSIANDTLYGLGAGVWTRDGNRAYRFGRAIQAGRVWTNCYHAYPAHAAFGGYKQSGIGRETHKMMLDHYQQTKNMLVSYSPKKLGFF

SEQ ID NO: 63097 - protein, 128 aa, Streptomyces coelicolor A3(2)
MTSSSPTGGGPGRPSALAPEIADRLKRSADGLLPAIAQQYDTGEVLMLGWMDDEALHRTLTTGRCTYWSRSRGEYWVKGDTSGHFQWVKSVALDCDADTVLVKVDQVGAACHTGTRTCFDTDVLLADQ

SEQ ID NO: 63098 - protein, 205 aa, Arabidopsis thaliana
MEKNISISKKLGNIVRFVLYMLHKGISKQKLLADFNATLKRGKNLMFHNRRRVPGSAVASHPQNEYEFSCSDTPNYTFPFNMAAFKKKSHHNSLFSCGQAPPTLDDDTSVSRAVLELLNSGGDHDQGSNTPAFSIEALTALSPYLPGFGRSTSSVRPLRVTDSPFPLREEGDVANGHVDKAADEFIKKFYKNLYQQKKMIESSPN

SEQ ID NO: 63099 - protein, 1139 aa, Bordetella parapertussis 12822
MQQLGATRRYAASDLVGFLACEHLTQLDLRALNAGQAPAAAADEQMALVQAKGQAHEQAWLERLRARHPDLADVTRAGPDLAARLAATRAAMAAGAPVIYQAALCHGPYVGHADFLLRTECPSALGDYGYEALDTKLARSPRASFVLQLSFYAWLLEHAQGVAPRSMHVVLGSGRELALRVADYAHYLRQVLRRFEAAIAAEPAPPTYPEPCEHCPQCRWRVGCEARRVADDHLSLVAGMSRQQARRLNAQGVATLAQLGALPEHAQVAGIEAGTLQRLRAQAALQWRARVDGARHYELLAAQDEGPRGLARLPRPDPGDMFFDMEGDPLEDGGLEYLFGLYVVDDGAERFVPFWAHDRRQERQAFEAFMDFVAERLRRHPDAHIYHYAPYEATALKKLMSLHGTREAEVDHLLRAGKLVDLYRVVREGLRISEPSYSIKYVERFYLPRRAGEVTNAGASIVYYERWKAAGEPRLLQDIADYNRDDVVSTWRLRDWLCGIRPAGLPWHNEADQQDLDAARAVIGEMTEAERRLLPYRAALADDLPADEAAWSPRDAFRALAWHLLDFHRREQKPAWWAWFARGEATDGELIEDAECLGGLVRDDAAPPVRQAQSLRYTYRYPAQETKLRTGARCTDVRTGASLANLVVDPHARLASFTCSARKPAPPPRMALGPAAPVNSKELVNAVFRYGDAVCRAPDGMSTPMRAVDALLRREPPRIRGLARGAPLVAPHAELLPQVLDVVARMDETTLFLQGPPGAGKTYTGSRVLLQLLRAGRRVAVSSNSHHAINNLLRGLERLAEREGFALRGAKKSASAGDDSCLGGRQIEDVFDNKDVDPARHQLVAGTAWLFARPEFEQAFDYLFVDEAGQVSLANLVAMGQCARNIVLLGDQMQLGQPSQGTHPGRSGESALEYLLDGQATIAASQGVFLDTSYRMHPEICGFISEAIYDGRLRAAPATAAHRLLLDEAAGRELPAHGIRYVPVPHDGNTQSSREEAARVAELCALLLRQRYVGEAGAPAPLRLDDILFVAPYNVQVNTLRAALPDGARVGTVDKFQGQEAQVVIVSMATSSGDYLPRDLEFLFSRNRLNVAISRARTLAILVASPALTAVRCRSAEQMALVNTLCWVAETGSASPYQV

SEQ ID NO: 63100 - protein, 273 aa, Synechococcus sp. CC9311
MRIRPLLAMVLALCLFVVTACSGGAEAIDRSNVTYDDIRNTGKANDCPTLPDSARGSISLTAGSAYELRGICMHPSQVFVKGEPANKRQEAQFVEGKILTRYTSSLDEVFGDLSVGANGLSFSEKGGIDFQPITVLVPGGEEFPFTFSSKNLQATADGSSLTTSTDFNGTYRTPSYRTSNFIDPKGRALTTGVDYPQGLVGLGGDYEELESENVKRYIDGTGEMSFSITKVDPETGEFAGVFTAIQPSDSDMGGREIVDVKISGEVFGRLEEA

SEQ ID NO: 63101 - protein, 116 aa, Ustilago maydis 521
MADTHTASVQEANAARLPLGYRDQCSASTLDDQGDGHAEKQRKQQLTTLFGFLVLGESRQFRLLIPLNKCRKQTLYAPWKCEDERHTYEKCQYDDFIRRQRELSQLKKAKLEAAEE

SEQ ID NO: 63102 - protein, 177 aa, Methanothermobacter thermautotrophicus str. Delta H
MKVDLEIDGSGKSSVNTGLGFLDHMLESVARHGLLDLEVEARGDLEVDDHHTVEDVALTLGEALREALGDKSGIRRMAHAMVPMDDALATVALDLSGRPYTVLELEFDDAVIGDVKSQNIGHFIESLAVSAAMNIHASVRGRNDHHKAEALFKALALAIRDAVRVEHGEIPSTKGKL

SEQ ID NO: 63103 - protein, 550 aa, Pseudomonas putida KT2440
MYVYDEYDQRIIEDRVKQFRDQTRRYLAGELSEEEFRPLRLQNGLYIQRFAPMLRVAVPYGQLNANQVRTLAKIARDYDKGYAHISTRQNVQFNWPALEDIPDILAELATVQMHAIQTSGNCLRNTTTDQFAGVAADEIVDPRPWCEIVRQWTTFHPEFAYLPRKFKIAINGSQEDRAAIEVHDIGLEPVRNAAGELGFRVLVGGGLGRTPVVGSFINEFLPWQDLISYLDAILRVYNRYGRRDNKYKARIKILVKALTPEVFAEKVEAEMVHLRGGTTTLTEAEVQRVSRHFVDPEYLALDNVDYTALDAEHPGFARWRSRNTRAHKRPGYVAVTLSLKPTGVAPGDVTDKQLDAVADLAERYSFGFLRTSHEQNIILADVEQRQLHALWLELRESGFATPNIGLLTDIICCPGGDYCSLANAKSIPIAESIQRRFDDLDYLFDIGEIDLNISGCMNACGHHHVGHIGILGVDKKGEEFYQVSLGGNAARGASLGKILGPSFAQDDMADVIEKLIAVYVEQRTEEERFIDTYQRIGIDPFKERVYAANH

SEQ ID NO: 63104 - protein, 873 aa, Xanthomonas campestris pv. vesicatoria str. 85-10
MLTRKHYSVFVHRTLTWIVGTFPLYFPARPHPEPALSSPSPAPVTPDLVCLRASARDKDDAIAQAAQLLVAAGCVAPGYDASMRRREGLANTFLGHGLAIPHGVGEDRHLVRRDGIAVLQLTDGVEWNPGQITRLVVGIAAQSDTHITLLRRLTRLIQDPAQLETLFSTDDPGVIVAALTGDRAPETNAAPATDLAETFEWTIAYPSGLHARPATRWAETARGFSARAQVRAGDQAADAKSLVGLLQLGLRAGDSITVSAEGSDAAELLRRLRAVMDSLTAQEKADAERAAQRRAAPVAGWTPPQAQPAIVGIGASPGVAIGIVHRLRAAQTEVADQPVGLGDGGALLHDALTRTRQQLAAIQDDTQRRLGASDAAIFKAQAELLNDTDLITRTCQLMVEGHGVAWSWHQAVEQIASGLAALGNPVLAGRAADLRDVGRRVLAQLDPAAAGAGLTDLPEQPCILLAGDLSPSDTANLDTARVLGLATAQGGPTSHTAILSRTLGLPALVAAGGQLLEIEDGVTAIIDGSSGRLYIDPSEQDLDAARTHIAEQQAIREREAAQRALPAETTDGHHIDIGANVNLPDQVAMALTQGAEGVGLMRTEFLFLESGRTPSEDEQHATYLAMAQALDGRPLIVRALDIGGDKQVAHLELPHEENPFLGVRGARLLLRRPDLLEPQLRALYRAAKDGARLSIMFPMITSVPELVALRAICARLRADLDAPEVPIGIMIEVPAAAAQADVLARHADFFSIGTNDLTQYVLAIDRQNPELAAEADSLHPAVLRMIRSTIDGARKHDRWVGVCGGLAGDAFGASLLAGLGVQELSMTPNDIPAVKARLRGAALSQLQHLAEQALACETAEQVRALEAKREDKA

SEQ ID NO: 63105 - protein, 295 aa, Staphylococcus warneri
VLGVSKGASKDEIKKAYRKLSKKYHPDINKEEGADEKFKEISEAYEVLSDDNKRANYDQFGHAGAQGGFGSQGFGGGDFGGFSGGGFEDIFSSFFGGASRQRDPNAPRKGDDLQYTMTITFDEAVFGGKKEISIRKDVTCHTCDGEGAKPGTNKKTCSYCNGAGSVSVEQNTILGRVRTEQVCPKCEGSGQEFEEPCPTCHGKGTENKTVKLEVTIPEGVDNEQQIRLAGEGSPGVNGGPSGDLYVVFRVKPSEVFKRDGDDIYYDLNISFPQAALGDEVKIPTLNSNVVLTIPA

SEQ ID NO: 63106 - protein, 295 aa, Staphylococcus xylosus
VLGVSKGASKDEIKKAYRKLSKKSHPDINKEEGADEKFKEISEAYEILSDDNKRANYDQFGHDGPQGGFGGQGFGGQDFSGFGGGGFEDIFSSFFGGGRQQRDPNAPRKGDDLQYTMTVTFDEAVFGSEKEISIRKDVTCHTCDGEGAKPGTKKKTCHYCSGAGHVSVEQNTILGRVRTEKVCPVCSGSGQEFEEPCPTCHGKGTENKNVKISVTIPEGVDNEQQIRLAGEGAPGENGGPQGDLYIVFRVKPSEKFERDGDDIYYSLDVSIAQATLGDEVKVPTLNGSVMLTIPA

SEQ ID NO: 63107 - protein, 411 aa, Triticum aestivum
  misc_feature (195)..(195): Xaa can be any naturally occurring amino acid
  misc_feature (220)..(220): Xaa can be any naturally occurring amino acid
  misc_feature (233)..(233): Xaa can be any naturally occurring amino acid
CISDYRTSLHKKAGWYRSGIPGISSTHASATCCAVLCRFLLAPLAVWIFLAYKYMKTRIIIDAVEKFLRIQQMIGPARYSYTDIVAVTSHFRDKLGQGGYGSVYKGVLLPGGVHVAVKMLEGNSNCNGEDFISEVSTIGRIHHVNVVRLVGFCSEEMRRALVYEYMPNGSLDKYIFSTEKSFSWDKLNEIALGIXARGINYLHQGCDMQILHFDIKPHNXILLDSNFVPKVAXFGLAKLYPRGDSFVPLSAMRGTVGYIAPEMISRSFGVISSKSDVYSFGMLLLEMAGGRRNADPNMGSSSQAYYPSWVYDRLTREEAGEISVVAADMHELEKKLCIVGLWCIQMRSRDRPTMSEVIEILEAGADGLQMPSRPFFCDEGHIQVEDSYQFASELSAVSEEELSVVSEEDDV

SEQ ID NO: 63108 - protein, 197 aa, Streptomyces coelicolor A3(2)
MSRVGRVERTTKETSVLVEIDLDGTGKTDIATGVGFYDHMLDQLGRHGLFDLTVKTDGDLHIDSHHTIEDTALALGAAFRQALGDKVGIYRFGNCTVPLDESLAQVTVDLSGRPYLVHTEPENMAPMIGEYDVTMTRHILESFVAQAQVALHVHVPYGRNAHHIVECQFKALARALRYASERDPRAAGILPSTKGAL

SEQ ID NO: 63109 - protein, 435 aa, Azoarcus sp. BH72
MEHEQALWLPFTANRAFWKQPRVISGARGHYYTTADGRELLDGFSGLWSCGLGHAHPGIVAAVQQQVATLDFSMTFQATNDKAIALAREVASMAPPGLHKVFFTNSGSESVDTALKIALAYHRARGDGHRTRLIGRERGYHGVNLGGTSVGGIAVNRKAFGAVLTPGVDHIRHTLSLPDMAFSRGQPSWGAHLADDLERLAALHDPSTIAAVIVEPVAGSTGILVPPVGYLERLRAICDQHGFLLIFDEVINAFGRLGAPFAATRFGVTPDLITTAKGLTNGVVPMGAVIVRQDIYDALMQGPEHAVEFFHGYTYSGHPLAAAAGLAALRAYREEDSFARVRALEPVFEDGLHSLRDEPNVVDIRNFGLMGGVELAPRDGVLGVRGFEVFLKCFEAGVVIRNGGDILQFAPFFDSTEDELARIFETVRAALRATA

SEQ ID NO: 63110 - protein, 541 aa, Zea mays
MDTAVSQNATVAAAATAAGVGSAGLAGLLPEVQTVELLVAVSIFVAIHSLRQRRTQGLPTWPLVGMLPSLLLGLRSDMYEWITGVLKARGGTFTFRGPWLTNLHCVVTADPRNLEHLLKTRFGSFPKGPYFRENMRDLLGDGIFGADDEVWRRQRKAASLEFHSAEFRALTASSLVELVHRRLLPVLAGAEAAAGAVDLQDVLLRLTFDNVCMIAFGVDPGCLRPGLPEIPFARAFEDATEATTVRFVTPTALWRAMRALGVGHERVLRRSLAGVDEFAYDVIRRRKEELADAAAAAGRRSDLLTVFTRMRDEDGRPYTDKFLRDICVNFILAGRDTSSVALAWFFWLLGKNPGVEAKILEEVEGIVAARKGAGEVVEEEEELVFRPEEVKRMEYLHAALSEALRLYPSVPVDHKEVVEDEVFPDGTVLKKGTKVIYAMYSMGRMESIWGDDCREYKPERWLRDGRFVGESAYKFTAFNGGPRLCLGKDFAYYQMKFTAASILRRYRVRVVEGHPVAPKMALTMYMKHGLKVTLTKRGKAN

SEQ ID NO: 63111 - protein, 279 aa, Xanthomonas axonopodis pv. citri str. 306
MPQCGFSAKAVGVLDGLGIDYAHVNVLADQEIREGIKAYGDWPTIPQLYVDGELIGGSDIIVQMADSGELSSMLGLQAPDRSPPKITITPAAVEMLKGALADAPDASLTLAIDANFQPNFQLAPTNPNAIAAESNGLRVQFDLASARRADGITIDWVDDIRGRGLAIDNPNAPKPVQELSVRDADDRLKAGSLTLVDVRPADERALATVAAPFRTLDAHERAAIEQLPKDTPLAFLCHRGGRSLQAAEHFRGLGFTNVYNVTGGIDAWSDEVDNGVAKY

SEQ ID NO: 63112 - protein, 1079 aa, Ustilago maydis 521
MSCNTASSDQDNRDPHFTATGLSAVDGDATSLFEYIIRDKNVIKPWHQRLSAEPSTQSNVDDQLAITVPFTCPVRLKSILINAGTGDFAPTRCRAFVNRPDGIDFDEVEQATADYHPADQTPLATAATLGNVGSGKAQADFALLRGEQGVVEYPVSVARFSHTNSITIVLSHSNATTLSRFFYLGFRGTALVLKAEPGERLNIGAANSADRPVDGVREKRGASQGLAGGSSRRTPPRYVVGDQAAAQRITQITEQAALTPRRSPRRNRNSAAAESPNTTPMRKRKPSPSQSGAGADDTESTPRDSQKSATTRTPKTAPPVRRRPSFSGPSASAGQQPSQETHGSQAQVSATASGSADPTRRRSLSQPPPNEVLLRQLHASNTTPSTKYPAAHLHARTPSHTAALTATPGRRILGTPRQPGPGMPSFWSNSVTAVSSSQPQTQAMQTPATDKRRKRNDALLASAQRTRERRLASRKSLLWGGVGGWAGGREESPMDLLRRLARAPDFVAPPTPSLDSISAPPGAARPGRSSTSSIIDASNSRTRARDSAASTSSRSSLSRATMLVPGESVPGDLTRDSNVSVSMDMDESLASASNEPGDRSRSRLSDIGIPRRASGVGLVRGGIFAGIADQFRASRLSTGSRVSFADQVSPSSMRFDDMSSRREDELERSLQQQNGGAQSFISASGIDLAKAKAIRRLDDLTRQSFFSDDGQLQYNQDEEDDEEEDESLEARRRKIVGRSMSETLDGEADGPVLFLGLGVTNDDDVQSQTRSDEEEQVSDTLAVEAADDDSDGLARRLDADNSRDLSDRLEISITGGDPDDSRASRVSFADQDQVSFQVNDAYSSDDAVEYRLSVPELDDDDDDNASDAERDASTRLNLLDPKDLNALLKRRIVKKRKSRVSPHTGLPLPPLPTSVMRDIFSSFLAPSSSTVSSSLLTSSSTSAKRAKLDATVLDELDSAAHDFFADFAANLLTQAKTRSRRSDAGTSITEADVVAVLKRQGRVTQRNDASSLAHKLLPRELTDQMELSRWAKAGTVQTTLSGMLRGSDRRKAKARGNEGVAETTMSSSVALDDEEVSIE

SEQ ID NO: 63113 - protein, 258 aa, Triticum aestivum
  misc_feature (3)..(4): Xaa can be any naturally occurring amino acid
  misc_feature (8)..(8): Xaa can be any naturally occurring amino acid
  misc_feature (10)..(10): Xaa can be any naturally occurring amino acid
  misc_feature (12)..(12): Xaa can be any naturally occurring amino acid
  misc_feature (14)..(15): Xaa can be any naturally occurring amino acid
  misc_feature (19)..(19): Xaa can be any naturally occurring amino acid
  misc_feature (26)..(26): Xaa can be any naturally occurring amino acid
  misc_feature (28)..(28): Xaa can be any naturally occurring amino acid
  misc_feature (32)..(32): Xaa can be any naturally occurring amino acid
  misc_feature (34)..(35): Xaa can be any naturally occurring amino acid
  misc_feature (48)..(48): Xaa can be any naturally occurring amino acid
  misc_feature (51)..(51): Xaa can be any naturally occurring amino acid
  misc_feature (57)..(57): Xaa can be any naturally occurring amino acid
  misc_feature (60)..(61): Xaa can be any naturally occurring amino acid
  misc_feature (71)..(71): Xaa can be any naturally occurring amino acid
  misc_feature (108)..(108): Xaa can be any naturally occurring amino acid
  misc_feature (127)..(127): Xaa can be any naturally occurring amino acid
  misc_feature (237)..(237): Xaa can be any naturally occurring amino acid
GSXXEFFXGXTXLXXAPQXLDWDLGXPXFPVXGXXTIGHVAAHRSNVXRVXVSFTHXLSXXEPAFSVLVSXFILGESFPMPVYLSLLPIIGGCGLAAATGLNFNMIGXMGAMISTLASVFRNIFSKXRGMKGKSVSGMNYYACLSIMSLVILAPLAIAMEGPQMWPAGWQKALADVGPNVLWWIGAQSVFYHLYNQVSYMSLDQISPLTFSIGNTMKRISVIVSSIIIFRTPARAAXLDALGAAIAIFGTFLYSQAKQ

SEQ ID NO: 63114 - protein, 308 aa, Streptococcus thermophilus CNRZ1066
MDLTFGVTVIRKWKRDIENSGHEAIGIVEEVGEQVTTVKPGDFVIAPFTHGCGQCDACRAGFDGSCDNHSGNNWSEGVQAEYIRFHFANWALVKILGQPSDYSEGMLKSLLTLADVMPTGYHAARVANVQKGDKVVVIGDGAVGQCAVIASKMRGASQIVLMSRHEDRQKMALESGATAVVAERGEKGIDKVREVLGGGADAALECVGTEAAVEQALGVLHNGGRMGFVGVPHYNNRSLGSTFAQNILVAGGVASVTTYDKQVLLKAVLDGDINPGRVFTTSYKLEDINQAYKDMDERKSIKSMIVLD

SEQ ID NO: 63115 - protein, 480 aa, Photobacterium profundum SS9
MTESVVRENQLIKRTLDDLPQPKGWPLLGNFLQLQSKNLHQVLEQWCLEYGDTYKVDIAGLLFVVIADPVVVKDILRRRPKSFNRTASLERVFKELGIHGVLSANGESWKRQRRLIMPAFSKKSLASFFPLLEQTTERLRLRLVKKRGQDTLAIHDDLRRFTVDITTSLVFGHDTRLLEHDGDGLQKHLEVIFPQLNSRTRMPFPYWQYIKFKKDRKLDQALIEVEKYALKIVEQTRDELQFNPQLADAPETILQAMVAASDDDNRLTNEELFANILTLLLAGEDTTSNLIAWMLYFISQRPDIQCKINEEAEQIRLKHKGQINVQGLDELTYLEAVARETLRLKSTAPMISAETADQVTLLDGTELPAGTGLFLMTRLGGLNKEHFKDAEQFRPERWQEEAVAAEACPHKATSHFPFGGGARHCPGETLAFMETKMVIAMLCQQFDISQPESPPVVEEYAITMRPKNLQICLRLKPVGR

SEQ ID NO: 63116 - protein, 524 aa, Coxiella burnetii RSA 493
MLKDIHQHRILILDFGSQYAQLIARRVREIGVYCELMPCDIDEETIRDFNPHGIILSGGPETVTLSHTLRAPAFIFEIGCPVLGICYGMQTMAYQLGGKVNRTAKAEFGHAQLRVLNPAFLFDGIEDQVSPQGEPLLDVWMSHGDIVSELPPGFEATACTDNSPLAAMADFKRRFFGLQFHPEVTHTPQGHRILAHFVIHICQCIPNWTTKHIIEDSIRDIQEKVGKEQVIVGLSGGVDSAVTATLVHKAIGDQLVCVLVDTGLLRLNEVDEVLNVFQKHLGAKVICVDAKDRFMKALKGISDPEEKRKIAGEQFIRVFEEQAKKLNVKWLGQGTIYPDVIESAKTKTGKGHIIKTHHNVGGLPLNMELKLIEPLRELFKDEVRKLGLELGLPADLIYRHPFPGPGLAIRILGEVSAEYINILKQADAIFIEELKKSDYYHQVSQAFAVFMPLKSVGVKGDARHYGYIIALRAVKTVDFMTAQWADLPHEFLSKVSHRIVNEIKEVSRVVYDMTNKPPATIEWE

SEQ ID NO: 63117 - protein, 514 aa, Legionella pneumophila subsp. pneumophila str. Philadelphia 1
MSHNAPLVLMILDGWGYNENDRYNAIAKANTPQWDEWWQTCPHILLKASGLPVGLPDEQMGNSEVGHMHIGAGRVIQQDFTRINEAINNGKFAKNAVFHEVIDQLKKTEKSLHIMGLLSPGGVHSHEQHLFALLALCNQKKFRSVHLHLFLDGRDTPPQSALDSLKCLNEELAKHPVATINSICGRYYAMDRDKRWERVEPVYNLLTQGKSERQFPDAETAIHFYYKNKISDEFVPPTLIGKEHSIQDGDAVLFFNFRADRARQLTSTFLDPSFKGFERKTLPKLSYFVSMTQYDKNLLTTTAFPPVPLNNTLGEVLSSHGLSQLRIAETEKYAHVTFFFNGGCESVFTNEERIMVPSPQVATYDLQPEMSAHELTKTLIAAINSQDYHVIICNYANADMVGHTGNFEATVQAIECLDQCMQQVWQALKNNGGKLLITADHGNAEEMFSEATNQAHTAHTSEPVPFLYVGGGWHFTHSEGSLIDIAPSLLALLGITPPPEMTGRILLEKNHAHP

SEQ ID NO: 63118 - protein, 1401 aa, Burkholderia xenovorans LB400
MSSTSVKTVCPYCGVGCGMVLHVEDGQVVKISGDKEHPANFGRLCTKGQSAHVALRKSGRLEGAFVRHARGRDPAPLPMTQAISATAARLRGLLDEHGPDALSFYVSGQMSIEAQYLVNKLAKGFVGTNNIESNSRLCMASAGSGYKLSLGADGPPGSYEDIDHADLFFVIGANMADCHPILFLRMMDRVKAGAKLIVVDPRRNTTAEKADLFMQIKPGTDLALLNGLLHLLHENGHTDAAFIAEATEGWEAMPAFLADYTPEKAAQITGLAVEDIRAAAQMIGSANEWISCWTMGLNQSTHGTWHTNAICNLHLATGKICRRGSGPFSLTGQPNAMGGREMGYMGPGLPGQRSVLVEEDRAFIEDLWRIPKGTLKPEAGNGTIDMFTRMAAGEIKACWIICTNPVASVANRQNAIDGLRAAQLVIAQDAFLDTETNRYADVLLPGALWAEAEGVMINSERNLTLMQKGVEPPGAALPDWQIIARIACEMGYAEGFTYASAEEVFAEITRVSNPKTGYDLRGASHRRLKETPLQWPLASDESAERNPVRYLNDGVSQTLKELADGSRPRLVFPTASCKAVFFARAYAAPAELPDREFPIVLNTGRLQHQWHTMTKTGKVAMLNKLNPAPFVEIHPEDATTLGIKAQDPVEIRSRRGRAVLPAVVTERVSAGSCFAPMHWNDVFGDDLCINAVTSDAVDPISQQPELKFCAVALSPVAADSRQPLLTDDDATITDASVAVAVSAAPGNTVSASAEDLDMPRIDALTSLLQLPPTPAPSFNDQQRLYLAGFVSGLRSAEAKGIDSTPVLPGNAPFDTTSRLYVDGLLAGLYSRSAMVPAASAPTLAVSHAETSHASGVRIVRARPKVTLLWASQTGNTESLTEGYATRLMESGFEIRTSCMADYPASALAKAQYVLLMTSTFGDGDPPDNAQSFWTQLSGEGAPRLDGVRFAVLALGDRNYDQFCGHGRRLDERLAGQGAQRLMDRVDCDSEYQASADAWLERIIVRIKEEDAALYAVPAGGMVNAVVPGTVPTKTRPAASRLVSNLRLNKQGAAKDTRYVSLHTGDSGLEYEAGDALGVWPSNCPELVDELIGLSGLHADAAVNVAGAGEMRLADALGKHYEIARPNPDLLAFVAARSNNGALRDLLAPDRKADLKQWLWGQQIADVLHEFPVSLTASELTGMLKRLQPRLYSIASSPKAHAGEVHLTVAAVRYSNGRRHRKGVSSTFLADRAGDVNVPVFVQKSAHFRPPHGSETPMIMVGPGTGVAPFRGFLHERRARGDTGRNWLFFGEQHAASDFYYRDELESMRDSGVLTRLDVAFSRDQADKVYVQDRMREQGAQLWAWLEDGAHFYVCGDANRMAKDVDAALKEVVARHGGMSDDKALEYVSRLAQEKRYARDVY

SEQ ID NO: 63119 - protein, 507 aa, Zea mays
MASNGCNGNGNGKAAPAGVVVPEIKFTKLFINGEFVDAASGKTFDTRDPRTGDVLAHVAEADKADVDLAVKSARDAFEHGKWPRMSGYERGRIMSKLADLVEQHTEELAALDGADAGKLLLLGKIIDIPAATQMLRYYAGAADKIHGDVLRVSGRYQGYTLKEPIGVVGVIIPWNFPTMMFFLKVSPALAAGCTVVVKPAEQTPLSALYYAHLAKMAGVPDGVINVVPGFGPTAGAALASHMDVDSVAFTGSTEVGRLIMESAARSNLKTVSLELGGKSPLIIFDDADVDMAVNLSRLAVFFNKGEVCVAGSRVYVQEGIYDEFVKKAVQAARSWKVGDPFDVTSNMGPQVDKDQFERVLKYIEHGKSEGATLLTGGKPAADKGYYIEPTIFVDVTEDMKIAQEEIFGPVMSLMKFKTVDEVIEKANCTRYGLAAGIVTKSLDVANRVSRSVRAGTVWVNCYFAFDPDAPFGGYKMSGFGRDQGLAAMDKYLQVKSVITALPDSPWY

SEQ ID NO: 63120 - protein, 243 aa, Triticum aestivum
MASRLLHHFLLLAALLLLIGGASSAGDVVAAGNGKVRMELYYESLCSDSFQFMVDSLARVFKDGLLDAADLTLVPYGNAKVDAHGAITCQHGPDECLLNTVEACAIDAWPDVKVHFGFINCVEELAMEYKHQEWQSCFQKQGLNPKPVMECYKSEHGHKLSLKYGRQTDALLPRHTSVPWVVVDSKPLYDNFGDFVAYICKAYKGRPPKICQHRHAGPWLSDRTTGGGGRQPCRLQLRRFRAQ

SEQ ID NO: 63121 - protein, 108 aa, Oryza sativa (japonica cultivar-group)
MEGGRGVTRVLLVDDSPVDRRVVQLLLSSSACAGSFHVIAVDSAKKAMEFLGLKEEGKEQAIDMVLTDYCMPEMTGYELLKAIKALSPLKPIPVIVMSSENEPQRISR

SEQ ID NO: 63122 - protein, 144 aa, Triticum aestivum
  misc_feature (108)..(108): Xaa can be any naturally occurring amino acid
  misc_feature (116)..(116): Xaa can be any naturally occurring amino acid
  misc_feature (131)..(132): Xaa can be any naturally occurring amino acid
  misc_feature (143)..(143): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCLEFNKVGFIFREQNATPGYXNGGTGTMXWKLPMFGVQPTPRKXXTKVEEVKEREXP

SEQ ID NO: 63123 - protein, 748 aa, Filobasidiella neoformans
VSQSHPNIVDGWFREINTQWPGQAMTLKVKQILHQEKSLFQDVLVFESETYGNVLVLDGVIQATERDEFSYQEMITHLPMASHPNPENVLVIGGGDGGVIREVLKHKSVKKVTLCDIDEAVIRVSKQWLPLMSDCYKDSRVEVHIGDGFKFLPEHKNEYDVIITDSSDPVGPAEALFQPPYFQLLKEALKEGGSVSTQAECLWVHLPLIKTLKETCSKLFPVVKYGFTTIPTYPAGQIGIMVCSKDSTRDLTVPLRAVPTPRYYNSEVHRAAFTIPEFGRAMLEDGVNVLPKFSGARPTPTTTKKKVLLLGSGLVAGPAADYIARHNHELTIACRTLASAQDLASGLPNATPMSVDVSSADALRQAIKGHDVVVSLIPYTYHAQVMEAALEEKVHVVTTSYVNPQMRALEQKFKDAGLICFNEIGVDPGVDHLWAIKVFDEVKKAGGKIKSFYSFCGGLVEPAAADNALGYKFSWSPVGVLMALNNDGKYLKDGKVVEVAGKDLMSTAKPYYFTPAYNLVAYPNRDSTVFREFYGLEGVQNLCRGTMRYAGFCEVITAWKEIGLMSDAQVDYLAQGAAPITWIKVVSQLLGVEAKEAAVIEKLKTLKSFETESRVLITKFRDLGLFSEEQVAQRGSVMRALSALLEEKCAFKEGEVDLVLLQHTFEIINADGSEQTITSSLEAYGDRNGGPSAMAKLVGVPCGMAVQFILEGVLNKPGVFAPYDEETCKLFRERLEKEEGITMVEKLV

SEQ ID NO: 63124 - protein, 490 aa, Pseudomonas syringae pv. phaseolicola 1448A
MARFELQKLYIDGGYVDASNTETFDAINPANGEVLAQIQRAGKEDVERAVVAAEKGQKIWAAMTAVERSRILRRAVDILRERNDELAALETLDTGKAISETRYVDIVTGADVLEYYAGLVPAIEGEQIPLRDSSFVYTRREPLGVVAGIGAWNYPIQIALWKSAPALAAGNAMIFKPSEVTSLTTLKLAEIYTEAGVPNGVFNVLTGSGREVGTWITEHPRIEKVSFTGGTDTGKKVMASASSSSLKEVTMELGGKSPLIVFDDADLDRAADIAMMANFYSSGQVCTNGTRVFVPNALKAEFEAKILERVKRIRAGNPEDENINFGPLVSFEHMESVLGYIAKGKEQGARLLCGGDRLTGGVFDKGAFVAPTVFTDCTDEMTIVREEIFGPVMSILGYDTEEEVVRRANDTDFGLAAGIVTRDLNRAHRVIHLLEAGICWINAWGESAAQMPVGGYKQSGVGRENGISSLAQYTRIKSVQIELGDYASVF

SEQ ID NO: 63125 - protein, 520 aa, Arabidopsis thaliana
MASVSAIGVLKVPPASTSNSTGKATEAVPTRTLSFSSSVTSSDDKISLKSTVSRLCKSVVRRNPIIVSPKAVSDSQNSQTCLDPDASSSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVTDYLWLFEEHNVLEYLILAGDHLYRMDYEKFIQAHRETDADITVAALPMDEQRATAFGLMKIDEEGRIIEFSEKPKGEHLKAMKVDTTILGLDDQRAKEMPFIASMGIYVVSRDVMLDLLRNQFPGANDFGSEVIPGATSLGLRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETATEKSLLAAKGSVPIGIGKNSHIKRAIIDKNSRIGDNVKIINSDNVQEAARETDGYFIKSGIVTVIKDALIPTGTVI

SEQ ID NO: 63126 - protein, 565 aa, Oryza sativa
MEVGVSLEAGKPAAAPWGMLYYGVPALLVLGALYRAAERCWLGPRRVAGALQGQGLRGTAYRFPAGDLPENARRSKEARAKPMPPCHDIVPRVAPLLQDIVKEYGNVCITWFGTTPRVVIAEPELVKDILSNKFGHFEKFTLKSLGKLIALGLASYEGEKWARHRRILNPAFHLEKLKHMLPAFSTCCSEMIDRWDSKLAGSDGPFELDIWQEFQNLTGDVISRTAFGSSFMEGRRIFQLQEEQADRIIKTIQYIYIPGYLYFPTENNRRMKENSREIEGLLRGIIEKRSRAVENGELSGDDLLGLMLKSNMDSGEPSNLRMSTEDVIEECKLFYFAGMETTSVLLTWTLVVLSMHPEWQHRAREEVLSAFGRDKPNFDGLSRLKTASACQNLNIFLHPYLITSGSTHVNLLTMPRYSVYLLQVTMILHEVLRLYPPAVTLSRRTFKEIQIGGITYPAGVGLELPIILIHHNTDVWGKDAHEFKPERFADGISKATKTNQQAFFPFGWGPRICIGQNFAMLEAKMALCVILQNFEFQLSPSYTHAPYASVTLHPQHGAQIILTRL

SEQ ID NO: 63127 - protein, 411 aa, Bradyrhizobium sp. BTAi1
MTEIRVPTLGESVTEATIGRWFKKAGDAVAVDEPLVELETDKVTIEVPAPSAGTLGEIIAKDGETVAVGALLGQINDGAVAAKPAAAAPAPAKPAAAPAAAAPAPAKALPADTPQAPSVRKLSAESGVDATTVPGSGKDGRVTKGDMLAAIERAASAPTPVNQPAAAVQVRAPSPADDAAREERVKMTRLRQTIARRLKDVQNTAAMLTTFNEVDMTNVMALRSQYKDVFEKKHGSKLGFMGFFTKAVVQALKDIPAVNAEIDGSDLIYKNYYHIGVAVGTDKGLVVPVVRDCDHKSIADIEKGIADFGRRARDGQLKIDEMQGGTFTITNGGIYGSLMSTPILNAPQSGILGMHKIQERPVVVGGKIEIRPMMYLALSYDHRVIDGKEAVTFLVRVKESLEDPARLVLDL

SEQ ID NO: 63128 - protein, 805 aa, Lactobacillus plantarum WCFS1
MRISTTWLRDYLKLDIPADELAEKIERTAVEVDGVIRPSEGLKKVVVGHVLTCEPHPDSDHLHVCQVDVGESEPLQIVCGAPNVAAGEKVIVALPNSWIGGHTKIKKSKMRGVPSNGMLCALDELGFDEKLVPKEVADGIFILPDDATPGDPVFSYLGMDDEIIDMSVTPNRGDMLSMNGTAHELAAIYDQQPTMPKVDLYEDATTVAADDLHVAVAADEHDVPMYKMRLIKNVTIKPSPLWLQIRIWNAGMRPINNVVDATNYILMQYGQPLHAFDFDQLNDGQINVRLAKAGEHLTTLDGEDRELLTSDLLICSGDQPICLAGTMGGLATEVTDQTTTIALEGAVFDAVKIRKTAHNHDLHSEASMRYERGIDHGMTATALDAAAAMIAELGDGQVASGMVIGRDEDVQPTTVTIDLARINHVLGTELSLDTVSDIFKRLDFPTVVANETFTVTVPSRRWDIHIPADLIEEIARLYGYDNLPATLPTGQPTIGKLNETQQVIRDSRKLMESAGLTQAISYSLTTETKSKAFALHASDVTKLDFPMSSERTTLRLSLVSGLLDDLAYNNARKEHNVALYEEGRVFYSQPEQVRPKEIEHIAGAITGSMVPKSWGVAEQPVDFFQIKGIVAGYLKSLALQDAVSYVATAEHPEMHPGRTADIYVGDQLVGFVGEVHPTTAKAYKIRETYVFELDLTALIALPKARQQYQPISKFPSITRDVAMLIDDDVTNATVVALINKKGGAHLRHVQLFDVYNGSHVPAGKKSLAYTLTYQDQNATLVDDDVTTAFEKVLTALTDELGAEIR

SEQ ID NO: 63129 - protein, 728 aa, Oryza sativa (japonica cultivar-group)
MSLPAISLYTSPPPGAVYSSEFDPSSRGSSPPCSTAPPSTSHRPPAAAGGLSCLFSSPAAAASPPRAPPHDELGALWQDRSDEPAFAGGGGGYSSSPLKWRDLHHHHHHSPVSVFQGPSSSPAASRSPPASWLAGRDRDRERLFAGFVRNALGSCVDYAPALSPRSEVGGGELAFELDENLAEASPACEPCARELLAGAQARHRIFHEELVVKTFFEAEKAHRGQTRASGDPYLQHCVETAVLLANIGANSTVLQHCVETAVLLANIGANSTVVSAGLLHDTIDDSFIDYDHIFHMFGAGVADLVEGVSKLSHLSKLARDNNTASRIVEADRLHTMLLAMADARAVLIKLADRVHNMKTLEALPLGKQQRFAKETMEIFVPLANRLGIASWKDQLENLCFKHLNPEEHKDLSSKLTKSFDEVLITSAVDKLDRGLRDAGLSYHNLSGRHKSLYSIHNKMLKKNLTMDEIHDIHGLRLVFEKEEDCYRALDVVHELWPQVPGRFKDYISRPKLNGYRSLHTVVMSENVHPFEVQIRTKEMHLQAEYGFAAHWRYKEGTCRHSFVLQMVEWARWVLTWQCEAMNKERPASLGDSDAIRPPCPFPMHSEDCPYSYTRQCDHDGPIFVILLEHDKMSVQEFQANSTVMNLMDRVGTNTPRWSPYRIPMKEDLRPKVNHEPISDLNRKLSMGDVVELTPALPHESLPNYREEIQRMYDRGGFALATRGGSSRR

SEQ ID NO: 63130 - protein, 467 aa, Bradyrhizobium sp. BTAi1
MANYDLVVIGTGPGGYVCAIRAAQLGMKVAVVEKNATLGGTCLNVGCMPSKALLHASELFEEAGHSFAKMGIKVPAPEIDLPAMMNFKQQGIDGNVKGVEFLMKKNKIDVLQGKGKILGTGKVQVTGNDGTAQTVETKNIVIATGSDIARLKGIEIDEKRIVSSTGALSLDKIPSSLLVVGAGVIGLELGSVWRRLGAKVTVVEFLDRILPGMDLEIAKQFQRILEKQGFAFKLGAKVTGVDTSGATLAATIEPAAGGAAEKIEADVVLVAIGRVPYTDGLGLQEAGVVLDNRGRVQIDHHFATSVPGVYAIGDVVAGPMLAHKAEDEGVAVAEILAGQAGHVNYDVIPGVVYTTPEVASVGKTEDELKQAGVAYTVGKFPFTANGRSKVNQTTDGFVKILADAKTDRVLGAHIIGREAGELIHEAAVLMEFGGSAEDLARTCHAHPTRSEAVKEAALAVGKRAIHM

SEQ ID NO: 63131 - protein, 396 aa, Streptococcus pyogenes MGAS10394
MSDFLFFIESFYGLVSYIMNNTEYYDRLGVSKDASQDDIKKAYRKMSKKYHPDINKEAGAEQKYKDVQEAYETLSDSQKRAAYDQYGAAGAQGGFGGGAGGFGGFDGGGFGGFEDIFSSFFGGGGSRNPNAPRQGDDLQYRVNLSFEEAVFGVEKEVSYNREATCGTCLGSGAKPGTAPVTCRKCHGSGVMTIDTQTPLGMMRRQVTCDICHGSGKEIKEPCQTCHGTGHEKQAHKVSVKIPAGVETGQQIRLQGQGEAGFNGGPYGDLFVILNVLPSKQFERNGSTIYYSLDISFTQAALGDTVEIPTVHGDVEMAIPAGTQTGKTFRLKGKGAPKLRGGGQGDQHVTVNIVTPTKLNDAQREALQAFAEASGDKMLHPKKKGFFDKVKDALEDI

SEQ ID NO: 63132 - protein, 358 aa, Codonopsis lanceolata
MSCYKGKYADELIANATYIGTPGKGILAADESTGTIGKRLSSINVENIESNRWALRELLFCTPGALQYLSGVILFEETLYQKTAAGKPFVDVLKENGVLPGIKVDKGTVVLAGTNGETTTQGLDGLGARCAQYYAAGARFAKWRAVLNIGPNEPSQLAINENANGLARYAIICQENGLVPIVEPEILVDGAHDIAKCADVTERVLAACYKALNDHHVLLEGTLLKPNMVTPGSDSAKVAPEVVAEYTIRALQRTMPAAVPAVVFLSGGQSEEQATVNLNAINKYKGKKPWSLTFSFGRALQQSTLKAWAGKEENVAKAQAAFLARCKANSEATLGTYEGGASLSEGAAESLHVKDYKY

SEQ ID NO: 63133 - protein, 401 aa, Oryza sativa (japonica cultivar-group)
MAKASVVVPEQVGAAAAAQVGCPCPGTTLFPYPPPRAGIAVRRKCLQAAQQLELGAGLRGGWVESMRASSPTHAKAAAALAAGVDEEHAAWMVRFRSPIDRCSSRSWRARADTDMNRAFPFVFVQARHPSALGEFEKVVAASKGKQIVMFLDYDGTLSPIVDDPDAAFMSETMRMAVRSVAKHFPTAIVSGRCRDKVFEFVKLAELYYAGSHGMDIKGPASRHAAAKSPPHNKGVLFQPASEFLPMIEQVHQRLEQATSSIPGAKVENNKFCVSVHFRCVDEKSWGALAETVRRVVREFPRLRLSQGRMVFEVRPTIKWDKGKALEFLLDSLGFADCSDVLPVYIGDDRTDEDAFKGVGILVSKHPKETSASFSLQEPAEVMEFLLRLVEWNRLSRTRLRL

SEQ ID NO: 63134 - protein, 375 aa, Prunus avium
MTFTLRKKDILIDILVRLPAKSLVRFLCTCKSWIDLIGSSSFISTHLHRNATKHTHVYLLCLHHPNFERNDDPDDPYVEQEFQWSLFSNETFEECSKLSHPSGSTKHYVIYGSSNGLVCISEEILNFDSPIHIWNPSVKKFRTPPMSTNINIKFSHVALQFGFHPGVNDYKAVRMMRTNKNALAVEVYSLKTDSWKMIEAIPPWLKCTWQHHKGTFFNGVAYHIIEKGPICSIMSFDSGSDEFEEFIAPDAICSPSELCIDIYKERVCLLFSFYSCDEEGMVPNDLWVLQEKRWKQLCPFIYPAGSYGTIGITIDNKLLMVRRDFLRGAGDLCLCNYESKQVFETGIELAVMKYGEIELLFAITYIESLALLNKY

SEQ ID NO: 63135 - protein, 325 aa, Glycine max
MAGLVVSSQCFLKLLLVVSVFHVSFAARRLNELVQDQSQLLHYHNGPLLYGKIAVNLIWYGNFKPSQKAIITDFVTSLSSPASQSSQPSVATWWKTTEKYYHLSPKNKKAASSLSLSLGDQFLDEGFSLGKSLTSKNLVELASKGGQRNAINVVLTSADVAVEGFCMSRCGTHGSSSSASHVKKNNNGKNYKFAYIWVGNSETQCPGQCAWPFHQPIYGPQSPPLVAPNNDVGLDGMVINLASLLAGTATNPFGNGYFQGPAEAPLEAASACPGVYGKGAYPGYAGNLLVDSATGASYNVEGDNGRKYLVPALYDPSTSSCSTPV

SEQ ID NO: 63136 - protein, 530 aa, Glycine max
MVSACVTLKANTHLVKSRKDNTFRQDGGFLGERIKGGLNYSPWIINQLASTSSLRTQEKVNKAKPGVVSAVLTSSNIKESVAFQMPSFLRRKADPKNVVSVILGGGPGIQLFPLTKRAATPAVPVGGCYRLIDIPMSNCINSGLNKIFVLTQFNSASLNRHISRTYFGNGINFGDGCVEVLAATQTQGEAGNNWFQGTADAVRQFTWVFEDAKHANIENVLILAGDHLYRMNYMDLVQSHVDRNADITVSCAAVGESRASDYGLVKADARGRIIQFSEKPNGADLKAMQVDTSVLGLPLHEAKRSPYIASMGVYVFKTDVLLRLLKWRYPTSNDFGSEIIPAAVRENNVQAYFFIDYWEDIGTIKSFYDANLALTEENPMFKFYDPKTPIYTSPRFLPPTKIDKCRIVDAIISHGCFLRECTVQHSIVGERSRLDYGVELQDTVMMGADYYQTESEIASLLAEGKVPIGIGRNTKIRNCIIDKNAKIGKDVIIMNKDGVQEADRPEDGFYIRSGITVILEKATIEDGTVI

SEQ ID NO: 63137 - protein, 329 aa, Beta vulgaris
MTITRFVLNEQSKRPESRGDFTILMSHIVLGCKFVCSAVNKAGLAKLIGLAGETNIQGEEQKKLDVLSNEVFIKALISSGRTCILVSEEDEEATFVEPSLRGKYCVVFDPLDGCSNIDCGVSIGTIFGIYMVKDLNNATLDDVLQPGKNMVAAGYCMYGSSCTLVMSTGSGVNGFTHDPSLGEFILTHPDIKIPKKGKIYSVNEGNAKNWDGPTTKYVEKCKFPKDGSSPKSLRYIGSMVADVHRTLLYGGIFMYPGDKKSPNGKLRVLYEVFPMSFLMEQAGGQAFTGEQRALDLVPKNIHDRSPVFLGSYDDVEDIKALYAAEQKNA

SEQ ID NO: 63138 - protein, 209 aa, Coprinopsis cinerea
MGLLSIIRKNRQKEREMRILFLGLDNAGKTTILKKLNNEDISGISPTLGFNIKTFVHRAYTLNIWDVGGQTTLRPYWRNYFEQTDALVWVVDSSDRMRMHDCKRELHSLLTEDRLAGASLLVFANKQDLPGSMDDSEISNVSLLALDLPSIKSHHWTIWPCSAVTGQNLVSGLDWVVNDVANRLYYSSTTAHPTNENIGGAPQPVEPIS

SEQ ID NO: 63139 - protein, 933 aa, Aspergillus oryzae
MVLPDFERRDPFMAMRSWLSQLMFHTEALGFIRKKWESTQGQRAARGDVISLLRAIVSAIPECTFTLDGLDECDWAKGSWSGNSDDSITSFLRALRRATAGTSTRILIVSRDEPEIRRGLSNESPYDPVFEHRIIPEDVQNDVLTYCRSIVEEKLSTKTDEAKDEITKKLADRCNGQFLWIRLQQDTLRSGKSQRKLEQAINSTPSGIEHIFERNWMKIMGLTEEDRTRAISLLRWTAFSLRPLTISEISGALVISEDDDELLLDDLPDSIDEYYVNTEIKELCGSFLEVRDAQDKSDVRLKTVHLTHFSVKEYLLRNLPIEGKVLQPNSTFSSSTEVIENTIIAKKCLRFVNSQEAWLGTSGVQVEEFLSTFRKYAAGSWYRHVELGNMSDTELRSSVAALFDPKNPNWPLWKAWFDANDTKAVERNARCGVATAGPLYYASWLGLTDSVASLIHELKPDVNNRGYDEQTPLGVASEEGNLEIVRTLLEQGADVTMADIDGWTPIYTASHIGHTEVVRLLIENGSNVNTSESGGCTPVNTACYQGHVETVKLLLKSGADIYTATNKGITPLYAASAGGHIEVVKLLLKWGADIDYANKYGDTPLSASSSKGHPAVSKLLVETGADIEAKNNFGRTPLHLASLDGHIEIVILLLERDAYVEAKDIHEWTPLMNASFEGHAEVVKALSGRGADIEAKSANGHTALMYASTEGHIEVTDIGFTPLMFASSYGHIEVVKLLLKHGADFTNRDITGTTSLHVAAYDGHVKVVEIFLQASSTHVDALNRLNRTPLFQAAARGHLCVVNTLLSHKANAKIKDHYRSTPLLMAVRNGHKDVVGRLITLADSSIHFQNGLDQTLLWWAARCGDAGIVELIVRWAKEHNIEAIESDLQVDGSLVKLGEPSRYCDVCIRDLRANEVYYKFKTCFDFNICSECF

SEQ ID NO: 63140 - protein, 175 aa, Triticum aestivum
MPPTLMPSSPTEVAPFQGLKSTAGLPVSRRSKGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 63141 - protein, 379 aa, Streptomyces albus G
MATDYYAVLGVRRDASQDEIKKAFRRLARELHPDVNPDPKTQERFKEINAAYEVLSDPQKKQVYDLGGDPLSQNGGGGAGGFGQGGFGNFSDIMDAFFGTASQRGPRSRTRRGQDAMIRLDIELDEAAFGTTKDIQVDTAVVCNTCNGEGAAPGTSAQTCDMCRGRGEVSQVTRSFLGQVMTSRPCPQCQGFATVVPTPCPECAGDGRVPSRRTLTVKIPAGVDNGTRIQLAGEGEVGPGGGPGGDLYVEIHELPHSVFQRRGDDLHCTVTIPMTGPRPSAPRCLETLDGMEEIDIRPGTQSGQSVPLHGRGITHLRGGGGRDLIVHVEVTTPGKLDAEQEHLLRELAKLRGEERPTGQFQPGQQGLFSRLKDAFNGRS

SEQ ID NO: 63142 - protein, 386 aa, Yersinia pseudotuberculosis IP 32953
MTRKQATIAVRSGLNDDEQYGCVVPPIHLSSTYNFIDFNQPRTHDYSRRGNPTRDVVQRALAELEGGAGAVMTSSGMSAIHLVCTTFLQPGDLLVAPHDCYGGSYRLFDSLSKRGAYRVLFVDQGDEAALNRALAEKPKLVLIETPSNPLLRVVDIAAICQAARAAGALTVCDNTFLSPALQQPLSLGADLVVHSCTKYLNGHSDVVAGAVIAKDPELVVELAWWANNIGVTGAAFDSYLLLRGLRTLSPRMAQQQRNADDIVRYLQQQPLVKKLYHPSLPQHPGHEIACRQQSGFGAMLSFELDGDEQVMRRFLSALELFTLAESLGGVESLISHAATMTHAGMAAEARIAAGITDSLLRISVGIEDSEDLIADLDHAFQLAVTR

SEQ ID NO: 63143 - protein, 488 aa, Psidium guajava
MARVVMSNMSPAMSSTYPPSLSPPSSPRPTTLPVRTIPGSYGWPLLGPISDRLDYFWFQGPETFFRKRIEKYKSTVFRANVPPCFPFFSNVNPNVVVVLDCESFAHLFDMEIVEKSNVLVGDFMPSVKYTGNIRVCAYLDTSEPQHAQVKNFAMDILKRSSKVWESEVISNLDTMWDTIESSLAKDGNASVIFPLQKFLFNFLSKSIIGADPAASPQVAKSGYAMLDRWLALQLLPTINIGVLQPLVEIFLHSWAYPFALVSGDYNKLYQFIEKEGREAVERAKAEFGLTHQEAIHNLLFILGFNAFGGFSIFLPTLLSNILSDTTGLQDRLRKEVRAKGGPALSFASVKEMELVKSVVYETLRLNPPVPFQYARARKDFQLKSHDSVFDVKKGELLCGYQKVVMTDPKVFDEPESFNSDRFVQNSELLDYLYWSNGPQTGTPTESNKQCAAKDYVTLTACLFVAYMFRRYNSVTGSSSSITAVEKAN

SEQ ID NO: 63144 - protein, 1117 aa, Mycobacterium avium subsp. paratuberculosis K-10
MPRRTDLNHVLVIGSGPIVIGQACEFDYSGTQACRVLKAEGLQVSLVNSNPATIMTDPEYADHTYVEPITPAFVERVIAQQAERGNKIDALLATLGGQTALNTAVALYENGALDRYGVELIGADFDAIQRGEDRQRFKDIVAKVGGESARSRVCFTMDEVRETVAELGLPVVVRPSFTMGGLGSGMARSVEEVDRMAGAGLAESPSANVLIEESIYGWKEFELELMRDGNDNVVVVCSIENVDPMGVHTGDSVTVAPAMTLTDREYQRMRDLGIAILREVGVDTGGCNIQFAVNPKDGRLIVIEMNPRVSRSSALASKATGFPIAKIAAKLAIGYTLDEIVNDITKETPACFEPTLDYVVVKAPRFAFEKFPGADPTLTTTMKSVGEAMSLGRNFIEALGKVMRSLETSRAGFWTKPDPDGGLDDVLARLQTPTEGRLYDLELALRLGAPVERVAQASGVDPWFIAQIGELVALRGELIGAPVLDADLLRRAKHHGLSDRQIAALRPELAGENGVRSLRERLGVHPVYKTVDTCAAEFEAKTPYHYSSYELDPAAETEVAPQAQRPKVLILGSGPNRIGQGIEFDYSCVHAATTLSQAGFETVMVNCNPETVSTDYDTADRLYFEPLTFEDVLEVFRAEQQSGAGGPGVVGVIVQLGGQTPLGLAQRLADAGVPIVGTPPEAIDLAEDRGSFGDVLTAAGLPAPKYGTATTFAQARRIAEDIGYPVLVRPSYVLGGRGMEIVYDEETLRDYITRATELSPEHPVLVDRFLEDAVEIDVDALCDGTEVYIGGIMEHIEEAGIHSGDSACALPPVTLGRSDIEKVRRATEAIAHGIGVVGLLNVQYALKDDVLYVLEANPRASRTVPFVSKATAIPLAKACARIMLGATISQLRAEGMLAASGDGAHAALNAPIAVKEAVLPFHRFRTVEGAGIDSLLGPEMKSTGEVMGIDRDFGSAFAKSQTAAYGSLPAQGTVFVSVANRDKRSLVFPVKRLADLGFRVLATEGTAEMLRRNGIPCDEVRKHFEDPQPGRPEMSAVDAIKAGEVDMVINTPYGNSGPRIDGYEIRSAAVSVNIPCVTTVQGASAAVQGIEAGIRGDIGVRSLQELHSQIASDKGPR

SEQ ID NO: 63145 - protein, 439 aa, Pyrococcus furiosus DSM 3638
MNISVSMNKFDSKIKFVQLVFVDINGMPKGMEIPASRLEEAVTDGISFDGSSVPGFQGIEDSDLVFKADPDTYVEVPWDNVARVYGFIYKDNKPYGADPRGILKRALEELEKEGYKAYIGPEPEFYLFKKNGTWELEIPDVGGYFDILTLDKARDIRREIAEYMPSFGLIPEVLHHEVGKAQHEIDFRYDEALKTADNIVSFKYITKAVAEMHGLYATFMPKPLFGFPGNGMHLHISLWKDGENVFMGEEGLSEIALHFIGGILKHAKALTAVTNPTVNSYKRLVPSYEAPVYISWGYRNRSALIRVPAFWGKGARIEYRCPDPSANPYFAFAAVLKAGLDGIKHKIDPFAYVEENVYEMSEEKRKELGIETLPGSLGEALEELEKDKVVKEALGDAYKNFINYKWKEWESYLEYLEEKHMPKDTKKVTEWELERYFFL

SEQ ID NO: 63146 - protein, 340 aa, Salinibacter ruber DSM 13855
MAHQLTLLPGDGIGPEVTEATLQVIEAAGVDIDWDRHRVIGANAVERGRPALPSDIVDSIQERGTALKGPVTTPVGQGFTSVNVQLRQRLDLYSNVRPATSLEGLDTPFDDVDLIIFRENTEGLYSGIEYYDERLDIADSIARVTKRGAERIIRFCFEYAQAHGREHVTLAHKANILKKTSGLFLDIGRDLAAEYPDIEFEDSIIDNLCMQLVTNPENYDCIVSTNLFGDILSDLTAGLVGGLGVTPGANIGDELAVFEAVHGSAPDIAGQNVANPTAMTRTAAMMLQHIGEDEAAAAIEQSLFAMYRDGDTLTQDVGGDASTSEFADALSDRVASKVEA

SEQ ID NO: 63147 - protein, 221 aa, Glycine max
MASSSSLHLSQALLARAVYLHGSSSSDRVSLSFPSFSGLKSHSTCKAAAATSSRRRGACPSTNVVRAAAVETLDQTTEVSLVEKSVNTIRFLAIDAVEKANSGHPGLPMGCAPMGHILYDEIMRYNPKNPAWFNRDRFVLSAGHGCMLQYALLHLAGYDTVQEQDLKEFRQWGSRTPGHPENFETLGVEVTTGPLGQGIANAVGLALAEKHLAARFNKPDN

SEQ ID NO: 63148 - protein, 291 aa, Glycine max
  misc_feature (81)..(81): Xaa can be any naturally occurring amino acid
FPCSQLCSFSLSLFLLEGPQPCCSYYINDELFQYSNLPCYLTVSCVLQIMRPHMEKIKQEIEDKAMDPVAVAEGQKRMKNXFKEYGAFPLLALKLSNIQTLVFISFFLAIRNMAEKMPSFKHGGAYWFVDLTTPDSLYILPVLTALSFLITVECNMQEGLEGNPVAGTMKKFSRGLAVLTVPFTMGFPKAIFCYWITSNLFSLVYGLVLKFPGVKKALRIPIIPQAAPTSGPQSPFSIFPALKQATSATNGPNSMPVEPSKHPKKKTSSSDVNQRLRRLEKQVKGRKKNKN

SEQ ID NO: 63149 - protein, 360 aa, Salinibacter ruber DSM 13855
MVWWWRALGPSGEGQPGPLPSSLFPVIDPSRPTMQDIECLGVYTSGGDAPGMNACLRAVVRTAIANDIAVMGIRRGYEGMIEADFVEMERRSVSNILQSGGTILKSARSEAFRTEEGRRAAANSLRENGIDALVAIGGDGTFRGASKLYDEHGLGVVGCPGTIDNDLYGTDQTIGYDTALNTAIDNIDRIRDTADAHNRLFLVEVMGRDAGFIALNSGIGGGAELILIPETITEMDMVKERILSLMTAQRRSTIVVVAEGDELGGAQGIERALRDDAAFSDIELRSTILGHTQRGGAPTASDRVLASRLGVAAVESLMDGHSDVMVGMTNNEIKLTPLRNVYGRRKSIDYDLLKLTQILS

SEQ ID NO: 63150 - protein, 87 aa, Streptococcus pyogenes MGAS10394
MTGVFLIRTRSRPLIRKGLAVSLARSVKPDLKLGICGEHGGDPASIAFCHSQGLTYVSCSPFRVPLTRLAAAQAAIKASGHSLTQDK

SEQ ID NO: 63151 - protein, 496 aa, Mycobacterium avium subsp. paratuberculosis K-10
MSSPAVPDHHTLIIGAGFSGIGAAIKLDKAGLPDYRVIEAGDGVGGTWHWNTYPGIAVDIPSFSYQFSFEQSRHWSRTYAPGRELKAYAEHCADKYGIRSRIRFNTKVLAAEFDDEPRLWRVHTDPGGTVTARFLISACGVLTVPNLPDIDGVDSFGGITMHTARWDHGQDLSGKRVAVIGTGASAVQVIPEIAPIVKSLTVFQRTPIWRFPKLDVPLPAPARWAMRIPGGKSVQRLLSQAYVEVTFPISAHYFTVLPLAKRMATLGKSYLRQQVRDPEVREKLTPKYAVGCKRPGFHNGYLATFNRDNVRLVTEPIDKITPDAVATTDGEHHRIDVLILATGFKVMDPDNVPTFAVTGPGGRSLSRFWDEHRLQAYEGVSVPGFPNLFTVFGPYGYVGSSYFALIEAQTHHIVRCLKRAERLGAARVEVSEEANARYFAEMMRRRHRQIFWQDSCKLANSYYFDKNGDVPLRPGTTPEVYWRSRRFNLDDYRFSA

SEQ ID NO: 63152 - protein, 320 aa, Mycobacterium avium subsp. paratuberculosis K-10
MPRLDNPADEKPGIDPILQKVLDAVPFRLSTEDGIDAARQRFRDLPRRPLHPELRVEDRTIPGPQGAIAVRIYWPPSHSESCPAPVVLYFHGGGFVIGDLDTHDGTARQHAVGAGAIVVSVDYRLAPEHPYPAAVEDAWAATLWAAENAAGLHGDPGRIAVAGDSAGGTLAAVTAQRARDRGGPPVRFQLLWYPSTMWDASLPSFAENATAPILDVKAVAEFSRWYAGDVDLSDPPADMAPGRATDLSNLPPAYIGVAGYDPLRDDGIRYGEPLAAAGVAAQVHNAETLVHGYLGYAGVVPAATAAMERGLAALRTALQG

SEQ ID NO: 63153 - protein, 110 aa, Erythrobacter sp. NAP1
MADINTRISTLVGENDVVLFMKGTPLFPQCGFSSRAVAILDHCGVQYESVDVLQDMEVRQGIKTFSDWPTIPQLYVKGEFVGGSDIMMEMFEAGELQQMMDENKVAKIES

SEQ ID NO: 63154 - protein, 231 aa, Populus tomentosa
MVMAGSNSLSADKQESSLSSLLSDSSGSQQDSPSSNEKVLLAASRPKKRAGRRIFKETRHPIFRGVRKRNGDKWVCELREPNKKSRIWLGTYPTPEMAARAHDVAALAFRGKSACLNFADSAWRLPAPISNEAKDIRRAASEAAELFRTSDLGGQVMEDHTTENRGEVCSSTNDDIRDLPSENVSYIDEEAEFNLPGLLANMAEGLLLSPPHYTGDWNDGEIDADWSLWSS

SEQ ID NO: 63155 - protein, 448 aa, Lactobacillus plantarum WCFS1
MAKQSYSKDDIRRIVKEENVNFLRLMFTDLFGTIKNVEVPVSQLDKLLDNKLMFDGSSIDGFVRIEESDMYLYPDLSTWLIMPWNTEHGKIARIICEVYTSDRKPFEGDPRNNLIRVLNDMREAGYTSFNCGTEPEFFLFKMNEKGEPTTELNDKGSYFDLSPMDLGENCRRDIALELERLGFNVEASHHEVAPGQHEIDFKYADALSAADHIQTFKLVVKTIARKYNLWATFMPKPLNGVNGSGMHVNMSLFHDQGNAFYDANDKNGLELSSDAYHFLGGLMKHARSYTAVTNPTVNSYKRLVPGYEAPVYVAWSASNRSPMIRIPSARGLSTRLELRSVDASTNPYLAFAAVLEAGLDGIKNGIEPPKSVDRNIYVMDEDERAAAGIADLPSTLHNALKEFQTDPTMKKALGPHIYQSFLEAKRLEWASYRQQVSEWERDQYMELY

SEQ ID NO: 63156 - protein, 231 aa, Populus tomentosa
MVLAGSNSFSADKQESSLSSLLSDSSGSQQDSPCSNEKVLLAASRPKKRAGRRIFKETRHPIFRGVRKRNGDRWVCELREPNKKSRIWLGTYPTPEMAARAHDVAALAFRGKSACLNFADSAWRLPAPISNEAKDIRRAAGEAAELFRTSDLGGQVMEDHTTEDRGEVCSSTNDDIRDLPSENVSYIDEEAESNMPWLLANMAEGLLLSPPHYTGDWNDGEIDADWSLWSS

SEQ ID NO: 63157 - protein, 625 aa, Medicago truncatula
MECIWDRFGLWLRIYIGLICIWGIRLCWSLNDEGIALWEFRVRIISDPYGALLNWNPNDSNPCKWMGVHCVDGKVQILDLNGQSLEGTLTPHLGKLNHLKSLLVHDNKIEGGGSQELGNMELPSKSLFSDNYSSPLTSLFQCKNRKFAHWFKLGKAASHGYEENYWGNLPSSDESEFGPDVSNLISSARRKLLDQSNNLAAAPYSGGPTIQISVIPISISSGSFPAVPDANKKQNQSSAPLHSATGFPHDNQTSQPNSANGAPSKLWKYIIIFFGVVFLAIFTVIMFCILRKRAAKVIKPWKTGISGQLQKAFVTGVPKLNRAELETACEDFSNIINSFEKCTIYKGTLSSGVEIAVDSTVVTSSEDWSKNMEMAYRRKIASLSRVNHKNFTNLIGYCDEEEPFTRMMVLEYAPNGSLFEHLHVKEIEHLDWMARMRVIMGTAYCLQYMHHDLNPPVSHSNLNSVAILLTDDFAAKVSEISFGSNGLSPASTVGDESKKSELPPHQGPETDVYNFGILLLEIISGKLPYSEEQGLLVNWAAEHLNDKRNIGCLIDPTLESFKDNELDVICEVIKECVQSDQRLRPTMKEVTHKLREVLSISPDQAVPRLSPLWWAELEILSVEAT

SEQ ID NO: 63158 - protein, 289 aa, Spinacia oleracea
MASAAFSLLPSTSSTTFNRHATTKLLNLKFLHNHRNKPFFTTTIKSLSSPSPTPVLTQDDLKKLAAEKAVDSVKSGMVLGLGTGSTAAFAVSRIGELLSAGKLTNIVGIPTSKRTAEQAASLGIPLSVLDDHPRIDLAIDGADEVDPDLNLVKGRGGALLREKMVEAASDKFIVVVDDTKLVDGLGGSRLAMPVEVVQFCWKYNLKRLQEIFKELGCEAKLRMEGDSSPYVTDNSNYIVDLYFPTSIKDAEAAGREISALEGVVEHGLFLGMASEVIIAGKTGVSVKTK

SEQ ID NO: 63159 - protein, 137 aa, Brassica napus
  misc_feature (34)..(34): Xaa can be any naturally occurring amino acid
MAVTAEAAAEMVLERRAYARVGLLGNPSDVYGGXALSFAIADFSATVHLRPSPELLIQPHPHHDLVAFPSLPQLVSRLQSEGYYGGVRLLMAICKVFYNYCVQNNISLKAENFTLSYDTNIPRQSGLSGSSATVCAA

SEQ ID NO: 63160 - protein, 431 aa, Prosthecochloris aestuarii DSM 271
MPQLTRSAELFEKAKQFIPGGVNSPVRAFKSVGGTPIYMAKGQGAYMTDVDGNTYLDYVGSWGPFILGSMHPRITAALEHTLTKIGTSFGTPIEMEIEIAELLCQIVPSIEMVRMVNSGTEATMSAVRLARGYTSRDKIIKFEGCYHGHGDSFLIKAGSGALTLGAPDSPGVTKGTANDTLNAKYNDIESVRLLVNENKGNIAAIIIEPVAGNTGVIPAKPGFLQALRDLCTEEGIVLIFDEVMCGFRVALGGAQERYGVTPDLTTMGKIIGGGLPVGAFGGKREIMERIAPLGDVYQAGTLSGNPLALTAGLETLKILRDENPYPELERKAAFLEEGFRNNMNKLGLNYVQNRVGSMACLFFTETPVTDYDTAVTADLKKYGTYYHAMLDQGIYLAPSQFEAMFTSAVMTDEDLEKTVKANYVALQATQK

SEQ ID NO: 63161 - protein, 358 aa, Venturia inaequalis
  misc_feature (26)..(26): Xaa can be any naturally occurring amino acid
  misc_feature (75)..(75): Xaa can be any naturally occurring amino acid
  misc_feature (161)..(161): Xaa can be any naturally occurring amino acid
  misc_feature (190)..(190): Xaa can be any naturally occurring amino acid
MYTSRTAVYCSNLTTQRSAVTILRTXSGTASNGIKSRSALTAYQQNPSLRTRNFHSTSVVQAKDFFPEPDTPHIXKTKTAWPHPIYTVEQMNQVAVAHRDTRNWSDKVALIAVKLLRWGLDTVSGYKHGKAQALHAQDPQEAQKRYGMTGKQYLVRNVFLXSVAGVPGMVAGMLRHLHSMRRMKRDHGWXETLLEESYNERMHLLIFLKLYEPGWFMRLAVLGAQGVFFNAMFLSYLISPRTCHRFVGYLEEEAVVTYTRELADLEAGKLPEWETLAAPDIAVDYYNLPEGHRTMKDLLLHVRADEAKHREVNHTLGNLDQNSDPNPYASKYDNPDVPHPRKDIKYLKPSGWEREEVM

SEQ ID NO: 63162 - protein, 377 aa, Sulfolobus solfataricus
MSVVSKGLENVIIKVTNLTFIDGEKGILRYRGYNIEDLVNYGSYEETIYLMLYGKLRTKKELNDLKAKLNEEYEVPQEVLDTIYLMPKEADAIGLLEVGTAALASIDKNFKWKENDKEKAISIIAKMATLVANVYRRKEGNKPRIPEPSDSFAKSFLLASFAREPTTDEINAMDKALILYTDHEVPASTTAALVAASTLSDMYSSLTAALAALKGPLHGGAAEEAFKQFIEIGDPNRVQNWFNDKVVNQKNRLMGFGHRVYKTYDPRAKIFKKLALTLIERNADARRYFEIAQKLEELGIKQFSSKGIYPNTDFYSGIVFYALGFPVYMFTALFALSRTLGWLAHIIEYVEEQHRLIRPRALYVGPEYQEYVSIDKR

SEQ ID NO: 63163 - protein, 462 aa, Coccidioides immitis RS
MAAPAVAADASKARPAGADIKKPHITETPMTWSNWHKHVNWLNVTLILLIPLYGCVQAFWVPLQLKTAIWAIAYYYMTGIGITAGYHRLWAHCSYSATLPLRIYLAAVGGGAVEGSVRWWARDHRAHHRYTDTDKDPYSVRKGLLYSHIGWMIMKQNPRRIGRTDITDLNEDPVVVWQHRNYLKVVITMGLIVPMLVSGLGWGDWWGGFIYAGILRIFFVQQATFCVNSLAHYLGEQPFDDRNSPRDHVMTALITMGEGYHNFHHEFPSDYRNALEWYQYDPTKWIIWVWKQVGLAYDLKQFRANEIEKGRLQQLQKKIDQRRAKLDWGIPLEQLPVMEWDEYVEQAKNGRGLIAVAGVVHDVTDFIKDHPGGKAMINSGIGKDATAMFNGGIYNHSNAAHNLLSTMRVGVIRGGCEVEIWKRAQQENKDVEFVRDANGKRIIRAGEQVTKLPEPVPSAGAA

SEQ ID NO: 63164 - protein, 977 aa, Oryza sativa (japonica cultivar-group)
MTPLLLLLLALAAGAGAASFPADFANLFAAKAALSDPSSALAAWDPGLSPSLSPCRWPHLLCSNPSSSSSAAIAAVLLSNLSLAGEFPAPLCELRSLALLDLSYNDLTGPLPGCLAAMPSLRHLDLAGNGFSGEVPRSYGAGFPSLLTLSLAGNELSGELPAFLANVSALEELLLAYNQFAPSPLPETFTGIRRLQVLWLAGCNLVGDIPPSIGSLKSLVNLDLSTNNLTGEIPSSIGGLESVVQLELYSNQLTGSLPEGMSALKKLRFFDAAMNQLSGEIPADLFLAPRLESLHLYQNELTGRVPATVADAAALNDLRLFTNRLVGELPPEFGKKSPLEFLDLSDNRISGEIPATLCSAGKLEQLLMLNNELVGPIPAELGQCRTLTRVRLPNNRLSGAVPPDMWGLPHLYLLELAGNALSGAVAPAIATARNLSQLLISDNRFAGALPPELGSLPNLFELSASNNVFSGPLPASLTVVTTLGRLDLRNNSLSGELPRGVRRWQKLTQLDLADNRLTGNIPAELGDLPVLNSLDLSNNELTGGVPVQLENLKLSLLNLSNNRLAGVLPPLFAGEMYKDSFLGNPGLCTGGSCSSGRRARAGRRGLVGSVTVAVAGVILLLGAAWFAHRYRSQRRWSTEDAAGEKSRWVVTSFHKAEFDEEDILSCLDDEDNVVGTGAAGKVYKAVLGNGARGGDDGAVVAVKKLWANGGAAKKAAAMEAGGGGGGGGKDTFEAEVATLGRIRHKNIVKLWCSLSSGDRRLLVYEYMPNGSLGDLLHGGKGGLLDWPARHRIMVDAAEGLSYLHHDCAPPIVHRDVKSNNILLDADLRAKVADFGVARAVSAAPPTAVSAIAGSCGYIAPEYSYTLRITEKSDVYSFGVVMLELLTGKAPAGPELGEKDLVRWVCGCVERDGVDRVLDARLAGAPRDETRRALNVALLCASSLPINRPSMRSVVKLLLELRPESKEKAMAEEKPLLV

SEQ ID NO: 63165 - protein, 297 aa, Bacillus licheniformis ATCC 14580
MNHDEVKKMNFGNIATAMVTPFDKNENIDFQKLSKLIDYLLNNGTDSLVVAGTTGESPTLSEEEKVALIQYSVKEAAGRAPIIAGTGSNNTKASIKLTKKAEEAGADAVMLVTPYYNKPSQEGMYRHFRAIAEETSLPVMLYNVPGRTAASLAPETTIRLAEIPNIIAIKEASGDLDAITKIVAETPEDFAVYSGDDSLTLPALSVGARGIVSVASHIIGPEMQEMIKHYTEGNTAQAALIHQKLLPLMKGLFAAPNPSPLKTALQLKGLDVGSVRLPLIPLNEDERLRLSSLMNGL

SEQ ID NO: 63166 - protein, 375 aa, Pyrocystis lunula
MLRRSQALVVHNGSGMCKAGFAGDDAPRAVFPSIVGRPRHTGVMVGMGQKDSYVGDEAQSKRGILPLKYPIEHGIVTNWDDMEKIWHHTLYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYMMKILTERGYSFTTTAEREIVRDIKEKLAYVALDFEQEMQTAASSSALEKSYELPDGQVITIGNERFRCPEALFQPSFLGMESAGVHETTYNSIMKCDVDIRKDLYGNVVLSGGSTMFPGIAERMNKELVALAPSTMKIKIIAPPERKYSVWIGGSILASLSTFQQMWISKEEYDESGPSIVHRKCF

SEQ ID NO: 63167 - protein, 185 aa, Oryza sativa (japonica cultivar-group)
MAVKYFGHRTPVIVVTKSHMYERGQIHQSLYIVWYIKIIKYTVTSDTVHFPQQQFKVTLHQKFAMSSPHVLVVDDTHVDRHVVSMALMRHNVRVTAVESVMQALMFLDSEHDVDMIVSDYCMPDMTGYNLLMEVKKSPKLAHLPVVIASSDNIPERIRKCLDGGAKDYILKPVKIVDVPRIMKYI

SEQ ID NO: 63168 - protein, 519 aa, Oryza sativa (japonica cultivar-group)
MLGEAASPWSLAGAGAAVALLWLCAWTLQWAWWTPRRLERALRAQGLRGTRYRLFIGDVAENGRLNREAASRPLPLGSHDVVPRVMPFFCNVLKEHGKLSFVWTGPKPFVIIRDPDLAREILSNKSGNFAKQTTAGIAKFVVGGVVTYEGEKWAKHRRILNPAFHQEKIKRMLPVFLACCTKMITRWVNSMSSEGISELDVWDEFQNLTGDVISRTAFGSSYQEGWRIFQLQEEQAKRVLKAFQRIFIPGYWYLPIENNRRIREIDQEIRTILRGIIVKRDKAVRNGEGSNDDLLGLLVESNMRQSNEKEDVGMSIEDMIEECKLFYAAGSETTSMLLTWTLILLSMHPEWQEQAREEVMHHFGRTTPDHDGLSRLKIVTMILHEVLRLYPPVVFLQRTTHKEIELGGIKYPEGVNFTLPVLSIHHDPSIWGQDAIKFNPERFANGVSKATKFQTAFFSFAWGPRICLGQSFAILEAKMALATILQSFSFELSPSYTHAPHTVLTLQPQYGSPIKLKKL

SEQ ID NO: 63169 - protein, 458 aa, Anabaena sp.
MTFDYDLFVIGAGSGGLAASKRAASYGAKVAIAENDLVGGTCVIRGCVPKKLMVYGSHFPALFEDAAGYGWQVGKAELNWEHFITSIDKEVRRLSQLHISFLEKAGVELISGRATLVDNHTVEVGERKFTADKILIAVGGRPIKPELPGMEYGITSNEIFHLKTQPKHIAIIGSGYIGTEFAGIMRGLGSQVTQITRGDKILKGFDEDIRTEIQEGMTNHGIRIIPKNVVTAIQQVPEGLKISLSGEDQEPIIADVFLVATGRVPNVDGLGLENAGVDVVDSSIEGPGYSTMNAIAVNEYSQTSQPNIYAVGDVTDRLNLTPVAIGEGRAFADSEFGNNLREFSHETIATAVFSNPQASTLGLTEAEARAKHGDDAVTIYAPFRPMYHSFTGKQERIMMKLVVDTKTDKVLGAHMVGENAAEIIQGVAIAVKMGATKKDFDATVGIHPSSAEEFVTMR

SEQ ID NO: 63170 - protein, 229 aa, Triticum aestivum
  misc_feature (139)..(139): Xaa can be any naturally occurring amino acid
  misc_feature (160)..(160): Xaa can be any naturally occurring amino acid
MDSSSSSTASSSQAQAQPDFDYLFKLLLIGDSGVGKSSLLLRFTSDSFEDLSPTIGVDFKVKMVNIAGKKLKLAVWDTAGQERFRTLTSSYYRGAQGIIMETALNERLPLYDVSRRESFTNLSDIWAKAIDLCSTPQDXCIKYLLRIGLDKETERAVTKXEGIDFAREYGCLFLECSAKTKVNVEQCFEELVLKILDTPSLLADASSGAKRNIFKQKAPEADAAASGCC

SEQ ID NO: 63171 - protein, 490 aa, Helicobacter hepaticus ATCC 51449
MKTILVITDGIGYSDKTQYNAFYHAKKPTYDYLFKNVPYGMIDTFGLSVGLPQGQMGNSEVGHMCIGSGRVLYQDLVRISRAIEYDEIKDNPALVEVTQQSAVVHLCGLLSDGGVHSHIVHLKALAQILSTQGKRVYLHLITDGRDVLPKSALNYLADIESICEDNVSIASVSGRFYAMDRDKRWDRVQKAYESIALGKNPTNLSPKEYIQSQYDEGIFDEFLTPVSFGGFQGMNDDESFVFVNFRSDRAREIVDCLGNPQFKEFKRERYVKLHIATMTEYDATFPYPILFPKQNVQNTLAEVISSHRLKQFHTAETEKYAHVTFFLNGGREEAFIGEERVLIPSPNVKTYDLQPQMNASAVGDAVIKAVEQGYDFVVVNFANGDMVGHTGNLEAAIKAVEAVDKELGRIVESAQKHHYALFITSDHGNCEEMKDEKGNMLTNHTVGQVWCFGMIEGVSKIENGGLNNIAPSVLKAMNLPIPPEMDKPLF

SEQ ID NO: 63172 - protein, 172 aa, Triticum aestivum
  misc_feature (14)..(14): Xaa can be any naturally occurring amino acid
  misc_feature (37)..(37): Xaa can be any naturally occurring amino acid
LPSSPTSVGPFQGXSSPPAGLPVNRRSNGASLGSVSXNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 63173 - protein, 563 aa, Medicago truncatula
MAKSKNNAKKLSYISVPSQIINSISSSSLQSLIDSPKKSSKTTIFTRKSTLWFLALFLVGFFGMFKFGFNPDTPFPQKPCSTTLQKFSISNHHSFSKLGFGSVLLQKERKTSLKNDHNDEFLQHGSEFLVSHVQLQAKGSSEFWKKPNGLGYKPCLSFSNDYRRQSERVLKDRRKYLMVVVSGGMNQQRNQIVDAVVIARILGAALVVPVLQVNVIWGDESEFGDIFDLEHFKRVLANDVRVVSALPSTHIMTRPVEGRPPLHATPSWIRARYLRRLNREGVLLLRGLDSRLSKDLPSDLQKLRCKVAFNALRFAEPIEELGNKIADRMKSKGPYLALHLRMEKDVWVRTGCLPGLTPEYDEVINNERIQRPELLTARSNMTYHQRKMAGLCPLNVMEVMRLLKALGAPKDARIYWAGGKPLGGKEALLPLIQEFPNFYNKEDLALPGELQPFVRKASLMAAIDYIVSEKSDVFMPSHGGNMGRAIQGHRAFTGHKKYITPNKRHMLPYFLNSSLSEEEFNRIIKELHQDSLGQPELRTNKNGRDVTKYPVPECMCNDSHAQS

SEQ ID NO: 63174 - protein, 107 aa, Rickettsia sibirica 246
MLENKNFKFIENEIKNNKVVLFMKGIKKSPACGFSGTVVAILNKLGVEFRDINVLFDAELREDLKKFSDWPTFPQLYINGELVGGCDIVRELYQSGELEKMLKAYTR

SEQ ID NO: 63175 - protein, 257 aa, Zea mays
MASSTQGQVITCKAAVAYEANKPLVVEDVQVAPPQAGEVRIKILSTALCHTDYYTWSGKDPEGLFPCILGHEAAGIVESVGEGVTDVQPGDHVIPCYQAECRDCKMCNSGKTNLCGKVRGATGVGVMMSDRKSRFSVNGKPIYHFMGTSTFSQYTVVHDVSVAKINPQAPLDKVCLLGCGVSTGLGAVWNTAKVGAGSIVAVFGLGTVGLAVAEGAKSAGASRIIGIDMDTQKFDVAKNFGVTEFVDPKDHDKPIQQ

SEQ ID NO: 63176 - protein, 407 aa, Streptomyces coelicolor A3(2)
MVVVGAGMAGVQTAVALREQGFTGPVTLIGAEPHQPYDRPPLSKAVLLGTAEGSAFDVDFEALGITLRLGCEALGVRPAEHVLDTSEGPVPYDVLVLATGAEPVRLPGAEGVPGVHLLRTLDDAERLRPVLARQHDVVVVGAGWIGAEFATAAREAGCAVTVVEAADRPLADALPAEVAAPMTAWYADAGAELRTRARVERVESGGPGESGRVVLDDGTRLAAGAVVVGIGARPATGWLAGSGIALGAHGEVLADDLLRTSAPDVHAVGDCASFPSARYGERLLVHHWDNALQGPRTVAADIVGTPGGETPAAYDPVPYFWSEQFGRFVQYAGHHTAADTTLWRGDPASPAWTVCWLREGRLVALLAVGRPRDLAQGRRLIQAGTPMDPDLLADPAKPLKAATAATA

SEQ ID NO: 63177 - protein, 500 aa, Arabidopsis thaliana
MATIWFLPLLFLSCLLLAALRLKKRRQHQRKPPSPPGFPIIGNLHQLGELPHQSLWSLSKKYGPVMLLKFGSIPTVVVSSSETAKQALKIHDLNCCSRPSLAGPRALSYNYLDIVFSPFNDYWKELRRMCVQELFSPKQVHLIQPIREEEVKKLMNSFSESAAQKTPVNLSEKLASLTVGVICKAAFGVSFQGTVLNSDNFDKLIHDAFLFLGSFSASDYFPNVGWIIDWLTGLQGQRERSVRGLDAFYEQMFDLHKQGNKEGVEDFVDLLLKLEKEETVLGYGKLTRNHIKAVLMNVLLGGIGTSAITMTWAMTELMRNPRVMKKVQSEIRNQIGGKSMICLDDIDQLHYLKMVINETWRLHPPAPLLVPREVMSEFEINGYTIPAKTRLYVNVWGIGRDPDTWKDPEEFLPERFVNSNIDAKGQNFELLPFGSGRRMCPAMYMGTTMVEFGLANLLYHFDWKLPEGMVVEDIDMEESPGLNASKKNELVLVPRKYLNL

SEQ ID NO: 63178 - protein, 113 aa, Arabidopsis thaliana
  misc_feature (49)..(49): Xaa can be any naturally occurring amino acid
  misc_feature (93)..(93): Xaa can be any naturally occurring amino acid
NDPRRRGGNHSGGEYIFSHHHPHEAGGVNLGKGQTPTAQATKVAPFTGXKTTANYPGTRTDNNDITSITSNGGRVSSTKERPPIGKKKIETLXYLTEQSDVETAKEGDNQSRN

SEQ ID NO: 63179 - protein, 257 aa, Pyrococcus furiosus DSM 3638
MTQVYKAKFGTPNRGWVIIVHGLGEHSGRYSKLVSMLVNEGYAVYTFDWPGHGKSPGKRGHTSVEEAMEIIDFIIEEINDKPFLFGHSLGGLTVIRYAETRPEKIRGVIASSPALAKSPKTPSFMVALAKILGVLLPSLTLSNGIDPNLLSRNPDAVKRYIEDPLVHDRISAKLGRSIFKNMDLAHREAHKIKVPVLLLVGTGDVITPPEGARKLYGEIKVEDKEIVEFEGAYHEIFEDPEWGEEFHKKIVEWIKKH

SEQ ID NO: 63180 - protein, 385 aa, Pyrocystis lunula
MSKPDHVLAEVRPFDGGKGSNHGASGEASNKKTSFTYNAERVLGSGSFGIVYQAQVVETGESVAIKKVFQDKRYKNRELQIMRELKHPNVVELKHAFYTSGDKPGESYLNVVMEYCSDTVYKMMKHYIKMKTPVPHIFVQLYSYQMNRACAYIHSVGICHRDIKPQNLLVDGTTHALKLCDFGSAKRLVKGEPNVAYICSRYYRAPELIFGATDYSTIIDIWSTACVTAELILAQPIFPGESGVDQLVEIIKVLGTPTREELMAMNPNYTEFKFPQIKPHPWHKVFLLQDHAGGRRLHLEAPRVRPEGAALGARVLCTPAVCDLRDRNTLISNAKGQALPSSIFAFSQEERALMDSDLRRKLIPDWVATRDKEQGPGAHDVGGSL

SEQ ID NO: 63181 - protein, 1049 aa, Pyrococcus furiosus DSM 3638
MDREEMIERFANFLREYTDEDGNPVYRGKITDLLTITPKRSVAIDWMHLNSFDSELAHEVIENPEEGISAAEDAIQIVLREDFQREDVGKIHARFYNLPETLMVKDIGAEHINKLIQVEGIVTRVGEIKPFVSVAVFVCKDCGHEMIVPQKPYESLEKVKKCEQCGSKNIELDVNKSSFVNFQSFRIQDRPETLKGGEMPRFIDGILLDDIVDVALPGDRVIVTGILRVVLEKREKTPIFRKILEVNHIEPVSKEIQELEISPEEEQIIKELAKRKDIVDAIVDSIAPAIYGYKEVKKGIALALFGGVSRKLPDGTRLRGDIHVLLVGDPGVAKSQILRYVANLAPRAIYTSGKSSSAAGLCVAPDSLVVVNDKVQEIGKLTEEWGREVGFLEYSSGIFYAPYLGRGISLDLVTGKVKPSVVSKVWKLKSPEELVTIKTITGKEITVTPETKLLTFNGTLEWKEAGKIKPGDYVLTVKKLHINGKQETLDEKLAYKRGLSLSDPLEFFSSSERTISAYLKGIFDKVGRLVGDTAVIKVDKDMAKRLQILLLRLGIVSSVDETGKVIIGREYIQKILGYNVSVVTHEVELFREFIAEISKFYGTSEEDVYSSLHEKGELDIGTVPVELPEGLREEINRERATYSELVKIAQEIKDEKLYNKLAWILSEVTEEEAKIKEKVNTLKVILSSDLIPERVESVKIIKSPYPYVYDLTVEGSHSFIANGFVVHNTAAAVRDEFTGGWVLEAGALVLADGGYALIDELDKMSDRDRSVIHEALEQQTISISKAGITATLNARTTVIAAANPKQGRFNRMKNPFEQIDLPPTLLSRFDLIFVLIDEPDDKIDSEVARHILRVRRGESEVVAPKIPHEILRKYIAYARKNIHPVISEEAMEEIEKYYVRMRKSVKKTKGEEEGIPPIPITARQLEALIRLSEAHARMRLSPIVTREDAREAIKLMEYTLKQIAMDETGQIDVTILELGQSARKLSKIEKILDIIEKLQKTSERGAHVNDILEEAKKAGIEKQEAREILEKLLEKGQIYMPESGYYKTV

SEQ ID NO: 63182 - protein, 482 aa, Arabidopsis thaliana
MSLIPERAKLHIAMVVFQTGYAGNHVIMRYALNLGVSKLVFPLYRTIVAFSVLAPSAYFLEKKERPAMKISFLIQFFLLGLVGITLNQGFYIFGLDNTSPTFASATENVVPAVSFLMAALLGIEKVEWKRKDGIAKVVGTIVSVAGSLVITLYKGPTIYQPSLNIVNQTIKPEEAEEENKNWTLGCLCLMGHCLCWSSWIVLQSPLLKKYPARFSFVSYSCFFAVIQFFGISAYFERDLERWKIISGGELYALLYTGLVGSAMVFAIQIYVVERGGPLFVSAYLPLQTLIAAVLATLALGEHFYLGGLIGAILIMSGLYLVVMGKSWENQALCQQQQHMISSAASDFGDEEDYHNNKPRSPIKGANLEFESKSNDNGNVKIAPNDQSFLTILDDIKSSKSPAVINYGASWCGVCSQILPAFRKLSNSFSKLKFVYADIDECPETTRHIRYTPTFQFYRDGEKVDEMFGAGEQRLHDRLWLHS

SEQ ID NO: 63183 - protein, 334 aa, Pisum sativum
MAPEIVQTSTKPVTGFTKLKRAYVTFLAGNGDYVKGVIGLAKGLRKVKTAYPLVVAVLPDVPEEHREMLESQGCIVREIQPVYPPENQTQFAMAYYVINYSKLRIWEFVEYSKMIYLDGDIQVYENIDHLFDLPDGYFYAVMDCFCEKTWSHTPQYKIGYCQQCPEKVQWPKEMGEPPSLYFNAGMFLFEPSVETYDDLLKTCQVTAPTPFADQDFLNMYFKDIYRPIPLVYNLVLAMLWRHPENVELRKVKVVHYCAAGSKPWRYTGKEENMQREDIKMLVQKWLDIYSDSSLDYKKNLSGNCETQRNDVEEPFVQALSEVGRVRYVTAPSAA

SEQ ID NO: 63184 - protein, 285 aa, Pseudomonas fluorescens PfO-1
MTDYPKPPFPKQAQPVPGSQRKMEPYPDCGEQSYTGSGRLAGKIALITGADSGIGRAVAIAFAREGADVAVAYLNEHEDAKETARWVEQAGRQCLLLPGDIAQKAQCQALVDQTVEHFGRIDVLVNNAAFQMTHETFEEIPDDEWVMTFDVNITAIFRLCQAAIKHMGPGSSIINTSSINSDMPKPTLLAYATTKGAIANFTGGLAQMLGPREIRVNCVAPGPIWTPLIVSTMPDEEVQHFGEQTPLGRPGQPVEVAPIYVLLASDEASYITGQRYGVTGGKPML

SEQ ID NO: 63185 - protein, 196 aa, Pseudomonas fluorescens PfO-1
MDLSRRQFFKVAGIGLAGSSLGALGMAPTQAFAEQVRHFKLAHTHETRNTCPYCSVGCGLIMYSQGDAAKNVAQNIIHIEGDADHPVNRGTLCPKGAGLLDFIHSPGRLQYPQVRKPGSSEWTRITWDEALDRVADLMKADRDANFVEQNAQGQTVNRWLTTGFLAASAASNEAGYITHKVVRSLGMLGFDNQARV

SEQ ID NO: 63186 - protein, 530 aa, Synechococcus sp. CC9311
MLEISLTDEFLYQGISTMSIQVPTRPFLENKKLNKIEQNKAAKDGLLVGNEIEEFARVGWEEVDETDLQLRLKWYGMFWRPKTPGKFMLRLRVPNGVINHQQLRVVASIVERYGENGSCDITTRQNLQLRGVLLNDLPDILKRLKDVGLSSIQSGFDNPRNVTGNPLAGIDPNEIIDTRPFTTELQDFLTNHCEGNPEFSNLPRKWNTAVAGAKDNFLLHNDIVFHPVERDGVLGFGVWIGGILSSQMNAYAIPLNAWVKQDEICRMTDCVIRLWRDNGERNKRPKGRFRMYLDQLGIDAFRSEVESLFGPLIEDPGSVFNSTPRSHYGIHPQKNADEFFAGLHVSVGRLTATDLHDLATASLDYGTGEIRLTEDQNVIIVGLSSANLDRFKADPLLQRFPLEPGAIAAGTVSCTGNTYCSFGLTNTKDQAIAAAKQLDAELELPEELKIHWTGCPNTCGQAFMGAIGLTGTKAKNSKGEMGEGYTLSIGGSQGENPQIGEVQQKAIPAEDIQNVLRQVLIEQFGAKPRA

SEQ ID NO: 63187 - protein, 820 aa, Pseudomonas fluorescens PfO-1
MASLAPTYGRGAMTNTWTDIANANLILVMGGNAAEAHPCGFKWVTEAKAHNAARLIVVDPRFTRTASVADYYAPIRTGSDIAFMGGLINYLLTEDKIQHEYVRNYTDVSFIVRAGFGFEDGLFTGYDAAKRSYTDKSTWGYELGEDGFVKVDPTLQDPRCVYQLMKQHYSRYNIDLASQICGMPVDAMKKIWEEIATCSAPGKTMTILYALGWTQHSIGSQIIRSAAMVQLLLGNVGMPGGGVNALRGHSNIQGLTDLGLLSNALPGYLTLPTDAEQDYAAFIHKRTQVPLRPGQLSYWQNYSKFHVSLMKAWYGANATAENQWAYHYLPKLDIPNYDILKVFDLMGQGKVNGYMCQGFNPIAALPDKNRVMAALAKLKWLVVMDPLATETSQFWEHVGPFNDVKSADIQTEVIRLPTTCFAEEDGSLVNSSRWLQWHWKGADGPGEARTDVQIMSALFLRLRERYQAEGGKFADPLLKLSWPYKIAEEPSPEEIAKEVNGYATTDFTDATGAAIKGNSQLAGFAQLKDDGSTASGCWIFCGSWTEAGNQMARRDNNDPYGMHQHQGWAWAWPANRRILYNRASADVAGKPWDPKKRLVWWNGKAWGGTDVPDYKADVPPEAGMNPFIMNPEGVARFFAVDKMNEGPFPEHYEPFETPIGINPLHPDNKKATSNPAARIFDSVWDSLGVAKDYPYAATSYRLTEHFHFWSKHCKLNAIAQPEQFVEIGEVLAKEKGIVAGDRVRVSSKRGFIEAVAVVTKRIRPLQVNNQVVHQIGIPLHWGFTGLTRHGYLTNTLVPFLGDGNTQTPESKSFLVNVEKL

SEQ ID NO: 63188 - protein, 421 aa, Oryza sativa (indica cultivar-group)
MAFLGNGYCSSGSEGEDEDEGMEGYRKGGYHAARPGDRFAGGRFVAQRKLGWGNFSTVWLAYDTLLNRFVALKIQKSARDYAQAALHEIELLSAIAKGDPTNSKNAVQLLDHFKHAGPNGHHVCLVTEFLGDSLLRLIRYNRNKGIGLSRVKEICRSVLVGLDYLHRELGIIHTDLKPENVLLVSTINPSKDPVRSGFTPILERTVSNQYSGSVISFSEKMLKMRARRAVAKISLRRESLGGVAAEMEKERSLDGISLKCKIVDFGNACWGSQQLAGEIQTRQYRAPEVIIGAGYSYSADMWSFACMAFELATGEVLFAPKTCQGCSEDEDHLALMMETLGKMPKKIASSGTRSKDYFDRHGDLKRIRRLKFWPLERLLVQRYNFTEPDAQGLADFLRPILDFTPENRPTAAACLKNPWLN

SEQ ID NO: 63189 - protein, 396 aa, Salinibacter ruber DSM 13855
MGRRLHLEPLPKSCILGAKKPCFPHVSSHIPSTHVMTGSHRTSHAGDGAPEDDLGTFQTLEQFILDRQDSFPHSTGAFSRLLRDISLAAKIVNRDMRRAGLLDVYGSTGERNVQGEVQQKMDALAHREFVQALRRGGECCLIGSEEHAEAIPLSTVSKEGDGKYIVLLDPLDGSSNIDVNVSVGTIFSIYRLPDGYEEEEPDPAAALQPGTEQVAAGYVVYGSSTMLVYTTGNGVNGFTLDPSIGEFLLSHPDIQTPSRGRLSSINSGYYHSFEEGLRDYLDWLQQKDPETNRPAKTRYIGSFVSDFHRNLLKGGIYMYPATESSPAGKLRLMYEANPMGFIAEQAGGAASDGHRRILEKEPDKLHQRTPLFIGSEEMVRRAEAFLQGEPERALSA

SEQ ID NO: 63190 - protein, 448 aa, Pseudomonas putida GB-1
MNMPETAPAGIASQLKLDAHWMPYTANRNFQRDPRLIVAAEGNYLVDDQGRKIFDALSGLWTCGAGHTRKEITEAVTRQLGTLDYSPAFQFGHPLSFQLAEKIAELVPGNLNHVFYTNSGSECADTALKMVRAYWRLKGQATKTKIIGRARGYHGVNIAGTSLGGVNGNRKMFGQLLDVDHLPHTVLPVNAFSKGMPEEGGIALADEMLKLIELHDASNIAAVIVEPLAGSAGVLPPPKGYLKRLREICTQHNILLIFDEVITGFGRMGAMTGSEAFGVTPDLMCIAKQVTNGAIPMGAVIASSEIYQTFMDQPTPEYAVEFPHGYTYSAHPVACAAGIAALDLLQKENLVQSAAELAPHFEKLLHGVKGTKNVIDIRNYGLAGAIQIAARDGDAIVRPYEVAMKLWKAGFYVRFGGDTLQFGPTFNTTPQELDRLFDAVGENLNLID

SEQ ID NO: 63191 - protein, 130 aa, Triticum aestivum
MVRVSVLNDALKSMYNAEKRGKRQVMIRPSSKVIIKFLTVMQRHGYIGEFEYVDDHRSGKIVVELNGRLNKCGVISPRFDVGVKEIEGWTARLLPSRQFGYIVLTTSAGIMDHEEARRKNVGGKVLGFFY

SEQ ID NO: 63192 - protein, 322 aa, Helicobacter hepaticus ATCC 51449
MKLDYALVAKEVLEIESASLLQATKRLNGKILESIVECIINSQGKVVVCGVGKSGLIGAKISATLSSTGTPSVFMHPTEAMHGDLGLLQKNDIVLAISYSGKSEELLNILPHIKRLGNPIITMSKDINSPLSRMGDYFLDISIQKEACPLNIAPTSSTTLTLALGDALAVCLMKRRDFKANNFASFHPGGALGKQLFVKLKDLMQIENLPLISPDLPLSQAIIIMSQKRLGSAIITQNDALWGILSDGDLRRAMMNKDFDLNAPVSIYATRNPKTCDNPDILAFDALKFMEENKIQLLIITNKQNHIQGVIHLHTLIAAGIK

SEQ ID NO: 63193 - protein, 194 aa, Brassica napus
  misc_feature (100)..(100): Xaa can be any naturally occurring amino acid
MGEQPDPFSASTLPDFISSQKIGRPVTLEGQSNRGHPYSGLKKRGQSSRSWVKIDENGNSTVLELDKATIMKRCSLPSRDLRLLDPLFIYPSSILGRERXIVVSLEKIRCIITAEEVILMNARDASVVQYQSELCKRLQSNQNLNLKDDLPFEFKALELVLELSCLSLDAQVNELEMEVYPVLDELATNISTLN

SEQ ID NO: 63194 - protein, 190 aa, Triticum aestivum
AYLGDTPEQVCTKKQAATGPEFPGYRRPTRPRKSSAADGLSIQQILDNWSKLLPTLMDEWQEDRESLVDLFGCVRDDWLENDLSGWIGANRFYPGTADALKLSSSELYIVTTKQSRFTGALLKELAGVDFPSERIYGLGSGPKVKVLQQLQEMPQHQGLTLHFVEDRLATLKNVIKEPALDKWNLYLGKS

SEQ ID NO: 63195 - protein, 369 aa, Helicobacter hepaticus ATCC 51449
MNIDFPFQQPSLYGYKLNELKSILSPAFRAKQIYHWLYHRYENDAMRMDNISKTMQNYIREHFALSQIYPIRVEHSIDGSKKYLFETYDGHCFESVLIQMRDKKLGHKGEVVESEKWTMCLSSQIGCKVGCAFCFTAKGGFVRNLHASEIVEQVVIMKKDNQMAPHKRVNIVYMGMGEPLDNIENVTRAIEILSESEGLSISARRQTISTSGIAPKIKQLGKLNLGVQLAISLHAVDDKLRSQLIPMNKAYNISDILTEVRAFPIDTRKKVMFEYLMIKGVNDDLKSAKKLLQLLNGIKAKVNLILFNPHEGSTFKRPEINDVRAFADFLIKRGLLCTIRESRGIDISAACGQLREKVKAENVSCETLT

SEQ ID NO: 63196 - protein, 199 aa, Sesamum indicum
MATLGGVHDSNSNPDTHSLARFAVDQHNTKENGLLELVRVVEAREQVVAGTLHHLVLEVLDAGKKKLYEAKIWVKPWMDFKQLQEFKHVRDVPSFTSSDLGAKTDDQVSGWRPVPVHDPVVQDAAHHAIKTIQERSNSLFPYELSEVVHANAEVVDTSAKFDMLLKVKRGGKEEKYKVEVHKSTEEGGFNLKKVDLDHS

SEQ ID NO: 63197 - protein, 649 aa, Oryza sativa (japonica cultivar-group)
MSTTVPSGANLRALLSSLSAAAAASSSGFAENATGAAPDTAYGLAQCRGGIVGGGNGTSCRSCLDDSVRDAAKACPGEKSAVIISDYCLVRYSNASFAGAADERTVKLWWNTDNATQPERFKSLLGTLMGNLTDAAARASSPLMFAAGETDLPPFTKIYGMAQCTRDLAAGDCYRCLVGAVNNIPKCCDGKQGGQVITRSCSIRFEVYPFFDAQAAKAAMSPAPAPAPVTTPTGVNGSNHTVSKSVIVPVTVGVAVLLVVILLLIALCLCKRNRKPHKHMMIGSVDLGDEDEMRGSESLLYDLSTLRAATANFSEENKLGEGGFGPVYKGTLQNGQEIAVKRLSATSHQGQLEMKNEVVLVAKLQHKNLVRLLGCCIEEREKILVYEFLCNKSLDTILFDTSRQQDLNWEQRFKIIEGIGRGLLYLHEDSRLKIIHRDLKASNILLDVDMNPKISDFGLAKLFNMEASVANTSRIAGTYGYMAPEYALHGIFSAKSDVFSYGVLLLEIVTGRRNTCLHDSEDLLAFVIPAQILSKVWRHWSRGGAGELLDGCPAAGRRPQELLRCIHVGLLCVQEDPQLRPGMAAVVVMLNSRSVTLPAPSAPAFGLREPWDRRKPAAGGGGGRCAGEEHGSRGSYGCSIAVDKRRFCL

SEQ ID NO: 63198 - protein, 420 aa, Mycobacterium avium subsp. paratuberculosis K-10
MRTLRKPRPLARATLELANAANGFRPLARKGYSTVLVFWFGWPASEVPGIYFSASLLDALRRGRRGDFAGRRGKAALALTAASWAILGVIKYRGITTAGPVLEAGLRDQLGDDYTEALNKLPQSRPTRSGRRTLPLGNIVARRRYVEKTNVVSYGPHGRANLADIWRRRDLPRDGKAPVLLQVPGGAWAIGMRRPQAYPLMSHLAARGWVCVSIGYRVSPRHTWPDHIVDVKRALAWVKENIARYGGDPNFVAITGGSAGGHLCSLAALTPNDPKYQPGFEDADTSVVAAVPVYGRYDWFTTEGEGRREFVQLLEKFVVKKKFATHRDIYVDASPIRRLRADAPPFFVLHGRDDSLIPVGEAQEFVEELRAVSKSPVAYAELPHAQHAFDIFSSPRAHRSAEAVARFLSWVYATNPPERD

SEQ ID NO: 63199 - protein, 342 aa, Streptomyces coelicolor A3(2)
MKVGVLTGGGDCPGLNAVIRAVVRKGVQEYGYDFTGFRDGWRGPLEGDTVPLDIPAVRGILPRGGTVLGSSRTNPLKQRDGIRRIKDNLAALGVEALITIGGEDTLGVATRLADEYGVPCVGVPKTIDNDLSATDYTFGFDTAVGIATEAIDRLHTTAESHMRVLVVEVMGRHAGWIALHSGLAGGANVILIPEQRFDVEQVCSWVTSRFRASYAPIVVVAEGAMPRDGDMVLKDESLDSYGHVRLSGVGEWLAKQIEKRTGNEARTTVLGHVQRGGTPSAFDRWLATRFGLHAVDCVHDGDFGKMVALRGTDIVRVPIAEATARLKTVDPALYEEVGVFFG

SEQ ID NO: 63200 - protein, 493 aa, Ostreococcus tauri
MRVARAPVTRPPAFGARAYASRARSKTASNATPRPDYDATTLFSPSVREIFLPEHIGEMYNLPKRPSPFARGGALWQFGLGQRFIDNGDSVSLNPLRTTGSSGEAASEEDVAFSDERAVRAGAREVIYYDPKKVRAAIVTCGGLCPGLNDVVRSITLTLEDYGVEDIVGIKYGFRGFFADPENALEAPMKLTSAIVDDIQITGGSMLGSSRGGADMPAIVQKIEEMELDFLFVIGGNGSHAGALAIDKLCREKNLTTSVIGVPKTIDNDILLLDRTFGFQTAVDEAVKAIRSANIEARSADNGVGLVRLMGRQSGFIAMHAALASGNTDVCLIPEIDCPLEGSGGVLAHIVRVIERQNHAVIVVAEGAGQEQLGMIGETDASGNPVLQNFAKYLQQKLKEAKPNVDIKYIDPTYMVRACRTNASDAVYCSILGQNAVHAAFAGLSAVTVGMCSGHYVYLPIPPVISAPRTVDPEGRMFERLRFAIGQPTFSKS

SEQ ID NO: 63201 - protein, 374 aa, Acetabularia peniculus
MADEEITALVVDNGSGVVKAGFAGDDAPRAVFPSIVGKPKHQGVMVGMGQKDTYVGEEAQSRRGILTIRYPIEHGIVTNWDDMEKIWHHTFYNELRVAPEEHPVLLTEAPMNPKSNREKLTQIMFETFNVPAMYVSIQAVLSLYASGRTTGIVLDSGDGVSHTVPIYEGYALPHAILRLDLAGRDLTDYLTKLLMERGYSFTTTAEREIVRDIKEKLCYVALDIEQELTSSTETLEKSYELPDGQVITVGSERFRCPEALFPPGLLGMEQLGLHDTCFNSIMKCDVDIRKDLYSNTVLSGGTMMFPGIGERMQKEITTLAPSSMKIKVVAPPERKFSVWIGGSILSSLSTFQQMWISKEEYDEAGPAIVHRKCF

SEQ ID NO: 63202 - protein, 808 aa, Oryza sativa
MESAPASRVRREDVARAVAALLRWLQHHPTPAPEPIYLLVTLKRAPARRFEHTLRLPRSPFPSISLVSDRLPADLPDDIDPLPSPALGSLPPAARRGLGPPGRQGQGGGQGRPGRARRLADQAWADSAREAARRVELRVEGGTCRAVRVGHAAMAREEAVENVVAAVEAAAACVPRKWRNVRALHVKAPESVALPLYSAVGTGGGDDGGNGEAEDAKRKGVAVKEQGIVKRRKKSSSVSVGASEVVVARRHAGAASPAAAAATHLLGTKLPGTHSDGRHCTLLDAHSSDAAQNASPRSLLGAHSGDAARHGTPRLTEHLLQPNSGVLRFSTHAHFEPDKSGSDLPQVSELPFHKFLLRVCVITSSSMAAIHLFDLNAPPPEDGDELRGGEAIADEAGVNIAGDEGGGGAVADEEIAQNVGNIASDEGVQPQERKIRRWLSDKERYAVYIALHAKSKGGRLEKDTTKKVAEYFNVGIQVIQRIWKHAREQVALGLKVDVDNRKTRCCGPNKMEIDLSKIATIPLNRRSNLRSLANSLGVSIATVHQKFKLVVDMTKRKKTYYLLPEEEDPLRTVQNKNRIGKVMFLTAIARPRFDEEGNVTFSGKIGTWPFVKEVPAIRKSRNRTIGTLETKSIIVNRDVMRQFLIEKVIPAIQSLWPEEDIGDTIYIQQDNARTHVPPNDPHFLQAVAATGLNIQLKQPSNSPDMNVLDLGFFSSIQSLTNCSSPKTIQELIHAVQEEFDGYEASKINRVFLTLQLCMLEVMKDNGGNRYKIPHMNKQALEREGRLPSWLSCDARVYEKALDCLEQVG

SEQ ID NO: 63203 - protein, 374 aa, Acetabularia peniculus
MADEEITALVVDNGSGVVKAGFAGDDAPRAVFPSIVGKPKHQGVMVGMGQKDTYVGEEAQSRRGILTIIYPIEHGIVTNWDDMEKIWHHTFYNELRVAPEEHPVLLTEAPMNPKSNREKLTQIMFETFNVPAMYVSIQAVLSLYASGRTTGIVLDSGDGVSHTVPIYEGYALPHAILRLDLAGRDLTDYLTKLLMERGYSFTTTAEREIVRDIKEKLCYVALDIQQELTASAETLEKSYELPDGQVITVGSERFRCPEALFNPGLLGMEQLGLHDTCFNSIMKCDVDIRKDLYSNTVLSGGTMMFPGIGERMQKEITTLAPSSMKIKVVAPPERKFSVWIGGSILSSLSTFQQMWISKEEYDEAGPAIVHRKCF

SEQ ID NO: 63204 - protein, 710 aa, Bacillus subtilis subsp. subtilis str. 168
MTERLLRYFRDKQQDVQSEKTYDTQCPFCSMQCKMQLVEQTIVTRKKYTAIGIDNPTTQGRLCIKGMNAHQHALNSSRITRPLLKKNGEFMPVSWEEALNHIKDQVTMIQTEHGHDAMAVYGSASITNEEAYLLGKFARVGLQTKYIDYNGRLCMSAAATAANQTFGADRGLTNPLSDIPHTRVIILAGTNIAECQPTIMPYFEKAKENGAYFIAIDPRETATTKIADLHLKIKPGTDAALANGLVKIIIDEQLINEDFIQSRTNGFEELKQHTDSLDLNDIAEQTSVSLVDIRKAAVKFAKETSGMLFTARGIEQQTDGTAAVKGFLNMVLITGKIGKPYSGYGAITGQGNGQGAREHGQKADQLPGYRSIENEEHRAHIAKVWGIHQDDLPRKGVSAYEVMEKINDGDIKGLFLMCSNPAVSSPNANLVKKALRRLTFFVAIDLFISETAKYADVILPASSYLEDEGTMTNVEGRVTLREASRPCPGEAKHDWQIICDLASALGKGRYFSYTSAEDIFNELREASRGGIADYSGISYGRLRREGGIHWPCPESDHPGTGRLFTESFAHPDQKAALSVIPNEPPVPKEKPTADYPLYLTTGRVMSHYLTGVQTRKSAALAARHFESFMEIHPQTAATYNIEDRVLVKIESPRGSITVRSKLSEQIRKDTVFVPIHWADAQNVNDLIGEALDPACKMPGFKVCAVRIIPI

SEQ ID NO: 63205 - protein, 770 aa, Bacillus subtilis subsp. subtilis str. 168
MKKQRLVLAGNGMAGIRCIEEVLKLNRHMFEIVIFGSEPHPNYNRILLSSVLQGEASLDDITLNSKDWYDKHGITLYTGETVIQIDTDQQQVITDRKRTLSYDKLIVATGSSPHILPIPGADKKGVYGFRTIEDCQALMNMAQHFQKAAVIGAGLLGLEAAVGLQHLGMDVSVIHHSAGIMQKQLDQTAARLLQTELEQKGLTFLLEKDTVSISGATKADRIHFKDGSSLKADLIVMAAGVKPNIELAVSAGIKVNRGIIVNDFMQTSEPNIYAVGECAEHNGTVYGLVAPLYEQGKALASHICGVPCEEYQGSAPSAALKIAGIDVWSAGKIQEDERTTSIKIYDEQAGVYKKALFVDDKLRVILFGDTRDKQRLLDSLLKQRDISIAKKQIIEPETSGPLFESMPSSETICQCNTVTKGAIEDAVHTNSLTTVEEVKHCTKATGSCGGCKPLVEDLLRYMTNSEYTKPASTPSFCSCTDFTEDDIIAELQRRPFTNPAEVMNQLDWKTKNGCSTCVPAIQYYLEMLYPGFVQPEPATEETCILIPQMYGGRTNAEQLRTIANIIEAYSIPDVSITHGQRLKLSGIKPADLPNMKKDLKMPVYTNEHRHALQSIKACTCGQNRSIQQLAAQIERQLEMLPLPAPISISLSCETDCTEAALQDVGAIRTQAGWDIHIGGVRGTHARSGALFCVTENEDSTAGMIKGLIQYYRETDHYLEGVHQWIDRLGIVHIREVLFEEDLRAQLLESLQTDLSLIQNPTVETGAYKKG

SEQ ID NO: 63206 - protein, 404 aa, Zea mays
  misc_feature (136)..(136): Xaa can be any naturally occurring amino acid
  misc_feature (371)..(371): Xaa can be any naturally occurring amino acid
  misc_feature (378)..(378): Xaa can be any naturally occurring amino acid
MEPGLASRVARSAAQPLSGCLSRHSLSPWLKIQNHIYPMPSLCHKVPSTAKCHTSMTTSYMETSDVTDLDWENLGFGLIETDFMYVAKCGTDGIFSKGEVLPFGPIALSPSAGVLNYGQGLFEGLKAYRKTDGSIXLLFRPEENAIRMLSGAERMCMPAPTVEQFVDAVKQTVLANKRWVPPTGKGSLYIRPLLIGSGAVLGLAPAPEYSFIIFVSPVGNYFKEGLSPINLIVEDKFHRASPGGTGGVKTIGNYASVLKAQKIAKGKGYSDVLYLDAVHDKYLEEVSSCNIFVVKDNVISTPAIKGTILPGITRKSIIEVAQSKGFKVEERLVCVDELINADEVFCTGTAVVVSPVGSVTYMGKRVEYVNXGVGVVNXQRFKSHTSLEMAHVEDWMGGTIQLYL

SEQ ID NO: 63207 - protein, 325 aa, Shewanella sp. MR-4
MVDQSQLRQWGCKVIDIEKSALDNLYQYVDSVEFAQACELILNCTGKVIVMGMGKSGHIGNKISATLASTGTPAFFVHPGEASHGDLGVLSDNDVILAISNSGESSEILALMPVIQRKAIPVIAMTGKPESTMARLSKIHLCIEVPEEACPLGLAPTSSTTATLVMGDAIAIALLQAKGFTREDFAMSHPGGALGRKLLLKVSNVMHSGDDLPLVKHDICITDALYEISKKGLGMTAVIDEQNKLVGIFTDGDLRRVIDAQVNLRTTPIADVMTRNCVTITENVLAAQALQVMDSKNINGLIVIDKDNHPVGALNMLDMVKAGVI

SEQ ID NO: 63208 - protein, 134 aa, Lilium longiflorum
RTKQTARKSTGGKAPRKQLATKAARKSALTTGGVKKPHRYRPGTVALREIRKYQKSTDLLIRKLPFQRLVREIAQDYKADLRFQSHAVLALQEAAEAYLVGLFEDTNLCAIHAKRVTIMPKDIQLARRIRGERA

SEQ ID NO: 63209 - protein, 469 aa, Pantoea agglomerans
MSAEHVLSMMNEHEVKFVDLRFTDTKGKEQHVTIPAHQVNADFFEEGKMFDGSSIGGWKGINESDMVLMPDATTAVMDPFFEDSTLIIRCDILEPGTMQGYDRDPRSIAKRAEDFLRSSGIADTVLFGPEPEFFLFDDIRFGSSTSGSHVAIDDIEAAWNTGKEYEGGNKGHRPGLKGGYFPVPPVDSSQDIRSAMCLTMEQMGLVVEAHHHEVATAGQNEVATRFNTMTKKADEIQIYKYVVHNVAHAYGKTATFMPKPMFGDNGSGMHCHMSLSKGGQNLFAGDKYGGLSEMALFYIGGIIKHAKAINALANPTTNSYKRLVPGYEAPVMLAYSARNRSASIRIPVVASPKARRIEARFPDPAANPYLAFTALLMAGLDGIINKIHPGDAMDKNLYDLPPEEEAEIPKVAGSLEEALNALNEDREFLTRGGVFTDESIDAYIELRKAEMDRVRMTPHPVEFELYYSV

SEQ ID NO: 63210 - protein, 361 aa, Arabidopsis thaliana
MNKGNTLDSIPTDLILEIFSRLSAKSVGRLRCLSKLWRKGEWFFFSSLQPQNLYEKPFLVVAADFHMKFSEDMSHDIYSYASGLIYFPKMLIENEKSGAIRVICNPITGQYAILPKLITLQAARSFLGFDPIDNQFKVLLVNNDIVNNDMDILTLGIGELMSEKLKFIEAKCFFALDDVQLINYKGKLGGISWNNHEVAPVELSMWVLEDVEKQEWSKNVYILPKNVVPNNWLHAAGVTVEGDIVFSEAVVSNPFDVFYFNPEKNTLQHVETHCNHEVFDDENLVNIFVDHVEDLKFDVMKPTYAATSIRPTEQKHKPTSTETSMSRKDHQVRTIDQPQQDRCTFESINNKFDVMCLLDDD

SEQ ID NO: 63211 - protein, 339 aa, Mycobacterium avium subsp. paratuberculosis K-10
MTVRVGINGFGRIGRNFYRALLAQQEQGTADIEVVAVNDITDNSTLAHLLKFDSILGRLPYDVSLEGEDTIVVGPAKIKALEVREGPAALPWGDLGVDVVVESTGLFTNAAKAKGHLDAGAKKVIISAPATDEDITVVLGVNDDKYDGSQNIISNASCTTNCLAPLTKVLDDEFGIVRGLMTTIHAYTQDQNLQDGPHKDLRRARAAALNIVPTSTGAAKAIGLVMPNLKGKLDGYALRVPIPTGSVTDLTAELKKPASVEDINAAFKAAAEGRLKGILKYYDAPIVSSDIVTDPHSSIFDSGLTKVIDNQAKVVSWYDNEWGYSNRLVDLVALVGKSL

SEQ ID NO: 63212 - protein, 415 aa, Mycobacterium avium subsp. paratuberculosis K-10
MAVHNLKDLLAEGVSGRGVLVRSDLNVPLDSDGEQGRITDPGRITASVPTLSALVEAGAKVVVAAHLGRPKNGPDPALSLAPVAAALGEQLGRHVQLASDVVGTDALARAEGLTDGDVLLLENIRFDARETSKDDAERLALARQLAELVGPTGAFVSDGFGVVHRKQASVYDVATLLPHYAGTLVAEEIAVLEQLTGSTKRPYAVVLGGSKVSDKLGVIESLATKADSIVIGGGMCFTFLAAQGFSVGKSLLETEMVDTCRRLLDTYVDVLRLPVDIVAADRFAADAAPQTVPADAIPDDLMGLDIGPGSVKRFTALLSNAETIFWNGPMGVFEFPAFAAGTKGLAEAIAAATGKGAFSVVGGGDSAAAVRALGIPESGFSHISTGGGASLEYLEGKALPGIEVLGRPQPTGGAA

SEQ ID NO: 63213 - protein, 261 aa, Mycobacterium avium subsp. paratuberculosis K-10
MSRKPLIAGNWKMNLNHFEAIALVQKIAFALPDKYYDKVDVTVLPPFTDLRSVQTLVDGDKLRLSYGAQDLSQHDSGAYTGDISGAFLAKLGCTFVVVGHSERRTYHNEDDALVAAKAATALKHELTPIICIGEHLEVREAGNHVIHCEEQLRGSLAGLSAEQIGKVVIAYEPVWAIGTGRVASASDAQEVCAAIRKELASLASAQIADSVRVLYGGSVNAKNVGELIAQDDIDGGLVGGASLDGEQFATLAAIAAGGPLP

SEQ ID NO: 63214 - protein, 378 aa, Ostreococcus tauri
MTTTTGADAGSIAALTTRDVVYETVKIDGDPNEVGHVVHTGAPGASGEISYETVRVVGHGSFGVVYQARCRENGQEVAIKKVLQDKRFKNRELQIMKAVEHPNVVKLIHSYYHTTAEEEVYLNLVLEFVPDTVYRIGKHYSKNNQRVPGLLVKLYTYQMARALASVHKLGICHRDIKPQNLLVDSKTHVLKICDFGSAKILAPTEPNISYICSRYYRAPELIFGAVHYTTAIDIWSIGCVTAELLLGSPLFPGDSGVDQLVEIIKILGTPTKEQILHMNPGYTDFTFPQLKPHAWSKVFSKNADPLAIDLISKILVYVPQERFNCMELCAHEYFDELRDESTRLPDGSALPPLFNFSDDELSSLDDNLKAKLIPAHAR

SEQ ID NO: 63215 - protein, 313 aa, Oryza sativa (japonica cultivar-group)
MASDGTDVVALYGGANGLSHKSGSFSVKVGLAQMLRGGVIMDVVTPEQARIAEEAGACAVMALERVPADIRAQGGVARMSDPGLIRDIKRSVTIPVMAKARIGHLVEAQILEAIGVDYVDESEVLTLADDAHHINKNNFRVPFVCGCRDLGEALRRIREGAAMIRTKGEAGTGNVVEAVRHVRSVMGDIRALRSMDDDEVFSYAKRIAAPYDLVMQTKQLGRLPVVQFAAGGVATPADAALMMQLGCDGVFVGSGIFKSGDPALRARAIVQAVTHYSDPKILAEVSSGLGEAMVGINLSDPKIHVERFAARSD

SEQ ID NO: 63216 - protein, 690 aa, Oryza sativa
MAGLIVLRRERLERRRRRRLGDDSDDSPGLPAPSPVSSLLSPLPGLLTSFLSARPARAPPGPPPPRPHAVVLKMLPAGATTARLSAMDAGAHLSPIPSTSLRAAVRADRRPAPARRCPSHPLTGARLSAMACRRARRCLLLADEERERVYDILQCTSAHVLANRRAAMAMNFEMWGAVWSALASLVFLWPMLQNHVPAGLRHWLTAMADKLASHLSPYLHITISEYGDHRFRRSDFFLAVEAYLSHACARRARRLKADLGRDARSVQVSVDDHQEVTDSFRGATLWWYPSSMSNKSSVISFYPGEDERRLYRLVFHRRHRDLVLDGYLPHVLAEGRAVTVRNRQRRLFTNNASTSWNPYRRGKGVWSHVPFEHPASFDTLAMDPGDKDAIVVDLVAFRDGKDYYAKVGKPWKRGYLLYGPPGTGKSTMIAAMANFLDYDVYDLELTAVKNNTELRKLYIETTGKSIIVIEDIDCSIDLTGKRKKSSGDNKASDGGGEGSDDKPKLPTEADKDDGGSKVTLSGLLNFIDGLWSACGGERIIIFTTNHKEKLDPALIRRGRMDVHIEMSYCGFEAFKVLASNYLGVEQHELLGDIRRLLEEADMSPADVAENLMPMSKRKKRDPDACLAGLVEALNMAKEEAQANKAAKEDEEAKAAKGIEEMKTKEQATTNGEDEGKDKRTSEENKANGDI

SEQ ID NO: 63217 - protein, 390 aa, Synechococcus sp. CC9311
MATLLEQLSAMTVVVADTGDLEAIRRFTPRDATTNPSLILAAAQIPAYENLIDEALRSSRRLLGESAPVEQVVHEALDEISVIFGKEILKIVPGRVSTEVDARLSYDTEATIEKGRKLIRLYNDSGISNDRVLIKIASTWEGIKAAEVLEKDGIHCNLTLLFGFSQAVACAEASVTLISPFVGRILDWFKADTGRDSYPGPEDPGVISVTSIFNYFKTYGYKTEIMGASFRNLDEITELAGCDLLTISPKLLDQLRSSDAALIRKLDPANLAPVSEQMHVDQELFISMMAEDRMATDKLSEGIKGFSKAIETLEQQLAHRLAQLEGGSAFSHAVQEIFMLNDFNGDGCITRDEWLGSDAVFDALDQDHDGRLTPDDVRLGFGGALSLTAV

SEQ ID NO: 63218 - protein, 482 aa, Neisseria meningitidis
GSADAEYDVVVLGGGPGGYSAAFAAADEGLKVAIVERYKTLGGVCLNVGCIPSKALLHNAAVIDEVRHLAANGIKYPEPELDIDMLRAYKDGVVSRLTGGLAGMAKSRKVDVIQGDGQFLDPHHLEVSLTAGDAYEQAAPTGEKKIVAFKNCIIAAGSRVTKLPFIPEDPRIIDSSGALALKEVPGKLLIIGGGIIGLEMGTVYSTLGSRLDVVEMMDGLMQGADRDLVKVWQKQNEYRFDNIMVNTKTVAVEPKEDGVYVTFEGANAPKEPQRYDAVLVAAGRAPNGKLISAEKAGVAVTDRGFIEVDKQMRTNVPHIYAIGDIVGQPMLAHKAVHEGHVAAENCAGHKAYFDARVIPGVAYTSPEVAWVGETELSAKASARKITKANFPWAASGRAIANGCDKPFTKLIFDAETGRIIGGGIVGPNGGDMIGEVCLAIEMGCDAADIGKTIHPHPTLGESIGMAAEVALGTCTDLPPQKK

SEQ ID NO: 63219 - protein, 265 aa, Pseudomonas fluorescens PfO-1
MTQQYKGTALITGASTGIGSIYAEHLARRGYDLVLVARNRERLNALASRLTSETRQNIEVLQADLGRPEDLAKVERKLREDASITLLVNNAGIGTHTGLLESDVERMAEMITLNVTALTRLTYAAIPGFVARERGAVINISSIVSLAPELLNGVYGGSKAYVTAFTQSLHKELSDKGIRIQAVLPGATATDFWQIGGLPVEHLDPGIVMSAQDLVAGALQDFDNGVLISIPSMHDLQGYERYEASRQALFSELSSNRLAPRYNAN

SEQ ID NO: 63220 - protein, 477 aa, Bacillus subtilis subsp. subtilis str. 168
MIHQHPESFPKHFLWGSASAAYQIEGAWNEDGKGPSVWDVFTKIPGKTFKGTNGEIAVDHYHRFKEDVALMAEMGLKAYRFSVSWPRVFPKGKGEINEAGLAFYDSLIDELLSHHIEPVLTLYHWDLPQALMDEYGGFESRNIIEDFNHYCITLYKRFGDRVKYWVTLNEQNYNFNHGFITAMHPPGVKDRKRFYEANHIAFLANAKAIESFREYVPEGKIGPSFAYSPAYPLSSHPEDILAFENAEEFTNNWWLDMYCWGTYPQIPFRCLEKQGWAPTIEAGDMDLLAKGKPDFVGVNYYQTITYERNPLDGVSEGKMNTTGQKGTNQETGIPGVFKTKKNPHLTTSNWDWTIDPIGLRIGLRRITSRYQLPVFITENGLGEFDKVEDGTVQDDYRIDYLRSHLEQCRQAISDGVDLIGYCSWSFTDLLSWLNGYQKRYGFVYVNRDEESTSDLKRLKKKSFYWYQDVIKTNGESL

SEQ ID NO: 63221 - protein, 335 aa, Saccharophagus degradans 2-40
MPRIAINGFGRIGRNVLRAIYERNLQNEMQVVAINDLGSPDINAHLLKYDTVHGRFGFDVEASEGAIRVNGDEIKITAERNPADLPWAALNVDIVFECTGLFVARDKAALHLDAGAKNVLISAPGKDVDLTVVYGVNHESITADHKVLSNASCTTNCLAPMTSALHSAIGVKTGLMNTIHSYTNDQRVTDAYHSDTLRARAAALNMIPTKTGAAAAIGLVIPDLAGKLDGLSIRVPTVNVSCLDFTFEAARDTTVEEVNQVLRDAAAGPLKGVMDVNTIPLVSSDFNHDAHSCIVDLSHTRVMGNQVKVLAWYDNEWGFSNRMLDTTMAIVKANA

SEQ ID NO: 63222 - protein, 1012 aa, Desulfovibrio vulgaris subsp. vulgaris str. Hildenborough
  misc_feature (189)..(189): Xaa can be any naturally occurring amino acid
MKTTRRSFLKLVGVSVVGLSLGQLGFDLEDAQAYAVKLKIEGAKEVGTVCPFCSVCCQVIAYVRNGKLVSTEGDPDFPVNEGALCAKGAALFSMYTNPHRLTKPLYRAPHSDKWVEKDWDWTLNQIARRVKDARDKDMILKNDKGQTVNRLESIFMMGTSHASNEECAVIHQAMRGLGVVHMDHQARVXHSPTVAALAESFGRGAMTNHWIDIKNTDAVLIIGSNAAEHHPVAFKWIMRARDNGAVLMHVDPKFSRTSARCDFHVPLRSGTDIAFLGGMVNHIIAKDLYFKDYVANYTNAAFVVGKDYAFEDGIFSGYDPKTRTYDRSKWEFEKGPDGGPVMDPTLKNERCVFNLMKKHYERYTLKNVSDVTGVSEENLLRVYDAFCATGRPDKAGTILYALGWTQHTVGVQNIRTSTLIQLLLGNIGVAGGGINALRGEPNVQGSTDHALLYHILPGYNAMPVAQWQTLADYNKANTPVTTLKNSANWWSNRPKYVASLLKGWFGDAATPENDFCYEYLPKLEKGEDYSYMYVMDRMYHGKLKGGFIFGVNPMNSFPNTNKMRAALDKLDWLVCSELHNSETTDNWKRPGVDPKACKTEVFLLPSAHRVEKAGTISNSGRWLQWFDKAVEPGQARNFADIFVPLVNKIRALYKAEGGTLPDPVLKLHWTDKFDPEEWTRRINGFFWADTKVGDKEYKRGQLVPAFGQLKDDGSTSSLNWLYTGSYTEEDGNKSKRRDARQTPMQANIGLFPNWSWCWPVNRRILYNRASVDVNGKPWNPKKAVIEWDGAKWVGDVPDGPWPPMADKEKGKLPFIMNKDGFAQFYGTGRMDGPFPEHYEPAETPLDSHPFSKQLSSPVYKFHTSDMDQIAKAADPKYPIVLTTYSLTEHWCGGGETRNVPNLLETEPQLYIEMSPELAEEKGIKNGDGVIVESIRGRAEAIAMVTVRIRPFTVMGKTVHLVGMPFAYGWTTPKCGDSTNRLTVGAYDPNTTIPESKACLVNVRKADKLTEIA

SEQ ID NO: 63223 - protein, 656 aa, Helicobacter pylori J99
MQKSLITTPIYYVNDIPHIGHAYTTLIADTLKKYYTLQGEEVFFLTGTDEHGQKIEQSARLRNQSPKAYADSISAIFKNQWDFFNLDYDGFIRTTDSEHQKCVQNAFEIMFEKGDIYKGTYSGYYCVSCESYCAVSKVDNTDSKVLCPDCLRETTLLEEESYFFKLSAYEKPLLEFYAKNPEAILPIYRKNEVTSFIEQGLLDLSITRTSFEWGIPLPKKMNDPKHVVYVWLDALLNYASALGYLNGLDNKMAHFERARHIVGKDILRFHAIYWPAFLMSLNLPLFKQLCVHGWWTIEGVKMSKSLGNVLDAQKLAMEYGIEELRYFLLREVPFGQDGDFSKKALVERINANLNNDLGNLLNRLLGMAKKYFNYSLKSTKITAYYPKELEKAHQILDNANSFVPKMQLHKALEELFNIYDFLNKLIAKEEPWVLHKNNESEKLEALLSLIANTLLQSSFLLYAFMPKSAMKLASAFRVEITPNNYERFFKAKKLQDMVLQDTEPLFSKIEKIEKIEKIEKIEKIEKGEEALAEKAEKKEKEKAPPTQENYISIEDFKKVEIKVGLIKEAQRIEKSNKLLRLKVDLGENRLRQIISGIALDYEPESLVGQMVCVVANLKPAKLMGEMSEGMILAVRDNDNLALISPTREKIAGSLIS

SEQ ID NO: 63224 - protein, 391 aa, Oryza sativa (indica cultivar-group)
MVAAAAAAAEAKAAIGVATPTPTAAPCGSTTTPRDADVDDKMTIVGHPAASLPLETRWPPFPLRRLGGFWMPESLLPAVAALHTSFAPAPDGVLLASFPKSGTSWLKALAFAAANRAAHPPSDADHPLRRRNPHDCVEFFEMRPDEHTGATSDGIAVDAASPPPPPRVLATHLPYSLLPKRITAGDGCRIIYICRDPKDTLVSFWHFSKKMAATMAVDAGAFTFDEAFELFCDGNCTGGPQWRHVLEYWEASRRCPGKVLFLRYEDMLRRPASGLRKMAEFMGCPFAAAEEAAGVADAIVELCSLDELRSLEVNRNGTDVLGLKNESYFREGVAGDWRNHMTPAMAARLDKIVNDATRGSGLSLANATPSPPMHENEIKGNLTIYHSQNDI

SEQ ID NO: 63225 - protein, 295 aa, Oryza sativa (indica cultivar-group)
MGTISRSILLARADKHVHRHANTGGGKFRLGGTSAVYEDPHRLSLRRLRLRDVLNDDADSSEFAATDAKVAGQEEERRAQQRLALIAVGGRGRWDEPLVSGEIYDPVTDKWFEIAGFPADVGLACSGAVCGQMFYVYCESDTLVAYHLDKGFWSVIQTSRPPPRLRDYAPTLLCCSSRLLMLCVSWCDRAGNGAASRRERVVRKLFELDLGSRRWGEASSHPDAPMDLNAAFAAGADTVYAVEMFRVFGKVLDFVTACRVSDTDDHRWRRLARNNAAADADAMAGYHRMSTCFRF

SEQ ID NO: 63226 - protein, 635 aa, Geobacillus kaustophilus HTA426
MCGFIGCIHDRPRAIEQTWKTTLVEMNRLITHRGPDDEGYFFDDYVSFGFRRLSIIDLEAGHQPLSYENDRYWIIFNGEIYNYLELREELAAKGYSFATHSDTEVIVALYSAEKEKAVEKLRGMFAFVIWDKQEKTVFAARDPFGIKPFFYAEQGDRTFFASEKKSILLALRQESPNGDSLQHYLTFQYVPEPLTMSAGIYKLEPGHYLKKKVGKPLTIHRYWKASFEPIRQSEEELVKKIRDALFDSVNVHMRSDVPVGAFLSGGIDSSFIVAIAKQFHPHLKTFSVGFEREGFSEIDVAKETAEKLGVDNISYVISPQEYMEELPKIMWHMDDPLADPAAVPLYFVAREARKHVTVVLSGEGADELFGGYNIYREPESLRLFARMPNIVKAVLRVIAKMLPDGMKGKSFLERGTTPLEERYVGNAKIYSEKEKAALLKTYQEGREYTAVTAPFYRETLHYPPVNRMQYIDLHTWLRGDILVKADKMTMAHSLELRVPFLDKKVFEVARQIAPDMKTANGTTKYILRKAAEGIVPDHVLNRKKLGFPVPIRHWLKNEMYDWARQLINESETDHLFHKDVLYRLLDEHARHKADHSRKLWTVLAFMVWHQVYVEKKYDFAQSVQNEKRPASVLEA

SEQ ID NO: 63227 - protein, 508 aa, Helicobacter pylori J99
MILVLDFGSQYTQLIARRLRESGIYAEIVPFFESVENIQKKAPKGLILSGGPASVYAKDAYKPSEKIFDLNLPILGICYGMQYLVDFFGGVVAYANEQEFGKAILEIVQNSVIFEGVKIKSLVWMSHMDKVIELPKGFTTLAKSPNSPYCAIESDKIFGLQFHPEVIQSEEGGKILENFALLVCGCEKTWGMQHFAQREIVRLKEKIANAKVLCAVSGGVDSTVVATLLHRAIKDNLIAVFVDHGLLRKNEKEKVQAMFKDLQIPLNTIDAKEVFLSKLKGVSEPELKRKIIGETFIEVFEKEAKKHHLKGKIEFLAQGTLYPDVIESVSVKGPSKVIKTHHNVGGLPEWMDFKLIEPLRELFKDEVRLLGKELGVSQDFLMRHPFPGPGLAIRILGEINENKIKRLQEADAIFIEELKKANLYDKVWQAFCVLLNVNSVGVMGDNRTYENAICLRAVNASDGMTASFSFLEHSFLEKVSNRITNEVNGINRVVYDITSKPPGTIEWE

SEQ ID NO: 63228 - protein, 612 aa, Arabidopsis thaliana
MDKRLDSTEQVVEEIMRIHRSLPARPGIDEVEAAKGLIDNVEKEDQACLEAIARQRKSSEVPGELFMVLQEMKKGYVQFRSKEQIREALKLLDLESVHSLFDDFIQRASNCIASPSSNGSVSSRPPLPPATTTAARSDSQSSLNFSERAPVRPKDMVSRDDSFVTKSKPSSLYSDGFAAPPRRPQILDSTLTTGNDGEKLSLIKLASLIEVSAKKATQEINLQNKLTEQLEWLPDSLGKLSSLTSLDLSENHIVVLPNTIGGLSSLTKLDLHSNRIGQLPESIGELLNLVYLNLGSNQLSSLPSAFSRLVRLEELDLSCNNLPILPESIGSLVSLKKLDVETNDIEEIPYSIGGCSSLIELRADYNKLKALPEAIGKITTLEILSVRYNNIRQLPTTMSSLASLKELDVSFNELESVPESLCFATTLVKLNIGNNFADMVSLPRSIGNLEMLEELDISNNQIRVLPDSFKMLTKLRVFRAQENPLHIPPRDIAEKGPQAVVQYMNDLVETRNAKSLMVKPKKSWVQMCFFSKSNKRKQSSMEIMFHYSFFVCFFLHYSHVSMCTTLFHSCLSTYHRAHPKTESNHVPCRLRFSLSSYHVCLSSLVLFLWFET

SEQ ID NO: 63229 - protein, 699 aa, Mycobacterium avium subsp. paratuberculosis K-10
MTTLEEISALTQPHLPDDWSELDSAAVDTIRVLAADAVQKVGNGHPGTAMSLAPLAYTLFQRVMRHDPSDTHWLGRDRFVLSAGHSSLTLYLQLYLGGFGLELSDIESLRTWGSKTPGHPEFRHTKGVEITTGPLGQGLASAVGMAMASRYERGLFDPDAAAGTSPFDHFIYVIASDGDIEEGVTSEASSLAAVQQLGNLIVFYDHNQISIEDDTNIALCEDTAARYEAYGWHVQRVEGGENVVAIEEAIAAAKAVTDRPSFIELRTIIGYPAPNAMNTGKAHGAALGEEEVAAVKKILGFDPDKTFQVRDEVIAHTRKLVDRGREAHQKWQTDFDAWAQREPERKALLERLTAEKLPDGWDADLPHWEAGSDAIATRKASGAVLNAVAPKLPELWGGSADLAESNLTTINNADSFGPPSISTKEFTASWYGRVLHFGVREHAMGAILSGIVLHGPTRAYGGTFLQFSDYMRPAVRLASLMDIDTIYVWTHDSIGLGEDGPTHQPIEHLAALRAIPKLSVVRPADANETAYAWRTILARGNGSGPVGLVLTRQGLPVLEGTDADGVARGGYILGSDGEEAGQEPDVILIATGSEVQLAVEAQKLLADKDIVARVVSMPCVEWFESQPDDYRDSVLPPSVSARVAVEAGVAQSWHKLVGDTGKIISIEHYGESADYKTLFREFGFTAEAVAAAAEEVVDN

SEQ ID NO: 63230 - protein, 263 aa, Triticum aestivum
  misc_feature (87)..(87): Xaa can be any naturally occurring amino acid
  misc_feature (243)..(243): Xaa can be any naturally occurring amino acid
ADDLRQAVSKVGNFSEDNRSGINHSLHRISAIRNRKANIIGLTCRVGRAISGSAEMIRDLVVGGGSILVIGPPGVGKTTLIREIARXILADEGKKRVIIVDTSNEIGGDGDVPHSGIGRSRRMQVPKVTMQHNVMIEAVENHMPEVIVIDEIGTELEAMAASTIAQRGVQLVGTAHGVTIDSIIKNPCLQMLVGGIESVTLGDEEAKKRKVQKTILERKGPPTFSCAVEMVSKTECRVHHKLXSTVDAILAGKPPKFEARMMD

SEQ ID NO: 63231 - protein, 361 aa, Oryza sativa (japonica cultivar-group)
MASPPEDAPAIPSNPSVPQEGRPKGVTPKFSLAPLVPRLSELLGIQVTKAEDVIGPDVEKLVSELPNGSVLLLENVRFYKEEEKNDPEFAKKLASLADLYVNDAFGTAHRAHASTEGVTKFLKPSVAGFLLQKELDYLVGAVSSPKRPFAAIVGGSKVSSKIGVIESLLEKCDILLLGGGMIFTFYKAQGLSVGSSLVEEDKLELATSLLAKAKEKGVSLLLPSDVIIADKFAPDANSQVVPASAIPDGWMGLDIGPDSVASFSSTLETTQTVIWNGPMGVFEFDKFAVGTEAIAKKLADLSGKGVTTIIGGGDSVAAVEKVGVADVMSHISTGGGASLELLEGKELPGVIALDEAVTVAV

SEQ ID NO: 63232 - protein, 328 aa, Candida glabrata CBS 138
MSSGKISGRNAINIVKNVKVKPTSDSLISGSNKVNVKRSGLLSKPHKKHASSDKSHSWINLNKYMNNSYAYPSASQLNAINHFFNRAECKYEWSVADFGNIPSEQMKSVYGHNSGMNHEGGKLYNGKTRYPFQLLNPLPEIAFLGKTNVGKSTILNNLITSFKQKDLDVHARMSNRAGFTKTLNCYNVGNKFRIIDTPGYGFHSAIEQGNVTLDYLSNRKELKRCFLLISAKKEISEHDRYLMDLMTESGIPFELIFSKMDKVTDVDEFVQWIDSSGLRNLPTLPKLIFTNSMVSKFIKKRYGVDLLRYSIFEACNLDSSVKPERIKY

SEQ ID NO: 63233 - protein, 400 aa, Acorus calamus
MNRRRKDMTVPATRQDLMIVNMGPHHPSMHGVLRLIVTLDGEDVIDCEPILGYLHRGMEKIAENRTIIQYLPYVTRWDYLATMFTEAITVNGPEQLGNIQIPKRASYIRVIMLELSRIASHLLWLGPFMADIGAQTPFFYIFRERELIYDLFEAATGMRMMHNYFRIGGVAADLPYGWIDKCLDFCDYFLTGIVEYEKLITQNPIFLERVERVGIISGEEAINWGLSGPMLRASGIEWDLRKVDNYECYNEFDWEVQWQKEGDSLARYLVRISEMKESIKIIQQALEGIPGGPYENLEVRRFDKVKDSEWNDFEYRFISKKPSPTFELAKQELYVRVEAPKGELGIFLIGDNSVFPWRWKIRPPGFINLQILPQLVKRMKLADIMTILGSIDIIMGEVDR

SEQ ID NO: 63234 - protein, 305 aa, Synechococcus sp. CC9311
MHQFLPYAWFEGRCIPFEQAKVSIATHALHYGTGAFGGMRAIPDPEKPGGMLLFRPDRHARRLSQSAKLLLADLSEDTVMEALVAVLRANKPTTPIYLRPFVYTSDLGIAPRLHNIETDFLIYGLELGDYLSPDGVSCRISSWTRQEDRSLPLRGKISGAYITSSLAKTEAVNSGFDEALLMNTRGKVSEASGMNLFLVRDGVLITPGVDQDILEGITRSSVIELAKHMGLQVIERPVDKTELCIADEVFLTGTAAKITPIRQLESTLLPTNRPVMDALRKRLVSITEGRDPEFRHWVTRIELET

SEQ ID NO: 63235 - protein, 319 aa, Yarrowia lipolytica CLIB122
MNTDKVNSIVSFLRPLISAHRSASANVPFVLGFSGPQGCGKSTLVAELSTALRQAPFNYKVIELSLDDLYLTHEGQERLSEEFPNNKLYRHRGEPGTHDVALGEKTLKSLVQNKVTPVPRYDKSKFQGQGDRVPESEWPVMTPPFDVVLFEGWCAGFRAISIDELEALYAQSTSLARDETDPDAAPAVDPANLEASSIDQLKEPVPTTLAHHQFSDLQQVNHELKKLQQLWKYFDAFVHLDSLDINFTYKWRLQQEHALIQKRGTGMTDQQVKKFIDGYMPAYEMYIPGLREQTLLTRPNRQLRLVLDEDRKVKFERVK

SEQ ID NO: 63236 - protein, 213 aa, Zea mays
MDSSSSSLSQQPEFDYLFKLLLIGDSGVGKSSLLLRFTADSFDDLSPTIGVDFKVKMVTIGGKKLKLAIWDTAGQERFRTLTSSYYRGAQGVIMVYDVTRRETFTNLSDIWAKEIDLYSTNQDCIKMLVGNKVDKESERAVTKKEGIEFAREYGCLFLECSAKTKVNVEQCFEELVLKILDTPSLLADASSGAKKNIFKQKPPEADAAASSCC

SEQ ID NO: 63237 - protein, 459 aa, Pyrococcus furiosus DSM 3638
MEYPKIITKLPGPKATEIIERESRILSPGIGVKLFPLVPKRGFGALIEDVDGNIFIDFLAGAAAASTGYSHPKLVKAVQEQVALIQHSMIGYTHNERAIRVAEKLAKISPIKNPRIIFGMSGSDAVDMAIKVSKFSTRRPWILSFIGAYHGQTLGATSIAAFQSSQKRGFSPLMPNVIWLPYPNPYRNIWGIDGYEEPNELINRFLDYLENYVFSHLSPSDEVAALFAEPIQGDAGIVVPPENFFKEVQKVLNDLGILLVMDEVQTGIGRTGKWFASEWFSVEPDLIIFGKGVASGMGLSGVIGRKELMDLTSGAALLTPAANPVVSAAAEATLEIIEEENLLENALKVGNFIKKRLEEMKEVFEVIGDVRGKGLMIGVEIVKDRESKKPDPELTGKICWRAFELGLILPSYGMFQNVIRITPPLVITQEIAEKGLEIMERAIKDALAGKVERKVVTWH

SEQ ID NO: 63238 - protein, 441 aa, Photorhabdus luminescens subsp. laumondii TTO1
MQATSQEQISQHYRRWRSRLLISMIIGYAAFYLTRKSFNFVMPVMQLELGLDKGHIGWITTLFYLAYGSSKFISGVFHDRTGYRWFMGAGLVMTGVLNIIFAFCSSFSALLIIWTLNGFFQGWGWPPCARLLTHWYSRNERGFWWGYWNISINIVGITVPMLSAFLATTYSWQTALMMPGIIGILLGIWLCYQLCGTPQQHGLPSVGQWRQDSLELRHEQLSHPMPMMQILRDTILTNRTIWLLGCSYILVYLIRMAINDWGNLWLSETHGANLLSANATLSLFELGGLTGALFSGWGSDLLFRGQRAPMILLFALGLFMAVTALWLTPIHHYTLLAVCFFSIGFFVFGPQMLIGLAATEYCHKQAAGTVTGYLGLYAYLGAAIAGWPLSQVVAHYGWSGMFALLTAAAAMMGLLLMPMLMADVSKREHGVASRLSNNKQF

SEQ ID NO: 63239 - protein, 188 aa, Pisum sativum
MNNGGEQYSAIETQYIRRRHKHDLRDNQCSSALVKHIKAPVHLVWSLVRRFDQPQKYKPFVSRCIMQGDLGIGSVREVNVKSGLPATTSTERLEQLDDEEHILGIRIVGGDHRLRNYSSVITVHPEVIDGRPGTMVIESFVVDVPEGNTRDETCYFVEALIRGNLSSLADVSERMAVQGRTDPINVNP

SEQ ID NO: 63240 - protein, 277 aa, Zea mays
  misc_feature (227)..(227): Xaa can be any naturally occurring amino acid
  misc_feature (241)..(241): Xaa can be any naturally occurring amino acid
MAPRKFFVGGNWKCNGTGDDVKKIVTFLNEAEVPSEDAVEVVVSPPFVFLQQAKGLLRPDFAVAAQNCWVRKGGAFTGEISAEMLVNLQVPWVILGHSERRALLNESNDFVADKVAYALAQGLKVIACIGETLEQREAGTTMEVVSAQTKAIAEKTSDWTNVVLAYEPVWAIGTGKVASPAQAQEVHDGLRKWLHANVGPAVAESTRIIYGGSVNGANCKELAAQPXDLDGFLVGGASLKXPEFVDIIKSATVKSSSCLVVFEMHAVACRSGFCLSL

SEQ ID NO: 63241 - protein, 446 aa, Pseudomonas fluorescens PfO-1
MTTQRIHPVDEVLPLRQLFTFGLQHVLVMYAGAVAVPLILGSAMGLTSAQVVLLINANLLTSGVATLIQTLGFWKFGARLPLIQGCSFIALAPMIMIGKEFGLSQIFGAVIAAGFITVALAPVFSRLLRFFPPVVIGSLITIIGISLMPAAAIWLGGGNPDSADFGNPANLLLGLATVSVTLVIYARFKGFIGNLSVLIGLFVGSLIAAACGMTHFNRVSEAAWFELSAPMAFGAPEFAPVPILIMTLAMLVIMAETTGNCLAIGKLTGKPTTQQTLGNAFRADGLSTMLGGLFNSFPYNAFTQNTGLIALSNVKSRFVVAAAGAIMVLMGLFPKLGALIAAVPTPVLGGCAIVMFGMTTVAGIQELSRVQFEGTRNGIIVAVSVSAGVLPMSFPALFEHVGPTLKLVLDSGIFLGAITAIVLNVLLNDEKKPTETIGATSAELAD

SEQ ID NO: 63242 - protein, 879 aa, Candida albicans SC5314
MSGLDRGANTATTTTTSSSSTTSSSSYSITYSTDEIPILTYTNNNNNNSLHIHQSSEVHETSHHSQYEENTFIDWSKESIIISRNPSVFLTNKWIILIFSAIILGYFTSAIDLIQVSLNDFKKGICFSSKDSWTLLNPYMTCPVEDWYNWDQIFFTIRNPIVKFIINFPIYLILALAFGIIAGYLTYNRAYMIRQSGIPEIKLIISGFNLKIDQYLGFKTLLSKSIALIFVVSSGLWLGKEGPLVHISCCVFNIIYEIISKYYSNQNEAIRRELLTAATATGISVAFNSPIGGVLFVLESMPSYFIPTRIMWNSFVSATVATIILTGFKIFTDGRNFNEQVLFQVNFGNFSWLFVEIIPFIMLGIMGGVYGHYFIKFNGKFSNIKIRSLIRHRLCNLLKVDYKYGSILEILLIVLITTIINFPFEISKLPLNALLNLLFKSCTKDNDNSNLSTSKDFICQDSNGVALFKLLYIMIEGFWLTCYTFGLDLPGGILMPSLVMGAMTGRFLGIITQAIQSKFNWESLATCTADSCLVSPSSYAVIGAASFMTGVTKLTMSVVVIMFEMTGAVTYVLPIMGGVMTSKFVSDWLTPNNIYDTWLQNNFNQSSDGVEGVTTNNHLNSNFYDNGNQLINQGKGTGLISFQNLTSTIKSKLPNINIASSMIPLLDVKCLCLLPDQEQEQFTLNSLNSFINNDCHEGYPMIINYNNPIIVGYIPKSQLLNQLFLSLSNREIDSNSPISFQINHGVDIPERVEQLLSQRKQPQVVSINVHPIQSTLIINEKTPILLIIEMFEKLHLNSLIIVSNQDETSMTGFIDRFILNDLIIDKFEKLVDKLNDYQVIQQFDIEENAGRVEMTEFDYDNDEDDDMTRIDRKSIELIT

SEQ ID NO: 63243 - protein, 219 aa, Pseudomonas fluorescens PfO-1
MRDIIDGFLRFQREVYPQRVELFRQLATEQNPKALFVTCSDSRVVPELLTQREPGELFVIRNAGNIVPSYGPEPGGVSATVEYAVAVLGVRDIVICGHSDCGAMGAISRCTCLDHLPAVANWLRHSDAAKAINAAHEFDTPRDKLDGLVRENVIAQLANLRTHPSVALALEQGRLNLHGWVYDIEAGCIDALDGATRRFVPLSDSPTTVAVAARNGGQI

SEQ ID NO: 63244 - protein, 817 aa, Arabidopsis thaliana
MLHRLRWFIGLSKRSREAKTLDAKPYISKVKPVLMVDTVQEIAIYIHRFHNLDLFQQGWYQIKITMRWEDGDNVTRGIPSRVVQYEAPDSGANDSYGVWKIVDKDNSFLTQPFRIKYARQDIRLCMMISFTLPLERYEGSATSAAILKFELMYAPSVDNASAKQLDTSPVAVHEFRIPPKALTGLHSYCPVHFDTLHAVLIDVSVHISVLKSAAYKRPASLSSGVSNSKNVSGSSAQSFKKALGLLASADKKLVSFVKALLGARGILLEEMQRLSKAVGQTIDLSDFVSNMNNVQLSNSTSTGSGQGKEQNSLEVLALILMLTGFFPIIFASFSSAYFSILLAQNLNITFDLTSDDWLHELSKDHLSRIFHLLGTQLHYLWNTLLGFHRDNHTKILEYLRDIWTKDRRAEWSIWMVYSKVEMPHHFINSGMTDILNQSAHKRASGVLNEPAQIAATRAELHRRSIAQMRINNRSIQDMHILGDPMRVPIVIIERVLNAPRRTLSDNSYLRHMDLLDSSLLNGHKDEAEKTKVTNSQQSARELKIVGHHLDLRLVRNQWLLIDPKIEFLMSEANEEKTHGDFREMGQRLAQEVVSFLKRKKDRYARQGHLKSIKLSFVGHSIGNVIIRTAIADSLMEPYRKYLHTYLSLSGPHLGYLYSTNSLFNSGLWLLKKLKSTQVIHQLTLTDDPDLRHTFFYKLCKQKTLENFKNIILLSSPQDGYVPYHSARIESCQPASFDSSKRGVAFLEMLNNCLDQIRGPVPEAPHQQRVFMRCDVNFDMTVYGRNLNSFIGRAAHIEFLESDIFARFIMWSFQDLFR

SEQ ID NO: 63245 - protein, 452 aa, Pseudomonas putida GB-1
MSKAVEPSPQCPVQQLTRNGLRKDDPLDPLLLPPPRKPVYILLQDHERAQRLAQQLEFFGLVVQALPNATAFLASICEYPPSAIIMDVDFTGTGQGLQLAAQVQQGLARHIPLLFFSHHEADTPTRLAAVRAGGQDFLTGSLEASSLLEKVELLTNATPHDPLRVLIIDDSRTQALYTERVLAGAGMVTRSLTDPIRTMAELADFQPDLIILDLYMPACTGPELAKVIRHSDRYVSVPIIYLSAEDDLDKQLDAMSEGGDDFLTKPFRSRHLITTVRNRAARARHLKARMVRDSLTGLYNHTHILQLLEDCSFRARREQQPLSFAMLDIDHFKKINDRHGHPMGDRVIKSLALFLKQRLRKTDFIGRYGGEEFAIVMPNTALDAAHRVLDEIRRRFAEILYPAQPRDLQCTFSAGVVQLDEGLDALTMASAADEALYRAKHAGRNCVVRVEP

SEQ ID NO: 63246 - protein, 518 aa, Arabidopsis thaliana; identical to SEQ ID NO: 796

SEQ ID NO: 63247 - protein, 470 aa, Pseudomonas fluorescens PfO-1
MSVATSLIEESSARIASAPAETLYQFNESPLLARQSRQESNARSYPRRIPLALKRAKGLYVEDVEGRSFIDCLAGAGTLALGHNHPVVIEAIQQVLSDELPLHTLDLTTPVKDQFVQDLFGLLPPALAKEAKIQFCGPTGTDAVEAALKLVRTATGRSTVLSFSGGYHGMSQGALSLMGSLGPKKPLGALLSSGVQFMPFPYDYRCPFGLGGAAGVKANLSYLENLLNDPEAGVQLPAAVIVEAVQGEGGVIPADIEWLRGLRRITEKAGVALIIDEIQSGFARTGKMFAFEHAGIIPDVVVLSKAIGGSLPLAVVVYREWLDSWQPGAHAGTFRGNQMAMAAGSAVMRYLVEHKVCEHAAAMGERLSEHLRILQRDFPQLGDIRGRGLMLGVELVDPSGTPDALGHPPAFARLAPLVQRECLKRGLILELGGRHGAVVRFLPPLVITAAEIDRVAEIFGRALSAATATL

SEQ ID NO: 63248 - protein, 83 aa, Panicum miliaceum
EPLVVGRVIGEVLDSFNPCVKMIVTYNSNKLVFNGHEIYPSTVVSKPRVEVQGGDLRSFFTLVMTDPDVPGPSDPYLREHLHW

SEQ ID NO: 63249 - protein, 237 aa, Oenococcus oeni PSU-1
MAKLVFIRHGQSEWNALNLFNGWVDTKLSEEGIRQAKEAGELLAEKGIQFDQAYTSVLTRAIQTLHIALEEIDQLWIPEEKSWRLNERHYGALQGLNKKASAEKWGDEQVHIWRRSYDTLPPLQDEIQKSITVNGKTYPALDRRYAELDPKTLPLGENLKVTLERVMPFWEDKIAPDLRAGKNVIIAAHGNSLRALSKYIENISDADIMGLEIANGQPIIYDFDENLKFTNKELLSK

SEQ ID NO: 63250 - protein, 83 aa, Sorghum halepense
EPLVVGRVIGEVLDSFNPCVKMIVTYNSNKLVFNGHEIYPSAVLSKPRVEVQGGDLRSFFTLVMTDPDVPGPSDPYLREHLHW

SEQ ID NO: 63251 - protein, 381 aa, Burkholderia vietnamiensis G4
MGLAAESKPIHDCRAQALAGWPKSRAAHVGQTGIWRIRLIIRRITHFDHHVVVHRLPHPQRRPPARSDRQRHGAGQSRYPAKPRVRRAADQPDRRVHHRCGRQAAASGAAVARGRRARRDLAPAARAGRRSRVHPYGHAAARRRRSTNPNCDPARQTANALFGNPASVLVGDYLYSRSFEMMVGVGKMRVMEILSEATTIISEGEVLQLLNMHDADVDESRYMQVIRYKTAKLFEASARLGAVLSGADAPTEAAAAEYGRRIGTAFQIMDDWLDYAGTAEAMGKNAGDDLREGKPTLPLIYLIERGTPEQAALAREAIEQGGTDRFDTIFEAITRSGALDHTLECARQEAQAAAAAIATFPDSIYKESLLGLCSYSTSRQS

SEQ ID NO: 63252 - protein, 401 aa, Zea mays
MNGEVECSVCHAKVPVPPPVSKAYDSHRSTVSSRQRALNVLLVSGDCVLAGLQPILVYISKVDGKFKFSPISVNFLTEITKIMFTIVMLFIQARRLKVGDKPLFTVSIFMQAARNNVLLSVPAFLYAINNYLKFIMQLYFNPASVKMLSNLKVLVIAVLLKMIMRRRFSVIQWEALALLLIGISVNQLKSLPEGSSVLGLPVAAGAYLYTLFFVTVPALASVYNEKALKSQFDTSIYLQNLFLYGYGAIFNFIGLVVTAIIQGPSSFNILEGHSKATMFLICNNAAQGILSSFFFKYADTILKKYSSTIATIFTGVASAVLFGHTLTINFVLGISIVIISMHQYLSNQIKDEVPSSKVEMAEAHDHSRKEPSYVNVPDSGASEMKSKHRHGSDERQPLLPV

SEQ ID NO: 63253 - protein, 464 aa, Listeria monocytogenes str. 4b F2365
MLYSKENKESYLEPVFGSSAEDRDIPKYTLGKEPLEPRIAYRLVKDELLDEGSARQNLATFCQTYMEDEATKLMSETLEKNAIDKSEYPRTAELENRCVNIIADLWHAPKNQKFMGTSTIGSSEACMLGGMAMKFAWRKRAEKLGLDIYAQKPNLVISSGYQVCWEKFCVYWDIDMRVVPMDKDHMQLNTDQVLDYVDEYTIGVVGILGITYTGRYDDIYALNEKLEEYNSKTDYKVYIHVDAASGGFFTPFVEPDIIWDFRLKNVISINTSGHKYGLVYPGIGWVLWKDESYLPEELIFKVSYLGGEMPTMQINFSRSASHIIGQYYNFLRYGFEGYRTIHQKTSDVAQYLAHAVEQTGYFDIYNDGSHLPIVCYKLKDDANVKWTLYDLADRLQMRGWQVPAYPLPKNLENIIIQRYVCRADLGFNMAEEFIQDFQASIQELNNAHILFHDTQQSGVHGFTH

SEQ ID NO: 63254 - protein, 291 aa, Zea mays
  misc_feature (243)..(243): Xaa can be any naturally occurring amino acid
  misc_feature (274)..(274): Xaa can be any naturally occurring amino acid
MATKRSVGTLGEADLKGKKVFVRADLNVPLDDAQKITDDTRIRASIPTIKYLLEKGAKVILASHLGRPKGVTPKFSLKPLVPRLSELLGLEVVMAPDCIGEEVEKLAAALPDGGVLLLENVRFYKEEEKNDPEFAKKLASVADLYVNDAFGTAHRAHASTEGVTKFLMPSVAGFLMQKELDYLVGAVANPKKPFAAIVGGSKVSSKIGVIESLLAKVDILILGGGMIFTFYKAQGLAVGKSLXVEEDKLELATSLIETAKSKGVKLLLPTDVVXVADKFAADAESKIVPAL

SEQ ID NO: 63255 - protein, 182 aa, Mesembryanthemum crystallinum
MASSMVSSAAVATVNRTPAQASMVAPFNGLKSVAAFPVTKKNNDITSVATNGGRVQCMQVWPPLGKKKFETLSYLPPLSEESLMKEVQYLLNNGWVPCLEFEPTHGFVYREHGNTPGYYDGRYWTMWKLPMFGCTDPSQVVAELEEAKKAYPEAFIRIIGFDNVRQVQCISFIAYKPASYDA

SEQ ID NO: 63256 - protein, 180 aa, Mesembryanthemum crystallinum
MASMMSNAAVVGRTTPAQASMVAPFTGLKSVSAFPVTKKSNDITSIASNGGRVQCMQVWPPLGKKKFETLSYLPPLSEESLMKEVQYLLNNGWVPCLEFEPTHGFVYREHGNTPGYYDGRYWTMWKLPMFGCTDPSQVVAELEEAKKAYPEAFTRIIGFDNVRQVQCISFIAYKPASYDA

SEQ ID NO: 63257 - protein, 183 aa, Mesembryanthemum crystallinum
MASSLMSNAATTMAAATTTAQANMVAPFNGLKSVSAFPVTRKNNDITSVASNGGRVQCMQVWPPLGKKKFETLSYLPPLSEESLMKEVQYLLNNGWVPCLEFEPTHGFVYREHGNTPGYYDGRYWTMWKLPMFGCTDPSQVVAELEEAKKAYPEAFIRIIGFDNVRQVQCISFIAYKPASYDA

SEQ ID NO: 63258 - protein, 183 aa, Mesembryanthemum crystallinum
MASSLMSNAATTMAAATTTAQANMVAPFNGLKSISAFPVTRKNNDITSVASNGGRVQCMQVWPPLGMKKFETLSYLPPLSEESLLKEVQYLLNNGWVPCLEFEPTHGFVYREHGNTPGYYDGRYWTMWKLPMFGCTDPSQVVAELEEAKKAYPEAFIRIIGFDNVRQVQCVSFIAYKPASYGA

SEQ ID NO: 63259 - protein, 444 aa, Saccharophagus degradans 2-40
MNRLTLPPSSRLRSKEFTFGVATSSYQIEGGIDSRLPCNWDTFCEQPNTIIDNTNGAIACDHINRWQDDIELIANLGVDAYRFSIAWGRVINLDGSLNNEGVTFYKNILTKLREKNLKAYITLYHWDLPQHLEDAGGWLNRDTAYKFRDYVNLITQALDDDVFCYTTLNEPFCSAYLGYEIGVHAPGIKDLASGRKAAHHLLLAHGLAMQVLRKNCPNSLSGIVLNMSPCYAGSNAQADIDAAKRADDLLFQWYAQPLLTGCYPDAINSLPDNAKPPICEGDMALISQPLDYLGLNYYTRAVFFADGNGGFTEQVPEGVELTDMGWEVYPQGLTDLLIDLNQRYTLPPLLITENGAAMVDELVNGEVNDIARINYFQTHLQAVHNAIEQGVDVRGYFAWSLMDNFEWALGYSKRFGITYVDYQTQKRTLKASGHAFAEFVSSRS

SEQ ID NO: 63260 - protein, 93 aa, Brassica napus
MLETVDSSGVVNGGFRQVKSFCGDSSSEEELTVLPRHTKVVVTGNNRTKSVLVGLQGVVKKAVGLGGWHWLVLTNGIEVKLQRNALSVLEAPT

SEQ ID NO: 63261 - protein, 252 aa, Salinibacter ruber DSM 13855
MPDFSDTLVDRLVEAGHVAVLTGAGISAESGIPTFRDPGGLWEEFDPQELANVEAFLDNPELVQGWYRHRREVVEDAAPNAGHHALADLEAHVPSMAVVTQNVDDLHNRAETSTVIELHGNITDNYCMDCEQAVGAAAVDAAIQDGEPARCPDCGGLVRPDVVWFGEMLPPDAMEQADATTEQADVFLSVGTSAVVYPAARLPVAAREQGAYVAEVNPDTTGVTDDVHETIRGPAGDVLPALVDAVAARQRP

SEQ ID NO: 63262 - protein, 355 aa, Pseudomonas putida GB-1
MPLAITCWPSRAATGCTLQTRVETTLENNKMSNQLSTEQLLHAYEVMRTIRAFEERLHVEFATGEIPGFVHLYAGEEASAAGVMAHLRDSDCIASTHRGHGHCIAKGVDVYGMMAEIYGKKTGVCGGKGGSMHIADLEKGMLGANGIVGAGAPLVAGAALAAKLKGRDDVSVAFFGDGASNEGAVFEAMNMASIMNLPCIFVAENNGYAEATASNWSVACDHIADRAAGFGMPGVTIDGFDFFAVYEAAGAAIERARSGQGPSLIEVKLSRYYGHFEGDAQTYRAPDEVKNLRESRDCLMQFRNKTTRAGLLTAEQLDAIDARIEDLIEDAVRRAKSDPKPQPADLLTDVYVAYP

SEQ ID NO: 63263 - protein, 380 aa, Thermobifida fusca YX
MKAVVYKEPFTVAVEEVADPRIEDPNDVIIRVTTSAICGSDLHMYEGRTGATPGMVFGHENMGIVEEVGSGVASIRKGDRVVLPFNVACGFCKNCLAGKTGFCLTVNPGFAGGAYGYVAMGPYQGGQSEYLRVPFADFNCLKLPPGTEFEDDFALLADIFPTGYHATELAQVSPGETVSVFGAGPVGLMAAYSAILRGASRVFVVDRVPSRLSLAERIGAIPIDYSKGDPVAQIKEHTNGEGTDKGIDAVGYQATAPEGEEQPALVLNTLVDTVRPTGALGVVGLYVTEDPGAPSESAKQGELLFAMGKLFEKGQRMGTGQANVKAYNRQLRDLIIAGRAKPSFVVSQRIPLQRAPEAYEKFDKREEGWTKVLLKPQQES

SEQ ID NO: 63264 - protein, 340 aa, Pseudomonas putida GB-1
MARKISYQQAINEALAQEMRRDNTVFIIGEDVAGGAGAPGEDDAWGGVLGVTKGLYHQFPGRVLDAPLSEIGYVGAAVGAATQGLRPVCELMFVDFAGCCLDQILNQAAKFRYMFGGKAVTPLVMRTMYGAGLRAAAQHSQMLTSLWTHIPGLKVVCPSSPYDAKGLLIQAIRDNDPVIFCEHKLLYSMQGEVPEEVYTVPFGEANFLRDGDDVTLVTYGRMVHVALEAANNLARQGIDCEVLDLRTTSPLDEDSILESVEKTGRLVVIDEANPRCSMATDISALVAQKAFGALKGPIEMVTAPHTPVPFSDALEDLYIPDAAKIETAVRKVIEAARSAA

SEQ ID NO: 63265 - protein, 398 aa, Lactococcus lactis subsp. lactis Il1403
MAKLTVKDVELKGKKVLVRVDFNVPIKDGVITNDNRITAALPTIKYILEQGGRAVLFSHLGRVKEEADKAGKSLAPVAKALSEKLGQDVVFPGTTRGAELEAAINELKDGEILLVENTRFEDIDGKKESKNDPELGKYWASLGDGIFVNDAFGTAHRAHASNVGISANVDKAVAGFLLENEIAYIQEAVEAPERPFVAILGGSKVSDKIGVIENLLSKADKVIIGGGMAYTFLKAQGYEIGTSLVEDDKLDLAKELLEKAAGKLILPLDHKVANAFAGYTEVKETADQNIPAGFMGLDVASKTIADYNTQLEGAKTVVWNGPVGVFENTDFQAGTVGLMEAIVKQPGVKSIIGGGDSAAAAINLGYADKFSWISTGGGASMELLEGKVLPGLAALTEK

SEQ ID NO: 63266 - protein, 83 aa, Pennisetum glaucum
EPLVVGRVIGEVLDSFNPCVKMIVTYNSNKLVFNGHEVYPSSVVSNPRVEVQGGDLRSFFTLVMTDPDVPGPSDPYQREHLHW

SEQ ID NO: 63267 - protein, 362 aa, Pseudomonas putida GB-1
MNDLSHTHMRAAVWHGRNDIRVEQVPLPADPAPGWVQIKVDWCGICGSDLHEYVAGPVFIPVEAPHPLTGIQGQCILGHEFCGQIAKLGEGVEGFAVGDPVAADACQHCGTCYYCTHGLYNICERLAFTGLMNNGAFAELVNVPANLLYRLPQGFPAEAGALIEPLAVGMHAVKKAGSLLGQTVVVVGAGTIGLCTIMCAKAAGAAQVIALEMSSARKAKAKEVGASVVLDPSQCDALAQIRALTAGLGADVSFECIGNKHTAKLAIDTIRKAGKCVLVGIFEEPSEFNFFELVSTEKQVLGALAYNGEFADVIAFIADGRLDIRPLVTGRIGLEQIVELGFEELVNNKEENVKIIVSPGVR

SEQ ID NO: 63268 - protein, 83 aa, Setaria italica
EPLVVGRVIGEVLDSFNPCVKMIVTYNSNKLVFNGHEIYPSAVVSKPRVEVQGGDLRSFFTLVMTDPDVPGPSDPYLREHLHW

SEQ ID NO: 63269 - protein, 351 aa, Oryza sativa (indica cultivar-group)
MGVYLSTPKTEKYSGEGGNDRLRYGLASMQGWRTTMEDAHTALPRLDECTSFFGVYDGHGGKAVSKFCAKHLHLQVLKNEAYSSGDLATSVLKSFFRMDEMMKGQRGWRELAELGDKGQKFTGMLEGIIWSPKPGESDKPEDTWTEEGPHSHFPGPTSGSTACVAIIRNDELIVANAGDSRCVLSRKGRAYDLSKDHKPDLDAEKERILNAGGFIVAGRVNGSLNLARAIGDMELKQNEFLPAERQIVTAEPELNTVKLSEDDEFIVLACDGIWDCMSSQEVVDFVHKEMNTEDSLSAVCEKLLDHCLAPVSGGDGCDNMTVIIVKFKKPSKSAATSSTNQSVSSEEMRPK

SEQ ID NO: 63270 - protein, 471 aa, Geobacillus kaustophilus HTA426
MNLFRKKPIQLLMKESGAKGASLRKELGAFDLTMLGIGAIIGTGIFVLTGVAAAEHAGPALVLSFILSGLACVFAALCYAEFASTVPVSGSAYTYSYATFGELIAWILGWDLILEYGVASSAVAVGWSGYFQGLLSGFGIELPKALTSAYDPAKGTFIDLPAIIIVLFITFLLNLGAKKSARFNAVIVAIKVAVVLLFLAVGVWYVKPENWTPFMPYGFSGVATGAATVFFAYIGFDAVSTAAEEVRNPQRDMPIGIIVSLLVCTLLYIAVSLVLTGIVPYEQLNVKNPVAFALNYIHQDWVAGFISLGAIAGITTVLLVMMYGQTRLFYAISRDGLLPKVFARISPTRQVPYVNTWLTGAAVAVFAGIIPLNKLAELTNIGTLFAFITVSIGVLVLRKTQPDLKRAFRVPFVPVVPILAVLFCGYLVLQLPAMTWIGFVSWLLIGLVIYFIYGRKHSELNEMARTEEKAG

SEQ ID NO: 63271 - protein, 320 aa, Oenococcus oeni PSU-1
MSEFITIGEPIVTFASTDADADLVHAENFKKIVGGAELNVAIGVSRLGHSTQYISRVGNDPLGTFVKNEIKSNQVGADYVSSDNDNWTAFQLKEKVTVGDPLTFNFRRNSAAAHLSSGIIDRVDLSDVKIAHMSGIFPAISKTAQTSFRHLFERLNQRNIFTTFDPNLRPSLWPNEKTMIKTINELAAFADVVLPGTNEGEILIGSKDPETIADFYLQADKTKTVIVKVGPQGAYVKNKGQSGYYVNGFKVGKVVDTVGAGDGFALGYITATLEGKSQKSAVMRGNAVGALQVQTPGDNDGYPTVKKLADFYAKEGVSEK

SEQ ID NO: 63272 - protein, 535 aa, Brassica nigra
LQLDKRLDTTEQVVEEIMRIHRSLPPRPGLDEVEAARSLIQKLEKEEPILLEAIANQRKPSEVPDELFAVLQEMKRGLVRFRSKEQIREAAKLLDLETVHSHFDDFIQRASDCIASPSPNGVSAPASSRPLPRAPTPPSSLYFSEKTPARPKEMVSRDDSFVSKAKPSLYGDGFVAPRTPQIVDSTLTAGKFADNDGEKLSLIKLASLIEVSAKKATKELNLQNKLSAQVEWLPDSIGKLSTLTSLDLSENNIVVLPNTIGGLVSLTNLDLRSNRINQLPESIGELLNLVYLDLSSNQLSSLPSSFSRLLQLEELNLSCNNLPVLPESVGSLANLKKLDVETNDIEEIPYSIGGCSSLKELRADYNKLKALPEAIGKITTLEILSVRYNNIRQLPTTMSSLASLRELDVSFNELESVPESLCFATSLVKLNVGNNFADMISLPRSLGNLEMLEELDISNNQIRVLPESFRSLTKLRVFASQENPLQVPPRDIAEKGPQAVVQYMNDLVETRNAKSLVVKPKKSWVQMCFFSKPEF

SEQ ID NO: 63273 - protein, 63 aa, Pariana radiciflora
EPLVVGRVIGEVLDSFNPCMKMIVTYNSNRLVFNGHELYPSAVQSKPRVEVQGGDLRSFFTLV

SEQ ID NO: 63274 - protein, 83 aa, Flagellaria indica
EPLVVGRVIGEVLDSFTPCVRMIVTYSSNRLVFNGHEFYPSTVISKPRVQVQGGDMRSFFTLVMTDPDVTGPSDPYLREHLHW

SEQ ID NO: 63275 - protein, 431 aa, Arachis hypogaea
GRGEFGVTYLCIDRGSRELLACKSISKRKLRTAVDVEDVRRKVAIMRHLPRSSSIVSLREACEDDNAVHLVMELCEGGELFDRIVARGRYTERAAAVVARTVVEVVQLCHRHGVIHRDLKPENFLFANKKENSPLKAIDFGLSVFFKPGEKFSEIVGSPYYMAPEVLKRNYGPEIDIWSAGVILYILLCGVPPFWAESEQGGAQAILRGLIDFKREPWPSISESAKSLVKQMLEPDPKLRLTAKQVLEHPWIQMLRRAPNIPLGDAVKSRLKQFSMMNRFQKKALRVIADFLSNEEVEDIKDIFQKMDTDNDGIVSIEELKAEFQNFGSQLAESEIQMLLEAVNTNGKGTLDYGEFVAVSLHLKRMANDEHLRKAFSYFDKDGNGYIEPDELRNALMEDGTDDCADVANDIFQEVDTDKDGRISYEEFVAM

SEQ ID NO: 63276 - protein, 165 aa, Bacillus cereus E33L
MNQIEKITHAAMNGDMPTIQEILNENPDLVNTFSQDGWTPLHLAAYFGKEEAARLLLSLGADVHARAKNSNENMPLHAAVANKQAKLVELLIKNGADINAKQSGGWTSLHEAALLGNTEIVELLIKEGANIQLRKDDEKTPLDIALEKEQNEVVNLIKQHINTAS

SEQ ID NO: 63277 - protein, 182 aa, Mesembryanthemum crystallinum
MASSLMSNAATTMAAATTTAQANMVAPFNGLKSISAFPVTRKNNDITSVASNGGRVQCMVWPPLGMKKFETLSYLPPLSEESLLKEVQYLLNNGWVPCLEFEPTHGFVYREHGNTPGYYDGRYWTMWKLPMFGCTDPSQVVAELEEAKKAYPEAFIRIIGFDNVRQVQCVSFIAYKPASYGA

SEQ ID NO: 63278 - protein, 186 aa, Mesembryanthemum crystallinum
MASSMLSNAAVATTAASRSAGAQASMVAPFTGLKSVSAFPVTRKSSNDLSTVPSNGGKVQCMQVWPPLGKKKFETLSYLPPLSEESLLKEVQYLLNNGWVPCLEFEPTHGFVYREHGNTPGYYDGRYWTMWKLPMFGCTDPSQVVAELEEAKKAYPEAFIRIIGFDNVRQVQCVSFIAYKPASYDA

SEQ ID NO: 63279 - protein, 768 aa, Yarrowia lipolytica CLIB122
MTRRRSVNISDVTEVRRYEDFSTIDWVDVAARENMLRCLTIEKFRPASRVAAGSSDTRGRIRHKLYEVYTAAQSWLVLALIGMAIGAIAAVLNISTEWLADLKTGYCSTGFYLNEDFCCWGTEGDHCPAWQSWTGFGLLNYFVYVGFAAGFAALAAFLVKTYAPYAAGSGISEIKCIVAGFVMQGFLGPWTLLLKSIGLPLAIASGLSVGKEGPSVHYAVCAGHVIASLFGRYRNSKSKMREIYSACTAAGVAVAFGSPIGGVLFSLEEITSNFQMKTMWRSYFCALVATGVLAAFNPFRTGQLVMFQVKYDRDWHFFEIFFFSIIGVFGGMYGIFVSKWNLRVQSFRKRYLGKYAVKEATLLASLTALICYSNEFLRLDMTAAMENLFHECENGWEKYHDLCQPDRQGLTMLLSLLAACVIRTFLVIISYGCKVPAGIFVPSMAVGATFGRLIGNIVQYWQQARPDSIIFSQCVVDQPCITPGAYAFLGAAAALSGITNIFVTVVVIMFELTGALTYILPTMIVVGITKAISDRFGKGGIADQMIWFNGFPFIDNKEEHAFNAPVSKAMQKNAVYFTYDSITLKEVETLLESNPFQGYPVVESSKEDPPMLVGYIAKEEIVRLIAKFKALNRDIHSSELGQVQCYFGEIPESARQSSQAFIDMRPSINTCPLTVAPLAPLENVTSIFLQMGPKVVLVVKEGRLVGLISRKDVLKYQFITERQHNHHTRLQTQQYNEQLEERVWKLLNQAGDYINHGLAKIKGYVLRR

SEQ ID NO: 63280 - protein, 246 aa, Bifidobacterium longum DJO10A
MTYKLVLLRHGQSAWNKTNQFTGWVDVPLTEQGEAEAKRGGELLKEKNVLPDIVFTSLLRRAINTANIALDAADRLWIPVQRDWRLNERHYGALQGKNKTEIREEYGDEKFMLWRRSYATPPPEIDPNDQYAQNNDPRYAGDPVPEAECLANVVERVKPYFESAIEPELKAGKTVLIAAHGNSLRAIVKMLDNLSEEEIAKVNIPTAIPLLYELDENFKPIKPRGEYLDPEAAAAGAAAVAAQGQK

SEQ ID NO: 63281 - protein, 583 aa, Raphanus sativus
MDIRRRPPKPPVNNPNRFSNDNDDQPRTKASDALPLPLYLTNAVFFTLFFSVAYYLLRRWRDKIRHSTPLHVITITELGALLALVASFIYLLGFFGIDFVQSFISRADTNNEFEDHRLVTCLPRGDVEVWWCHVPMQITSLKTTASSRAPRGGRRVVDPTLPEEDEEIVKSVIRGVIPSYSLESSLGECKRAAAIRREALQRITGRSIEGLPLEGFDYESILGQCCEMPVGYVQIPVGIAGPLLLDGCEYSVPMATTEGCLVASTNRGCKAMYVSGGGTSTVVKDGMTRAPVVRFASARRASELKFYLEDLENFDTLAVVFNRSSRFARLQSVKCTLAGKNAYVRFSCSTGDAMGMNMVSKGVQNVLEFLTDDFPDMDVIGISGNFCSDKKPAAVNWIEGRGKSVVCEAVIRGEIVNKVLKTSVAALVELNMLKNLTGSAVAGSLGGFNAHASNIVSAVFIATGQDPAQNVELSQCITMMEAVNDGKDIHVSVTMPSIEVGTVGGGTQLASQSACLNLLGVKGASTESPGMNSRTLATIVAGAVLAGELSLMSAIAAGQLVKSHMKYNRSSRDISGAMTATTT

SEQ ID NO: 63282 - protein, 113 aa, Caulobacter crescentus CB15
MTDAATSPALDFIAKTVADHPVVVFMKGVPDQPRCGFSSVVVQILDHLGVEFVGVDVLQDEDLRQGVKTFTDWPTIPQLYVKGEFIGGSDIVREMFQSGELKTFLTEQGVIAA

SEQ ID NO: 63283 - protein, 573 aa, Raphanus sativus
MDIRRRPPKPPVNSNRFLDNRSDDDDRRKTLTSPPKASDALPLPLYLTNAVFFTLFFSVAYYLLHRWRDKIRYNTPLHVVTVTELGAIVALIASFIYLLGFFGIDFVQSFISRPDSGDSERDFDDHRLVTCPPPPPPSQIVAAKLPNPEQPPLPKEDEEIVKSVLDGVVPSYSLESRLGDCKRAASIRREALQRLTGRSIEGLPLDGFDYDSILGQCCEMPVGYIQIPVGIAGPLLLDGYEYSVPMATTEGCLVASTNRGCKAMYVSGGATSTVLKDGMTRAPVVRFASARRASELKFFLESPENFETLAVVFNRSSRFARLQSVMCTLAGKNAYVRFSCSTGDAMGMNMVSKGVQNVLEFLTEDFPDMDVIGISGNFCSDKKPAAVNWIEGRGKSVVCEAVIRGETVNKVLKTSVASLVELNMLKNLTGSAIAGSLGGFNRHASNIVSAVFLATGQDPAQNVESSQCITMMEAINDGKDIHISVTMPSIEVGTVGGGTQLASQSACLNLLGVKGASKESPGMNSRRLATIVAGAVLAGELSLMSAIAAGQLVRSHMKYNRSSRDISGATTTT

SEQ ID NO: 63284 - protein, 124 aa, Arabidopsis thaliana
  misc_feature (2)..(2): Xaa can be any naturally occurring amino acid
  misc_feature (10)..(10): Xaa can be any naturally occurring amino acid
  misc_feature (12)..(12): Xaa can be any naturally occurring amino acid
  misc_feature (31)..(31): Xaa can be any naturally occurring amino acid
  misc_feature (39)..(40): Xaa can be any naturally occurring amino acid
  misc_feature (42)..(42): Xaa can be any naturally occurring amino acid
  misc_feature (52)..(52): Xaa can be any naturally occurring amino acid
  misc_feature (54)..(56): Xaa can be any naturally occurring amino acid
  misc_feature (59)..(59): Xaa can be any naturally occurring amino acid
  misc_feature (62)..(63): Xaa can be any naturally occurring amino acid
  misc_feature (65)..(65): Xaa can be any naturally occurring amino acid
  misc_feature (67)..(68): Xaa can be any naturally occurring amino acid
  misc_feature (73)..(73): Xaa can be any naturally occurring amino acid
  misc_feature (78)..(78): Xaa can be any naturally occurring amino acid
  misc_feature (80)..(80): Xaa can be any naturally occurring amino acid
  misc_feature (82)..(82): Xaa can be any naturally occurring amino acid
  misc_feature (84)..(84): Xaa can be any naturally occurring amino acid
  misc_feature (86)..(86): Xaa can be any naturally occurring amino acid
  misc_feature (88)..(88): Xaa can be any naturally occurring amino acid
  misc_feature (91)..(91): Xaa can be any naturally occurring amino acid
  misc_feature (93)..(94): Xaa can be any naturally occurring amino acid
  misc_feature (96)..(96): Xaa can be any naturally occurring amino acid
MXSSMLSSTXGXTSPAQATMVAPFTGLKSSXSFPVTRKXXNXITFITSKGGXVXXXKVXPPXXKXKXXTLSLXSLTLXTXKXGXGXVXTFXPXXRXIPWQAFCYPHEPPPTLFVHNIRPVKKIN

SEQ ID NO: 63285 - protein, 179 aa, Candida glabrata CBS 138
MDKKGKYVVLVSGEGEKFTVEKKIAQRSLLLKNYLNDMHESSLDDEDEEQDEDEDEDDEIVMPVPNVRSSVLQKVIEWAEHHRDSNFPDEDDDDSRKSAPVDAWDREFLKVDQEMLYEIILAANYLNIKPLLDAGCKVVAEMIRGRSPEEIRRTFNIVNDFTPEEEAAIRRENEWAEDR

SEQ ID NO: 63286 - protein, 219 aa, Magnetospirillum magnetotacticum MS-1
MSKVPGIDRLLANNKVWAEETERTKPGFFAHLAEQQTPGYLWIGCADSRVPANEIVGLEPGEVFVHRNVANQVHHADMNCLSVLQYAIDVLKVEHIIVCGHYGCGGVRAALQDSRLGVTEYWIRPVRDICECHRHELDMLPNEAAQVDRLCELNVMAQVRNLCRSPVIQDAWQRGQQLEVHSWVYGLTDGMVRTLGPVVTGLKSLDELGASYLMRGAAF

SEQ ID NO: 63287 - protein, 187 aa, Streptomyces avermitilis MA-4680
MVSGAAGAVGSVVGQIARIHGCRVIGVAGGPEKCRTIVDEFGCDVAIDYKSENLRDALRKHAPDGVDVYFDNVGGKTLDSVLTRLARGARIVICGSMSQYNATERPPGPANYMALLAARASMTGMVVFDYEDRYPQASAELARWLKDGRLRSREHIVEGGVRAFPETLLKLFSGENTGKLILALGNG

SEQ ID NO: 63288 - protein, 202 aa, Oryza sativa (japonica cultivar-group)
MNPEYDYLFKLLLIGDSGVGKSCLLLRFADDSYLESYISTIGVDFKIRTVEQDGKTIKLQIWDTAGQERFRTITSSYYRGAHGIIVVYDVTDQESFNNVKQWLNEIDRYASENVNKLLVGNKCDLAENRVVSYEAGKALADEIGIPFLETSAKDATNVEKAFMTMAGEIKNRMASQPATNASKPATVQMRGQPVAQQSSCCS

SEQ ID NO: 63289 - protein, 260 aa, Pseudomonas fluorescens PfO-1
MTQDFIQNFSLAGRTVLITGASSGIGAHLARVAGHAGARVVLTARRVERLAQVAKDIEWDCGQALSVELDVTDRNSVEAAFDAAEAHFGVVDVVLNNAGIGNGQRPLEISEEQWREMLSTNLDGVWRVAQVAAQRLAKAGRKGSIVNVASILGLRVSTGYSHYCAAKAGVVQLTKSLALELARYNIRVNAIAPGYFKTEMNEAFFEGDKGNSYIRDRVPMRRLGQLHELAGPFLLLASDAGAFMTGSVLTVDGGHLVSSM

SEQ ID NO: 63290 - protein, 482 aa, Pseudomonas putida GB-1
MPSDHSAGSPAGSSVDFEKVGSDYFQQRELKKGAAGWVLLVGLGVAYVISGDYAGWNFGLAQGGWGGMFLATLLMATMYLCMCFSLAELSSMIPTAGGGYGFARSAFGPWGGFLTGTAILIEYAIAPAAIAVFIGAYCQSLFGIGGWMIYLAFYIVFIGIHIFGVGEALKLMFIITAIAAIALAVFLVSMVPHFDAANLFDIAKTDAVGASSFLPFGYVGVWAAIPYAIWFFLAVEGVPLAAEETKNPKRDLPRGLIGAMLVLLAFALLILVVGPGGAGSEALKASGNPLVEALSKAYGGNTWMGGFVNLVGLAGLIASFFSIIYAYSRQIFALSRAGYLPRKLSQTNKSKAPVLALIIPGIIGFALSLTGQGDLLILVAVFGATLSYVLMMAAHITLRIRRPKMERPYRTPGGVFTSGVALVLACIAVVAGFLVDPRVVIGAAVIYAVLIAYFAFYSRHHLVAGTPEEEFAAIQKAEEALH

SEQ ID NO: 63291 - protein, 177 aa, Triticum aestivum
  misc_feature (71)..(71): Xaa can be any naturally occurring amino acid
  misc_feature (123)..(123): Xaa can be any naturally occurring amino acid
  misc_feature (152)..(152): Xaa can be any naturally occurring amino acid
MAPAVMASSATTVAPFQGLKSTAGLPVSRRSSGSLGRVSNGGRIRCMQVWPIEGIKKFETLSYLPPLSTEXALLKQVDYLIRSKWVPCLEFSKVGFVFREHNSSPGYYDGRYWTMWKLPMFGXCTDATQVLNEVEEVKKEYPDAYVRVIGFXDNLRQVQCVSFIAFRPPGCEESGKA

SEQ ID NO: 63292 - protein, 448 aa, Helicobacter pylori J99
MYVEKILQSLQKKYPYQKEFHQAVYEAITSLKPLLDSDKSYEKHAVLERLIEPEREIFFRVCWLDDNHQIQVNRGCRVEFNSAIGPYKGGLRFHPSVNESVIKFLGFEQVLKNSLTTLAMGGAKGGSDFDPKEKSEHEIMRFCQAFMNELYRHIGATTDVPAGDIGVGEREIGYLFGQYKKLVNRFEGVLTGKGLTYGGSLCRKEATGYGCVYFAEEMLQERNSSLEGKVCSVSGSGNVAIYTIEKLLQIGAKPVTASDSNGMIYDKDGIDLELLKEIKEARRGRIKEYALEKTSAKYTPTENYPKGGNAIWHVPCFAAFPSATENELSVLDAKTLLSNGCKCVAEGANMPSSNEAIELFLQAKISYGIGKAANAGGVSVSGLEMAQNASMHPWSFEVVDAKLHHIMKEIYKNVSQTAKEFKDPTNFVLGANIAGFRKVASAMIAQGV

SEQ ID NO: 63293 - protein, 378 aa, Geobacillus kaustophilus HTA426
MKAVTYQGIKDVAVKQMPDPKILKDDDIIVKITSTAICGSDLHLVHGMIPNMPEDFIIGHEPMGIVEEVGPAVTKVKKGDRVIVPFTIACGQCWYCQHGLESQCDASNPNGESGGYFGYSETFGGYPGGQAEYLRVPFANFTPFVVPENCELEDEKLLFLSDIIPTAFWGVDEAGVKDGDTVVVLGCGPVGLLTQKFAWMKGAKRVIAVDYIDYRIEHAKKTNKVETLNFTEYENVGEYIKEMTGGGADVVIDCVGLDGKMTPLELIGSALKLQGGAMGAIVIASQAVRKGGTIQLVGVYGARYNQFPLGDLFSRNITLKMGQAPVIHYIPTLYEWIVEGKFDPTDIITHRLPLDEAQYAYEIFDEKKDGCIKVVLKP

SEQ ID NO: 63294 - protein, 338 aa, Frankia sp. CcI3
MAGFQPATHIPETGYSENGYGADGSTPRRKTISNSYLHRLQRRHFLLFDVLPIAGTAAAIAFLAVHPIGATELALLFSMWLLTGLGITVGYHRLFTHRAFKAAPAAAAALAVLGSMAGQGGVVSWVALHRRHHECSDRDGDPHSPNLAGNGLKGRLRGLAHSHFLWMRRHEYPNVVHYAPDLIKNRALVRVARLYYYWVTLGLLLPALVGGLVYQSWTGAVSGFLWGGLVRMFVLEHVIWGINSFLHMFGTRPYESRENSRNGGIFALLSLGESWHNNHHAFPDSPSFGLRWYRLDPGYWLIRLLAVSGLAWDVKLPSEERMAAKRIAARRSAPSTAV

SEQ ID NO: 63295 - protein, 231 aa, Sinorhizobium meliloti 1021
MTGIDLIIFDCDGVLVDSEIIASEVEAGLLTEAGYPISIEEMSERFSGMTWRDTLLAVEKEASIPLSASLIDKVDAILDVRLARDVKIIEGVRPALMQLTLPHCICSNSTSQRLAMMLGKVGIRDHFGKHIYSARDLGPDRVKPKPDIFLHGAAQFGVDPARVLVIEDSVHGIHGARAAGMRVVGFTGGSHTFAAHADKLTEAGAETVISRMAALPGVIAALAEWSESMTA

SEQ ID NO: 63296 - protein, 560 aa, Arabidopsis thaliana
MASSTALICDTEAWKDLKGHVEDIKKTHLRDLMSDANRCQSMMMEFDGLLLDYSRQRATVETMDKLLNLAKASQLTEKISRMFNGEHINSTENRSVLHVALRAPKDAVIKADGMNVVPEVWNVLDKIKEFSDKIRSGSWVGATGKPLKDVIAIGIGGSFLGPLFVHTALQTDPEALESAKGRQLRFLANIDPVDVARNISGLNPETTLVVVVSKTFTTAETMLNARTLREWITAALGASAVAKHMVAVSTNLALVEKFGIDPNNAFAFWDWVGGRYSVCSAVGVLPLSLQYGFSMVEKFLKGASSIDQHFQSTPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTAPEGFNYSTTTLLKRYLETSSEPQM

SEQ ID NO: 63297 - protein, 297 aa, Bacillus cereus ATCC 14579
MYMTNVTGTERVKRGMAEMQKGGVIMDVVNAEQAKIAEEAGAVAVMALERVPADIRAAGGVSRMADPTIVEEVMGAVSIPVMAKCRIGHLVEARVLESLGVDYIDESEVLTPADEVYHLNKRDYTVPFVCGCRDIGEAARRIAEGASMLRTKGEPGTGNIVEAVRHMRQVNAEIRQVASLREDELMTYAKNTGAPYEVLLEIKRLGRLPVVNFAAGGVATPADAALMMQLGADGVFVGSGIFKSENPEKFARAIVEATTHYEDYELIASLSKGLGNAMKGVEISTLLPEQRMQERGW

SEQ ID NO: 63298 - protein, 588 aa, Zea mays
MADVQPESGPDGKALMDAWDYKGRPASRATTGGWACAAMTLGVELFERMTTLGIAVNLVPYMTGTMHLGNAAAANTVTNFIGASFMLCLLGGFVADTYLGRYLTIAIFTAVQATGVVILTISTAAPGLRPPACGAASPNCVRANKTQLGVLYLGLYLTALGTGGLKSSVSGFGSDQFDEAHDVERNKMLRFFNWFYFFVSIGALLAVTVLVYVQDNAGRRWGYGVCAAGILCGLAVFLLGTRKYRFRKLVGSPLTQVAAVTVAAWSKRALPLPSDPDMLYDVDDVAAAGSDAKGKQKLPHSKECRLLDHAAIVGGGESPATASKWALCTRTDVEEVKQVVRMLPIWATTIMFWTIHAQMTTFSVAQAEVMNRAIGGSGYLIPAGSLTVFLIGSILLTVPAYDRLVAPVAHRLTGNPHGLTPLQRVFVGLLLSVAGMAVAALIERHRQTTSELGVTITVFLLMPQFVLVGAGEAFTYMGQLAFFLRECPKGMKTMSTGLFLSTCAFGFFFSTLLVTIVHKVTGHGGRGGWLADNIDDGRLDYFYWLLAVISAINLVLFTFAARGYVYKEKRLADAGIELADEECVAAGH

SEQ ID NO: 63299 - protein, 932 aa, Bifidobacterium longum DJO10A
  misc_feature (572)..(588): Xaa can be any naturally occurring amino acid
MSNEYPYASMRDSFDLSAYFVVGPEDCKGRPLTDVVDQALHGGATFIQLRAKEADASELTDMARDIAQIIEDNEKSDSVAFVIDDRADVVWQARRKGIKVDGVHIGQTDMEPREARALLGDEAIVGLSAETESLVRLINELPDGCIDYIGAGPLHVSTTKPEASVGGNDGSGKTLDAAQINTICVASEFPVVVGGGVTAADMAMLADTKAAGWFVVSAIAGAENPEEAARTMVEGWKAVRGDKKHGYAPRVVTHTPATDTQAAQEGAAKPGSEATEKKFTNAKDAKDAQKLAKQQRVDIAARGSKQRDKAHIRKTKSVPFTYQYGSYDLEVPYTEIKLSDTPGVGPNPPFHDYNTEGPKCDPKEGLKPLRLDWIRDRGDIEDYEGRRRNLEDDGKRAIKRGRATKEWRGRKHEPMRAKDHPITQMWYARHGIITPEMQYVATRENCDVELVRSELAAGRAVMPCNINHPEAEPMIIGSAFLTKLNANMGNSAVTSSIDEEVEKLTWATKWGADTVMDLSTGNDIHTTREWILRNSPVPIGTVPMYQALEKVEDDASKLSWELFRDTVIEQCXXXXXXXXXXXXXXXXXGVDYMTIHAGVLLRYVPLTANRVTGIVSRGGSIMADWCLRHHQESFLYTHFDELCDIFAKYDVAFSLGDGLRPGSLADANDAAQLSELMTLGELTERAWAKDVQVMIEGPGHVPFDTVRMNIELEKAVCHNAPFYTLGPLTTDTAPGYDHITSAIGATEIGRYGTAMLCYVTPKEHLGLPNKDDVKQGVIAYKIACHAADIAKHHPHAMDRDNAISKARFEFRWLDQFNLSYDPDTAIAFHDDTLPAEPAKMAHFCSMCGPKFCSMAISQNIRKAFGGEAAQQQIVKEAAAGIDSEALATAKANVDNGVVSANVLSPEEILAGMDAMSEKYTAQGGKLYSTAQE

SEQ ID NO: 63300 - protein, 292 aa, Vibrio cholerae O1 biovar eltor str. N16961
MFSGSIVALITPFTPDGEVDYISLKKLVDFHVDAGTDAIVSVGTTGESATLTVEEHVKVVAKTVEFAEGRLPIIAGTGANATHEAVTFSRLLNNTGIAGYLSVTPYYNKPTQEGLFLHYNAIAQETDIPVILYNVPGRTAVDMRPETVARLSEIKNIVALKDATGDLSRVAKHREMCKEGFVLLSGDDATGLEFVKLGGQGVISVTNNIAAADMAKMMHLALDGKFDEAAIINQRLMTLHKNLFIESSPIPVKWAAHKMGLIANGDLRLPLTQLSEPARPIVAQALSEACIY

SEQ ID NO: 63301 - protein, 369 aa, Caulobacter crescentus CB15
MKTRAAVAFEAKKPLEIVEVDLEGPKAGEVMVEIKATGVCHTDAYTLDGFDSEGIFPSILGHEGAGVVVEVGAGVTSVAVGDHVIPLYTPECRQCKSCLSGKTNLCTAIRATQGKGLMPDGTSRFSYKGQPIYHYMGCSTFSNYTVLPEIAVAKIRRDAPFKTACYCGCGVTTGVGAVTNTAKVEPGANAIVFGLGGIGLNVIQGLKLVGANMIVGVDINPDREEWGRKFGMTHFVNPKDVQGDLVAHLVALTDGGADYTFDATGNTGVMRTALEACHRGWGESIIIGVAEAGKEISTRPFQLVTGRVWKGTAFGGARGRTDTPKIVDWYMDGKIQIDPMITHVLPLEEINKAFDLMHAGESIRTVVTF

SEQ ID NO: 63302 - protein, 157 aa, Listeria monocytogenes str. 4b F2365
MSIFTNTPLIASIIAIVFAQVVKVPIHILVYRKFNLGLMFSTGGMPSSHSAAVTALMTTLAIEYGLDSPYFAIAVVFGIIVMFDATGVRRQAGEQAVVLNKLVTDFQDFVEHAKGLAAPEQEEKTKHLKELLGHKPMEVFFGALTGIAIGFILEMFM

SEQ ID NO: 63303 - protein, 289 aa, Photorhabdus luminescens subsp. laumondii TTO1
MSQKEIWSETLHANFGQYFSVDKVLYHDKTEHQDLIIFENATLGRIMALDGTVQTTERDEFIYHEMMAHVPLFAHGNAKRVLIIGGGDGGMLREVCRHQYLESITMVEIDAGVVEFCRQYLPNHNAGAYDDPRFNLIIDDGVNFVNTTDQKFDVIISDCTDPIGPGEGLFTSEFYQGCQRCLNEGGIFVAQNGVCFLQQDEAVTSHKKLSNYFADSGFYQAAIPTYYGGIMTFAWASQNPALRHVDLATLQQRFDNASFTCRYYNPAVHVGSFALPQYLLDALFTGCTI

SEQ ID NO: 63304 - protein, 395 aa, Methanosarcina barkeri str. Fusaro
MNEQGLSEKEIFSYLEDVKSEDTDYYRVLSSMCTHPHRIAVEAHRLFIEANLGDLGLFAGAHRLEKEVIRMLGELLHAQSVEIPSGEACESSVCGYLTTGGTESNIQAIRGMKNLVTEDGKKSGEILNIVVPESAHFSFDKVANMMGIEVKRASLDPEFRVDIASAESLIDANTIGLVGIAGNTEFGQVDPIEELSKLALENELFLHVDAAFGGFVIPFLEKPYSFDFKVPGVTSIAIDPHKMGLSTIPSGALLFRSPFFMDSLKVNTPYLTTKSQFTLTGTRSGASAAATYAVMKYLGREGYRKNVQYCMQLTTKLVKEARKFGFEPLIEPVMNVVDLRVPNPDIVREQLLKKFGWNVSITRNPRSLRLVLMPHNTARDIEEFLQDLRKVTTEL

SEQ ID NO: 63305 - protein, 275 aa, Lactococcus lactis subsp. lactis Il1403
MIELTDEILAKVIKKRKKASYKGTYGRLLVIGGNRQYGGAAILVTTSAVYSGAGLVSVALAKENHSALQARLPEAMTLDFDDLIKLREVAKAADVIVIGPGLGLERLDLLTEVLNLLTENQKLVIDGSALTLFAREHLDLPFPENTVFTPHEMELERLSGLKIGQQTKEEVQDFVNQLGAIVVAKSSETRIFAPNRESFILKIGSPAQATGGMGDTLAGMVGGFLAQFHGETEEVVAAATYLHSLIASVLARKTYVVLPSRLIEEIPLFMKKYEC

SEQ ID NO: 63306 - protein, 204 aa, Oryza sativa (japonica cultivar-group)
MACLHDHSCEDHNCAADWSLFNHIDVPKVVALNESVAGSVKSVFKPWEQRLDTSGGFLESNEGDPELLVFIPFTSDVKIKSISVVGGADGTSPSRMRAFINREGIDFNDAQNMQPVQEWELAENLQGVLEYQTRYSRFQGVANLTLHFPENFGGDTTKIYYIGLRGEATQNKRDVVATIVYEIMPNPSDHKTKSETGGGFSHVE

SEQ ID NO: 63307 - protein, 436 aa, Bacillus subtilis subsp. subtilis str. 168
MSQTTASITTAQWQQKRDQFVSKGVSNGNRSLAVKGEGAELYDLDGRRFIDFAGAIGTLNVGHSHPKVVEAVKRQAEELIHPGFNVMMYPTYIELAEKLCGIAPGSHEKKAIFLNSGAEAVENAVKIARKYTKRQGVVSFTRGFHGRTNMTMSMTSKVKPYKFGFGPFAPEVYQAPFPYYYQKPAGMSDESYDDMVIQAFNDFFIASVAPETVACVVMEPVQGEGGFIIPSKRFVQHVASFCKEHGIVFVADEIQTGFARTGTYFAIEHFDVVPDLITVSKSLAAGLPLSGVIGRAEMLDAAAPGELGGTYAGSPLGCAAALAVLDIIEEEGLNERSEEIGKIIEDKAYEWKQEFPFIGDIRRLGAMAAIEIVKDPDTREPDKTKAAAIAAYANQNGLLLLTAGINGNIIRFLTPLVISDSLLNEGLSILEAGLRA

SEQ ID NO: 63308 - protein, 176 aa, Panicum miliaceum
KRRNGLLKKAYELSVLCDAEVALIIFSSRGRLFEFSTSSCIYKTLERYRSCSFASEASAPPEAELNNYQEYLKLKTRIEFLQTTQRNLLGEDLGPLSIKELEQLENQIEISLKHIRSSKNQQMLDQLFELKRKEQQLQDSNKDLRRKIQEIGEENVLRLTCQDLGPTGSSGHPDDA

SEQ ID NO: 63309 - protein, 462 aa, Bacillus subtilis subsp. subtilis str. 168
MPDQLTVYNPATGEEIKTIPQQSATEVEEAIERSHQAFKTWSKTSANERTSLLKKWYELIVEHKEELADLITKENGKPYQEAVGEVLYGAGYIEWFAEEAKRVYGRTVPAPTTGKRIVVTRQPVGPVAAITPWNFPNAMITRKAAPALAAGCTFIIKPAPDTPLSAYELARLAYEAGIPKDVLQVVIGDGEEIGNVFTSSPKIRKITFTGSTPVGKILMKNSADTVKHVSMELGGHAPLIVDEDADIDLAVEQAMASKYRNAGQTCVCANRLIVHESIKDEFAAKLSEQVSKLKVGNGLEEGVNVGPIINKRGFEKIVSQIDDAVEKGAKVIAGGTYDRNDDKGCYFVNPTVLTDVDTSMNIMHEETFGPVAPIVTFSDIDEAIQLANDTPYGLAAYFFTENYRRGIYISENLEYGIIGWNDGGPSAVQAPFGGMKESGIGREGGSEGIEPYLETKYLSIGL

SEQ ID NO: 63310 - protein, 365 aa, Thermobifida fusca YX
MADTAKPKATGKTGSRRRAARNNADSHFNGEKPEVLLDYYRQMLLIRRFEERAAQAYTQARIGGYCHLNLGEEATIVGLMEALQERDYLFTNYREHGYAIAKGTHPREVMAELYGRSTGVSKGWGGSMHLFDARTRLLGGYGIVGGQLPLAVGAALAITYRGSDEVVMCQMGDGTTNIGAFHESLNIASLWNLPVIFVVINNFTGMGTPVERSSAEPELYKRGSAYRIEGVRVDGRDVLAVRDTATTLVERARSEHRPFLLEAFSYRMKGHSVVDPAKYRTKEEAEEALANDPIAMFEERLTEAGILTDEIKKEIAESVKAEVADAADFAENSPHPEVSTLFDYTYATPVANESRRMPADPVFAE

SEQ ID NO: 63311 - protein, 331 aa, Thermobifida fusca YX
MPVITYRQALRDTLRAEMHRDENVFLMGEEIGVFEGSYKITEGLLKEFGERRVRDTPIAEEGFVGAAVGAAMLGLRPVVEIMTINFSLLALDQIVNHAAKIYGMFGGQNSVPMVIRTPGGGGQQLGATHSQNVELYYAFVPGLKVVAPSTPADAAALLRAAIRDDDPVLFLENLGLYNTKGEVPDEEVVGEIGRAAVVREGTDITLVGYSRMAMIATQVADRLAEEGISVEVVDLRSLRPLDRETIVNSVKKTGCAVVAEDDWLTYGIGAEIAASIQEGAFDYLDAPVRRVAMAEVPLPYAKPLENAALPSAESVTTVIYETLRAVGRRVG

SEQ ID NO: 63312 - protein, 289 aa, Populus alba
EENWAEEVREDWFQDELEGESYCSNNSNKLNTFPILLEQDLSWEDEELSSLFAKEEQNQLCKDLETNPSLARARCEAVEWILKVNEHYSFTALTAVLAVNYLDRFLFSVHLQKEKPWMAQLAAVSCLSLAAKVEETQVPLLLDFQVEDSKYVFEAKTIQRMEILVLSTLKWKMNPVTPISFLDYITRRLGLEHYLCLEFLKRCERMVLSILADSRSMPYVPSVMAAATMLYVIDNIKPSLAAEYQSQLLSILGIDKDKVEDCSKFLMEFALREHFKLLSNKRKFCSLPG

SEQ ID NO: 63313 - protein, 692 aa, Oryza sativa
  misc_feature (38)..(38): Xaa can be any naturally occurring amino acid
  misc_feature (57)..(57): Xaa can be any naturally occurring amino acid
  misc_feature (406)..(406): Xaa can be any naturally occurring amino acid
MLAGYVYGGGILAVVLAVVVVTLPLPATAAPVAECDPXNLGLLAAGLAANASAAGAXGFAVRTAGAAPDQVYALALCRGDVNASACRACVAAAFVDAKGVCPGGISLYEDACLIRFTGQSFMDFLRPDKWQVSQMTETDLLLVLNSWIPGQASGNVKVPEVGWFNAAVAKILAALVEHAWATTTTTTTGNNSTTTIKYFATGEESFNPKIYGFAQCVPVLTPEQCKECLRSLHDNAKTVYMGNSLRLMYSVRPFYGGRATLQLSPPPPPVVETPVEAGAGKKKSAAGVAAGLACSVLVLLILAVFAFVRFKRRTKAVEADHPLKKITRAQCMIFDLPTLQEATENFSENNKLGEGGFGSVYKGVLSDGQEVAVKKLLGTSGHGLDQLHNEVLLLAELQHKNLVRLXGFCLHYGETLLVYEYIKNGSLDNFLFGNFTSHSNISYFFTLLEEIPKDINRGNALNWEQQYNIILGIAKGILYLHEDSSLRIIHRDLKSNNILLGEDMEPKIADFGLARLLGEGHTHTRTTRVVGTFGYMAPEYAIDGNVSTKIDIFSFGVLVLEIVTRRRNCNSDDHDLVNLLSDVWSCWTKGTVSQMIDPSLHGYSQSQALRCIHIALLCVQSDPNDRPQISSVIFMLTRENMELQPPAQPAFFFGGGSASSSPSFGQRSYVYDRCGFDNISVNGVTLTEPYPR

SEQ ID NO: 63314 - protein, 395 aa, Geobacillus kaustophilus HTA426
MTMEIPFSELLEQLPKQFFASLVAKVGEKIKAGCDVINLGQGNPDQPTPKHIVEAMQRAAANPKYHKYSPFQGYFFLKEAIAAFYAREYGVNVDPDREVAILFGGKAGLVELPLCLVNPGDVVLVPDPGYPDYWSGIALARARMEMMPLSSENGFLPDYEAIPESVADRAKLMFLNYPNNPTGATATKEFFAETVAFAAKHGIAVVHDFAYGAIGFDGRKPVSFLEADGAKDVGVEIYTFSKTYNMAGWRVAFAVGNERIIRALELLQDHLYVSLFGAIQEAAAAALLGPQDCVTELVALYEARRNAFIAALCEIGWEAPAPYGSFFAWLPLPKGISSAEFADMLLERAHVAVAPGIGFGEHGEGYVRVGLLTDEARLREAAERIGRLGLFEKNF

SEQ ID NO: 63315 - protein, 898 aa, Sinorhizobium meliloti 1021
MAKWVYTFGAGQAEGSAEDRDRLGGKGANLAEMCNLGLPVPPGLTIVTAACNSYLEKGRSMPEGLREQVREGITRMEKITGRVFGDTNRPLLLSVRSGARASMPGMMDTVLNLGLNDQSVHALGHDAGDARFAWDSYRRFIQMYGDVVMGVDHEVFEEVLEDEKARLGHEQDTELSAVEWQHVISRYKEAIEEVLGLPFPQDPEVQLWGAIGAVFSSWMNPRAITYRHLHGIPAGWGTAVNVQAMVFGNLGNSSATGVAFTRNPSTGEKELYGEFLVNAQGEDVVAGIRTPQNITEAARIASGSDKPSLEKLMPEAFAEFEKICNALERHYRDMQDIEFTIERGKLWMLQTRSGKRTAKSALKIAVDMAEEGLISKEEAVARIDPASLDQLLHPTIDPHARRDIIGSGLPASPGAATGEIVFSSDEAVQAVKEGRKVILVRVETSPEDIHGMHAAEGILTTRGGMTSHAAVVARGMGTPCVSGAGSIRVDQRNELLIAASVTLRKGDVITIDGSSGQVLKGEIPMLQPELSGDFGKIMQWADASRRMTVRTNAETPADARAARSFGAEGIGLCRTEHMFFEDDRINVMREMILAEDEAGRRTALAKLLPMQRSDFVELFSIMHGLPVTIRLLDPPLHEFLPKTDEEIAEVARVLTIDPAELRQRVDALHEFNPMLGHRGCRLAISYPEIAEMQARAIFEAAVQAAHDTGAAVVPEIMVPLVGLRAELDYVKARIEAVAKEVIGEAGVNIDYLIGTMIELPRAALRADTIAESADFFSFGTNDLTQTTFGISRDDAALFLATYQQKGIIEQDPFVSLDFEGVGELIQIAAERGRRTKNGLKLGICGEHGGDPASIRFCEEAGLDYVSCSPFRVPIARLAAAQATINGREVAEVQALAAS

SEQ ID NO: 63316 - protein, 288 aa, Burkholderia vietnamiensis G4
MSATASTSGADRYVVFGNPVAHSKSPFIHAQFAAQTGQALVYEHRLAPVDGFEAAVRAFVAEGGRGANVTVPFKLDAHALADTLSPRAAAAGAVNTLRIEADGRIFGDNTDGVGLVRDIESNLGVSLAGARILLLGAGGAARGVVLPLLERAPLSITIVNRTASKAEALVGQFAQAAHDAGCVLSGGGPDVVRAEPYDVIVNATAGSLDAALPACDPAAFGPHTLAYDMMYGAQPTVFMQHAASLGARTADGLGMLVEQAAESFYIWRGVRPDGAPVLAALRQALAAG

SEQ ID NO: 63317 - protein, 79 aa, Arabidopsis thaliana
  misc_feature (68)..(68): Xaa can be any naturally occurring amino acid
MAGYMLSSATMVDCSAQATMVAPLNGLKSCADLPVTRMANNDITFMTRNGGRVNCMHVWTSIGKKKWXTLSHLTDLTES

SEQ ID NO: 63318 - protein, 207 aa, Saccharophagus degradans 2-40
MTTTKPALRLGIGGPVGSGKTALVKVLCAILKEKYNIAVITNDIYTREDAEFLLRHEVLEADRILGVETGGCPHTAIREDASMNLSAVAELQDRFANLDVILIESGGDNLAATFSPELSDLTLYVIDVSAGDKIPRKGGPGITKSDLLIINKIDLAELVGADLGVMDRDAKKMRGNKPFVFSNLKNGTGVEDIVSFIEKQGMLTPSK

SEQ ID NO: 63319 - protein, 278 aa, Zea mays
MRGLHRCPHQLLLVSPPPRSAPACRQSATASSRGLRSSLAVFSAPGARVAAAAREQKWGHVEGDEDGGEEGLGEALHRTRELVECAMFAAVAGLAYFLSNSLAIENYFSCFFPLPIVISSLRWGLEASRKTVVATVLLLFTLSGPVKASTYLLMHGVVGLIMGTVWRLETNWIVSIILCSIVRALGACGYVLVSSFLIRENILALITVNIHASLTYILTAAGVNTIPSMGTIYLLFGTLLLLNCGFFVFLLHVMYTVFLAKLGINPSLRSPRWLDRVM

SEQ ID NO: 63320 - protein, 575 aa, Ostreococcus tauri
MAVTEFDDDINRRRVASSMLARALRRGASSNNTCLRLSERSVRWISTSSDDETRTNAWNPDSQKSVSPPPTPHARRWSVSVHDDGGVGLGVAMDYDDRGDAFDRGRNRRNSTLGASARDEYEEYVESLTPRQASVVHAPGVLDKATGRYRIEVTTGTNRGAGTNGRVELTLVGADGLTYPVALQYDKGIDPQFSRASCLPFRFAVSARLGELRRTRVRLVPELTAVGRGWYLDDIRVTCENTGDEWVFPCHRWFGQSDSGDGQSGPYTQDLDAKSADELRRAFGAEGEMPRKERGEFECVASGAAVPHPEKTKRDGARAVVRRTHGHGGEDAYFIARAPGHNNVGMGIADGVYLWRWQGIDAGEYSRALMTHAAEALISGAIVRPTAMMAHAYDEVNNAGMKGSTTACIVVIDKEHGLMYCSNVGDSGFMLIRGEPGGRYVAHRSPPQEHNFGCPFQLGHHETSDKASDAMRTKLYLEPGDIVVLGSDGLWDNLSEVEVLASVEASVADEAKVDQKAIDIATRNLLARAYDVSMDRSRVTPYSLAATEHFDMVYSGGKKDDISVVVCHASLKSGF

SEQ ID NO: 63321 - protein, 347 aa, Ostreococcus tauri
MFSIETRVTAPSPLARLASAHRAQRRVGRRRIGASASRVGPAPESETERLNQKFGIPGSVSFSNGRGGLPRCALTHKNGRTAEVYLFGACVTSWTQPTGDDALYVRPDCVWDKTKPLAGGAPLCFPQFGPGPMQQHGFARNVDWEVIGTSADVNPDDPEPAVMLRLRPNAYTKAMWDEPFEATYEVTLRRELLKLEFCVKNCAEEGGKAFDFTAAVHTYIEVTDCANAGVFARGLKGKTYLDKAIDANNPPRKTQDGRDVFFGLELVDRVYLDTEPETLLHVGSGAAVAVENTAGWTDTVIWNPHHNMKEYYKNFCCVESAAVGKPVVLQPGEVWRAETNLSVVDVN

SEQ ID NO: 63322 - protein, 346 aa, Oryza sativa (japonica cultivar-group)
MAATASNKRVILKRYVTGLLSEDDMEVVTTEVPPLAVVPAGSEAVVVKNLYVSCDPYMRNRMTRHEVPSYVSDFIPGEVLANFGVMRVISSGHPDFKAGDLVWGITGWEEYTVINNPESLFRINHPKLPLSYYTGILGMPGLTAYAGFFEVSKPKKGEYVFISAASGAVGQIVGQLAKIIGCYVVGSAGSDEKVSLLKTKFGFNDAFNYKKEPDLEAALRRYFPEGIDIYFENVGGETLDAVLPNMRLGGRIAACGMISQYNLERPEGVKNLFYIVTKRLRMEGFLVFDFYDRYYQFEDEMARYLKEGKVAYVEDVVEGLDAAPAALIKLFTGRNVGKQLVAIARE

SEQ ID NO: 63323 - protein, 403 aa, Listeria monocytogenes str. 4b F2365
MSKPKIVILGAGYGGLKTLRKLQQRNLEAEIVLVNKNDYHHETTWLHEAAAGTIEPEKLMYPLDKVVNNTKTTFIQDTVVKINKDEKTVTLDANGDISYDYLLIALGSEAETFGISGLKEYAFTITSVESVKKIRAHIEAQFAKWKTDPRDELLTIIVGGAGFTGIEFLGELTNRIPELVKEYDVPREKVRIYCMEAAPKVLPQFDAKLVDYGVGVLEDRGVEFHVGKPVKEATADGVKYAESENEVREIKAATIIWAAGVRGNSVIEASGFEAGRGRVKVNNNLTVPGNEEILIVGDCSLIINPANDRPFPPTAQIAMQQADVAAVNLAKLVKGETDLQDFVYHEKGTVCSLGDNDAIGVVFGKNLKGYPASVMKKVIDDRALLLIGGSGVLASKGKFKFYK

SEQ ID NO: 63324 - protein, 625 aa, Oryza sativa (japonica cultivar-group)
MLCVVFAPTAAGPGIPEIKAYLNGVDTPNMFGAPQLIVKIIGSICAVSSGLDLGKEGPLVHIGACLANLLSQGGSGRHRLRLRWLRYFDNDRDRRDLITCGASSGVCAAFRAPVGGVLFALEEVATWWRSALLWRTFFSTATVVVVLRGFIEVCRNGRCGLFGEGGLILFDVGDVAVRYHAGDLLPVTIVGVLGGVLGALYNHVLHKVLRVYNLINEKGRAAKLALALAVCALTSALLYVTPFAVPCTPCDPAFGGACPTLGKSGNFKRFNCPEGHYNDLATLLHATNVDATRNIFSTGTAGEFRLDSLLIFFAVYCVLGLFTFGIAVPSGLFLPIILMGSAYGRVTALVLSRFARIDHGLYAVLGAAALMSGSMRMTVSLVVIFLELTNNLLLLPITMFVLLIAKTVGDAFNPSIYEIILDLKGLPFLEAKPEPWMKDLTVGELAAAKPRAVALQVVERVSTVVEALRATRHNGFPVLDRPRPGVSELHGLVLRSHLVAALRKRWFLPERRRTEEWEAREMFSSAELADKCGGVDELEISPEEMGMYVDLHPLTNTTPYTVVETMSVAKAVVLFRSVALRHMLIMPKFQGPEISPIVGILTRQDLIAHNILGAFPHLASKRKTH

SEQ ID NO: 63325 - protein, 431 aa, Acidobacteria bacterium Ellin345
MSRKLDRSRELQKRAEALIPGGVNSPVRAFRAVGGEPPILVRGEGARVFDADGNGYIDYVLSWGPLILGHAFTPVINAIEKAAEKGTSFGASTPTEADLAEAVVHAMPAIEKIRFVSSGTEATMSAIRLARGFTGRKYIVKFEGCYHGHSDSLLVKAGSGVATLGIPGSAGVPDELAQLTLALPYNNVAAVEQAFTKFKGQIACVIVEPIVGNMGCVPPAADYLQALSDITKREGAVLIVDEVMTGFRVAYGGAQELYGLKPDLVTLGKIIGGGLPVAAYGGRKDIMDKIAPLGPVYQAGTLSGNPLAMAAGLAMLCHLRDNAMEIYPRLDQLSADLVNRVLDAAREAGVALTANRVGSMFTWFFTDKHVTDWDSAATCDTKQFGQFHGAMLDAGVWLPPAQFEAAFLSSAHTEQDIDDTVAAAREAFAIL

SEQ ID NO: 63326 - protein, 444 aa, Magnetospirillum magnetotacticum MS-1
MSERILIVDFGSQVTQLIARRVREAGVYCEIHPFNRVSVDSIREFGPKGVILSGGPASVPEAGSPRAPQGLFDMGLPILGICYGQQTMCEQLGGKVSPGDHREFGRAMLSVSGEPCALFDGIAAKGDEVQVWMSHGDRVTAIPPGFKVVATSEGAPFAAIANADKRFYGVQFHPEVVHTPIGKQLLSNFVHKIVGCAGDWTMKAFRAQEIAKVRAQVGSGRVICGLSGGVDSSVVAALLHEAIGDQLTCVFVDTGFMRAGESEQVVSVFRDRFNIKLVHKDASGLFLDKLAGLTDPEKKRKIIGATFIDVFEEEARAVGGADFLAQGTLYPDVIESVSFTGGPSVTIKSHHNVGGLPERMNMKLVEPLRELFKDEVRALGRELGLPADMVGRHPFPGPGLAIRIPGQPLTRENLDILRKADSIYLDEIRKAGLYDEIWQPSPCC

SEQ ID NO: 63327 - protein, 401 aa, Streptomyces avermitilis MA-4680
MADSTATSTPRAVPSHEDRPVYVIGGGPGGLAAAHALRAQGVRAVVLEKSDRVGASWRRHYDRLHLHTTRRLSALPGLPMPRSFGRWVSRDNVVRYLEKYVEHHQLEIVTGVEVSRVEPAPDGTGWLLHATGGRELTGSAVVVATGHNHTPHLPDWPGRDAYTGELLHAGDYRNATPHAGRDVLVVGVGNTGAEIAVDLVEGGASRVRLAVRTAPHIVRRSTAGWAAQFTGIVVRRLPVRLVDLLAGPMARLSVPDLSAQGLPRPDTGLYSRVREGSIPVQDVGLIDAVRKGRVEIVAAVDGFEDGKVVLADGNRIGPDVVIAATGYARALEDLVGHLDVLDGRGRPTVHGARTPRTAPGLYFTGFTNPISGMFRELAIDAEKIAKAVAKALARTTARTPA

SEQ ID NO: 63328 - protein, 420 aa, Zea mays
MPATDLQGSSPFSSFGRTLLSLRRDAPASASAAAAMPPPGVDPELEEFHAHVAAHLADLSGPGAAGEEEFMSIAWIRRLLEAFLLCQEEFRVAVAEARRRRAGATPPAAERLVAEFGDRAVKVLDVCNAARDGVDQARRWERLAGIAASALLAPADGQIHEGQLRRARKALSDLSVLLIDDAAAAAATGPAGGLASILASHRNRSFGRARASPSRAASSSSSSSSPSAHFRSLSWSVSRTWSAARQLQAIGAGLAAPRASEASWSLAAPAYAMGCLLHLAAWALVAAVPCPDRAAALQAHHLPAAPPRAAFPWAPPLLALQERLAEEGKRKDRRNSCGLLREIHALEKCAQRLAEAIDAAPVPLTGEREAEVREAAAQLAAACSAMKDGLDPLERQVREVFHRIVRSRMEGLDSPMPNAD

SEQ ID NO: 63329 - protein, 141 aa, Saccharophagus degradans 2-40
MAIERTLSIVKPDAVEKNIIGKVISRFEKAGLKIVAAKMMHLTEEKARGFYAEHEGRPFFAGLVEFMTSGPVVVQVLEGENAIALNRELMGATNPAEAAEGTLRKDFADSVGRNAVYGSDSPASAEREINYFFDASEICPR

SEQ ID NO: 63330 - protein, 431 aa, Thermobifida fusca YX
MSEIYMPRLSDTMEEGVISSWVKQVGDKVSVGDVLVEIETDKAVMEYEAYEDGYLVQQTVREGETVPIGAVIGVIADSPDAVPAAPEGGEGAEQKAEEPQQPAPAAQEAKEEQPTVPAPAAPAEQGGKPRPLSSPLARRLAREYGLDITKIQGSGPKGRVVRADVEAAAQQKREQEAAAPQPAAAKAPAPAAAPPQPEFEDLRASEEVPVTNIRRVIARRLTQAKQEIPHFYLRRRIDAEALREFRAQINEQLAPTGVKVSVNDLIVKAVATVLRDHPEVNSSWVDDKLLRHKRINVGIAVAVDTGLVVPVLHDADTLALSEVARRSRALVEKARDGKLSPQDMSGGTFSVSNLGMFGVESFSAVINPPEAAILAVGAMQQEPVVRDGEIVARHTIALELSVDHRAVDGAVGAAFLKDLAEVLESPMRIVL

SEQ ID NO: 63331 - protein, 424 aa, Oryza sativa (japonica cultivar-group)
MQASFAPGGWQGTAAAPGGWQGMAPPQPPQAPLFAYGANTSAPHLAQMKQGSDRSSMDDSLSDLQESGMDSRPPGGFLSYFQDPSSLQNHQPSIPLNYYATQQAAPWAPSPAEYRSPVTKSGPGEQHPINIDSGGEETPTVRTEKRLTWTHEEDIRLVSAWLNNLNDSINGNFKKNDCYWGDVTTAYNSTTPRNRMRQEKQIKDRFHKIKKNVGRFCCAYKEVKSIYVSGQNELQLMEKVHATYEADYKEGQFTFLHCWKALRDQPKWHAYLEELEKPNKTKSDNEVEVRELTSTPNSPEDIIRPEGTKAAKARRNGKDKRKRKAKVYLSDMDDEIDKPKEVQNMADKGRDELLETQRRVSSENLESKRLAHLAAMEHKEAVMLETYRALMLQDTKDMPDDVRFEHVMALKSMREKLFPKTKHN

SEQ ID NO: 63332 - protein, 233 aa, Zea mays
MDAADVWGRSSSSSSSSAAAARRLQARYDLYMGIDDADAGLDEVTEPRGGAESYNCPFCGEDFDFVGLCCHIDDEHAVEAKSGACPICATRVGMDLIGHLTMQHGSYFKMQRRRRVRKVSSGSHSLLSLLRKDLRNGSLQSFLGGSSYVSNPPAAAPDPFVSSLICTLPVAEPSKDLHSDSSDNNFLLNKFPDEKPVERAEPSLSEKDQKERVQRSKFVRGLVLSTIFDDDNL

SEQ ID NO: 63333 - protein, 210 aa, Oenococcus oeni PSU-1
MTTIYISSKQAHNFDDYTINKIGVPSSVLMERAALAVCQRLLESRNFNLKKVLVVAGIGNNGGDGIAVARMLYLKQVPVKIYLLGDREKISKDSRIQLKIAENYGVPFVSNIDDLSSYTTIVDAVFGVGLSRDVTGEIAGIVDFINNSPASVMAVDMPTGLNADNGNIMGTAVKAAETVTMSYNKLGLISETGRKFAGVVTVADIGIYEP

SEQ ID NO: 63334 - protein, 422 aa, Lactococcus lactis subsp. lactis Il1403 [sequence omitted]

SEQ ID NO: 63335 - protein, 233 aa, Oenococcus oeni PSU-1
MDAELQNKLKKEAARKAASYVKNGMVVGLGSGSTVKMLVDELGRRVKEEDLQFTGVATSIFTAQQAKSLGIKIVDLDMVDSIDLTIDGADQVDSNFNGIKGGGGNLLWEKIVAINSKKIVWVVDKSKVVDTIGAFPLAVDVIPFGSQHVMQNFDKAGYEPVLRLDKEGKPFKTDSNNLIIDLHLHKIEEPTQLADNLIQTVGVVEHGLFLNMVSEVVVGKEGQPEILVNPNIG

SEQ ID NO: 63336 - protein, 125 aa, Brassica napus
  misc_feature (6)..(6): Xaa can be any naturally occurring amino acid
  misc_feature (9)..(12): Xaa can be any naturally occurring amino acid
  misc_feature (14)..(16): Xaa can be any naturally occurring amino acid
  misc_feature (18)..(19): Xaa can be any naturally occurring amino acid
  misc_feature (22)..(23): Xaa can be any naturally occurring amino acid
  misc_feature (25)..(25): Xaa can be any naturally occurring amino acid
  misc_feature (28)..(30): Xaa can be any naturally occurring amino acid
  misc_feature (33)..(34): Xaa can be any naturally occurring amino acid
  misc_feature (36)..(38): Xaa can be any naturally occurring amino acid
  misc_feature (40)..(40): Xaa can be any naturally occurring amino acid
  misc_feature (44)..(44): Xaa can be any naturally occurring amino acid
  misc_feature (48)..(48): Xaa can be any naturally occurring amino acid
  misc_feature (52)..(52): Xaa can be any naturally occurring amino acid
  misc_feature (56)..(56): Xaa can be any naturally occurring amino acid
  misc_feature (63)..(63): Xaa can be any naturally occurring amino acid
  misc_feature (84)..(84): Xaa can be any naturally occurring amino acid
  misc_feature (87)..(87): Xaa can be any naturally occurring amino acid
  misc_feature (100)..(100): Xaa can be any naturally occurring amino acid
  misc_feature (110)..(110): Xaa can be any naturally occurring amino acid
  misc_feature (112)..(114): Xaa can be any naturally occurring amino acid
  misc_feature (117)..(124): Xaa can be any naturally occurring amino acid
DQSSMXSSXXXXTXXXQXXMVXXFXVLXXXAAXXVXXXAXNDIXSIAXNGGXVSCXKVWPPVXKKKFETLSYLPDLTEVELGLXKSXTLLRNKCIPCVEXELEHGFCAPXSXXXPPXXXXXXXXM

SEQ ID NO: 63337 - protein, 341 aa, Shigella flexneri 2a str. 301
MKALSKLKAEEGIWMTDVPVPELGHNDLLIKIRKTAICGTDVHIYNWDEWSQKTIPVPMVVGHEYVGEVVGIGQEVKGFKIGDRVSGEGHITCGHCRNCRGGRTHLCRNTIGVGVNRPGCFAEYLVIPAFNAFKIPDNISDDLASIFDPFGNAVHTALSFDLVGEDVLVSGAGPIGIMAAAVAKHVGARNVVITDVNEYRLELARKMGITRAVNVAKENLNDVMAELGMTEGFDVGLEMSGAPPAFRTMLDTMNHGGRIAMLGIPPSDMSIDWTKVIFKGLFIKGIYGREMFETWYKMAALIQSGLDLSPIITHRFSIDDFQKGFDAMRSGQSGKVILSWD

SEQ ID NO: 63338 - protein, 475 aa, Listeria monocytogenes str. 1/2a F6854
MAKEYDVVILGGGTGGYVAAIQAAKNGQKVAVVEKGKVGGTCLHRGCIPTKALLRSAEVLQTVKKASEFGISVEGTAGINFLQAQERKQAIVDQLEKGIHQLFKQGKIDLFVGTGTILGPSIFSPTAGTISVEFEDGSENEMLIPKNLIIATGSKPRTLSGLTIDEEHILSSDGALNLETLPKSIIIVGGGVIGMEWASMMHDFGVEVTVLEYADRILPTEDKEVAKELARLYKKKKLNMHTSAEVQAASYKKTDTGVEIKAIIKGEEQTFTADKILVSVGRSANTENIGLQNTDIATENGFIQVNDFYQTKESHIYAIGDCIPTIQLAHVAMEEGTIAANHIAGKAAEKLDYDLVPRCIYTSTEIASVGITEEQAKERGHEVKKGKFFFRGIGKALVYGESDGFIKIIADKKTDDILGVSMIGPHVTDMISEAALAQVLNATPWEVGNTIHPHPTLSESFREAALAVDGNAIHG

SEQ ID NO: 63339 - protein, 417 aa, Vibrio cholerae O1 biovar eltor str. N16961
MKNAIQGAQMLFVAFGALVLVPLLTGLDPNVALFGAGLGTLLFQLITRRSVPIFLASSFAFIAPIMFGIQTWGIPATMGGLMAAGAVYIVLGGIIKVRGVAIIHKLLPPVVVGPVIMVIGLGLAPAAVNMALGKTGDGSVQLVDPQAALWISCISLLVTVVFSVFAKGFFKLVPILAGIVSGYAVSLVMGVVSFAAVEQAAWLALPNFTFPEFNINAILFMIPVAIAPAVEHVGDMLAISNVTNKDYLKKPGLHRTIAGDGVATMAATMLGAPPNTTYSEVTGAVMLTRAFNPAIMTWAAITAIVLALVGKLGALLQTIPVPVMGGIMILLFGSIATVGLNTLIKNQVDLHKSRNLVIVAVTLVFGIGGMAFGVGDFSLQGVSLCGIVAIVLNLVLPNDLGENHVVDNAQMEEEARH

SEQ ID NO: 63340 - protein, 327 aa, Listeria monocytogenes str. 1/2a F6854
MPVISYIDAITMALKEEMERDDKVFILGEDVGKKGGVFKATAGLYDEFGEDRVLDTPLAESAIAGVGIGAAMYGYRPVAEMQFADFIMPAVNQIISEAARIRYRSNNDWSCPMVIRAPFGGGVHGALYHSQSVEKVFFGQPGLKIVVPSSPYDAKGLLKAAIRDNDPVLFFEHKRAYRLLKGEVPETDYIVPIGEANVVREGDDITVITYGLAVQFAQQAAERLAAEGVEAHILDLRTIYPLDQEAIIEATKKTGKVLLVTEDNKQGSIISEVAAIISEHCLFDLDAPIARLAGPDTPAMPFAPTMEKHFMINPDKVADAMKELAEF

SEQ ID NO: 63341 - protein, 416 aa, Listeria monocytogenes str. 1/2a F6854
MAVEKITMPKLGESVTEGTISSWLVKPGDTVEKYDAIAEVLTDKVTAEIPSSFSGTIKEILAEEDETLEVGEVICTIETEEASSSEPVAEAEQTEPKTPEKQETKQVKLAEAPASGRFSPAVLRIAGENNIDLSTVEGTGKGGRITRKDLLQVIENGPVAPKREEVKSTPQEKEATPNPVRSAAGDREIPINGVRKAIAKHMSVSKQEIPHAWMMVEVDATGLVRYRNTVKDSFKKEEGYSLTYFAFFIKAVAQALKEFPQLNSTWTGDKIIEHANINISIAIAAGDLLYVPVIKNADEKSIKGIAREISELAGKARNGKLSQADMEGGTFTVNSTGSFGSVQSMGIINHPQAAILQVESIVKRPVIIDDMIAVRDMVNLCLSIDHRILDGLLAGKFLQAIKANVEKISKENTALY

SEQ ID NO: 63342 - protein, 318 aa, Arabidopsis thaliana
MILAHLPRFHLSILAKPSFSLSSSHFSFLNPKPSVTVSRTLFSFASKSNLATVEPIPLSVSDSTDLDDAPVEIALDKLFIPPETDISGEDSASLTTRILKGSNIVLSKYARDAQVVQADYVKSSVKTEDCPADGLPEFALVGRSNVGKSSLLNSLVRRKRLALTSKKPGKTQCINHFRINDKWYLVDLPGYGYASAPHELKQDWNKFTKDYFLNRSTLVSVFLLVDASIPVKPIDLEYASWLGQNQVPMTLIFTKCDKRKKKKNGGKKPEANIKEFQDLIQGFFETTPPWIMTSSVTNQGRDEILLHMAQLRNYWLKH

SEQ ID NO: 63343 - protein, 414 aa, Saccharophagus degradans 2-40
MSDFHYQNGELFAEQCSLNAIADALGTPCYVYSKAAFTRAYQDYANALGNHPGMVCYAVKANSNIAVLQVLAKLGAGFDIVSSGELRRVLKAGGQPNRIIFSGVGKTREEMREALEVGIACFNVESEAELERLADVAAELGVVASISLRVNPDVDAKTHPYISTGLKENKFGIDIQRAPAVYARASELASLKVVGVDCHIGSQLTELTPFLDALDRLLQLVDTLAETGITIEHLDIGGGLGVTYRDEVPPAVADYLTQIKAKLGDRKLAIIMEPGRSIAANAGVMLTEVEFLKPTEHKNFAIIDGAMNDNIRPALYQAWQDVKPLSQREGETQQWDLVGPVCETGDFLAKDRALALQAGDRLALMSSGAYGFVMSSNYNTRGRAAEVLVDGDKYFVVRERESFEDLIRGEHLLP

SEQ ID NO: 63344 - protein, 224 aa, Striga asiatica
PGRSLLDIGRFCTGYGIGIFSYVVPVFISEIAPKNLRGGLATLNQLMIVIRIIYSVYLRNSVNMENLALTGLLPCLLLLVGLFFIPESPRWLAKIGRQKEFELALRKLRGKNANVSKEAAEIQASFDTLRDLPKVNMFELFDAKYIRPLIVGVGLMFSQQFGGIKRVGFYTSQTFVAAGFSSGKMGTILYAIIQVPVTVVGAVLMDKSGRRPLLMVSPKDCPIL

SEQ ID NO: 63345 - protein, 325 aa, Listeria monocytogenes
MAQKTMIQAITDALAVELEKDENVLVFGEDVGKNGGVFRATEGLQEKFGEDRVFDTPLAESGIGGLAIGLALEGFRPVPEIQFFGFVFEVMDSVAGQMARMRYRTGGTRTAPITIRAPFGGGVHTPEMHADNLEGLMAQSPGLKVVIPSTPYDAKGLLISAIRDNDPVIFLEHMKLYRSFREEVPEGEYTVEIGKAAVRREGTDVSIITYGAMVQESMKAAEALEKDGVSVEVIDLRTISPIDVETIIASVKKTNRAVVVQEAQKQAGIAANVVAEINDHAILSLEAPVMRVAAPDSVFPFSQAETVWLPNHNDIIERVKEVIAF

SEQ ID NO: 63346 - protein, 217 aa, Photorhabdus luminescens subsp. laumondii TTO1
MMKKIEELLANNKQWSESVNEENPIFFKELAKSQKPHFLWIGCSDSRVPAEKLIDAAPGDLFVHRNVANLVIHTDLNCLSVIQYAVDVLEVEHIIICGHYGCGGIEAAIDGTELGLINNWLLHIRDLWYKHSSMLGELPPNERLNRLCEINVVEQVYNLGHSTIMQAAWKRGQKVMIHGWVYGIHNGQLQDLEVTADSREKLELAYRQTISKLTHKK

SEQ ID NO: 63347 - protein, 666 aa, Mycoplasma mycoides subsp. mycoides SC str. PG1
MIYLLNIRRKMKTSKNDNLNALRILGVSAINKAKSGHPGIVLGAAGIVYVLFNKIMNFNPKNPEWFNRDRFILSAGHGSALLYSALHLSGYDLSIDDLKQFRQWDSKTPGHPEKTLTCGVEVTTGPLGQGVGMGVGMAVAEAHLASVYNKHDFNLIHHYTYVLCGDGDLQEGISQEAISFAGKHRLNKLILIHDSNDVQLDSNVVDVQIEDMHKRFKACNWNTIKVSDGEDLNSIYKAIRKAQLSDKPTYIEVKTVIGLGSTKQGTKDIHGAPLNDDITKVKKYFDWDYDDFIIPDSVYKHWSINAKKGEIKEEYWNQLKAKYSLKYPELSSYLDNAINKNITFDFSSLLKDIPNNDEATRLSSGKIFEKIANHEKMLIGGSADLSSSTRIKGADNQFTNLNKTGRNIMYGVREFGMGAINNGIAAHKGLIPVASGFFVFADYLKPAMRLASIMQLQQLYVFTHDSIAVGEDGPTHQPIEQLAMLRTIPNHVVLRPADFSETIACYKVALTKLTKTPASIILTRQNVKQLQHNDVLNQVERGAYIISDQTDATISLIASGSEVGLAIDVQKELLNHNIKSKVISMVSTNLFDKQDKEYQDLIINKNTKRIAIEMGSNAIWYKYVGDDGLVFGIDRFGESAPANSVIKEFGFTKENLTKKILEYLNK

SEQ ID NO: 63348 - protein, 336 aa, Helicobacter pylori J99
MPKTETYPRLLADIGGTNARFGLEVAPRQIECVEVLRCEDFESLSDAVRFYLSKCKESLKLHPIYGSFAVATPIMGDFVQMTNNHWTFSIETTRQCLNLKKLLVINDFVAQAYAISAMQENDLAQIGGIKCEINAPKAILGPGTGLGVSTLIQNSDGSLKVLPGEGGHVSFAPFDDLEILVWQYARSKFNHVSAERFLSGSGLVLIYEALSKRKGLEKVAKLSKAELTPQIISERALNGDYPICRLTLDTFCSMLGTLAADVALTLGARGGVYLCGGIIPRFIDYFKTSPFRARFETKGRMGAFLASIPVHVVMKKTPGLDGAGIALENYLLHDRI

SEQ ID NO: 63349 - protein, 207 aa, Rhizobium galegae
MCAHLPAGHSFEWRKACRRKTTNRVIMTASTKDILATAIRSIPDYPKPGIIFRDITTLLGDAAAFRLAVDELVKPYEGLGVDKIAGMEARGFILGGAMAHQLSAGFVPIRKKGKLPYRTVSMAYALEYGTDEMEIHVDAVKPGEKVILCDDLIATGGTAVGAVKLLRQIGAEVVSACFVIDLPDLGGRKALEALGVEVRTLAEFSGH

SEQ ID NO: 63350 - protein, 476 aa, Sulfitobacter sp. EE-36
MNPGTEPSFRDSVDIMFNRAVALMDLSPGLEEKIRVCNATYTVRFGVRLRGGIQTFTGYRSVHSEHMEPVKGGIRYSPGVNQNEVEALAALMTYKCALVEAPFGGSKGGLCIDPRDYDEHELELITRRFAYELIKRDMINPAQNVPAPDMGTGEREMAWIADQYKRMNTTDINGVACVTGKPINAGGIHGRTEATGRGVQYALHAFFRDTKGMEKAGLGGELDGKRVVVQGLGNVGYHAAKFLSEEDGCKITAIIERDGALFDDRGLDVEEVHRWISMHGTIKGYPDAPLEEDGAKLLEADCDILIPAALEGVINLTNAHNIKAPLIVEAANGPVTAGADDILRAKGVVIIPDMYANAGGVTVSYFEWVKNLSHIRFGRMQRRNEESRHQLLVDELERLSADSGVGWQLSPNFKDKYLRGAGELELVRSGLYDTMSDAYRSMAEVWHSRDDVEDLRTAAYLVSIGKVAASYRAKGL

SEQ ID NO: 63351 - protein, 791 aa, Pisum sativum
MYSLSPPHTTTTSISHSTTHALINKTKLLELHNHNHSRISITISSKSNSNKTFAIGNRVGVETEIAVVEIHKPQFEVSRGFPSPFGATAQEDGVNFAIYSLNAHSATLCLFTLSDFKNNKVTEYIALDPLVNKTGCVWHVFLKGDFKDMLYGYKFDGKFSPQQGHYYDSSRVLLDPYAKAVISRGEYGAVGLDGNCWPQMAGMVPFDPEEFDWEGDLPLKYPQKDLIIYEMHVRGFTKHESSKTEFPGTYLGVVEKLDHLTELGVNCIQLMPCNEFNELEYYSYNAVQGDYRVNFWGYSTINYFSPMIRYSSAGTQNCGRDGINEIKFLIKEAHKRGIEVIMDVVFNHTAEGNEKGPIISFRGVDNSVYYMVAPKGEFYNYSGCGNTFNCNHPVVRKFIVDCLRYWVAEMHVDGFRFDLASIMTRGSSLWNGVNVFGTPIEGDMLTIGTPLSSPPLIDMISNDPILRGVKLIAEAWDAGGLYQVGIFPHWGIWSEWNGKYRDTVRQFIKGTDGFAGAFAECVCGSPSLYQGGRKPWNSINLVCAHDGFTLADLVTYNSKHNLPNGEDNNDGENHNNSWNCGEEGEFVSASVKKLRKRQMRNFFLSLMVSQGVPMIHMGYEYGHTKGGNNNTYCHDNYLNYFQWDKKEESSSDFFRFCSLLIKFRQECESLGLDDFPTSERLQGHGLFPVTPDWSETSRFVAFTLVDSVKGEIYIAFNTSHLPFTVTLPERPGYRWEPLIDTSKSAPYDFLTPDLPGRDIAIQQYAHFLDVNMYPMLSYSSIILLRTPDVNA

SEQ ID NO: 63352 - protein, 335 aa, Frankia sp. CcI3
MATRVGVNGFGRIGRNFWRALAASNRNDLEIVAVNDLTDNKTLAHLLKYDTTLGTLSAAVGVVDEGIRVGDTVIKVLAERDPAALPWADLGVDVVIESTGRFTKAADAGKHLQAGAKKVIISAPAKDEDITVVIGVNDDAYDPARHHILSNASCTTNCVAPMAKVLDEAFGISQGLMTTIHAYTNDQVILDFPHSDLRRARAAAQNIIPTTTGAAKATALVLPHLKGKLDGLAMRVPVLDGSVTDLVATLDKKASKEEVNAAFKAAAEGPLKGYLVYTEDPIVSSDIVNTPASCTFDSLLTMSAGNQVKVVGWYDNEWGYSNRLVDLTALVAARL

SEQ ID NO: 63353 - protein, 857 aa, Pisum sativum
MTNLLPAFSFSVTPHKYETKCSFFHTSFTCIQHQNQLVSKNLQDLKIPFSQNLTSKLCATSSRLSIEETGQKLISFTQSEDIKTALPYLFRTETGEGLVKVYVKKKKDTYFVYIEVSSLELSNVEGETFVLCWGVYSDDSSSLGSGKGMNVSPLVKNSLGKFSVELEFDVEQVPLYLSFLLRLSGSEITTHAEKKFLRACLVFLGVVHLRWGSPFLLTGLSILQFFRGMQQGVVLCLYDNNVDTGVKKPALELDLDPYVNRSGDIWHISLENAKSFVSYCYRFRGANRDNSYAECVVLDPYARIVGNSFPNGIGSVKNLGFLRKEPAFDWGDDYHLNLDMEKLVVYRLNVKHFTEHESSQLSGDLAGTFSGLAKKLQHFKDLGVNAVLLEPVFTFDEEKGPYFPCHFFSPVNLYGPSGDPESTINSMKEMVKTMHANGIEVIMEVVFSNTAEVGALQGIDDLSYYYANGVVGGLKVHSALNCNYPIVQNLILDSLRHWVTEFHIDGFSFVNASHLLRGYHGEYLSRPPLVEAIAFDPVLWKTKIIADCWDPNDMETKEIRFPHWMRWAEINTNFRSDVRNFLRGESLLSNLATRLCGSGDMYSDGRGPAFSFNYISGNFGLSLVDLVSFSNAGLEAELSWNCGEEGPTNSTAVLERRLKQIRNFLFILYVSLGVPILNMGDECGHSSGGSLANGNTKPFNWAALKTGFGKQTIQFISFLTSLRTRRSDLLQSRSFLKEENIEWRGIDEAPPKWEDPSCKFLAMTLKAERNEHQESSVSSDILGDLFVAFNADDCPETVVLPLPPEGMSWYRIIDTALPFPGFFLNNGDLVLEQMSGLSTYEMKSYSCILFEANISPS

SEQ ID NO: 63354 - protein, 792 aa, Streptococcus pyogenes M49 591
MKTKKVIILVGLLLSSQLTLIACQSRGNGTYPIKTKQSRKGMTSNKIKPIKKSKKINKTHKGVAGVDFPTDDGFILTKDSKILSKTDQGIVVDHDGHSHFIFYADLKGSPFEYLIPKGSSLAKPAVAQQAASQGTSKGADPHHHYEFNPADIVAEDALGYTVRHDDHFHYILKSSLLGQTQAQAKQVATRLPQTSSPVSTVTANGIPGLHFPTSDGFQFNGQGIVGVTKASILVNHDGHLHPISFADLRQGGWAHVADQYDPAKKAEKPAETHHTPELSEREKEYQEKLAYLAEKLGIDPSTIKRVETQDGKLGLEYPHHDHAHVLMLSDIEIGKDIPDPHAIEHARELEKHKVGMDTLRALGFDEEVILDIVRTHDALTPFPSNEKDPNMMKEWLATVIKLDLGSRKDPLQRKGLSLLPNLETLGIGFTPIKDISPVLQFKKLKQLLMTKTGVTDYRFLDNMPQLEGIDISQNNLKDISFLSKYKNLTLVAAADNGIEDIRPLGQLPNLKFLVLSNNKISDLSPLAWLHQLQELHIDNNQITDLSPVSHKESLTVVDLSRNADVDLATLQAPKLETLMVNDTKVSHLDFLKNNPNLSSLSINRAQLQSLEGIEASSVIVRVEAEGNQIKSLVLKDKQGSLTFLDVTGNQLTSLEGVNNFTALDILSVSKNQLTNVNLSKPNKTVTNIDISHNNIPLADLKLNEQHIPEAIAKNFPAVYEGSMVGNGTAEEKAAMATKAKESAQEASESHDYNHNHTYEDEEGHAHEHRDKDDHDHEHEDENEAKDEQNHAD

SEQ ID NO: 63355 - protein, 729 aa, Burkholderia vietnamiensis G4
MSAHLLKCRALQPRPSAPSASRPSGAASRAGNVRRSSFRMPPCSRFLDSFSGLDMTTSSPASTTLMANAIRALAMDAVQQANSGHPGMPMGMAEIGVALWSRHLKHNPTNPHWADRDRFVLSNGHGSMLLYSLLHLTGYDLPIEELKNFRQLHSKTPGHPEYGITPGVETTTGPLGQGLANAVGMALGEALMADEFNRDGAKIVDHHTYVFLGDGCLMEGISHEACSLAGTLKLNKLIALYDDNGISIDGDVVNWFHDDTPKRFEAYGWNVIPNVNGHDVDAVDAAIAKAKLSDKPTLICCKTVIGKGAATKAGGHDVHGAALGAEEIAKTRAALGWTWEPFVIPQEVYAAWDAKDAGQRAEAAWSDTFAQYRAKYPAEAAEFERRMANKLPADWAEKAAAIVAGANQRGETVATRKASQQAIEGLAAVLPELLGGSADLTGSNLTNWKASKAVRANPEGAGVVLGNHINYGVREFGMSAAINGLALHGGHKPFGGTFLTFSDYSRNALRVASLMKVPSIFVFTHDSIGLGEDGPTHQSIEHVSSLRLIPNHDVWRPADTVETAVAWTHAVAADRPSSLIFSRQNLAFNSRTDAQIANIEKGGYVLKDWDDEIVARKIILIATGSEVELAMKAVEPLAQQGIAARVVSMPSTNVFDRQDAEYRERVLPHGVRRVAIEAGVTGFWHKYVGLEGGVVGIDTFGESAPAGVLFKYFGFTVEHVIETAKAVLA

SEQ ID NO: 63356 - protein, 400 aa, Frankia sp. CcI3
MRTIDDLQVAGHRVLVRSDLNVPLDRSGDTPRITDDGRVRASVPTISALLDRGARVVVSSHLGRPKGEPDPKYSLEPVAGRLAELLGRPVAFAGDGSGDIAGAHAREVVAGLGDGEVALLENLRFAAGETSKDAAIRAAFADELSALAEFYVGDAFGAVHRAHASVADVPKRLPHAAGRLVLTELEVLRRLSSDPARPYSVVLGGSKVSDKLGVIRALLPKVDALLVGGGMCFTFLAALGHGVGGSLLETEMIETCKELLAEGGERIVLPTDVVVADRFAADADTAVVAADAIPAGWLGLDIGPASTELFAARLAGAATVFWNGPMGVFELAPFAAGTRGVAEAVAAGKGFSVVGGGDSAAAVRTLGIPEDAFSHISTGGGASLEYLEGKTLPGLAALDV

SEQ ID NO: 63357 - protein, 336 aa, Burkholderia vietnamiensis G4
MTIRVAINGYGRIGRNTLRAFYENGKKHDLEIVAINDLGDAKTNAHLTQYDTAHGKFPGEVSVDGDYLVVNGDKIRVLANRNPAELPWGELGVDVVMECTGFFTSKEKASAHLKGGAKKVIISAPGGKDVDATIVYGVNHNVLKAEHTVISNASCTTNCLAPLVKPLNDQIGLETGLMTTIHAYTNDQVLTDVYHEDLRRARSATHSQIPTKTGAASAVGLVLPELNGKLDGYAIRVPTINVSIVDLSFIAKRDTTVEEVNAIMKEASEGALKGILGYNDAPLVSIDFNHNPASSTFDATLTKVSGRLVKVSSWYDNEWGFSNRMLDTAVAFANAK

SEQ ID NO: 63358 - protein, 308 aa, Frankia sp. CcI3
MALLGRGRSERGSDRGSGKNRGSGKDEDGVGKDRSVKGAAGSKGAAGVKGTGRRTLVAGNWKMNLNHLEAIALVQKIAFDLKPAELETVEVVVLPPFTDLRSVQTLVDGDKLAIAYGGQDLSPYASGAHTGDISGAMLAKLGCDYVVVGHSERRADHHEDDALVAAKAKAAFSVGLTPILCVGEPEEIRAAGTQVEHVLRQLERSLAGITAEQAATIVIAYEPVWAIGTGRTASAQDAQDMCAAVRGQLASQYGDEIAAGIRVLYGGSVKAANAGELFTMPDVDGGLVGGASLVAEEFVGIVRSGPPA

SEQ ID NO: 63359 - protein, 736 aa, Pisum sativum
MQASGSKSSNSGRGSFSETREGLKVRTTNANAYGRAQEEVNKDEAFKVMETRPSWEVSPGQAFPLGVSQVDNGINFAIFSQHATAVTLCLVLPKRESIDTLDGGTIELALDPHLNKTGDIWHIRIEDLARSNVLYGYRIDGSQDWGKGHRFDRSIVLVDPYAKLVEGRRYFGDISKKFSKFLGTYDFDSLPFDWGENYKLPNVAEKDLVIYEMNVRAFTMDESSGLDNNIRGSYLGVIEKIPHLLELGINAVELLPIFEFDELELQRRPNPRDHMINTWGYSTINFFAPMSRYASAGGGPANASQEFKQMVKALHSASIEVILDVVYNHTNEADDPNPYTTSFRGIDNKVYYMLDDKGQLLNFSGCGNTLNCNHPVVMELILDSLRHWVTEYHVDGFRFDLASILCRGTDGSPLNAPPLIRAIAKDAVLSRCKIIAEPWDCGGLYLVGSFPNWDRWAEWNGKYRDDVRRFIKGDSGTKGSFATRVSGSSDLYRVNKRRPYHGINFVIAHDGFSLHDLVSYNLKHNEANGEGGNDGCNDNFSWNCGFEGETDDTSIRALRSRQMKNFHLALMVSQGIPMMLMGDEYGHTRYGNNNSYGHDSAINFLLWDQLDARKGDHFRFFSNVIKYRLGHKIFSHENFLSENEITWHEDNWDNYESKFLAFTLHDKSGGDVYLAFNAHDYFLKVLLPTPPTKRRWYRVVDTNLESPDDLVLDGVPGIGKTYSIAPYSSILLEAKF

SEQ ID NO: 63360 - protein, 245 aa, Zea mays
MDHHHHHHHHMIPGQEPPAADSSAPDSFFLGPAGAIIFSGGAGVSGAGSSSGAAALGSSAGAGGGPSPSSSSPSLSRYESQKRRDWNTFGQYLRNHRPPLSLSRCSGAHVLEFLKYMDQFGKTKVHTPVCPFYGHPNPPAPCPCPLRQAWGSLDALIGRLRAAYEENGGTPEMNPFGARAVRLYLREVRETQARARGISYEKKKRKKPSAASAAAAGPSSEGSPPPGPSSGGGGPDTSSPQFIMP

SEQ ID NO: 63361 - protein, 150 aa, Striga asiatica
MADLLNEEQIVEFQEAFSLFDKDGDGCITIEELATVMGSLDQNPTEKELQDMINEVDSDGNGTIEFAEFLNLMAKKMKETDAEEEIQEAFKVFDKDQNGYISANELRNVMMNLGEKLTDEEVEQMIREADLDGGGQVNYDEFFKMMRTIG

SEQ ID NO: 63362 - protein, 468 aa, Ostreococcus tauri
MRRCGATRARASRADADAAVEAFLNTLKYDDGGLVAAIAQDVDTGAILMQGYANRDAVAYTLKHRKATFWSRSRSQLWCKGETSGNYIAIDSVHVDCDKDSLIYLGVPTGPTCHTGAHTCYYKRVDGPDGAATKASGGRHAAEEALTTLYELEATIEARRVEAKKEGVKPSWTRRLLDDPELLCKKIREEAGELCQTWEENEGKEAAANEMADVLYHSMVMLNKPRPLWHRAGVDEKASRPPKKLINVSKRYDERFFLSKVGETTPSHTAARVSSERANEARDAVRSRRACATTRDGRERATRTGRDAFIPEKSNIWRDCVDGYYDWVREHIHEGAPINECDHCGDPPLVLAAGNGHTKVVELLLSEGADIQQSGMMKDCALQRAAHNGHYHTVQYLLEQGADVDALDLGDNTALHWAAMRGHVEIVNLLLQSGADKNIKNQQENLPIDLCKAVWSNSHKYVRELLAH

SEQ ID NO: 63363 - protein, 538 aa, Oryza sativa
MSPPPAAARAPPVLRNELSRRTAVLGLRLWVLVGIAVGAAFLLLLAVISFHLAQARRRKPAAKRASSAAAAAAAPGGAAVPLSPATIPPVSKEIQEVAVHVGSLRHYLEAGATFLKEGGGVGGAVVDGDSLGGSTVYGSQRVHIEAGKGRRMVAYADGEVGPVASDLAASAQAAVGVGVGPEVSHLGWGHWYTLRELEEATAAFAPEHVVGEGGYGIVYRGVLPDGCEVAVKNLLNNRGQAEREFKVEVEAIGRVRHKNLVRLLGYCAEGAHRILVYEYVDNGNLEQWLHGDVGPVSPLSWDIRMNIVLGTAKGITYLHEGLEPKVVHRDIKSSNILLDKRWNPKVSDFGLAKLLGSDSNYVTTRVMGTFGYVAPEYASTGMLNERSDVYSFGILIMEIISGRSPVDYARAPGEVNLVEWLKNMVSNRDYEAVLDPKLPEKPTSKALKKALLVALRCVDPDSQKRPKMGHVIHMLEVDDFPYREIILYVHGSSDSAGEPTGQNKNICEAGDGVGRRGQHHHSCQYAIQIARELEIGLT

SEQ ID NO: 63364 - protein, 105 aa, Glycine max
MASENVSPETVSKAVDALLQWRRSQSEIQKPKLLGEDEEFVYLILTLKKIPSKSRVNPHKIPLPHSLISPFSEQCLILDDRPNKARVTKAQAQAKIQSESIPVHK

SEQ ID NO: 63365 - protein, 286 aa, Bacillus subtilis subsp. subtilis str. 168
MANYPKELPAQTQSRQPGIESEMNPSPVYEYEDYKGADKLKGKVALITGGDSGIGRAVSVAYAKEGADIAIVYKDEHEDAEETKKRVEQEGVKCLLIAGDVGEEEFCNEAVEKTVKELGGLDILVNNAGEQHPKESIKDITSEQLHRTFKTNFYSQFYLTKKAIDYLKPGSAIINTTSINPYVGNPTLIDYTATKGAINAFTRTMAQALVKDGIRVNAVAPGPIWTPLIPATFPEETVAQFGQDTPMGRPGQPVEHVGCYVLLASDESSYMTGQTLHVNGGNFVTT

SEQ ID NO: 63366 - protein, 393 aa, Aspergillus nidulans FGSC A4
MPGPERENVNHGGKVIMPPSALDKLTRLHITYPMLFELHNGAKEKMSHAGVLEFIAEEGKIYLPYWLMQTLLLEPGDLVQIKSTDLPPGRFIKLQAQSTSFLDISDPKAVLENAFRNFSCLTKDDVFTFAYNDQVYEMAVLETKPANDTNAISVLETDLEVDFAPPVGYEEPQRPSGTSTPGSVVSGRLPAGGLLHPHGTMAQSINYAAIAPESTDAAAGARAVSSNFLSGGHRLNAKKGSKTPTPTASTPTPGATNPSHPPPVKRTNGPQPLRLPPNQLFFGYAIKPVPKRDEGGNVVEPEKPRFQGTGQSLRGKKKEAIAGRSCRFEYSPDRDFIDFQPTTSKQQLTPIAAPPITASGFQLTRWAMDTSMSLSQKLIFARLPFVRYYKKRS

SEQ ID NO: 63367 - protein, 126 aa, Xanthomonas oryzae pv. oryzae KACC10331
MRAGLNRTDQSLNTPHAAPATIVFDGVCLLCNGWVKFLLRHDRRARYRFAAMQGQAGRALLQQHGLDPDDPLSFLLVNHSGAWSDSDALVRVLAGLGGLWRFAAVCGGVVHDSAWLTRYRVSPHRA

SEQ ID NO: 63368 - protein, 722 aa, Oryza sativa
MAGRGGRCQVVPPRYPALARRRTKAALAGPPHRGSHRSEVAVLPPWVAPWWPDLETAARSGWRGGAAGMAPVERRLVGSGLLGEEEEEKGNGMAEVNPCVCSPVVRLSPASSPWVRGWRRATAATQMAVAVLDRSFSSEYPASSRTEGRSCSWKRVFVQTENGYVLGIELERGENAHTVKKKLQVALKEQDHSEPIEILGCLSPSSRMKQLAKDVVEAIRNGVDPVPVNSGMGGAYYFKNIYGERVAIVKPTDEEPFAPNNPKGFVGKTLGLPGLKRSVPVGETGLREVAAYLLDHDNFANVPPTMLVKITHSVFNVNDTVSCKSKVFHNKLQAVSKLASLQQFIAHDYDASDHGTSSFPVSAVHRIGILDIRIFNTDRHAGNLLVRKLGPGPDNFGVQTELIPIDHGLCLPESLEDPYFEWIHWPQASIPFTEEELEYIANLDPVKDAEMLRLELPFIRGACLRVLVLSTIFLKEAAAFGLCLSEIGEMMSRQFTGKEEEPSELELLCMEARKWVKKRELFLPEAGVEDDNDGITQFSIDSEDGSDASELPSFSKFGLMNASHRNPLSKLDECDEEDGEEEEDDDGDEEDDDEDMFKDDAGNLKNPFSKHIPSVSKLSASFKGLGFIGKARAYHKGVPKNKVTAKTNYSGKGSEHQSGSRSANELLPPSASFVKLSDMGSDEWSAFLDKFQELLPSAFRARKHAAADGPRPLQRLGTSCQF

SEQ ID NO: 63369 - protein, 515 aa, Oryza sativa (indica cultivar-group)
MGSTGDCGNGKAAAGGGGLVVPEIKFTKLFINGEFVDAASGKTFKTRDPRTGDVLAHIAEADKADVDLAVKAAREAFEHGKWPRMSGYERSRVMNKLADLVEQHADELAALDGADAGKLLTLGKIIDMPAAAQMMRYYAGAADKIHGESLRVAGKYQGYTLREPIGVVGVIIPWNFPTMMFFLKVSPALAAGCTIVVKPAEQTPLSALYYAHLAKLCTFDIIIQAGVPDGVINVVPGFGPTAGAALSSHMDVDSVAFTGSAEIGRAIMESAARSNLKNVSLELGGKSPMIVFDDADVDMAVSLSSLAVFFNKGEICVAGSRVYVQEGIYDEFVKKAVEAAKNWKVGDPFDAATNMGPQVDKVQFERVLKYIEIGKNEGATLLTGGKPTGDKGYYIEPTIFVDVKEEMTIAQEEIFGPVMSLMKFKTVEEAIEKANCTKYGLAAGIVTKNLNIANMVSRSVRAGTVWVNCYFAFDPDAPFGGYKMSGFGRDQGMVAMDKYLQVKTVITAVPDSPWY

SEQ ID NO: 63370 - protein, 322 aa, Nicotiana paniculata
MSTASINSCLTISPAQASLKKPIRPVAFARLSNTSSSSSSVPSLIRNEPVFAAPTPIINPILREEMAKESYEQAIAALEKLLSEKGELGPIAAARVDQITAELQSSDGSKPFDPVEHMKAGFIHFKTEKYEKNPALYGELSKGQSPKFMVFACSDSRVCPSHVLNFQPGEAFVVRNIANMVPAYDKTRYSGVGAAIEYAVLHLKVENIVVIGHSACGGIKGLMSLSADGSESTAFIEDWVKIGLPAKAKVEGEHADKCFADQCTACEKEAVNVSLGNLLTYPFVREGLVKKTLALKGGHYDFVNGGFELWGLEFGLSPSLSV

SEQ ID NO: 63371 - protein, 675 aa, Arabidopsis thaliana
MLYFIFCQNLSSSSSMSNSILFLSLFLFLPFVVDSLYFNFTSFRQGDPGDIFYHGDATPDEDGTVNFNNAEQTSQVGWITYSKKVPIWSHKTGKASDFSTSFSFKIDARNLSADGHGICFFLAPMGAQLPAYSVGGFLNLFTRKNNYSSSFPLVHVEFDTFNNPGWDPNDVGSHVGINNNSLVSSNYTSWNASSHSQDICHAKISYDSVTKNLSVTWAYELTATSDPKESSSLSYIIDLAKVLPSDVMFGFIAAAGTNTEEHRLLSWELSSSLDSDKADSRIGLVIGISASGFVFLTFMVITTVVVWSRKQRKKKERDIENMISINKDLEREAGPRKFSYKDLVSATNRFSSHRKLGEGGFGAVYEGNLKEINTMVAVKKLSGDSRQGKNEFLNEVKIISKLRHRNLVQLIGWCNEKNEFLLIYELVPNGSLNSHLFGKRPNLLSWDIRYKIGLGLASALLYLHEEWDQCVLHRDIKASNIMLDSEFNVKLGDFGLARLMNHELGSHTTGLAGTFGYMAPEYVMKGSASKESDIYSFGIVLLEIVTGRKSLERTQEDNSDTESDDEKSLVEKVWELYGKQELITSCVDDKLGEDFDKKEAECLLVLGLWCAHPDKNSRPSIKQGIQVMNFESPLPDLPLKRPVAMYYISTTTSSSSPSVNSNGVSVTFSGIEYGR

SEQ ID NO: 63372 - protein, 167 aa, Burkholderia vietnamiensis G4
MILIAMGVSGAGKSRIGEMLAERLSCSYTDGDAFHSAANKEKMHHGIPLTDDDRWPWLRAIRAAIEEKQRAGETAVFTCSSLKRSYRDVLRGTDADVRFVYLKGSFDVLRERLKTRTGHFFDPSLLKSQLETLEEPGADEAIEVSIELTPEQIVDEVMVKIGLAQQH

SEQ ID NO: 63373 - protein, 585 aa, Triticum aestivum
MCGILAVLGCADDTQGKRVRVLELSRRLKHRGPDWSGMHQVGDCYLSHQRLAIIDPASGDQPLYNEDKSIVVTVNGEIYNHEQLRAQLSSHTFRTGSDCEVIAHLYEEHGENFIDMLDGVFSFVLLDTRDNSFIAARDAIGVTPLYIGWGIDGSVWISSEMKGLNDDCEHFEIFPPGHLYSSKQGGFKRWYNPPWFSEVIPSVPYDPLALRKAFEKAVVKRLMTDVPFGVLLSGGLDSSLVAAVTVRHLAGTKAAKRWGTKLHSFCVGLEGSPDLKAAKEVANYLGTMHHEFTFTVQDGIDAIEDVIYHTETYDVTTIRASTPMFLMSRKIKSLGVKMVISGEGSDEIFGGYLYFHKAPNKEELHRETCQKIKALHQYDCLRANKATSAWGLEARVPFLDKEFINEAMSIDPEWKMIRPDLGRIEKWVLRKAFDDEEQPFLPKHILYRQKEQFSDGVGYSWIDGLKAHAESNVTDKMMSNAKFIYPHNTPTTKEAYCYRMIFERFFPQNSAILTVPGGPSVACSTAKAVEWDAQWSGNLDPSGRAALGVHLSAYEQEHLPATIMAGTSKKPRMIEVAAPGVAIES

SEQ ID NO: 63374 - protein, 407 aa, Arabidopsis thaliana
MSRTIKRALLGSFIFILASASVVVAAIVGAIEGHTTDIGFLQGSVLGVVAGVITAVQLFGPVLHSDQPLSKVALLRRVVNGKAIMGLVRPFVLKAYQWQIIALDTSYMESSNLYDFNHEKKGLSKSSIQNIPMFYNRSEHQTKSSCSICLQDWEEGEGKVGNTKKHFEEKEEDKRRSTRIICLKSNRIDSVFFFFFTYLSLSLSWSIRYSILLVGAGESEMTWSVFRSINTPTLDLSTALRSTRTPLVAAGVGCATFAGVSLFRMSSRSPPFASLSVSASSVKKEVVSTEKAPAALGPYSQAIKANNLVFLSGVLGLIPETGKFVSESVEDQTEQVLKNMGEILKASGADYSSVVKTTIMLADLADFKTVNEIYAKYFPAPSPARSTYQVAALPLNAKIEIECIATL

SEQ ID NO: 63375 - protein, 492 aa, Debaryomyces hansenii CBS767
MGKFNLYPSISNNIKRTVLNSIKPKSASRLGLFQSVQSKLQTRAFHSSRNVLINFDPYLTLGVEKSASAKDIKKAYYQLVKKYHPDVNKEKDAEKRFHKIQESYELLSDKEKRSQYDQFGAAAFDSNGNANPFAGGNPFGGSHGGNPFGGGAGGNPFGGMGFDFEDLFKQAFNGGAGGRGGGGGQFVTEHVGDNIEVLKTIGFKESIFGTKVEINYKAVDSCNTCKGSGMKKGKKKTTCSTCHGTGQSTHILGGFHMSSTCNSCHGTGVTIPSSDQCTSCKGNGVEEVPKSTSVDLPCGIADGTRLRIPGAGDAPFITKDPYNQTRNGDLIIRVHVSKDPVFTRSNNKIVVNQDIIMTTAALGGEIVVPTIDGQSIKLKLRPGVQNGKTLTIPEKGVPINRNIQNRGDMEVKINVKTLIPETPIQTALLEALADAFDDKNAKRTDAHWKLDLNEDEKDVKETFDEKDLHPSKLNRIGKFLGKFFNMKDEDKK

SEQ ID NO: 63376 - protein, 221 aa, Kluyveromyces marxianus
MTYPERKAFVSRITNETKIQIAISLHGGHISIPNSILDRPESDVAKQATGSQIIDIQTGIGFLDHMIHALAKHSGWSLIVECIGDLHIDDHHTTEDWGFGSRTGFKEALGHVRGVRRFGTGFAPLDEALSRAVVDLSNRPFAVIDLGLKREKIGDLSCEMIPHFLESFAEAARVTLHVDCLRGFNDHHRSESAFKALAVAIREAISSNGTNDVPSTKGVLM

SEQ ID NO: 63377 - protein, 357 aa, Triticum aestivum
MVAITVPISVDTIPLVKCANAAAAAVPSVDLSAPGAAAAVADACRGVGFFRATNHGVPAALAEALEERAAAFFALPHKDKLEASARPLGYGSKSIGCNGDVGWLEYILLSVGSGSVAAASLPPLLRAALEEYADAVREVGARVLELMADGLGVAEEHRGVLRRMVAPDEADELVRVNHYPPCPCPLAAGQRGVTGFGEHTDPQIISVLRSNRTGGLQIMLPDGRWVPVAPDPDSLFVNVGDSLQVLTNGRFQSVKHRVVAPAEGQQSRLSVIYFGGPAPAQRIAPLPELMREGERSLYREFTWAEYKKAAYKSRLGDHRLGPFELPAAKEPNSSDQHSSSNAVQPPARAPPHVAPVY

SEQ ID NO: 63378 - protein, 113 aa, Zea mays
MGCAGSTPKTDDNGKNLKKPKPWKHTQAITPAQLRQMRDEFWDTAPHYGGQKEIWDALRAAADSDLALAQTIVDSAGIIVSNSDMTLCYDERGAKYELPKYVLSEPTNLIRDG

SEQ ID NO: 63379 - protein, 158 aa, Triticum aestivum
MAAPLRRVFPSLGRALLSPTPARMLSAEASDALVEIKPGEIGMVSGIPEEHLRRKVLIYSPARTASQQGSGKVGRWKINFVSTQKWENPLMGWTSTGDPYANVGEAGLTFDSAESAKAFAEKHGWEYVVRKRHTPLLKPKTYAENFKWKGPPKTEEAA

SEQ ID NO: 63380 - protein, 147 aa, Nicotiana tabacum
MERVNNYKLCVALLIISMVMAMAAAQSATNVRSTYHLYNPQNINWDLRAASAFCATWDADKPLAWRQKYGWTAFCGPAGPRGQVSCGRCLRVTNTGTGTQTTVRIVDQCSNGGLDLDVNVFNQLDTNGVGYQQGHLTVNYEFVNCND

SEQ ID NO: 63381 - protein, 570 aa, Sulfitobacter sp. EE-36
MTRHLITSAIPYINGIKHLGNLVGSQLPADLYARYQRGRGQEVLFLCATDEHGTPAELAAAKAGKPVAEYCAEMHEVQARIAEGFGLSFDHFGRSSSAQNKALTQHFAAALYDQGLIEEVEQRQIYSETDGRFLPDRYVEGTCPNCGFEDARGDQCDNCTKQLDPEDLINPRSTVSGATDLEMRATKHLFLRQSQMKDKLNEWINSKADWPVLTTSIAKKWLHDGDGLQDRGITRDLDWGVPVKRGDADWPGMEGKVFYVWFDAPIEYIACAQEWVDAGKGSDWESWWRTDKGADDVRYTQFMGKDNVPFHTLSFPATIMGSQEPWKLVDYIKSFNYLNYDGGQFSTSRGRGVFMDQALEILSADYWRWWLLSHAPETSDAEFTWENFQSSVNKDLADVLGNFISRITKFCRSKFSEDVPAAGEYGPEEHALIADLTERVARYQTAMEAMEVRKSAAELRAIWAAGNEYLQAQAPWTTFKTDPDKAAAQVRLALNLIPLYAVLSAPFIPTAAASMLDSMKVENAAWPDDVPAALAQLAPGHAFEVPEVLFAKITDDQRDEWAEKFAGGRS

SEQ ID NO: 63382 - protein, 1139 aa, Sulfitobacter sp. EE-36
MARDSSPILRHQIDAGTYTDQDNVLRELVRNAHLSPEERVKITQDAAQIVRDIRGHTSPGIMEVFLAEYGLSTDEGVALMCLAEALLRVPDAETIDALIEDKIAPSDWGRHMGHSTSPLVNASTWALMLTGRVLDDDQPGPVRHLRAAIKRLGEPVIRTAVSRAMKEMGRQFVLGENINAAMERAKGMEKKGYTYSYDMLGEAARTESDAKRYHLSYSRAISAIATACVHKDSRKNPGISVKLSALHPRYEVAQEASVMRDLVPRLRALALLAKSAGMGLNVDAEEADRLGLSLDVIEKVLSEPALSGWDGFGIVVQAYGPRAGVVIDALYDMAIRHDRKLMVRLVKGAYWDTEIKRAQVKGVEGFPVFTQKAATDVSYIANARKLLNMTDRIYPQFATHNAHTVAAVLHMAEDKEKFEFQRLHGMGETLHNIVMDKHGTHCRVYAPVGAHADLLAYLVRRLLENGANSSFVNQIVDEDVAPEVVAADPFDSLAESGLHIPTGPELYAPARVNSMGFDLMHTPTLDVIESARAPWKAHRWAAVPLLNGEAKPKKSARLMNPAASGRSPGTVRNASEADVAKALDNAAVWDAPLEERREVLLRAADMLESHYGEIFALLSREAGKGLPDCVAELREAVDFLRYYAQQATNTPPAGIFTCISPWNFPLAIFCGQVSAALAAGNAVLAKPAEQTPLIAFLAVTLLHDAGVPRHALQLLPGGGEVGAALTSDKRINGVAFTGSTATALRIRSAMAEHCDPGAILIAETGGLNAMIVDSTALPEQAVQSVVESAFQSAGQRCSALRCLYIQEDIAEDVIEMLEGAMDALVMGNPWDISTDVGPVIDETAQKGIAEHIETARAEGRIIAELTAPTIGTFIAPTMIRVNGIADLEREIFGPVLHIATFKATELDKVIDAINATGYGLTFGLHTRIDDRVQHVSERIEAGNIYVNRNQIGAIVGSQPFGGEGLSGTGPKAGGPNYLPRFSAPDLKVVEDTWDSTQKDLPKLPGHSGAFLETITLPGPTGESNRLSTLPRPALLCMGPGKDTAAEQARAVTALGGNAVELSGSIDATALTDGPAYGGVLWWGDEATARKLEQALSERDGPIIPLLRGLPDTARVRAERHVCVDTTASGGNAQLLGAAG

SEQ ID NO: 63383 - protein, 575 aa, Arabidopsis thaliana
MATSSAWKLDDHPKLPKGKTIAVIVLDGWGESAPDQYNCIHNAPTPAMDSLKHGAPDTWTLIKAHGTAVGLPSEDDMGNSEVGHNALGAGRIFAQGAKLCDQALASGKIFEGEGFKYVSESFETNTLHLVGLLSDGGVHSRLDQLQLLIKGSAERGAKRIRVHILTDGRDVLDGSSVGFVETLEADLVALRENGVDAQIASGGGRMYVTLDRYENDWEVVKRGWDAQVLGEAPHKFKNAVEAVKTLRKEPGANDQYLPPFVIVDESGKAVGPIVDGDAVVTFNFRADRMVMHAKALEYEDFDKFDRVRYPKIRYAGMLQYDGELKLPSRYLVSPPEIDRTSGEYLTHNGVSTFACSSSCLLIIGLYYALHFCQYETVKFGHVTFFWNGNRSGYFNEKLEEYVEIPSDSGISFNVQPKMKALEIGEKARDAILSGKFDQVRVNIPNGDMVGHTGDIEATVVACEAADLAVKMIFDAIEQVKGIYVVTADHGNAEDMVKRDKSGKPALDKEGKLQILTSHTLKPVPIAIGGPGLAQGVRFRKDLETPGLANVAATVMNLHGFVAPSDYEPTLIEVVE

SEQ ID NO: 63384 - protein, 428 aa, Burkholderia vietnamiensis G4
MSSQLQSIPSYLHADDLGPWGNYLQQVDRVAPYLGSLSRWLETLKRPKRILIVDVPIELDNGTVAHFEGYRVQHNVSRGPGKGGVRYHQDVTLSEVMALSAWMSVKNAAVNVPYGGAKGGIRVDPRKLSRGELERVTRRYTSEIGIIIGPNTDIPAPDVNTNEQVMAWMMDTYSMNQGQTSTGVVTGKPISLGGSLGRKEATGRGVFVVGCEAAKKKGLEIEGARIAVQGFGNVGGIAAKLFQEAGAKVIAVQDHTGTIYQPAGLDANKLLDHVARTGGVAGFEGTEPMPNDEFWTVETDILIPAALENQITEKNASKIRTKIIVEGANGPTTTAADDILSANGVLVIPDVIANAGGVTVSYFEWVQDFSSFFWTEDEINHRLERVMREAFAGVWAVAEEHNVSVRTAAFIVACKRILMAREMRGLYP

SEQ ID NO: 63385 - protein, 157 aa, Striga asiatica
MPGIVFGRVDDSFSLASVKAYIAEFISTLLFVFAGVGSAIAFNKLTSDGDLNPPGLVAIAVCHAFALFVAVSVGANISGGHVNPAVTFGLAVGGQITILTGIFYWIAQLLGAVVGSFLLKFVAGGLAIPTHAVGAGVGAVEGVVMEIIITFALVYSV

SEQ ID NO: 63386 - protein, 2143 aa, Colletotrichum lagenarium
MSIVYNSIVFCLPSSSTFSTFSVVTTSPTFASAPRGALSPASTTSNVSPFRDHRLSDFANYRRDLAVLETSSGRLPTIQQQPPTATPSSTSQVAPWMSPSNGGATAHAHPHAHPHTSQSQLHTTFFNDSSDNLSVSSQLSPGFRPPTNRIAPQSSGSQDSPDGAYFGDERRPSLASITTLSSQGSKASMRRGGLQKLQGFFGEEFPGRDGSESSLHSSSGKDRSRSYSHSRPTRDRNYSNATDHARDREGSPSSSRPRTPVPAPEVVPFLYQEADDIARYGEAPVRDILSGPDRERYMNNENPNNPQNPPKTSSSGRSGHSIVHLPGHHHRHNKSIDDGKALRPTVSREDSQASLQVQQHPRERGGSAATVMYGSNRSRAQSPTPSGGYFSSKHNPSVDGSTSPGGQSHHHSHTKRGILHRFKRNRDKDDAASKLREMPGSTRSLASKPSHSNFARPEPAPNTFPLNYADTEPRSNQDPRLAAYNQRSHQPFNNKFPFSSKGKARHQQRTDVPEEHIGPTDRQGGNVFVLDTNLNDMEGILTKPQPLTPMDSAFIASVEPDKDAPPVPAKPDAQNGINGNGAWNAPDSWAVRRGTEDTTYQAPDMDDVGSPPRPEEKNLAYCIRIFKSDGTFATVSMLLDSTVTDVVSQLVKKSYTGDGMENYHIILKKHSLVRVLAAPERPLLIQKKLLEQLGYDKRDKIEDIGREDNSYICRFMFLSSRESDFHSVTNDLGLGRIQKFNHVDLSGRNLITIPISLYSKAAEIITLNLSRNLSLDLPRDFIQSCQNLRDIKFNNNEARRLPPSLGNAAKLTYLDVSNNRLEQLEHAELHGLQGILKLNVANNLLKTLPQYFGAYKALRNLNISSNFLDHFPLFLCDVGSLVDLDISFNNIKSLPDEIGKLQNLEKFVITNNSLNNSLPDTIRGLSGLRELDIKYNCISNIDSISRLPKLETLSAEHNSISQFVGTFDCVRNLKLNSNPITKFELSAPVPSLKMLNLSACQLASIGETFNNMLNLERLVLDKNYFVSLPAQIGNLSKLEHFSIANNNVAELPTSIGCLTELRVLDVRRNNIRKLPMELWWANKLETLNASSNILENFPKPASRQPRPAGEEVQTPGAVNKANPMNVLPQAMDDGLDSRRPSQNSSSTLLSVGPSPAPGADRKGSVVSVYGKGGRKTSVVSRSTSQGTVATMTPPSTRKDSTLSSRLNTTFAGSLRNLYLAENKLDDEVFDQITMLNELRVLNLSWNYINDMPQRSIKSWPQMVELYLSGNELTTLPADDLEDASLLQVLHINGNKFTNLPADISRAKKLAVLDCGSNSLKYNISNVPYDWNWNLNPNLRYLNLSGNKRLEIKQTSTGPATSNREAYHEFNRLSNLRVLGLMDVTLISPTIPDQSEDRRVRTSGSLAGHLPYGMADTMGKNEHLSTIDLVVPRFNSSDTETLLGLFDGQALSSGGSKVAKYLHENFGFHLAQELKALKTRDNETPADALRRAFLSLNKDLVTVAVQHTTDDRSERSAQKTHRLPSVASPVILSREDLNSGGVATVVYLSHTELYVANVGDAQAIIIATDGTHKVLTKKHDPAEPSERLRIRDAGGWVSRNGRLNDLLEVSRAFGYVDLMPAVQAAPNVSHRTINEHDDIIIIATKEFWEYLDPALVVDFARQERTDLMRASQKLRDLAIAYGATNKIMVMMISVADLKRRVERSRLHRGQSMSLYPSGVPDDLQQLPRRGKRNKGDVDVLDSNLQRLEAEIPAPTGNVSIAFTDIKNSTTLWEMYPAAMRSAIKLHNEVMRRQLRRIGGYEVKTEGDAFMVSFPTATSALLWCFAVQTSLLEVNWPAEVLNSVSCQPVFDKDNALIFKGLSVRMGIHYGEAVSEMDPVTRRMDYFGPMVNKASRISSVADGGQITVSSDFISEIQRCLETYQDTDRSGSTGSEDTFDDDEGFAFTIRKDLRSLSSQGFEVKEMGEKKLKGLENPEVVYSLYPHSLAGRIEAHQQPEARIEVDKPAMLQAGSELAFDTESIWALWRVSLRLEMLCSSLENVSGRGLQPPETELLERMKHRGGEVTERFLLNFMEHQVSRIETCVTTLSLRHIVMGKPPLNQLDDLRMPITSILDQVGEQMAELARYKALYGELSESDQGSDTVQE

SEQ ID NO: 63387 - protein, 464 aa, Edwardsiella tarda
  misc_feature (186)..(186): Xaa can be any naturally occurring amino acid
MKKGTDTRGGYLDSRFGSEAIRTAAEAHHFPQGEMREDIAFQVINDELFLDGNARQNLATFCQTWDDDYVHRLMDISINKNWIDKEEYPQSAAIDLRCVNMVADLWHAPRPADGQAVGTNTIGSSEACMLGGMAMKWRWRAKRLAQGKSVDKPNMVCGPVQVCWHKFARYWDVELREIPMAPGKLXMDPERMIAACDENTIGVVPTFGVTYTGNYEMPDVLHKALDDLQARTGLDIDMHVDAASGGFLAPFCAPDIVWDFRLPRVKSISASGHKFGLAPLGCGWVVWRDAASLPDDLIFKVDYLGGQVGTFAINFSRPAGRVIAQYYEFLRLGREGYTKVHTASYQVAQFLAAEIAKLGPYEFICSGDPQQGIPAVCFRIPAGKALGYSLYDLSERLRLRGWQVPAFALNGEMSDVVVMRIMCRRGFEMDFAQLLMEDFRAALAYLKAHPAVANVAHQNSFKHS

SEQ ID NO: 63388 - protein, 427 aa, Photorhabdus luminescens subsp. laumondii TTO1
MSQSDILYSQAKQLIPGGVNSPVRAFNGVGGTPLFIKHADGAYLYDVDGKAYIDYVGSWGPMVLGHNHSAIRNAVIKAAEQGLSFGAPTAAEVEMAQLVTELVPSMDMVRMVNSGTEATMSAIRLARGYTHRDKIIKFEGCYHGHADCLLVKAGSGALTIGQPNSPGVPVDFVKHTLTCTYNDLSSVREAFEQYPQEIACIIVEPVAGNMNCVPPQPEFLPGLRALCDEFGALLIIDEVMTGFRVALSGAQSYYDVEPDITCLGKIIGGGMPVGAFGGRYEVMEKLAPIGPVYQAGTLSGNPIAMAAGLACLKEVSQPGVHQRLTELTDNLAAGLTKSAKAANIPLVVNHVGGMFGIFFTDAETVTCYQDVMNCDIERFKHFFHLMLDEGVYLAPSAFEAGFMSIAHTDEDIQRTVNAAARCFAKLK

SEQ ID NO: 63389 - protein, 223 aa, Torulaspora delbrueckii
MSERKAFVSRITNETKIQIAISLNGGHIEIKDSILCKKQQENGSDVAAQTTKSQVIDIQTGVGFLDHMIHALAKHSGWSLIVECIGDLHIDDHHTTEDCGIALGQAFKEALGQVRGVKRFGTGFAPLDEALSRAVVDLSNRPYAVIDLGLKREKIGDLSTEMIPHFLESFAEAARLTIHVDCLRGFNDHHRSESAFKALAVAIRESLAPNGTNDVPSTKGVLM

SEQ ID NO: 63390 - protein, 302 aa, Daucus carota
MDNSCATLQEGCLVVQQQNTTAAATMATVDHSSSSTKAPVTRNSRWSLAGMTALVTGGTRGIGHAIVEELAELGACVYTCSRNEQELNERLEEWRAKGFDVTGSVCDVSSVTEREQLFQRISSCFGGKLHILINNVGTNIRRATENYTAEQYSIVMATNLEAPYHACQLAYPLLKASGSGCIVFNSSVAGLVHLGTPGSVYGAAKGAINQLTKNLACEWAKDNIRTNCVAPGYIKTPPVEKLFERKNFLDRLVSRTPLRRPGETEEVSSLVAYLCMPAASYITGQIIAIDGGLTVNCFERVV

SEQ ID NO: 63391 - protein, 307 aa, Lactobacillus acidophilus NCFM
MKKIVVIGSSNVDTTLHVKDFPKPGETINATEITTAAGGKGANQAIAAAKSGAETYFINRVGEDSEGGYITHQLKSYGVDTTYVQTTMGVKTGHAYITLNEAGQNNIVIDHGANYELTVEDIKAAGDLIKSWDCIIAQFETPIEVTTAAFKMAKKAGKITILNPAPAVEEIPEELLKYTDIITPNETESAKITGIQIKDKSSLAANAEKLHLLGVKNVVITYGDKGSYISTKDIETLIPAYKVEATDTTGAGDTFIGYLASNLNEDLSNFEDAAKIASRASSIAVQRLGAQPSIPTAQEVEQAMEDE

SEQ ID NO: 63392 - protein, 230 aa, Lactobacillus acidophilus NCFM
MDKKEQDRLKKEAAEKAANMVQSGMILGVGTGSTVAFFIDALGKRKDEEDLKLKAIVTTSNRSKKQLESLGFEVSELADIDQADLTVDGSDRVADNLDGIKGGGGALTLEKNVAINSKKIVWIVDESKLVHRLSGFPLPVEVLPISCEQNFRRFEQEGLKPQWRTDGDKRYITHYGNYIIDLAVDPIPAPHGLADYLDHTVGVVEHGLFLDMCDEVIIAHSDGTIEDKIK

SEQ ID NO: 63393 - protein, 168 aa, Oryza sativa (japonica cultivar-group)
MARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIRGLHPCLEQKMSLATCLISLAPNCSLLRFTSNFCKDA

SEQ ID NO: 63394 - protein, 116 aa, Haemophilus influenzae Rd KW20
MAEETIFSKIIRKEIPANIVYQDELVTAFRDISPQAKTHILIIPNKVIPTVNDVTEQDEVALGRLFSVAAKLAKEEGVAEDGYRLIVNCNKHGGQEVFHLHMHLVGGEPLGRMLAK

SEQ ID NO: 63395 - protein, 194 aa, Brassica napus
  misc_feature (167)..(167): Xaa can be any naturally occurring amino acid
MSYSAAGQGKNSSGKRRISDLLTQSDNRVCADCSAPDPKWASANIGVFICLKCCGVHRSLGTHISKVLSVTLDEWSDDEVDSMIEIGGNASANSVYEAFIPDGVSKPGPDASLDQRMQFIRSKYEHQEFLKPSLRITSVKGSNSSSSQQPHLEGMVEFIGLLKVTLXKGTNLAVRDMRTSDSYVVLTLGQQTAK

SEQ ID NO: 63396 - protein, 227 aa, Oryza sativa
  misc_feature (77)..(77): Xaa can be any naturally occurring amino acid
MDATLLRSADAAVAVRSTTTAPPPRPRLHRPSTLPLPSSCACGPLRAYAAPAAPAPAAHNNGVYTVGDFMTKRPNLXVVTPATSVDEALETLVQHKISGFPVVDDTGKLVGVVSDYDLLALDSISGSGLTGTNTSMFPGVDSTWKTFREIQRLLSKTNGKVIADVMTYSPLAVRESTNLDAATRLLLETKYRRLPVVDSTGKLVGMITRGTVVRAALKIKKTAEETA

SEQ ID NO: 63397 - protein, 412 aa, Frankia sp. CcI3
MPSPRVLGLVLAGGAGRRLAPLTADRAKPAVPFGGLYRLIDFVLSNLVNAGYLRIAVLTQYKSHSLDRHITTTWRMSNLLGNYVTPVPAQQRLGPRWFAGSADAIHQSLNLVYDDAPDIVVVFGADHVYRMDPRQMVAQHLDSGAGVTVAGLRVPRSEGRAFGVIQTAPDGRTIEAFLEKPADPPGLPGSPEETFASMGNYVFSTDVLIDALRKDAADEDSVHDMGGNIIPMLVAQRAAAVYDFAGNVVPGTTVRDRGYWRDVGTVDSYFEAQMDLCALDPVFNLYNREWPILTSIPSLPPAKFVHDGLQRTGTAVNSIVSNGVIISGGTVRSSVLSPGVRVSSWAEVDHTVLMDNVLVGRGAVVRDAILDKNVHVPAGAQVGVDKDRDRARGYTVSEQGITVVGKGVTIAD

SEQ ID NO: 63398 - protein, 419 aa, Oceanobacter sp. RED65
MSDFKQDALDYHANPKPGKISVELTTAADSARDLSLAYSPGVAEPVKAIAEDPENAYKYTAKGNLVAVITDGSAILGLGNLGPLASKPVMEGKSLLFKRFAGIDSIDVEVESESPQAFIDTVRRIANTYGGINLEDIKAPECFEIERTLIEQCNIPVFHDDQHGTAIVTVAGMLNALEIQGKKVDEAKMVVLGAGAAAISCAKLLILAGMKPENIFMCDRKGVIHSGRDDLNQYKAMFAVDTDKRTFEEALEGADIFLGLSGPDMVTGEQIKTMAENPVVFACANPVPEIMPEIVAEVRPDAIMATGRSDFPNQVNNVLGFPFIFRGALDVRSRAINEEMKLAAAKALADLAREPVTQEVLDAYELDSLEFGKDYIIPKAVDSRLLGAVSTAVAQAAIDTGVADGPLPANYPLKSISDI

SEQ ID NO: 63399 - protein, 443 aa, Oryza sativa
MATRPLAASTLLPPLRFCSPLKTPPPSPPPPHLRRLQTLTRALASSSSAMASPPAKKVLVPIASGTEPMEAVITVDVLRRAGADVSVASVDPGSAQVGGAWGVKLAADALLDDLADAEFDLISLPGGMPGSSNLRDCKLLENMVKKHAGKGKLYAAICAAPAVALGSWGLLNGLKATCYPSFMDKLPSEVNAVESRVQIDGNCVTSRGPGTAMEYSVVLVEQLYGKEKADEVAGPMVMRPQHGVEFSLKELNSTSWNVGETPQILVPIANGTEEMEATMIIDILRRAKANVVVASLEETLEIVASRKVKMVADVLLDDALKQQYDLILLPGGLGGAQAYAKSDKLIGLIKKQAEANKLYGAICASPAIALEPHGLLKGKKATSFPGMWNKLSDQSECKNRVVVDGNLITSQGPGTSMEFSLAIVEKLFGRERAVELAKTMVFM

SEQ ID NO: 63400 - protein, 415 aa, Saccharomyces cerevisiae
SLSSKLSVQDLDLKDKRVFIRVDFNVPLDGKKITSNQRIVAALPTIKYVLEHHPRYVVLASHLGQPNGERNEKYSLAPVAKELQSLLGKDVTFLNDCVGPEVEAAVKASAPGSVILLENLRYHIEEEGSRKVDGQKVKASKEDVQKFRHELSSLADVYINDAFGTAHRAHSSMVGFDLPQRAAGFLLEKELKYFGKALENPTRPFLAILGGAKVADKIQLIDNLLDKVDSIIIGGGMAFTFKKVLENTEIGDSIFDKAGAEIVPKLMEKAKAKGVEVVLPVDFIIADAFSADANTKTVTDKEGIPAGWQGLDNGPESRKLFAATVAKAKTIVWNGPPGVFEFEKFAAGTKALLDEVVKSSAAGNTVIIGGGDTATVAKKYGVTDKISHVSTGGGASLELLEGKELPGVAFLSEKK

SEQ ID NO: 63401 - protein, 464 aa, Escherichia coli O157:H7 EDL933
MVRSQLSRADAPCLLTSLRRQLMAMFGLPHWQLKSTSTESGVVAPDERLPFAQTAVMGVQHAVAMFGATVLMPILMGLDPNLSILMSGIGTLLFFFITGGRVPSYLGSSAAFVGVVIAATGFNGQGINPNISIALGGIIACGLVYTVIGLVVMKIGTRWIERLMPPVVTGAVVMAIGLNLAPIAVKSVSASGFDSWMAVMTVLCIGLVAVFTRGMIQRLLILVGLIVACLLYGVMTNVLGLGKAVDFTLVSHAAWFGLPHFSTPAFNGQAMMLIAPVAVILVAENLGHLKAVAGMTGRNMDPYMGRAFVGDGLATMLSGSVGSSGVTTYAENIGVMAVTKVYSTLVFVAAAVIAMLLGFSPKFGALIHTIPAAVIGGASIVVFGLIAVAGARIWVQNRVDLSQNGNLIMVAVTLVLGAGDFALTLGGFTLGGIGTATFGAILLNALLSRRLVDVPPPEVVHQEP

SEQ ID NO: 63402 - protein, 222 aa, Zea mays
RKNEIKFPQHELIKARVSFLSSFGSVTAVDSGKKAMEHLRLMEQGGQLDSCAADANRITIDIVLTDYCMPEMTGYDLLKAIKALSSPNPIPVVVMSSENEPQRISRCLTAGAEDFILKPLKTKDVQRLRNCSSAARPRDDAAHQCESLRRSSRKLRSDQVAAPGHRSQPTTGLTMVLHASSIELSHYFQFLLKFVLLAYAVLCLTELLHRWSNGSVLSLWSA

SEQ ID NO: 63403 - protein, 483 aa, Zea mays
MAGPMEREGRDAAEKPLLVRVGGSGGSQGGSASSSSVAVVVGCTAIAVAGSFEFGMSIGYSSPTQLGIMRDLRLSLAEYSVFGSILTIGAMLGAIVSGSVADRAGRRGAMAISDVLCALGYLLIGFSQSYWWLDIGRVLIGCGIGILSYVVPVYISEITPKDLRGGFATVNQFMICCGGSLAFVLGTFIAWRTLAIVGVVPCLVQLVGLLLIPESPRWLARFGHPGAFTGALQTLRGHGTDISEEASEIKVFTEKLQRLPKSKMLDLFQKEYIRAVIAGVGLMALQQLGGVNGVLFYASEVFVSAGFSSGNTGTVAMAVVQVPMVGLGVLLMDKAGRRPLLMISAAGTCVGCLLVGLSFLSKEQHWERDLNVLALAGLLVFIGSFSLGMGGIPWVIMSEIFPINMKGSAGSLVTLVSWLGSWIVSYAFNFLLIWSSYGTFFIFAAICGLTVVFVHRLVPETKGRTLEEIQASMNSSLTPFHKY

SEQ ID NO: 63404 - protein, 175 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWNLPMFGCTDATQVINEVEEVKKEYPDAYVRIIGFDNMRQVQCVSFIAFKPPGCEESGKA

SEQ ID NO: 63405 - protein, 128 aa, Escherichia coli O157:H7 EDL933
MPKSVIIPAGSSAPLAPFVPGTLADGVVYVSGTLAFDQHNNVLFADDPKAQTRHVLETIRKVIETAGGTMADVTFNSIFITDWKNYAAINETYAEFFPGDKPARFCIQCGLVKPDALVEIATIAHIAK

SEQ ID NO: 63406 - protein, 200 aa, Brassica napus
  misc_feature (156)..(156): Xaa can be any naturally occurring amino acid
  misc_feature (176)..(176): Xaa can be any naturally occurring amino acid
FISGKIPKEISSLKSLRSLVLANNEFNGSVPDLRGLSNLQELNLDGNKLGPDVVTSLASNLITVSLKNNSFGSKLPEQIKKLNKLQSLDLSSNKCVGSIPRFLFSLPSLQNLTLAQNLFSGSLPNSSLCSSKLRLLDVSRNLLTGKLPSCLSSKTXTIIKQWSTHFNCLSVNGSPXSAKYQRPVSFCENEAKQAVSAVKS

SEQ ID NO: 63407 - protein, 218 aa, Medicago truncatula
MSTSEDQRQVKQKQPKDGERILAPTRRPDGTLRKPVRIRAGYTPQDEVAIYQPKPALMRKEMASHIGPPGYDPQLDSKPKTKAVKRNERKKEKKRLQAKETNLEPTVVEDSRKQENVIVENSVHSLTSQINELAVSGDTSIVTPTTNSVEASEPIGSAQDLDKRIRALKKKIRLTEALQEKTAEQDLKPEQLEKLAKLEDWRKELKQLEDKKAEISAA

SEQ ID NO: 63408 - protein, 498 aa, Wolinella succinogenes DSM 1740
MLKCPHQFTFSIRQSSSHSRRKDMADQSKVKEFFRFCQENEVEFVDFRFTDIKGVWHHVSYSMASIDEESFNGLPFDGSSIPAWQPINRSDMQLIPDPVSYFLDPFTADTTVVVFCDVWDIYKNQPYEKCPRSIAKKALKYLESTGLGDVAYFGPENEFFVFDSIKIQDSINCQSYEVDVEEGTWNSNRAYENGYNLGHRPGTKGGYFPVAPVDSMVDIRAEMVKVLNQVGLETFVVHHEVAQGQGEIGVRFGDLIKAADNVQKLKYVVKMVAHMNGKTATFMPKPLYGDNGSGMHTHISIWNKGENTFAGDAYQGLSETALHFVGGVLNHAKSAAAFTNASTNSYKRLIPGFEAPSILTYSAQNRSASVRIPYVQGAKAKRVEFRFPDSSANPYLAFSALLMAGIDGIQTKANPGEPMEMDLFELSLDEIREKGIKQMPHTLRSAVENMLADKDYLKKGDVFSEDFLQTYKAYKFETEIWPWEARPHPFEFISTYSC

SEQ ID NO: 63409 - protein, 449 aa, Alkalilimnicola ehrlichei MLHE-1
MAARLDEKLEPIFQDVLRRNPGESEFHQAVHEVLETLGPVLVKYPELAERKIIQRICEPERQIIFRVPWQDDRGETHINRAFRVEFNSALGPYKGGMRFHPSVYLGIIKFLGFEQIFKNALTGLPIGGGKGGSDFDPKGKSEDEIMRFCQSLMTELYRHLGEYTDVPAGDIGVGQREVGFLFGQYKRITNRYESGVFTGKGLSWGGSRARKEATGFGTVYFLEEMLKARNDGLEGKTCVVSGSGNVAVYAMEKIYELGGKVIACSDSSGIVVDEKGIDLDRVKRIKEVERRRISTYADEVKHAKYIEDGNIWAVPCEAALPCATQNELNGKDAKKLLQNGCIAVAEGANMPSTPEAIRLFLESGIAYGPGKAANAGGVATSALEMQQNASRDSWTFEHTEQRLHEIMKNIHRNCYETADEFGAPGNYVTGANIAGFLKVSQAMEAMGLI

SEQ ID NO: 63410 - protein, 398 aa, Trichodesmium erythraeum IMS101
MTKKTVASLSKSDLSGKKVLMRADFNVPVDNGSITDDTRIRAALPTIQDLTEKGAKVILTSHFGRPKGKVNEKMRLTLVGERLSEVLGKEVKKCDDCIGDEVTSTVAEMKDGDVVLLENVRFYSGEEGNDPEFAKQLASVADLYVNDAFGTAHRAHASTEGVTKYLSPSVAGYLIEQELKFLQGAIDSPQKPLAAIIGGSKVSSKIGVIEALLDKCDKLLLGGGMIFTFYKARGLSVGKSLVEEDKIELAKSLEAKAKEKGVTMLLPTDVVVADKFDPEANTQTVSIEAIPDGWMGLDIGPESAKVFQDALADCKTVIWNGPMGVFEMEKFAKGTEAIAQTLADKQDAITIIGGGDSVAAVEQLGLGEKMSHISTGGGASLELLEGKKLPGIVALDDQ

SEQ ID NO: 63411 - protein, 130 aa, Brassica napus
HASDHDRIQALAEGRQWRDPAVVKEVVPPLQGSNGGWDDWDNDDAFRSPRRNQSASDFRGYGGGGGGGGGAPAKSKSSEDIYSRTQLEASAANKESFFAKRMAENESKPEGLPPSRGGKYVGFGSSPGPA

SEQ ID NO: 63412 - protein, 107 aa, Haemophilus influenzae Rd KW20
METLDKIKKQISENPILIYMKGSPKLPSCGFPARASEALMHCKVPFGYVDILQHPDIRAELPTYANWPTFPQLWVEGELIGGCDIILEMYQAGELQTLLAEVAAKHA

SEQ ID NO: 63413 - protein, 306 aa, Oryza sativa (japonica cultivar-group)
MTSGGDSFVRMMSEDTDVEVLMPNEDLRTSTNGAKGSAKRSSNYTHKEDIQLCISWQSISSDPIIGNEQPGKAYWQRIAEHYHANRDFESDRNANSLEHHWGNIQKEVLEAEALYSSTAPKNRAFQFNHCWLKLRNSPKFQTLESHKRPRSRKSSTPIERAGEEDEGDDASKSTAPDLSQPSAKKRPIGRKQAKEKLKNGGQDGPYKEAMKDLLDAKEKEAKLKEERWKETKEIQERKLLFAERKLVWDQEQKIMFCDVSTLEPDVRTYVLAMRAQIAASKVAALNGGFDGSSGFGGEFGGGNGEV

SEQ ID NO: 63414 - protein, 487 aa, Oryza sativa (japonica cultivar-group)
MAKFTLDDADDDPPVATARDKRKRDDGPADAEDEPPRARGSAVAGREPAAPGAEAEAAGRRGPAEEMANGEVEGGLSVQIDPDVLDCSICFESLRPPLYQCQNGHVACFSCWSKLSNKCHICSRDAKFARNIALEKIVESIKSSCSYAKWGCCKFINYAQRDAHEEACLFAPSVCPISNCGYRGFTGRWSGHFLTSHSSDVMRFIYGQPFEVNIEVSVPFLVFLGEDDHLFLLQNNNLTPFGHAFSVVCLRSGNLNWMFSYQIEATSRKKPENRLQLKASVTNTRQWTGIYPSEAFLLVPFDFCHSSNIVLNISIERYAVVRVDASRRLQRRADGRRAQRRVASAAGARRGVVGPGQAADGAGARRGVVGPGQAPGHSLPPRLLRRRARLAAAAAPPPCLTLASPLPPPFRLPHRRLASSAADLVSSAVIAVVIPELRRARWGRRDGRRAPRTLKMTTASSGAVAAMAAATAMSTRAPTSRRPEREG

SEQ ID NO: 63415 - protein, 347 aa, Cyanophora paradoxa
MAFVNTVPVFASSSKVAVDAQTCFLNTKNSRKVGSFKAASTKFEAAAAPAVFSVSASAERVAEKATTFGRALAAFVAAAGISFAGVSQANAEGLTFDQLNSANYLKLKGTGISNTCPTLGASARGNISLEKGKEYYLTDLCIQPTEILVKAESLQKGKGEEFQPTRLVTRATYTIDKVEGPIFVDSDNQVTFVEKDGFDYQALTVKLPGGELVPMLFTVKELIAKAPVSDGGISPATNLKGSFAVPSYRMGNFLDPKGRGLATGYDFAHALPAADQEELAKENDKQNITREGQISLQVVRVDGATGEIAGVWESSQPGDDDLGSKNPKPVKLSGVWYARVNDSNPAL

SEQ ID NO: 63416 - protein, 201 aa, Silicibacter sp. TM1040
MIEALQDLGHQIEAKRPECVLSWDIAHGELNIDVKPANIAGLVEFLRVDSACRFSTLVDITAVDYPERTKRFDVVYHLLSMYQNQRIRLRAAVREEDMVPSIVDVHPSANWFEREVFDMFGILFTGHPDLRRLLTDYGFRGHPLRKDFPTTGYTEVRYDEAQKRVVYEPVKLVQEYRQFDFMSPWEGAEYILPGDEKEIAK

SEQ ID NO: 63417 - protein, 403 aa, Silicibacter sp. TM1040
MDGSKFDDAQTGEQKIRNFNINFGPQHPAAHGVLRLVLELDGEIVERCDPHIGLLHRGTEKLMESRTYLQNLPYFDRLDYVAPMNQEHAWCLAIEKLTGVEVPRRAQLIRVLYSEIGRILNHLLNITTQAMDVGALTPPLWGFEEREKLMIFYERACGARLHAAYFRPGGVHQDLPDELLDDIDLWAMEFPKVMDDIDGLLTENRIFKQRNCDIGVVTEDDIQKYGFSGVMVRGSGLAWDLRRAQPYECYDEFDFQIPVGKNGDCYDRYLVRMEEMRQSLSIIRQAIAKLREATGDVLARGKLTPPKRGDMKTSMESLIHHFKLYTEGFHVPEGEVYAAVEAPKGEFGVYLVADGSNKPYRAKLRAPGFLHLQAMDYVAKGHQLADVAAIIGTMDIVFGEIDR

SEQ ID NO: 63418 - protein, 513 aa, Medicago truncatula
MLFASSSLLLLSLLFSFLFTSFASIHIYDREPFRDVGNAFLLSGGSEGIASSISTASHTDSIHDGHSYIRFENITIRRRKSAARARGTVPMHIIIFEAADRDDIGGSVYGGQRAICCTSDLAKMGACKQGEVIRRPSATDTNWPVIIDLYFKGKSRIISLDSKEVSITKTGMYNLFFVACDPKLKDIVMSGKTIWKNPDGFLPGRMAPLKKFYVFMALAYVCLGIVWLLQYVRFWDDVLLLQHCISAVIVLGLFEMILWYFEYAHFNNTGIRPIILTTWVVTVGAIRKTIARLLILSVSMGYGVVRPTLGGLTSKVLLLGVTYFLASELLNITEYVGTINDVSGRARLILVLPDAFLDAFLILWIFTSLSKTLEQLQAKRSSVKLDIYRKFSNALLVTVTSSVVWIGYEVYFKATDPFNERWQSAWIITAFWDILAFALLCVICYLWAPSQSSQRYAYSEKVGEESDDEEAMSLTKGKQEGQGEISLVRQEKNGQTDASSDDEDDESEEDKRE

SEQ ID NO: 63419 - protein, 130 aa, Mycoplasma mycoides subsp. mycoides SC str. PG1
MSSKATKTVKSKFDIINNQLRDDLIDFRSGDTIRVDVKIKEGYKFRIQSFEGLVIKTQGSGITYSVVVRKMSNGVFVERTFPLHSPIIDSVTLIKRGKVRRSRIYYIRKLSGKAARIKEIMPTKQAKEIK

SEQ ID NO: 63420 - protein, 447 aa, Eremothecium gossypii
MASQEEFYRTQIFGTVFEITNRYADLNPVGMGAFGLVCSAVDTYTQQPVAIKKIMKPFSTAVLAKRTYRELKLLKHLRHENLICLEDIFLSPLEDIYFVTELQGTDLHRLLQTRPLEKQFLQYFLYQILRGLKYVHSAGVIHRDLKPSNILINENCDLKICDFGLARIQDPQMTGYVSTRYYRAPEIMLTWQKYNVEVDIWSAGCIFAEMIEGKPLFPGKDHVHQFSIITDLLGSPPKDVIDTICSENTLKFVTSLPHRDPVPFTERFKNLKPDAVDLLEKMLVFDPKKRITAGDALTHPYLAPYHDPTDEPVADAKFDWNFNDADLPVDTWRVMMYSEILDFHQVPDSQINPNDTFDDQVAAATAAAEAARQQQQQKQQQQKQQQQRHQGVEHGAQHVQLQHGAKQLSADPLVGDSNGGIPLNVSAANETLNNFANQAAQYATDFE

SEQ ID NO: 63421 - protein, 133 aa, Pennisetum glaucum
MEHQGQHGHATNQANEYGTPVTAGVGAAGEQQVQPMRDDHKTDGLLRRSGSSSSSSSEDDGMGGRRKKGIKEKIKEKLPGGNKDGNQQHTTTGDAIGQQEHAGAAGAGAPGVESTGEKKGLMDKIKEKLPGQH

SEQ ID NO: 63422 - protein, 169 aa, Nostoc punctiforme PCC 73102
MIIIVMGVSGSGKTTIGKLLADSLSWEFSDADSFHSPENVDKMRRGIPLTEADRMPWLQDLQTAIKHWLQENKNVVLACSALKDSYRQFLVSDSDRCTNAKSDRIKLVYLKGSYELIQMRLQERSNHYMSEKLLNSQFDTLEEPLDTISIDVAQPPQIIVQNIRTALRL

SEQ ID NO: 63423 - protein, 351 aa, Alkalilimnicola ehrlichei MLHE-1
MSTMQAAVFVEPGRIEVQEKPIPEIGPTDALLRVTTTTICGTDVHILKGEYPVEPGRIVGHEPVGVIEKLGEAVTGYEPGQRVIAGAITPCGQCHACQDGVSSQCGGKAMGGWQLGNTIDGCQAEYVRIPNAQANLTPVPDELTDEQVLMCPDIMSTGFGGAENGHIRIGDTVAIFAQGPIGLCATAGAKLMGATRIIVVDGVPERLETARKLGADVGVNFREQDPVEAIMELTGGRGVDVAIEALGLQETFEACLRVLKPGGTLSSLGVYSGKLSMPLDAIAAGLGDHTIVTTLCPGGKERMRRLMEVVAAGRVDLTAMVTHRYTLDQIVEAYDLFSHQRDGVLKVAITP

SEQ ID NO: 63424 - protein, 676 aa, Gibberella zeae PH-1
MASPLQFAYRTQKTIGVFDAAPVYEPLAGFNKPEGNLRYCIYSPCGRYFGWASPEVVTVVDASTGQQVLSLPILNVYELGFSPCGTFVITWERPGKDENGDATKNLKVWRVVEEGVAGQDKQPLGRFVQKQQQGWNLQYTADEKYCARLVTNEVQFYESHDLVTVWNKLRVEGATNFALAPGSQNHAVAVFVPERKGQPAAVKVFNVPLFTNPISQKTFFKGDKVQLKWNKLGSSILVLAQTDVDRSGKSYYGETTLYLLSTTGAFDARVSLDKEGPIHDVSWSPNSREFGVVYGYMPAKATIFNHRAVATHSFPIGPRNTITFSPTGRFVLVAGFGNLAGQIDIYDLEKDFRKVTTIESGNPSVCEWSPDSRYIMTATTSPRLRVDNGIKLWHVNGGIMYNEDMIELYNVIWRPQSPESIAPGDPLSPVPTPHSSATALLATAKTPSKPAGAYRPPGARGLATPLHFKREDEGGAAHVVGNGVPNVGPNGFGRPRRGVPGAEFAEQTPTVRTVPGAEPMGDENSSKSKNKKKRNKKNAQGEGGRPQGEPNGGASLAPPSHDRGHEGRSPERRNHRNRSQSRNNQPRSRSNTHRNGHGNQQQAQSSGATAAAAAAAADASQNPNAKKIRSLQKKVRAIEDLEMRLAGGEKLEDTQLKKINTKSSVLKELDGLEKEN

SEQ ID NO: 63425 - protein, 576 aa, Debaryomyces hansenii CBS767
MSSLLTNKYFKDYYNNPSPTAIGTMIAILEIGALISSFVAGKVGDHIGRRRTIRYGSFIFIIGGLIQTSSINIINLGAGRFISGVAIGFLTTIIPCYQSEISPPDDRGFYACLEFTGNIIGYSTSIWVDYGFSFIENDYSWRTPLAIQCVMGGLLFIGSFVIVETPRWLLDHDHDIEGMIVISDLYGDGDVEDELSKTEYRNIKENILIARVEGGERSYRYMLTKYKKRLSVACFSQMFAQLNGINMVSYYAPMIFELAGWVGRQAILMTGINSIVYVLSTIPPWYLVDGWGRKPLLLSGAVVMGIPLLVISYSLFLDNIYTPNIVVVSVIIFNAAFGASWGPIPWMMNEVLPNSIRSKGAAMSTATNWLFNFIVGEMTPILLDTIKWRTYLISAVSCALSFLCVHFLFPETKGLSLEDMGSVFDDNSSIFSFHSGASSGNNASTTTINNYGAADRDSGIEVRRTSISVETPNHANIVNEAFRQSPASIARNSKAKPELDGLITGNPPPVPPDLSVLDSNVPPQEIEPPSFDVIFKYKVRQLEKPNIFQKAFRAISGDSTFKPPQIDEERTLLSNN

SEQ ID NO: 63426 - protein, 292 aa, Oceanobacter sp. RED65
MITGSMVALVTPMSKAGDIQWDSLEKLVEMHIKEGTDSIVAVGTTGESSTLSTEEHLKVIEQVIKWSNGCISVIAGTGANSTSEALYLTKEAERLGADAALLVVPYYNKPTQEGLYQHYKTIAEASGIDQILYNVPGRTVCDMLPETVERLASIKNIVGIKEATGDINRVYDIINRCGDEMIIYSGDDATAYELMLAGGKGNISVTANVAPKQMAELCRLSIEGHAEEAKALNDQLMPLHHSLFTEANPIPVKWAMHEMGLMGPGIRLPLTPLSEHLREPLRQVLRQYDLLK

SEQ ID NO: 63427 - protein, 551 aa, Olea europaea subsp. europaea
MDIQSNVLTITSGSTPTDTSSNGQAAKSTKERIKRSDFPSDFVFGAATASYQVEGAWNEGGKGMSNWDYFTQSQPGGISDFSNGTIAIDHYNMFKDDVVVMKKLGLKAYRFSLSWPRILPGGRLCHGVSKEGVQFYNDLIDALLAADIEPYITIFHWDIPQCLQLEYGGFLHERVVKDFIEYSEICFWEFGDRVKYWITLNEPWSFTVQGYVAGAFPPNRGVTPKDTEETQKHARLHRGGGKLLAAFKYGNPGTEPYKVAHNLILCHAHAVDIYRTKYQESQGGKIGITNCISWNEPLTDSQEDKDAATRGNDFMLGWFVEPVVTGEYPESMIKYVGDRLPKFSEKEEKLVKGSYDFLGINYYTSTYTSDDPTKPTTDSYFTDSHTKTSHERNKVPIGAQAGSDWLYIVPWGIYRVMVDMKKRYNDPVIYITENGVDEVNDKSKTSTEALKDDIRIHYHQEHLYYLKLAMDQGVNVKGYFIWSLFDNFEWAAGFSVRFGVMYVDYANGRYTRLPKRSAVWWRNFLTKPTAVPLKNEPEKSEDRRKRLRGST

SEQ ID NO: 63428 - protein, 177 aa, Nicotiana tabacum
MGVAHQVNQFWFPLIILLLSITISSTSGAESNCVYTAYIRTGPFMEDATDSKISLTLYDASGYGIRIKNLVAWGGLMGSGYNYFETDHSDMFSGHGPCLTGPICKMVLTSDGTGRQSAWYCSYVEVTSTGDHKQCSQQLFNVDQWLSTDRSPYQLTATRNNCRRMSGDQQPIVVDVI

SEQ ID NO: 63429 - protein, 543 aa, Magnetococcus sp. MC-1
MSIQTKITTPFDDQKPGTSGLRKKVKVFQQPNYLENFVQSIFDTLEEFQGKTLVLGGDGRYHNREAIHTILHMAAANGFGKVLVGRGGVLSTPAVSHLIRKYDAFGGIVLSASHNPAGPDGDFGIKYNVSNGGPAPESITNAIFTHSKAITQYRIWSDTEVDLDYLGDSEIGNMVVRVIDPVYDYAQLMEELFDFEAIRALLKGGFRILFDAMHAVTGPYAREILENRLGAPAGTVLNGVVKDDFGGGHPDPNLTYAADLVARMWADDAPDFGAASDGDGDRNMILGRKFFVTPSDSLAVLAENGTCAPGYARGIVGVARSMPTSQSVDRVAEKKNFACFETPTGWKFFGSLLDAGKATLCGEESFGTGSDHVREKDGLWAVLFWLNILAHRKTSVEAVVKDLWAIYGRTYYARHDYEDVDSAAASTLMSELRANFATLTGQVHEGLTIKLADEFGYTDPVNGESTIKQGVRILFVDGSRIVFRLSGTGTSGATLRIYLERFEPNPSLQHKDAQEALADLIRIADTLAGIKQHTGRQAPTVIT

SEQ ID NO: 63430 - protein, 164 aa, Silicibacter sp. TM1040
MTQIDYTRAAKYFLLQDVWQGFKLGLKYFFAPKATINYPHEKGPLSPRFRGEHALRRYPNGEERCIACKLCEAVCPAQAITIDAEPREDGSRRTTRYDIDMTKCIYCGFCQEACPVDAIVEGPNFEFATETREELFYDKDKLLANGERWEAEIARNLELDAPYR

SEQ ID NO: 63431 - protein, 472 aa, Glycine max
MARLSSDQVLKDNNAADPTSVTTLHLTHKALSDITCLANFVNLEKLDLKLNNLTSLEGLRSCVNLKWLSVVENKLESLEGIQGLTKLTVLNAGKNKLKSIDQVMSVVSLRALILNENEISSICKLDQLKDLNTLVLSKNPIRKIGEALMKVKSITKLSLSYCELQGIGTSLKSCVELSELRLAHNEIKSLPAELKLNSKLRSLDLGNNVITRWSELKVLELLTNLRNLNLQGNPAATVNKVMRKIKKALSKLQIFNARPVDKDTENKKGSIVDGTRDFSVDQNENDHIEAADDLDSGRKSSKKRKRTVDASKKEDRVVDEENKGHKKDKADRKKESLITNVDPGMENKSTKKKAKKDDKPLDKGFALEENVSKVEKKLKKQHKNDEQSELDVIDDAEASFAELFKINDAENLNLADEMKAQDKVPKDVMKLAGDPVTSFAKHKNAKIQNMESLSAPVAEIGMGGPSTWGDEL

SEQ ID NO: 63432 - protein, 397 aa, Gibberella zeae PH-1
MTSTPKTSFMRAVQWEGELRHMSVNIIPRPKLIDPEDAVVRITTSAICGSDLHIYHGLFGTDEKFGVGHEAVGIVEEVGPAVDFLKPGDRVLVTGFSEDGNLLPKAALVPTDLDMVGVGFGSSFHSEGGLQAEYVRMPWADSSLAKIPHGLDDKEWLPLTDIFPTGWTALTRSGFQPGDTVAVFGAGGVGLMCAYSAIIRGASLVYVIDHIPARLALAASIGAQPINFTRGGKASEQILALRPAGVNRAIDCVGQFCLNENLKPQPDFILREAVKITTNGGGIGIAGVYQAGGPEGYKPEINFAIPELWFKSLQVGSGLVDIEGNIRALVDLVKNGRARPGFVFSNEYSLEEAPLAYRRFEQHQETKVMLKGSRKLEDDSSLDMIIGRNGVSDANGA

SEQ ID NO: 63433 - protein, 589 aa, Medicago truncatula
MRLNKLVAFRNTERKRRRIRRRNTTVTAVNNCYLSDNCSEYVFTFLINDNPRYLKSLSTVSKQFLSVTNTLRFSLTILYQTCTFLPRLFQRFTNITYLDLSSYNGDLNALLYQIPFPLNITSLNLSNQPIIPATGLRAFSQNITTLTSLICSNIASICNNDLVLISDCFPFLEELDFNSSNPFASRDFDMNVWVKTMAMVLPKLRKVNLSGYYNIDDSSLLHLCKNCEFLEEVMMLKCPFLTHDDVASAIRERPTLKSLFVRWRTNGRHDNIGANFIGSLVSLNGLTCLNLSSLRISDELLFSIAMGGLPLRRLVLQNCTSYNYVGIYSLLSKCRIQHLDLQNATFMNDHDVAELSLFLGDLVSINLSECSMLTDSAMFALVRNCPSLIEVKMEHTSLGEKSVDNSNSSMDCVLNHQLKSLHLTCNFQLLNENIILFASIFPNLQFLDLSSCHNISEEGICEVLRRCCKVRHLNLAYYSRVKLLRINFKVPELEVFNLSHTCVDDETLYMISKNCCGLLQLFLENCDEVTENGVKHVVENCTQLREVDLGGCDNVNANVTASVVFSSTSLRKVNAPPHFRISDREMKLL

SEQ ID NO: 63434 - protein, 166 aa, Glycine max
  misc_feature (2)..(2): Xaa can be any naturally occurring amino acid
  misc_feature (118)..(118): Xaa can be any naturally occurring amino acid
MXGSGSGVVTAYGNGAITETKKSPFSVKVGLAQMLRGGVIMDVGNAEQARIAEEAGACAGMALERVPADIRAEGGEARMSDPQLIKDIKRAGTIPVMDKARSGHFREDQNREGTGIGXGDEREVVTLADEGGHIKKHQLAEYPLAGGRRNLRKDPRRNWEGDDKNR

SEQ ID NO: 63435 - protein, 199 aa, Streptococcus pyogenes MGAS315
MAEEQVLNTHNASILLSAANKSHYPQDDLPEIALAGRSNVGKSSFINTILGRKNLARTSSKPGKTQLLNFFNIDDKLRFVDVPGYGYAKVSKSERAKWGKMIEEYLTSRDNLRAVVSLVDLRHAPSKEDIQMYDFLKYYDIPVIVVATKADKIPHGKWNKHESVVKKALNFDKSDTFIVFSSVERIGIDDSWDAILEQV

SEQ ID NO: 63436 - protein, 1089 aa, Wolinella succinogenes DSM 1740
MPKREDIKTILLIGSGPIIIGQACEFDYSGTQAAKTLKSLGYKVVLINSNPATIMTDPEFADRTYIEPITEEIVQDIIRKEKVDAILPTMGGQTALNIAMSMHNKGMLEDVVFLGAKPEAIKKGEDRQAFKEAMQKIGMDLPLSRYAYNMEEAMIAAKEIGFPLIIRASFTLAGGGSGVAYNIEEFKQLAQNGLEISPIHEILIEESLLGWKEYEMEVIRDRADNCIIVCSIENLDPMGVHTGDSITIAPALTLTDKEYQRMRDASFAILREIGVDTGGSNVQFSIHPETGRMIVIEMNPRVSRSSALASKATGYPIAKVATLLAVGYTLDEIKNDITGTPASFEPTIDYIVTKIPRFTFEKFPQADSTLTTSMKSIGEVMAIGATFQESLQKALCSMETGIFGFNPISNDLELVKKEIRRPNAERLLYVAEGFRLGLSREEIHELCKIDPWFLEQIEQIIKSESSIDLELLADKTRLRAIKAQGFSDKMIASLISKKEGIELSESEVYEARARLGVVLEYQEVDTCAAEFEALTPYLYSSTNIMEIAGAGRALEENSSKKKVMIIGGGPNRIGQGIEFDYCCVHASFALEDMGITSIMYNCNPETVSTDYDTSDVLYFEPIDFEHVRSVIEREKPDGVIVHFGGQTPLKLAKNLTRIGANIIGTSAKVIDVAEDREKFSRFVEENGLKQPENGTAFTKEEAHEIANRIGFPVLVRPSYVLGGRAMRIVYNQEELKLYMEEAVSVSNESPVLIDKFLDNAIELDVDAISDGQKVYVAGIMQHIEEAGIHSGDSACSLPAVSIEPALLKELEHLTAKIALALGVKGLMNTQYAIHKGMIYLIEVNPRASRTVPFVSKATGIPLAKVATRVMWKGDLLEALSFYDRFNMVMEEEGIYKPKPTKHIAVKESVFPFTKLSGADLILGPEMKSTGEVMGISHSFGISFAKSQLACKNSLPQKGKLFISLTDLDKAHGVEIARKFETLGFEILATGGTHKALLEAGVKAQVVLKISEGRPNIEDMLTNGDVALAINTSDNKSSKDDAKRIRHQVLRSNVPYFTTLAAANAAALAIKEMREGEVNSAVAIQDYLRG

SEQ ID NO: 63437 - protein, 455 aa, Triticum aestivum
  misc_feature (96)..(96): Xaa can be any naturally occurring amino acid
  misc_feature (104)..(104): Xaa can be any naturally occurring amino acid
  misc_feature (145)..(145): Xaa can be any naturally occurring amino acid
  misc_feature (149)..(149): Xaa can be any naturally occurring amino acid
  misc_feature (168)..(168): Xaa can be any naturally occurring amino acid
MGQKDSKPSYNSGNSSNGYNSRYANTPSSYSPRYASSAGNNVQQPEAQARLQRKYSRIGDDYRSVSQVTEALAQAGLESSNLIVGIDFTKSNEWTXGKIFYNRXCLHDIGNTPNPYEQAISIIGRTLLAFDEDNLIPCFGFGDAXTHDXEVVSFYPENQPCNGFEEAXLERYREIVPTLRLAGPTSFAPIIETAIGIADSTGGQYHVLLIIADGQVTRSVDTQSGQLSPQERDTIDAIVKASHFPLSIVLVGVGDGPWDMMHKFDDNIPARSFDNFQFVNFTEIMSKSIAADRKEAEFALSALMEIPTQYKATLDLQLLGRRQGIPPRVPLPPPTRTPYSRSTSFDQQSGVYSRSSSFGQQTSGFQQSDNFKQRQHGATRRPDSYSSESSQPAASRIPDTYASESSESTLSCAICMDKSKDLAFGCGHQTCYDCGKNLVRCPMCQQHITTRIRLY

SEQ ID NO: 63438 - protein, 293 aa, Zea mays
MQTPARLSAPSSPLVSSAPPIPVRPQRVAFPSLRRRDLLLLPAALTLPTAPAPLPASARGLFRMPPPRLVNRYFLVRAGESVYEGQGLLRTNPVAKTSVDSGLSPVGLRQTARAALELQRLGACEDDCWIWPSITQRAYQAAEIIAAANGVNRSRIVPEYSFLDARGLGAFEWKSLDTLPEVYASDNISPDLKPPPIRDGTPNESVADVFVRVTQLMSILETQYSGETVVIVSPDSDNLSILQAGLIGLDLRRHSSLFFQPGEVRPVDPSSIPEYKQPPSTVFKCANPPSCKE

SEQ ID NO: 63439 - protein, 424 aa, Methanosarcina mazei Go1
MVSEITLEKSRQMYEKAKTLIPGGVSSPVRAIKPYPFYTASANGSKIRDLDGNEYIDYCLAYGPAILGHNHPVIKEAIRQQLDRGWLYGTPTELEVTLAEKVASYYPSIDMLRFVSTGTEATMSALRLARGFTRRNKFIKIEGGFHGAHDAVLVKAGSGATTLGEPDSLGIPADFTKHTLQAPYNDIETMTSLVEKNRDDLAAVIIEPVLGNIGPVLPLPGYLEELRKLTEENDVLLIFDEVITGFRLAMGGAQEYFGVVPDMTTLGKIVGGGLPIGVFGGKREIMEMIAPSGAVYQAGTFSGSPCSVAAGIAMVDYLNEENIHAKLNSAGDYMRAALSEIVEDEGLDYHVCGIASMFKIFFGDEPHNYQEVLKCDKEGYLAFFHRMLASGVFLPPSQFETNFISAVHSDEDIEKTLEAYSENL

SEQ ID NO: 63440 - protein, 582 aa, Populus tomentosa
MVLFNVSRVETTPFGDQKPGTSGLRKKVKVFKQPNYLQNFVQSTFNALTPQNVRGATLVVSGDGRYFSKDAIQIITKMAAGNGLRRVWVGQNGLLSTPAVSAVIRERVGVDGSKATGAFILTASHNPGGPNEDFGIKYNMENGGPAPEGITDKIYENTKTIKEYLTADLPDVDITTIGVTSFSWSEGQFDVEVFDSASDYIKLMKSIFDFESIRKLLSSPKFTFCYDALHGVAGAYAKRIFVEELGAQESSLLNCVPKEDFGGGHPDPNLTYAKELVARMGLGKSNSEVEPPEFGAAADGDADRNMVLGKRFFVTPSDSVAIIAANAVEAIPYFSAGLKGVARSMPTSAALDVVAKSLNLKFFEVPTGWKFFGNLMDAGLCSVCGEESFGTGSDHIREKDGIWAVLAWLSILAYKNRENLGGGKLVTVEDIVHNHWATYGRHYYTRYDYENVDAGAAKELMACLVKLQSSLTEVNEIVSGIQSDVSKVVHADEFEYKDPVDSSISKHQGIRYLFEDGSRLVFRLSGTGSEGATIRLYIEQYEKDPSKTGRDSQDALAPLVAVALGLSKMQEFTGRSAPTVIT

SEQ ID NO: 63441 - protein, 862 aa, Hordeum vulgare
MLLGGLIDTLTGANKSARLKGTVVLMRKNVLDLNDFGATIIDGIGEFLGKGVTCQLISSTAVDQDNGGRGKVGAEAELEQWVTSLPSLTTGESKFGLTFDWEVEKLGVPGAIVVNNYHSSEFLLKTITLHDVPGRSGNLTFVANSWIYPAANYRYSRVFFANDTYLPSQMPAALKPYRDDELRNLRGDDQQGPYQEHDRIYRYDVYNDLGEGRPILGGNSDHPYPRRGRTERKPNASDPSLESRLSLLEQIYVPRDEKFGHLKTSDFLGYSIKAITQGILPAVRTYVDTTPGEFDSFQDIINLYEGGIKLPKVAALEELRKQFPLQLIKDLLPVGGDSLLKLPVPHIIQENKQAWRTDEEFAREVLAGVNPVMITRLTEFPPKSSLDPSKFGDHTSTITAEHIEKNLEGLTVQQALESNRLYILDHHDRFMPFLIDVNNLPGNFIYATRTLFFLRGDGRLTPLAIELSEPIIQGGLTTAKSKVYTPVPSGSVEGWVWELAKAYVAVNDSGWHQLVSHWLNTHAVMEPFVISTNRHLSVTHPVHKLLSPHYRDTMTINALARQTLINAGGIFEMTVFPGKFALGMSAVVYKDWKFTEQGLPDDLIKRGMAVEDPSSPYKVRLLVSDYPYAADGLAIWHAIEQYVSEYLAIYYPNDGVLQGDTEVQAWWKETREVGHGDLKDAPWWPKMQSVPELAKACTTIIWIGSALHAAVNFGQYPYAGFLPNRPTVSRRRMPEPGTEEYAELERDPERAFIHTITSQIQTIIGVSLLEVLSKHSSDELYLGQRDTPEWTSDPKALEVFKRFSDRLVEIESKVVGMNHDPELKNRNGPAKFPYMLLYPNTSDHKGAAAGLTAKGIPNSISI

SEQ ID NO: 63442 - protein, 270 aa, Oryza sativa
  misc_feature (41)..(41): Xaa can be any naturally occurring amino acid
MSSAAGEPSSSSAAAAAISCSSSNDDEKPPPSLEGKELRRXEEEEPAAAARPEKLTEGSSRAAEAEEEEEVVEDEEDDDEEDEGKVAEAIDLGPRVSIKEQLEMDKEDESLRRWKEQLLGSVDLNSVGESLEPDVRITSLCILSPGRPDVLLPLPVEPSNSKEPWFTLKEGSTYRLKFTFSVSSNIVSGLRYTNTVWKAGIRVDKTKEMLGTFSPQLEPYTYVTPEETTPSGVFARGSYSAKTKFVDDDRKCYLEINYTFDIRRDWPCKS

SEQ ID NO: 63443 - protein, 1618 aa, Thanatephorus cucumeris
MATASVEQPDLTKVSILGKDSIHCGFHLSPYIADTVLTNLPASTYVLITDTRVAKFHLESFEAAFTDALAARPNTSARFLTHVIPPGETSKSREGKAEIEDFLLDNSCTRDTVVLALGGGVIGDLVGFVAATFMRGVRFVQIPTTLLAMVDSSVGGKTAIDTPHGKNLIGSFWQPSYVFIDAAFLETLPQREFVNGMAEVIKTAAIWNEDEFSMLEASAPALFAAIGSSSSTTSAGRTTATRSEAQSLLLHVITESIGVKAHIVTLDERETGLRNLVNFGHTIGHAIEAVLTPTILHGECVAIGMVLEGEVARQLGVLSQVGVGRITRALKAYGLPTSTKDPRIAAVPASRLLTIDRLLDIMKIDKKNSGPEKKIVLLSRIGKTYEERATGVKDEVIRRVLAEACRVIPGIPRGNPVRMSTPGSKSISNRALVLAALGNGTCRLRNLLHSDDTQVMMSALIELKGAKFAWEDGGETLVVSGGGGAFTIPPAGKELYLGNAGTAARFLTTVCTLVGPDSSSATASSEFPEGYTFITGNARMKQRPCGPLVDALRANGSKVKYIESEGCLPLHIGAGGLKGGTIQLAASVSSQYVSSILLCAPYARDEDVVLELVGGQVISQPYIDMTLAMMKTFGVEVTRRKAEDGTLLDIYDIPRAQYTNPEKYAIESDASSATYPLAVAAITGTTCTIENIGTSSLQGDAGFAVNVLKRMGCKVEQSENETTVTGPPIGQLKAIGLVDMETMTDAFLTAVVVAAVCGEGSAEGLESDVPKNTTRILGIANQRVKECNRIRAMIDELAKFGVKTKELDDGLEVYGQPIETLNKNVSVHCYDDHRVAMAFSVLATVVPGTILEEKRCVEKTWPNWWDDLTNKIGIDVEGIELAHQSPAVAKYNPEATIIIVGMRGAGKTHIGGIAAASLGWKFIDADHVFEGRTGELVSQYVRSKGWTAFRQAESQIIQDLLAENPTRTIISTGGGIVESPLNRALLSGYGRATGPVVYVMRDVNEILSYLGSETARPAYGEEIADVYWRREPWFREVSTHEYISYTGGFHAANGATPGEIASACRDETARFFRQITGIKPNLSEALAQGERSFFLSLTYPDLLPAVPSIPLLTAGADAIELRVDLLNPSGDPVTGPPNIPSLDFVATQLSALRHTSSLPVVFTVRTASQGGAFPDTAEKEAFALYNLALRHGVEYIDVEISWSDKKIQDLAARKGASQIIASWHDWSGNMKWNGAVVKEKYALAERVGDIVKIVGKALSIEDNFALRAFAAAHTSKPFIGINMGAEGQLSRVLNTAFTPVSHPLLPTRAAPGQMSVQDIHTALHLNGQLAPQKFYLFGSPIAHSMSPHLHNTGFEKLGLPHKYHIFETATITDEVKAVIRAPEFGGASVTIPLKLDIIPLLDEVSPEAKAIGAVNTIIPRKRADGSTSLFGTNTDWRAIHDLARNNLVVGITNETTALVLGAGGTARAALYAIHALGIKTIYLFNRTRAAAQALADTFPTFGIIPLDSLNSFPKAAPTVVVSAIPATGTTTEKASDSAGVYLPPSLFEAPSGVVVEMAYKPAVTPVLGLAAKSSGWVGVRGVDILCEQGFYQYEAWTGRKAPRAAMKAKVISLYDSQQ

SEQ ID NO: 63444 - protein, 543 aa, Acidithiobacillus ferrooxidans
MAVLQIATRPFADQRPGTSGLRKKVKVFQQPHYLENFVQSIFNAIPDRAGKTLVLGGDGRFYNREAIQIILRMAAGNGWGKVVVGRGGLFSTPAVSTVIRARGAHGGIILSASHNAGGPDQDFGIKYNTANGGPAPEKLTDAIWTASRSIQGYQILDGADVDIDHAATFWLGDMQIEVCDPVAEYAELMARIFDFDALKRLMQGPFRMRFDALHAITGPYAHEIFEKQLGAPAGTVVNGTPLTDFGGGHPDPNLVYAKPLADELFAENAPDFGAASDGDGDRNMILGRHFFVTPSDSLAVLAAHATAIPAYRHGLKGIARSMPTSQAADVVAEALGIAHYETPTGWKFFGNLLDAGKITFCGEESFGTGSDHIREKDGLWAVLAWLSVIAHTGQPVAEIVTRHWQRFGRHYYTRHDYENLPAEIGEQIMHSIAAQLPVLPGQTLAGREILIADDFAYADPIDGSVSAHQGLRLLFADGARLIFRLSGTGTEGATLRIYHEHLEKDPLRQHQDPQRTLRDLIQVGRNLSRLETLTGRKTPTVIT

SEQ ID NO: 63445 - protein, 392 aa, Rhynchophora phillipsonii
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCVAPPVKVIQDERLPQPLSLCASTLRSPHGCHAQYMTNMGIVASLVMSVTVNEEDDMVDSDQPQMARKLWGLVVCHHTSTRFVPFPLRYACEFLIQVFGVQINKEVELAAQVREKHILQIQTMLCDMLLRDAPVAIITQSPNVMDLVKCDGAALYFKNKTWLLGVSPTEEQIRDIAEWLLEYHSGNTGLSTDSLMEAGYPGAAALGDAVCGMAAVSITSRDFLLWFRSHTAKEIKWGGAKHDPDDKDDGRKMHPRSSFKAFLEVVKWRSMPWEDMEMDAI

SEQ ID NO: 63446 - protein, 260 aa, Brassica oleracea
SLSGHLFDKFLINEALDMIEAAGGSFHLAKCEIGQSADAESYSELEVGADDRKVLDQIIDSLTRLANPNDEEDYISPRRESNKISLKIGKVQQENEEKPEEMTKRSSVLILGAGRVCRPAAEFLASVRNISSQQWYKTYLGGEQRDVRVIVASLYLKDAKETVEGMPEVEAVQLDVSDSESLLKYVDVVLSLLPASCHASVAKTCIELKKHLITASYVDDETSGLHEKAKHAGITILGEMGLDPGIDHMMAMKMINDAQS

SEQ ID NO: 63447 - protein, 392 aa, Rhynchophora phillipsonii
DLEPVNPADVPVTAAGALKSYKLAAKAISRLQSLPSGNISLLCDVLVKEVRDLTGYDRVMVCKFHEDEHGEVVSECRRSDLESYLGLHYPATDIPQASRFLFMKNKVRMICDCVAPPVKVVQDERLPQPLSLCASTLRSPHGCHAQYMTNMGIVASLVMSVTVNEEDDMVDSDQPQMARKLWGLVVCHHTSTRFVPFPLRYACEFLIQVFGVQINKEVELAAQVREKHILQIQTMLCDMLLRDAPVAIITQSPNVMDLVKCDGAALYFKNKTWLLGVSPTEEQIRDIAEWLLEYHSGNTGLSTDSLMDAGYPGASALGDAVCGMAAVSITSRDFLLWFRSHTAKEIKWGGAKHDPDDKDDGRKMHPRSSFKAFLEVVKWRSMPWEDVEMDAI

SEQ ID NO: 63448 - protein, 93 aa, Glycine max
MERNAVKGGAIQLLRVLCNNMQAITMPSMRDLATRGAVNHINGLIYDETRGVLKIFLDNVIRDAFTYTEHARMKTRTAMDVVYALNRHGKTLY

SEQ ID NO: 63449 - protein, 392 aa, Microsteira sp. Davis et al. 38-01
DLEPVNPADVPVTAAGALKSYKLAAKAISRLQSLPSGNISLLCDVLVKEVRDLTGYDRVMVYKFHEDEHGEVVSECRRSDLESYLGLHYPATDIPQASRFLFMKNKVRMICDCVAPPVKVIQDERLPQPLSLCASTLRSPHGCHAQYMTNMGIIASLVMSVTVNEEDDMVDGDQLQMARKLWGLVVCHHTSTRFVPFPLRYACEFLIQVFGVQINKEVELAAQVREKHILQIQTMLCDMLLRDAPVAIITQSPNAMDLVKCDGAALYFKNKTWLLGVTPTEEQIRDIAEWLLEYHSGNTGLSTDSLMEAGYPGASALGDTVCGMAAVSITSRDFLLWFRAHTAKEIKWGGAKHDPDDKDDGRKMHPRSSFKAFLEVVKWRSMPWEDVEMDAI

SEQ ID NO: 63450 - protein, 336 aa, Oryza sativa
MARKFRREIERERRTLAAAWEESRARVSRSRVVEGCSRVSLKKKKKKSFYVFAIDGAWAVLGLMCSSYGPRYTGLRIPHCHGPFAVRMAHLSLGGGDVNGPSQKGKLRLSECVGNGRDGGIGKCADDAVPGWSLASLKPSYYHHVFSKAEFHVVILGVHKAGKTTLLEKVKSIYLKEEGLPHDRIVPTVGLNIGRIEDANVKLVFWDLGGQPGLRTIWEKYYEEAHAVIYVIDSAAASSFEDAKSALEKVLHHEDLQGVPLLIFANKQELPAAVTEEELARHLHLKGLDERPYMFQGGSAYDGTGIKAGIDWLVEEMERSKRTEVLMARTETAEKI

SEQ ID NO: 63451 - protein, 392 aa, Mascagnia sepium
DLEPVNPADVPVTAAGALKSYKLAAKAISRLQSLPSGNISLLCDVLVKEVRDLTGYDRVMVYKFHEDEHGEVVSECRGSDLESYLGLHYPATDIPQASRFLFMKNKVRMICDCLAPPVKVIQDERLPQPLSLCGSTLRSPHGCHAQYMTNMGTIASLVMSVTVNEDDDMVDGDQPQMTRKLWGLVVCHHTSPRFVPFPLRYACEFLIQVFGVQINKEVELAAQVGEKHILQIQTMLCDMLLRDAPVAIITQSPNVMDLVKCDGAALYFKNKTWLLGVTPTEEQIRDIAEWLLEYHSGNTGLSTDSLMEAGYPGASALGDAVCGMAAVSITSGDFLFWFRSHTAKEIKWGGAKHDPDDKDDGRKMHPRSSFKAFLEVVKWRSMSWEDIEMDAI

SEQ ID NO: 63452 - protein, 770 aa, Rhodopseudomonas palustris CGA009
MHSGLDNSAELRVSDFDPITLAGGTRTEVLPGAIQPHAALLALAPADLTIVHAAGATASLLGAAAELLPGTAASTAFSSDQIARLQALATAERWIERPQHAFTLNAPDATPIDVIVHHASGLLVVELDPRREPAPENSLALVQSMIRRARPAPNLQGFCDAMAAELRSVTGFDRVMVYRFARDGSADVIAEARGPETSPFLGLRDPQPDISNQPGSISRIRVQPDVHAPAAPLWPAHSPRNGLALDLSFSATRSASPEHRLYLAQLGVAASLSLSLVVEGELWGLIVCHHATPRFLPYRMREACALFAEMASLQLETRLAADQLAARLRSTRIHEELVTRMSQESDLAEGLIRFYPNLLDFIPAAGVGLWIDGQFTGIGATPGPAQVAAMMGWLHGVPHDGVYHTDCLALAYPPAKAFAGCASGLLALSLSNTPHNYVLWFRPEVVRVVTWAGMPNKPVGVDAGAPRTPKGCASSWQESVRLHGEPWLDTDVDAAHRLRESLLDVVLRRIDGIARERRSAQLLQEQLMRQVELGLSRSKDVAKTLQEEKRRRVLVEADLSKVLRRTVEDQEAERLRIARELHDTLGQSLTLLQLGFDKLGQAAGDNPELQQRIAEMKSLTADVGRQANRLAWEIRPTALDDLGIQTAIQNLLDSWSEKSSIEFDLHMTLGSRRLPSPVETTLYRVLQEALTNVVRHASARHVSVILQLGDDQVTMIVEDDGCGFVTAGRKPPSGRLGLLGIRERLSLVGGSLEIESAPGKGTALYARIPL

SEQ ID NO: 63453 - protein, 219 aa, Zea mays
MASHDHHHSHSHDDHHHHSHGDGGGHAAGGSWVGEDGRVWHSHDGLAPHSHEPIYSPGDFTKRAPPLASRDFADRAFTVGIGGPVGTGKTALMLALCRFLRDKYSLAAVTNDIFTKEDGEFLIKHGALPEERIRAVETGGCPHAAIREDISINLGPLEELSNLYKADLLLCESGGGIFFYLIQNKCRSFLLLCMLESTPERQPCRLPASSYLPGKFLQV

SEQ ID NO: 63454 - protein, 268 aa, Thermoanaerobacter tengcongensis MB4
MAIAFITGATDGIGREVAKRLAFHGYDVIIHGRNELKLEKVADEIRDLTGKSVFKIKADFSSLKDLKKLVKEIKDNFSKVDLLLNNAATFEKERKVTEEGFERTFMVNYLAPFYLTISLINEGVDIKYVLNVSSMAHASSIEFEDLQLEKGYDGYKAYSLSKLYITLFTYYLAEMLKGKIYVNCLHPGVINTKLLMENWGAIGASIEEGAKNVIDAIKYIEAHNVTGVYFDNGKPSKSKPITYDREVQRKLWEKTLKLLKINERDLKF

SEQ ID NO: 63455 - protein, 513 aa, Rhodopseudomonas palustris CGA009
MTHSASAAPSSAAASTPFSDPAPNPDCEHVDVLIVGAGISGIGAAYHLTTQCPGTRFVVLEAQDGFGGTWRTHRYPGIRSDSDLYTFGYRFKPWTGKPIATAAEIRDYLGEVIAEHDLARHIRYRHRIVSASWSSEDACWTIEALQGDGGETVRFTASFLWMCQGYYRHSEGYTPEWPGMAEFKGRIVHPQTWPDDLDVAGKRVIVIGSGATAATLVPSIAPKAEHVTVLQRSPTYFIPGRNKIEIADTLRELGISEDWIHEIVRRKILFDQATFTRRSMSEPEVVKQELLAGVRAHLGPDADLDPHFTPSYRPWRQRIAFVPDGDLFRAIASGKASVVTDEIDRFTEQGIRLKSGGTLEADIVVTATGFNLNVLGDIAFSIDGKPLNFAETVTYRGMMFTGVPNMAWVFGYFRASWTLRADLVADFVCRLLSHMKQTGHRSVVPALRPEDRDMALLPWIDPENFNPGYLMRGMHLLPKRGDKPEWQHSQDYWTEKDQFPAIDLDDPAFVYSS

SEQ ID NO: 63456 - protein, 148 aa, Oryza sativa (japonica cultivar-group)
MARKNLLLLGVFLSALLFFFLDVAHARELAEASESEGKNVKPTGRSGVEDQKWGGAHGGGYGYGGGYGGGGYGHPGYGGGYGGGYGHPGYGGGYGGGYGQGYGCGYGHPGHSGGYGGGYGGGYGGGYGGGGGYGGGGGYGGGHGGGWP

SEQ ID NO: 63457 - protein, 427 aa, Colwellia psychrerythraea 34H
MNKSEQLFEQAQKIIPGGVNSPVRAFNGVGGTPCFIKRAQGAYIYDADDKAYIDYVGSWGPMILGHNHPAILEAVITTAKNGLSFGAPTEIEITMAEKVRELVPSMESLRMVSSGTEATMSAIRLARGYTGRDKILKFEGCYHGHADALLVKAGSGALTLGVPNSPGIPEDFAKHTLTVSYNNIDEVKEIFAKYADEIACIIVEPVAGNMNCIPPVEGFLEGLRDVCDQYSSVLIFDEVMTGFRVALGGAQAHYNIKPDLTTLGKVIGGGMPVGAFGGKQEIMDYIAPVGPVYQAGTLSGNPIAMAAGLASLTELAQGNKHQQLSSATEKLAMGLKAAAERNGVSLSVNYVGAMFGFFFTEDKNPITTYEQATQCDGEMFKRFFHLMLDEGVYLAPSSYETGFLSTSHTDDIIEKTLVAADKCFAQL

SEQ ID NO: 63458 - protein, 500 aa, Atriplex hortensis
MAFPIPARQLFIDGEWREPLLKNRIPIINPSTEEIIGDIPAATAEDVEVAVVAARKAFKRNKGRDWAATSGAHRAKYLRAIAAKITEKKDHFVKLETLDSGKPRDEAVLDIDDVATCFEYFAGQAEALDAKQKAPVTLPMERFKSHVLRQPIGVVGLISPWNYPLLMATWKIAPALAAGCTAVLKPSELASVTCLEFGEVCNEVGLPPGVLNILTGLGPDAGAPIVSHPDIDKVAFTGSSATGSKIMASAAQLVKPVTLELGGKSPVIMFEDIDIETAVEWTLFGVFWTNGQICSATSRLLVHESIAAEFVDRMVKWTKNIKISDPFEEGCRLGPVISKGQYDKIMKFISTAKSEGATILCGGSRPEHLKKGYYIEPTIITDITTSMQIWKEEVFGPVICVKTFKTEDEAIELANDTEYGLAGAVFSKDLERCERVTKALEVGAVWVNCSQPCFVHAPWGGVKRSGFGRELGEWGIENYLNIKQVTSDISDEPWGWYKSP

SEQ ID NO: 63459 - protein, 183 aa, Mycoplasma mycoides subsp. mycoides SC str. PG1
MKKIALYLNPGFEEIEAVTVCDVLKRAGILVDMVSTIDSLEVKGAHNIVIKANKLWKDLNINYYDGMVLPGGSGVTSLFDNQTLIDNILEFNKQNKLIASICAAPQVIGQTKLLDNKTITHYPNCNFYLDKANVVLDKPFVVDNNFITGVSAGSSMLFSLAIVEYLLGKEKKEEIYKNLVIFG

SEQ ID NO: 63460 - protein, 385 aa, Populus tomentosa
MAIDCIKTMPSITTPQHHPKDQDQCKDDGKSFVFDAQILRHQTNIPQQFVWPDHEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYTAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNGQTPRKSLAFFLCPKNDKMVTPPHELVDTCNPRIYPDFTWPMLLEFTQKHYRADMKTLEVFTNWLHQRSFT

SEQ ID NO: 63461 - protein, 173 aa, Listeria innocua Clip11262
MEIKDLQDYVAIVNDWPKKGIVFKDITPLMNDGEAYRFATDKIVEYAKELKIDIIVGPEARGFIIGCPVAYALGIGFAPVRKPGKLPRETIEMEYDLEYGTNKLSMHSDAIKPGQRVLITDDLLATGGTIEATIKLVEELGGIVAGCAFLIELKELEGHKKLNGYDRLILMKL

SEQ ID NO: 63462 - protein, 624 aa, Oryza sativa (indica cultivar-group)
MEHKGLCILAVVIAFQLAGGQAVTDATARARRFACNVSAPCDTFVVYRTQSPGFLDLGNISDLFGVSRALIASANKLTTEDGVLLPGQPLLVPVKCGCTGARSFANVTYPIRPRDTFFGLAVTAFENLTDFVLVEELNPAAEATRLEPWQEVVVPLFCRCPTREELSAGSRLLVTYVWQPGDDVSVVSALMNASAANIAASNGVAGNSTFATGQPVLIPVSQPPRFPPLTYGAIAADPGAGKHRHGIIVATSIAGSFVACAVLCTAILAYRRYRKKAPVPKHVSPKLSWTKSLNRFDSNSSIARMINGGDKLLTSVSQFIDKPIIFREEEIMEATMNLDEQCKLGSSYYRANLEREVFAVKPAKGNVAGELRMMQMVNHANLTKLAGISIGADGDYAFLVYEFAEKGSLDKWLYQKPPCSQPSSSSVATLSWDQRLGIALDVANGLLYLHEHTQPSMVHGDVRARNILLTAGFRAKLSNFSLAKPAATVDAAATSSDVFAFGLLLLELLSGRRAVEARVGVEIGMLRTEIRTVLDAGGDKRAAKLRKWMDPTLGGEYGVDAALSLAGMARACTEEDAARRPKMAEIAFSLSVLGQPLSVADAFERLWQPSSEDSIGIGNEVAAR

SEQ ID NO: 63463 - protein, 341 aa, Streptococcus pyogenes MGAS315
MMTIAIDWDNLGFEYHKLPFRYISYYKNGQWDKGQLTEDATLHISESAPALHYGQQAFEGLKAYRTKDGSIQLFRPDRNAVRLQATADRLLMPQVSTEQFIDAAKQVVKANEDFVPPYGTGATLYLRPLLIGVGDIIGVKPAEEYIFTIFAMPVGNYFKGGLAPTNFIVSEAFDRAAPYGTGAAKVGGNYAGSLLPGKAAKSAGFSDVIYLDPATHTKIEEVGAANFFGITANNEFVTPLSPSILPSITKYSLLQLAEERLGMTVIEGDVPINELDKFVEVGACGTAAVISPIGGIQYKDNLHVFYSETEVGPVTRRLYDELVGIQFGDIEAPEGWIVKVD

SEQ ID NO: 63464 - protein, 263 aa, Wolinella succinogenes DSM 1740
MRQYAVFGDPIAHSKSPLLHNRVFLELGVPAFYGRYHLKEPSSLLERFHALGLEGANITVPFKEVAFEQCDEVRGIAQKIGSVNTMVKEGERVIGYNTDAEGFFQTLEGKLRPQNVLILGAGGTAKALAMIFDLHQIPVTILNRTPGRLKPLAEQGFKTLTHEEFAPDSYDLIINSTSAGLSDDSLPLPAPWLESLLHSGVLAYDVIYGKTTPFLRLAKAQGARFQDGREMLISQAALSSLHFTQHHFSLSTLHSLMRLALPQ

SEQ ID NO: 63465 - protein, 577 aa, Lactobacillus acidophilus NCFM
MTKTLKGIAASDGIAIAPAYLLVEPDLSFSKSSVDDIDAEVARYNDAIKESTAEVEKIRDIAKKSLGEEESQVFEAHLMILNDPEFTGAIENEIKDSKINAEAALDETAQKFIAIFEGMTDNPYMQERAADVRDVSKRIMAHLLGKELPNPASIDHEVIVVAHDLTPSDTAQLNKKYVKGFITDVGGRTAHSAIMARSLELPAVVGTDSITKDVKNGDMLIDDGLDGVAIISPSEEQIADYKKKGEDFLKQKAEWKKLKDEPSVTADGKQFIIAANIGTPNDMPGVHENGAEAIGLYRTEFLYMDSSDFPTEDDQFEAYKKVIEGMNGKQVVIRTMDIGGDKHLDYWDLPEEMNPFLGVRAIRLSLMNEEIFRTQLRALLRASAYGKLGIMFPMVGTLAELRKAKAILNDEKQKLVEKGVKIGDNLQVGMMIEVPAAAVLADQFAKEVDFFSIGTNDLIQYTMAADRGNDNVSYLYQPYNPSVLRLIKHTIDAAHENGIWCGMCGEAAGDNTMFPILLSMGLDEYSMSATSILRIRSLMKKLDTKDLKELANEACFVSETAEENEKLVNDLMKKINK

SEQ ID NO: 63466 - protein, 129 aa, Brassica napus
MGDSASSSSSSSTRVSVHNSLGGGSVADLLLWRNRTGAVIVLVSSTVFWFLFERAGYNLLSFVSNVVLLLVAILFLWAKSASLLNRPLPPVPNMEIPEELAVKAADDIRVWINRVLSIASDITIARNPI

SEQ ID NO: 63467 - protein, 305 aa, Oryza sativa
MAQQNGTPSNDFTVKAGLAQMLKGGVIMDVVNAEQARIAEEAGAAAVMALERVPADIRVEGGVARMSDPAMIKEIMEAVTIPVMAKARIGHFVECQILEAIGVDYIDESEVLTPADDVYHVTKSTFKVPFVCGCRNLGEALRRISEGAAMIRTKGEAGTGDVVEAVKHMRTVNSQIARARAILQSAADPEPELRTYARELEAPYELLRQAAELGRLPVVNFAAGGVATPADAALMMQLGCDGVFVGSGIFKSGDAKKRAKAIVQAVTHHKDAKVLAEVSEGLGEAMVGINVQRMPEGDKMAGRGW

SEQ ID NO: 63468 - protein, 366 aa, Zymomonas mobilis subsp. mobilis ZM4
MSQTKETSILTIEPTDHPTPADKRKAMMANPGFGTTFSDHMVVIHYSEEKGWHNGRVMARQPLPLDPAASVLHYAQEIFEGMKAYRSPENEILLFRPEENARRFRHSAEVMAMEPIPEEIFLDAVHKLVDIDRDWVPDGEVGSLYIRPFQIASQPFLGVKPAKEYIFAIIACTVGSYFKDATKGVPIWVSENHVRAVPGGTGTAKCGGNYAASLTAQAEGYAHGCAQVVFLDAIERRWIEELGGMNVFFVMNGKTLITPPLKGTILHGITRKSIIALARDKGYTVLEQPYSLDQWREDAKSGKLLEAFACGTAAVITSIGKVCDTHGDFEIGENGANNPVANELRESLINLQYGRAEDPYGWVKRV

SEQ ID NO: 63469 - protein, 652 aa, Oryza sativa (japonica cultivar-group)
MRGAVVAAAAAAVGNMLQGWDNATIAGALLYMRRDLPALQAHPALQGLVVATSLIGATIVTTFSGPLSDSRGRRPMLIASALLYSLAGLLMLWSPNVPILLLARLVDGFAIGLAVTLVPVYISETAPPDTRGLLNTLPQLTGSTGMFLSYCMVFLITLAPIPNWRLMLGVLLLPALLYLLLTIFFLPESPRWLVSKGRMKEARTVLQMLRGRQDVSAEMALLVEGLTTGRDTAIEEYVVGPTDEAKVTLYGGMSSGLAPGSMFGSAVTLASRQGSMLDHLKDPVVALLDSLHDMNPPAGGTTDVPNLGSMIGVHDRPPIDWDEENSGDDDGDIAAPLLTMEGEAATSTVGIGGGWQLAWKWTEGVAADGTRQSTVKRMYLHEEQAEGVHAAALVSQSALCTKKEAEAEVEGGWREVLEPGGVRHALVCGVAIQILQQFSGISGVLLYTPQILEQAGVGVLLSRLGLRDDSASILISGVTTLLMLPSIGVAMRLMDVSGRRSLLLWTIPLLVASLAVLVAASVAPMAAAAHAAVCTGSVVVYLCCFVMGFGPIPNILCAEIFPTRVRGLCIAICSLAFWLADIAVTYTLPVMLASLGLAGLFAIYAAVCCVALVFVALRVPETKGLPLEVIIDFFNVGAKGTLPNLHDDDDHY

SEQ ID NO: 63470 - protein, 469 aa, Oryza sativa (japonica cultivar-group)
MEKMIIKFFITSSILDLTIVGLDPAENETTLQAQQPHYLKTCCKPSLDHGSVVYLLGHTGKKELVIGEGKVVIGTDNLLKLSTDGVTWCPGSAGFDAQGNLAFMICDPMKLASSPTTRSSSTSSSSSHSSKKDHPMQFGVPISVVCDWLYQHWQGNLDEVSKPKLPLVRLMSSRSDHSSTSFTRRHVFKPADDENDDTSVSSQVTSKPKHQQASGNSANARISHDANPLVDLRANNEQGVSTPEIYESPRQSSCQGQKDAGSVQLLDINFPPSAPKTIFLPLPLKQMLSDENNADTSKPRNQSRDNGFPSGIIWHRNCEALSRDPPVAPLQDDCSSEGQSSSSPVELLEYRNEDHFSSEEETMYSAETMESRNIPSPREKHVGRSQSCVTYRRWSSPRMSTIQNGTLRKQHTLVPVRKSHSQNTSLPQRSHDYLSPTVSSAMKKRNSMEQQLPTKPRRSIAQTSPKWMF

SEQ ID NO: 63471 - protein, 1094 aa, Gibberella zeae PH-1
MDELFDVFEGNVEAPSASEDESRQNRKGDKTKKRKANAINGKHGDADKSEDVDMDNNTTEESKDEASSDDESSEESASQQDAKRRKKEEAVGPVITDTFQTAESREVAGAATFTEQDSSLVLSHNIQHQVALPPDLDYEYVPLSEHKAPEQPARTWNFKLDPFQSLSVASIEREESILVSAHTSAGKTVVAEYAVAQCLKRNQRVIYTSPIKALSNQKYRDFEAIFGDVGLMTGDVTINPTASCLVMTTEILRSMLYRGSEIMREVAWVVFDEIHYMRDKTRGVVWEETIIMLPDKVRYVFLSATIPNAFQFAEWIAKIHHQACHVVYTDFRPTPLQNYFFPAGGSGARLIVDEKSNFNEQNFNKVMQEVEEKKGADPNDPNARQKGKGKNKKTNKGGADNGSDIAKIIRMTIKKKFNPVIVFNFSKRECENMAMNISSLSFNDDSEKAMVRKVFHNAIESLSEQDRELPQIINLLPLLERGIGVHHSGLLPILKETIEILFQESLIKVLFATETFSIGLNMPAKTVVFTQVTKWDGVKRRPLTSSEYIQMAGRAGRRGLDARGIVIMMIDDKLEPDTAKEIVTGHQDRLNSAFYLGYNMILNLLRIEAISPEFMLERCFHQFQNAASVPSLEKELMSLQQERDSTSIADESTVKDYYQIRQQLSAYTRDMRTVIQHPNYSISYLQPGRLVQIYNPKDKNESIAGNGTDFGWGVIVNQTPRRAPKLNEPEYIPQEAHVIDVLLPISRSSADFHPGHPAEEMPPGIKPCNDDDDIKFAVVPCLLTCIKAISQIRLFLPKEGLKSDSDKDTLTKSLMEVKRRFPDGLPVLDPIENMEITDDSFKKLLRKIEVLESRLLANPLHLSPLLPSLWDQYHAKVKLTEKVKETKKSIAKAYSIAQMDELKSRKRVLRRLGFINDAEVVQLKARVACEVSSTEGHELLLSELLFDRFFNEQTPEMCAAVMSCFIFDEKVEAPALKEELQKPYREIQAKARIIAKVSQECKLDVNEEEYAQKLKWQLMETVYTWAQGRPFVEICKMTNVYEGSLIRLFRRLEELLRQMAQAAKVMGNEDLTKKFEESLSKIRRDIVAAQSLYL

SEQ ID NO: 63472 - protein, 262 aa, Bradyrhizobium japonicum USDA 110
MEITGKTKIMFVLAHPVDHVRASAVLNTYFQSIDDDVAVSPLHVLPADLGAVLASVRLMRNVVGFGVTIPHKTGVIEHLDETTPTAALIGAVNFVKRTADGRLIGDNLDARGFVASLAQHQIAVRGRKVLQVGAGGAGRATAFGLAEAGARELTIMNRDGAKAHALAEAVSRRYPETKVNAGRAEARAFDLIVNTTSLGMKTDDPLPLDIEGVGPATAVSDIIVTPEVTRLLEQAAAQGARTIGGKPMLDAQMALVARFIAR

SEQ ID NO: 63473 - protein, 324 aa, Methanosarcina mazei Go1
MMLMTLVDEIKNRSSHVDAAIDELLPVTRPEELYKASRYLVDAGGKRLRPAVLILAAEAVGSNLRSVLPAAVAVELVHNFTLIHDDIMDRDDIRRGMPAVHVKWGEAGAILAGDTLYSKAFEILSKVENEPVRVLKCMDVLSKTCTEICEGQWLDMDFETRKKVTESEYLEMVEKKTSVLYAAAAKIGALLGGASDEVAEALSEYGRLIGIGFQMYDDVLDMTAPEEVLGKVRGSDLMEGKYTLIVINAFEKGVKLDIFGKGEATLEETEAAVRTLTECGSLDYVKNLAISYIEEGKEKLDVLRDCPEKTLLLQIADYMISREY

SEQ ID NO: 63474 - protein, 687 aa, Oryza sativa
MALTTLCQLKLGIVKSSFCFNAATDNDGRAEASRYDDGRRLMVISVSLIAAAAAAAGGGAAILLGALAIGVASRRGRAAAAGGGGEGEERIGDWSASCLAELRVSTNLLHTPNTADHEVRCCSFDRGMSLHCCPAAGDPPAPAGTAEELLERARSLVPAALDAARAATGFGGRWKVIAARLERVPPCLSDLSSHPCFSKNSLCRELLQSVAATLAEAAELGARCREPPRAGKLQMQSDLDALAGKLDLNLRDCALLIKTGVLSDATVPPVAPAAEAAAQTDVRELLARLQIGHAEAKHRAVDGLLDALREDEKSVLSALGRGNVAALVQLLTATAPKIREKAATVLCLLAESGSCECLLVSEGALPPLIRLVESGSLVGREKAVITLQRLSMSPDIARAIVGHSGVRPLIDICQTGDSISQSAAAGALKNLSAVPEVRQALAEEGIVRVMVNLLDCGVVLGCKEYAAECLQSLTSSNDGLRRAVVSEGGLRSLLAYLDGPLPQESAVGALRNLVSSAISPDSLVSLGVLPRLVHVLREGSVGAQQAAAAAICRVSSSSEMKRLVGEHGCMPLLVRLLEAKSNGAREVAAQAVASLMSCLANARDIKKDEKSVPNLVQLLEPSPQNTAKKYAISCLLTLSASKRCKKLMISHGAIGYLKKLSEMDVAGAKKLLEKLERGKLRNLFSRK

SEQ ID NO: 63475 - protein, 561 aa, Oceanobacter sp. RED65
MNENFFSDKYPEGLPATVDVDKYANVVEVFNHSVKKYADRPAFTALGKTLSYSELDQLTADFAAYLQNDTNLQKGDRIAVQLPNLLQYPVVVFGAMRAGLVVVNTNPLYTEREMEHQFNDSGAKALVVLANMAGKADRVVPKTQIEHVIVTQAGDMCSPLKRTLVNFVVKNVKKEVEPFTLPGHKTLLNCLKQGKKSSYSPVSSAPEDIAVLQYTGGTTGVAKGAMLTNRNLVANMCQAHPLFMMGLSKGGDESAKVVVAPLPLYHIYAFTVNCMVLMETGNHNVLIPNPRDLPGFISELKKWKFNAFLGLNTLFVGLCNNEDFRKLDFSNLQLTISGGMALTKAAADRWKEVTGCEVSEGYGMTETSPIVAFNPPGHTQIGTIGMPVSNTVCKVIDEEGNDLPVGEAGELCVKGPQVMKGYWQRPEATAETITEDGWLKTGDMAQIQEDGYLKIVDRKKDMIIVSGFNVYPNEVEDVVAGHPDIVECAAVGVPDDTTGEQVKIFAVTSNPSLTPKDVKDFARERLTAYKVPKMVEFREELPKTNVGKILRRELRDEETSK

SEQ ID NO: 63476 - protein, 217 aa, Gibberella zeae PH-1
MSFRGGSRGRGGSGFGGRGGGRGGFQQRDMGPPAQILEMGKFMHACEGEMVCESINPKVPHFNAQIFLENKTAVGKVDEVLGPINQVFFTIKPTEGIQATSFKEGDKFYIGSEKLLPLDKFLPKPKPPPGAPKLKRAGGSRGGARGGRGGFGARGGGRGGFGGGRGGAGGFSRGGGRGGSSFGGRGGRGGSGGFSRGGGGGGFGGGRGRGGFSRGGR

SEQ ID NO: 63477 - protein, 249 aa, Fusobacterium nucleatum subsp. nucleatum ATCC 25586
MHKTFFEDIGLKDEYKLYEVDETEIDNFKNYMLENSIEGVNITVPYKKIFLDKLNFISDEAKDIGAINLLYIKDNKFYGDNTDYYGFKYTLTKNDIDVKNKKIAIIGKGGASASVDKVLKDMGAKDITFYFRRDKLSKIEFPENMEGDIIINTTPVGMYPNIHDNLVNEEILKNFKIAIDLIYNPLETEFLKIARKNGLKTINGMDMLIEQALKTDEILYDILLSTQLRKKIRKKMKKKVEEFYENNGD

SEQ ID NO: 63478 - protein, 123 aa, Arabidopsis thaliana
  misc_feature (17)..(17): Xaa can be any naturally occurring amino acid
  misc_feature (39)..(39): Xaa can be any naturally occurring amino acid
  misc_feature (68)..(68): Xaa can be any naturally occurring amino acid
  misc_feature (86)..(86): Xaa can be any naturally occurring amino acid
  misc_feature (101)..(101): Xaa can be any naturally occurring amino acid
TSRALATLDGPFTPPKXSPSFPFTRIANNYITFITSNVXRVSFMNVLPPILKNKSDTLSYLPYLTFFXFSKEVDYLFPNKWIPCIXFIFDHLFFFLEHLNXPLYYNLTYFTIYKSYHCSNAPS

SEQ ID NO: 63479 - protein, 135 aa, Zea mays
MRKHRIVSLVAALLVLLALAAVSSTRNAQEESAADNAGMLAGGIKDVPANENDLQLQELARFAVNEHNQKANALLGFEKLVKAKTQVVAGTMYYLTIEVKDGEVKKLYEAKVWEKPWENFKELQEFKPVEEGASA

SEQ ID NO: 63480 - protein, 591 aa, Oryza sativa (indica cultivar-group)
MEEAAEDRRLQVREEGGDQEPLLLLPQDANLYTGDGSVDIKGRPALKHATGNWRACFFILGDECCERLAYYGIAKNLVTYLKTNLHQGNLEAARNVTTWQGTCYLTPLIGALLADSYWGKYWTIAAFSAIYFIGLVALTLSASVPALQPPKCSGSICPEASLLQYGVFFSGLYMIALGTGGIKPCVSSFGADQFDDSDPADRVKKGSFFNWFYFCINIGAFVSGTVIVWIQDNSGWGIGFAIPTIFMALAIASFFVASNMYRFQKPGGSPLTRVCQVVVAAFRKWHTEVPHDTSLLYEVDGQTSAIEGSRKLEHTSELEFFDKAAIISSDDAKSDSFTNPWRLCTVTQVEELKILIRMFPIWATTIIFNAVYAQNSSMFIEQGMVLDKRVGSFIVPPASLSTFDVISVIIWIPFYDRVLVPIARKFTGREKGFSELQRIGIGLALSILAMLSAALVELRRLEIARSEGLIHEDVAVPMSILWQIPQYFLVGAAEVFAAIGQVEFFYNEAPDAMRSLCSAFALVTVSLGSYLSSIILTLVSYFTTQGGDPGWIPDNLNEGHLDRFFSLIAGINFVNLLVFTGCAMRYRYKKA

SEQ ID NO: 63481 - protein, 210 aa, Candida albicans
MPLCGGGQKTIQRKIVILGDGACGKTSLLNVFTRGYFPQVYEPTVFENYVHDIFIDGQSVQLSLWDTAGQEEFDRLRSLSYSDTHCIMLCFSVDSPDSLENVQSKWVGEIADHCEGVKLVLVALKCDLRNNEDIEDQQQSNPYSSQKRLITYEEGLAVAKKVGALRYLECSAKKNKGVNEAFSEAARCALNAKPKGANDNEPQKKGCVVM

SEQ ID NO: 63482 - protein, 355 aa, Oryza sativa (japonica cultivar-group)
MTAMMEVGPVARPTVGERRGVGVMGSAARRRVIGLVSSSVLCPYASDMKASMLADVAGPTAGAVGDADIELVAAGEVAVEVAAGAAGRTVVLTAGEGGEAGRTVDAAKEEEDASHHAAAGSGGKRGGEEDADDHHGDADDHREKRGTPTPTTTMLAARGPLPPLPLPPSPPSTGRRSPSTGRSPPACRHRRSAPPLYSASSAAARSHTASAGRRSAPLATAHSFPAANRSKPTPGRGGGGGPAGRGGREGSAAASTREQGRGVGGGEGEEAAAGVGILAPALALARQRRRTAAWEGVAAGPAVDSQVTKEQDEGLEKLEETVLSTKHIARLIDDLDDHVDVTNSRLQRVQRGLPF

SEQ ID NO: 63483 - protein, 317 aa, Escherichia coli
  misc_feature (132)..(132): Xaa can be any naturally occurring amino acid
MTDKLTSLRQYTTVVADTGDIAAMKLYQPQDATTNPSLILNAAQIPEYRKLIDDAVAWAKQQSNDRAQQIVDATDKLAVNIGLEILKLVPGRISTEVDARLSYDTEASIAKAKRLIKLYNDAGISNDRILIXLASTWQGIRAAEQLEKEGINCNLTLLFSFAQARACAEAGVFLISPFVGRILDWYKANTDKKEYAPAEDPGVVSVSEIYQYYKEHGYETVVMGASFRNIGEILELAGCDRLTIAPALLKELAESEGAIERKLSYTGEVKARPARITESEFLWQHNQDPMAVDKLAEGIRKFAIDQEKLEKMIGDLL

SEQ ID NO: 63484 - protein, 139 aa, Glycine max
  misc_feature (116)..(116): Xaa can be any naturally occurring amino acid
VLANADTPEDALAARNNGAEGIGLCRTEHMVSVFFLFFSFPHLYLGQFFASDERIKAVRQMIMAPTVELRQQALDRLLSYQRSDFEGIFRAMDGLSVTIRLLDPPLHEFLAEGNVXEIVRELCSETGANQEDALARIEK

SEQ ID NO: 63485 - protein, 257 aa, Oryza sativa (japonica cultivar-group)
MTLSEQLSAPDQAIRDFLKIPHDGLGGGDGEGGRIPAAAGASGGGGGVGGMINWKPLRDRLRLRRAASAWMSASPKPAASNSGGGGGGGATLSSSNSGSNHSNKRAAVDGGGHANEDDDEDHTDDDDDDDEEEQGKDDAPAAQMSLMALLEQSDSQWDSEDEDDQGHGGGGGGGGNGGGGGGGGARKNGDGDDDEDDGEGREEEMVHVCCVCMVRHKGAAFIPCGHTFCRLCSRELWVSRGNCPLCNGFIQEILDIF

SEQ ID NO: 63486 - protein, 923 aa, Sesbania rostrata
MMELPDIWILRLAVACALCLYIFLRSASASEEFESIACCADSNYTDPLTTLNYTTDYSWFSDKRSCRQIPEAGLNNRSNENVRLFDIDEGKRCYNLPTIKNKVYLIRGTFPFDSTNSSFYVSIGITQLGAVRSSRLQGLEVEGVFRATKDYIDFCLVKGEVNPFISQLELRPLPEEYLHDLPTSVLKLISRNNLGGSKDDIRFPADRSDRIWKATSSPSSAFPLSFNVSNVDLQANVTPPLQVLQTAITHPERLEFIHNGLETEDYGYRVFLYFLEINRTLKAGQRVFDIYVNNEIKKEKFDVLDGGSNYGYTVLNVSANGSLNVTLVKASESEFGPLLNAYEILQVRSWVEETNQTDVEVIQKMREELLLQNQENKALESWTGDPCILFPWKGIACDGSNGSTVITKLDLSLSNLKGPIPSSVTEMTNLKILNLSHNSFDGYIPSFPLSSLLISIDLSYNGLRGTLPESITSPLHLKSLYFGCNQHMSEEDPANLNSSLINTDYGRCKSKEHKFGQGIVIGAITCGSLLVTLAVGILFVCRYRQKLLPWEGFGGKNYPMATNVIFSLPSKDDFFIKSVSIQTFTLEYIEVATERYKTLIGEGGFGSVYRGTLNDGQEVAVKVRSATSTQGTREFDNELNLLSAIQHENLVPLLGYCNENDQQILVYPFMSNGSLQDRLYGEPAKRKVLDWPTRLSIALGAARGLAYLHTFPGRPVIHRDVKSSNILLDHSMCAKVADFGFSKYAPQEGDSNVSLEVRGTAGYLDPEYYKTQQLSEKSDVFSFGVVLLEIVSGREPLNIQRPRNEWSLVEWAKPYIRASKVEEIVDPGIKGGYHAEAMWRVVEVALQCLEPFSAYRPCMVDIVRELEDALIIENNASEYMKSIDSLGGSNRYSIVIEKRVLPSTTSTAESTITAQSLSHPQPR

SEQ ID NO: 63487 - protein, 1476 aa, Neurospora crassa
MASTTQIKTPQEAVARIAYLASDVVVSVQPSLAAESDFSATLKSLASSRTQSLVAKAADAVTEIIPVRHNNDPLLSVFTPIRSGRLVSVTTTSEVLLPSIAHLYKLAQLPVVLHVALGPKSLPDYTAITSIRNSGWTFLQSNSLQEAQDLALTAHALAVQSGKGVIHFFDPSSSASEQPIAAEDLSLVQEILNLDNVRRFQSASISGSSIYANDGRVAVVSEQSEPVASQTVLDARQVEAATATATDSLAPAQDGSDDAFEYSGPSNAENALFVFGSGSPLFAQAIAQAQSDDSFAKAGVLTARLYRPWLGAKLLEAIPKSVKRVAVLEQVSRKTTKWGPLLIDVLTSVKSGPGGVQTIVGHQLGYISQETVVQALRGIFQNLTSEKPVQNLEVGEREAPKEASEYGLEKPKLETAYTKILDQLFGERAYIANSIEKDNAGISNTISATPEYGFGALLARKERKQKFVSEVKEAASNGQFSSDAPKQALAKWVANAEDSKKVEEVASEAVSKLSEDGSDLSKSLLEYKQFFRKQSLWLVGSDAWSYDLGNSGVHHVLASGENVNLLIIDSTPYSERAAADANRRKKDIGLYAMNFGNAYVASTAVYSSYTQVLQAMDEADKFNGPSVVLAYLPYFGEHDSALTVLQETKKAVDIGYWPLYRWNPENEKKGEPSFSLDSERIKKELKEFLDRDNHLTQLMKKEPSFGAVLSEDFGTEIRAQQKRKAKDAYNQLLEGLFGAPLTILYASDNGNAISLSKRLGNRGRARGLKTTVMSMEDYPVEDLATEENIVFITSTAGQGEFPQNGLSFWHAVKDNTSLDLANVRYSVFGLGDSHYWPRKEDKIYYNKPAKDLDRVLANFGAKPLAPIGLGDDQDPDGFQTGYSEWEPKLWEALGVANVDGLPEEPAPRTNEDIKIESNYLRGTIVQGLNDTSTLAISPDDCQLTKFHGTYMQDDRDIRDERKAQGLEPAYSFMIRCRLPGGVSTAKQWVQMDDIANELGNETMKLTTRQTFQFHGVVKSKLKPAMQAINRALMTTIAACGDVNRNVMCSPLPAHSKYHRAVHACAKRISDHLLPNTTAYHEIWLTDDDGAKTQVGGNAVQDFEPLYGPTYLPRKFKVSIAIPPHNDVDVYAHDIGLIAIKNEDGSLAGFNLLAGGGMGATHNNKKTYPQTGRMLGFVTAADVHLACEKVMLVQRDNGDRKNRKHARLKYTIDDMGVDVFKAKVEEYWGQKFEEPRAFHFDSNVDTFGWTKDETGLNHFTMFIENGRIEDTAEFQMKTGLREIAKVHKGEFRLTPNQHLILSNVADEDKPELEKLLAQYKLDNLHHSGLRLSSSACVAFPTCGLAMAESERYLPVLITKLEGVLEEVGLKQDSIVMRMTGCPNGCARPWLAEVAFVGKAYGAYNMYLGGGYHGQRLNKLYRSSIKEEEILTIMKGLLRRYAKEREEGERFGDWTIRAGIIKATTDGRNFHEGVSEIF

SEQ ID NO: 63488 - protein, 884 aa, Methanosarcina mazei Go1
MSKFVYFFGKDVTDGKSSMKDLLGGKGANLAEMANLGVPVPPGFTISTEVCVLYLKEGKYPEEVLRQVEEAIDKLEKLNGKKLGDPEDPLLVSVRSGARVSMPGMMDTVLNLGLTDKSVIGLANKVNDERFAYDCYRRFIAMFGDVVLGVEFRKFDSLIDDKKKELGVKSDTDLDSKALQELAERFKEVIKLEKGFEFPQDPKVQLQMAINAVFDSWNNQRAITYRKLNAIDDSWGTAVNVQTMVYGNRGNTSGTGVAFTRNPSTGEKKFFGEYLINAQGEDVVAGIRTPDYIDTLGNKIPEAYAQLVDICQKLEAHFKDMQDIEFTIQEGKLYMLQTRTGKRTAAAAVKIATEMVAEGLINKETAVKRVNAEHIDLLLHPRIDPKAKLEVIAKGLPASPGAAVGKVVFTAEDAEEMAENGEKTILVRTETSPEDIGGMAAAQGVLTVRGGMTSHAAVVGRGMGKPCVVGCGEISIDMKNALFMVNGFTIKEHDYITIDGSVGSVIIGKVDLIDAEINEDLKKLLIWADKIRTLGVRTNADNPADAALARELGAEGIGLCRTEHMFFGEDRIPAVREMIMAEDEKSRKKALKKLLPMQKEDFLGIFRSMEGLPVTIRLLDPPLHEFLPDKEELDTKLRELETSGDCGKIDGVKKVIQRVVSLKELNPMLGHRGCRLGITYPEIYNMQVRAIMEAACELTAEGMEVVPEIMIPLVGIVKELSLSREEVCKTAEAVMAEKGMKIDYKVGTMIELPRAAIVADQIAKEADFFSFGTNDLTQTTFGFSRDDVSKFVPIYQKAGILEHDPFAVLDQEGVGEIMKIGISKGRSVKPKLKMGICGEHGGEPKSIAFAHEIGIDYVSCSPYRVPIARLVAAQSTMEMRDAKK

SEQ ID NO: 63489 - protein, 408 aa, Bradyrhizobium japonicum USDA 110
MPGLNRTRDTTLRARAEKVVPGGMWGHLHAAKLPDGYPQFFRRGEGGVLWDVDGNRYVDFMCSWGPNLLGHHHPEVEEAAERQRREGDCLNGPAEVMVELAELVVDMVGHADWTQFQKNGTDATTTCVTIARAATGRRKILVAKGAYHGAVPWCSPSLLGVTAEDRAHLAYFTFNDVESLEVAAKAAGDDLAGILVSAYRHDLGLDQELPTVEFAHAARRICDDRGAALIIDEVRAGLRLNAAGSWEGLGVRPDLSAWSKAIANGYALAAVTGANWLRGAASQVFVTGSFWAGAVAMAAAVATLKIVRRDNVPSRLAQLGQMLREGLETRSRQFGVSIRQSGPAQMPTLLFDQDPAYRKGSAFCSAMLARGVYFHPKHNMFLCAAHTEADIAEALQAAEHGFAVVAGL

SEQ ID NO: 63490 - protein, 627 aa, Oryza sativa (japonica cultivar-group)
MAAAAAVAKSVEAGGEPGGGGGGAWSTVSRSGRSSYSAGGGVGGGKVGELAEGLAGVEIGGERRLDKYDIPVEVSGEDVPPPADGFEAAGLVEAVLRNVARCGYESPTPVQRYSMPIALAGRDLMACAQTGSGKTAAFCLPVVSGLVAAGGSGIGHRERSSFNRAAAKPRALVLAPTRELAAQSFDNVIFIDTVNQNFSLFCYEELDNINEEAKKFSFQTGLRVVVAYGGTPMYNQLRDLERGADILVATPGRLVDMVERSKVSLEAIKYLVMDEADRMLDMGFEPQIRKIVERMNMPRKSVRQTMLFSATFPPEIQRLASDFLSNYIFITVGRVGSSTDLIMQKVELLSDGEKRGYLLDLLQRQSVGVANSKLQQPLTLVFVETKREADSLRYWLYSKGFPATAIHGDRTQQERESALRSFKTGLTPIMVATDVASRGLDVPNVAHVINYDLPKSIEDYVHRIGRTGRAGKAGSATAFFTESDHSLAKGLLELMTEAKQDVPDWLVQYAERPYYGGSSYGGRNRRSGGGGNRFAGRDFRQGSGGGYSGGGGGGGYSGGGGGGGYSGGGGGYSGGGRGGGYSRGGRGGYSGGGGGGGGDPYRASAPPPRYYPSYPMGTADINASGWD

SEQ ID NO: 63491 - protein, 148 aa, Spinacia oleracea
MEQTFIMIKPDGVQRGLVGEIISRFEKKGFSLKALKFVNVDRPFAEKHYADLSAKPFFNGLVEYIVSGPVVAMVWEGKGVVATGRKLIGATNPLASEPGTIRGDFAIDIGRNVIHGSDAVDSATKEIALWFPDGVVHWQSSLHSWIYE

SEQ ID NO: 63492 - protein, 292 aa, Magnetococcus sp. MC-1
MFKGVYTALITPFKNRAVDYTALAKLVEQQINGGIHGLVPCGTTGESATLSHEEHKAVIRTVVELVQGRVKVLAGTGSNCTEESTELTCYAEEVGADGALLITPYYNKPTQAGLIAHYTTVANHTKLPVVLYNVPGRTAVDMHADTVIALSKVSNIVAIKEATGNMERASQIHKGAGSSMTLISGDDATFLPFLSVGGQGVISVTTNLAPRLVRDLWDLWHNGQINEAREVHEQLLEINGLLFCETSPIPVKAGAAMLGLCHNELRLPMTAMSEANQAKLHRAMVKLNLLEE

SEQ ID NO: 63493 - protein, 446 aa, Glycine max
MVIINLGKKKSEREGMRLGKYELGRTLGEGNFGKVKFARNTDSGQAFAVKIIEKNKIVDLNITNQIKREIATLKLLRHPNVVRLYEVLASKTKIYMVLEYVNGGELFDIIASKGKLTEGECRKLFQQLIDGVSYCHTKGVFHRDLKLENVLVDNKGNIKVTDFGLSALPQHLREDGLLHTTCGSPYYVAPEVLANKGYDGATSDTWSCGVILYVSLTGYLPFDDRNLVVLYQKIFKGDAQIPKWLSPGAQNMIRRILDPNPETRITMAGIKEDPWFKKGYIPANPEDEDVHVDNEAFSSHEEPNEAEQRNSGSPTLINAFQLIGMSSCLDLSGFFEKEDVSERKIRFASILSVKDLIDRIEDTVTEMEFRVEKKNGKLKVMRENKVHKTLGCLSVVVEVFEISPSLYVVELRKSYGDGSVYKQLCKKLLNDLGVPPKQGLVRSAAN

SEQ ID NO: 63494 - protein, 933 aa, Oryza sativa (indica cultivar-group)
MVTPSDFESDGLLNTWKICTVTQVEELKILIRMFPVWATMILFAAVLDNMFSTFIEQGMVMEKHIGSFEIPAASFQSIDVIAVLILVPVYERVLVPVFRKFTGRANGITPLQRMGIGLFFSMLSMVSAALVESNRLRIAQDEGLVHRKVAVPMSILWQGPQYFLIGVGEVFSNIGLTEFFYQESPDAMRSLCLAFSLANVSAGSYLSSFIVSLVPVFTAREGSPGWIPDNLNEGHLDRFFWMMAGLCFLNMLAFVFCAMSAYHCIEIRKLVSLRYKLCTKDKKRSLNTYRYESPFDMTISRNTFLNDRAHHPDREYFLQQELPKKQFKAEHLSSWRVQQPFRAAKGAFMGSSLEAEQQSLIVRTTEPEDVDDYTGDGSVGFSGQPILKHETGNWRACSLILGTEVCERLAYYGISKSLVTYLSTRLHEGNVSAARNFTTWQGTCYLTPLIGATLADSYWGKYKTIAVFSTIYFLGMAALTFSALVPSLQPPQCFGSFCPQPTVPQYLIYFVGLYMIALGSGGIKPCVSSFGADQFDDTDPVERTKKGAFFNWFYFAINIGSLISGTVLIWVQQNCGYGIGFGIPTIFIALAIGSFFIGSQRYRYQIPGGSPLIRVCQVVVAAIHKRNVDLPVDSSVLYELHGKTSAIEGSRKLEHSSEFSFLDKAAVILSNERGGSHDPWRLCTITQVEELKILMRMFPIWATGIVFFTVCAQNSSMFIEQGMALNNQIESFKIPPATLSSLDVISIVVWVPIYETFVVPIASRLTGKERGFSELQRMGIGLFVATTAVATAALVEIKRLEIARSEDLIHSKVPVPMSILWQAPQYLLVGIGEVFTAIGQAEFFYNQSPDSMRSLCSAFALVTVSLGSYLSSFILTLVSYFTTRDDNPGWIPDNLNEGHLDRFFWLIAGLSFLNLLLFVYYAQQYKCKKAAAI

SEQ ID NO: 63495 - protein, 492 aa, Oryza sativa (indica cultivar-group)
MVLSKAVSESDMSVHSTFASRYVRASLPRYRMPENSIPKEAAYQIINDELMLDGNPRLNLASFVTTWMEPECDKLIMAAINKNYVDMDEYPVTTELQNRCVNMIAHLFHAPLGEDETAVGVGTVGSSEAIMLAGLAFKRRWQNKRKAEGKPFDKPNIITGANVQVCWEKFARYFEVELKEVKLRDGYYVMDPEKAVDMVDENTICVAAILGSTLNGEFEDVKLLNDLLDKKNKETGWETPIHVDAASGGFIAPFLYPELEWDFRLPWVKSINVSGHKYGLVYAGIGWCIWRNKEDLPEELIFHINYLGADQPTFTLNFSKGSSQVIAQYYQLIRHGFEGYRNIMENCHENAMVLKEGLVKTGRFDIVSKDEGVPLVAFSLKDRSRHDEFEISDMLRRFGWIVPAYTMPPDAQHVTVLRVVIREEFSRTLAERLVLDIEKVMYQLDALPSRLMPPVPPAPLLVVAKKSELETQRSVTEAWKKFVLAKRTNGVC

SEQ ID NO: 63496 - protein, 604 aa, Wolinella succinogenes DSM 1740
MCSICGGTIKPSLIQKASDTMRHRGPDARSFWSDGKISLAHNRLSILDLSEAGNQPFGDERYRLIFNGEIYNFQELSSDYGLRLQSSSDTEVLWRLLILEGERILPRLNGMFSFLFYDGHKGEILMARDRFGKKPLFYFHEGKELGVASEIKALRAILGEKGALDQGALLDYLSYLAPCGEKSFFPTIHKLPAGCLARFSLSEGRLEKSSFYSLPSAPSRENIEEKEALRKIEELLVESVRYRLLSDVPVASFLSGGIDSSLISALYARLSPCSIETFSIGYDEYKHYDELPYAREVASHIGSIHHEKIATRKDFLEAFEEVLPILDEPLGDPAIIPTYLLSKEVAKSGFKVVLSGEGSDEIFFGYDGYFDSLKLLWLENSLGLKEKAILLDYHRKSEHGGKEWERLRRLLMDEKPYFRGINESWTPGQRARLFKQEPAWRDPILETFQDFPSKEGEGWYSYIDLKHWMAEVLMSKMDRMSMAHSLESRAPFLDYQLVDFVLSLPSSLRTGEITKNLLKKIALAYLPDSIVNRRKKGFSSPMFEWYFEAYQGRILEDYQRVNRELGWFEDSYLKFLYEKGRMGEYKSQNWGMILFSRWFLIHCG

SEQ ID NO: 63497 - protein, 554 aa, Gibberella zeae PH-1
MSNSSSRDEPYTMEPSTKKTIWQCIRENPKIIFIAFFASLGGFEYGYQQGVLGQSLVMTRFTQNFPSVVESSSATGWLTSILQLGGILGSLSAGVSSEIISRKYTMFIACCWVVLGSYLYVGATAGNPSLLYAGRFFTGLGVGLFSGVGPLYNAELSAPEMRGFLVSFYQLATILGIMLSFWVGYGCNYIGGTGDGQSDLAWRLPSIIQGIPAAILAVGIWFMPFSPRWLVKVGRDEEAKSTLAWMRKLPIDSDRVQVEYLEIKAEAVFEQKVFARDFPHLAEKGKSKFRQEIAQYVTCFRSMDNFKRVCTAWLIMFFQQWSGIDAIIYYASNVFISLGLTGGTIALLATGVTGVVFLISTIPAMFIIDRVGRKPMLQVGSIVMGASMITVGIIVAKFRHDWPSHVAAGWTAVALIWVYIAGFGATWGPVSWTLISEIFPLSIRAKGASIGASSNWLNNFAIAFFVPPMLEAWEWGTYIFFAVFLFAGILWVWFFLPETKNASLEEMDRVFKSRAGEQDAELLREAQAEVGLLGSVSGRKASMEKQGEKHVEEL

SEQ ID NO: 63498 - protein, 606 aa, Wolinella succinogenes DSM 1740
MCGILGYLRKGSAGQSQLSCEQFNQILSKIAHRGPDHQDFVWFNEPEYQLYLGHVRLSIIDLDERASQPMLFKDRYLLVFNGEIYNYRELKEKLLLQGYGFATQSDSEVLLAAYDFWGETCVEHFNGMWAFAIYDKKRHSLFCSRDRFGVKPFYFYENEEIFVFASEIKALLPFFKEAKLNPKVILPYLARGFLDGGSETFFDGVYRLEASSNLFYDLRGKQKSFQTYYSILLNPLSAKEREIPSSAKELLSLLRQSVSLRLRSDVRVGACLSGGLDSSGVAALASQQYDFGEKLVAIHAKSSLKESDESSYAIEVANHLGLDLHMVEPSFEDFCESLDDLFYTQEEPFGSTSMFMQYFVMKKAKELGCKVMLDGQGADEVFLGYEHYFHNIFKDLRDRKFFLENDFFKDLKTFRYTKEQILEELKKADDAGVAWDVIKNRGNICSRYLCREWLDSYIAPVKTIQEFQKREIFYNHLPSLLRYEDRDSMRFGIETRLPYLDYRIVEWVLALPTEVKFQQGYLKFALREALEISGLLPKSIVWRYNKMGFESPQKLWIDRYRFEMMKVIEGSEIIRDIFFKVDIRRDDFLWKLFSIAKWEKMFNVKL

SEQ ID NO: 63499 - protein, 178 aa, Oryza sativa
MEGEDAVVPEAVAADAEKAEEKESGSRMITLKSNEGKAFVVTEVSARQSTTIGHMIDDDCTRGAVPPPNVDSKTLEKVIEYFDEHANNKADTDDEKAALDKFDKDFIGELDGDKAFLFHVTMAANYLHAQGLLDLTTQCIADTIKGKTPEEIRTAFNIAYDLTEEDQEEIKEEDAWAF

SEQ ID NO: 63500 - protein, 113 aa, Triticum aestivum
HSITSLYKKAGWYRSGIPGISSTHASGAIAKYPKVHEFLRVKDRYDPEGLFSNEWTDKVLGINGSPNIIKKRCAIEGLCICSTNSHCAPEQGYFCRPGKVYKEARVCSFFKNY

SEQ ID NO: 63501 - protein, 593 aa, Neisseria meningitidis
MALVELKVPDIGGHENVDIIAVEVNVGDTIAVDDTLITLETDKATMDIPAEVAGVVKEVKVKVGDKISEGGLIVVVEAEGAATAPKAEAPATPAQEAPKAAAPAPQAAQFGGSADAEYDVVLGGGPGGYSAAFAAADEGLKVAIVERYKTLGGVCLNVGCIPSKALLHNAAVIDEVRHLAANGIKYPEPELDIDMLRAYKNGVVSRLTGGLAGMAKRRKVDVIQGDGQFLDPHHLEVSLTAGDAYEQAAPTGEKKIVAFKNCIIAAGSRVTKLPFIPEDPRIIDSSGALALKEVPGKLLIIGAGIIGLEMGTVYSTLGSRLDVVEMMDGLMQGADRDLVKVWQKQNEYRFDNIMVNTKTVAVEPKEDGVYVTFEGANAPKEPQRYDAVLVAAGRAPNGKLISAEKAGVAVTDRGFIEVDKQMRTNVPHIYAIVDIVGQPMLAHKAVHEGHVAAENCAGHKAYFDARVIPGVAYTSPEVAWVGETELSAKASGRKITKANFPWAASGRAIANGCDNGFTKLIFDAETGRIIGGGIVGPNGGDMIGEVCLAIEMGCDAADIGKTIHPHPTLGESIGMAAEVALGTCTDLPPQKKK

SEQ ID NO: 63502 - protein, 489 aa, Xylella fastidiosa Ann-1
MVPQARCMMSFACVGLGGEDRRGIARDAGIFWCVVRGITGIGGVSDACLPVLAGVGTAWRCSQAVAVIGGRLVGWTLGVYLLPDEPGQWPFVSIKEIEMSIVRMTDLALSGKRVLIRQDLNVPIDQGRITSEQRIIASLPTIRVALERGAAVMVTSHLGRPKEGVWSEEDSLAPVAKRLSQLLGIEVPLRRDWVDGVQVAPGQLVLLENCRMNVGEAQNDEALARKYAALCDVFVMDAFGTAHRAQASTHGVICCAAIAAGGPLLMAELDALSRGLKHPVKPLLAIVGGSKVSTKLELLSNLVNNVEQLITGGGIANTFLAAAGYSIGKSLYEADLIETAREIIIVAKARGAEIPLPTDVVVAKQFLPGVTATVKTVDAIVADDLILDIGPQTARHYAALIETAATVVWNGPVGVFEFDAFSKGTEVLARAVAASSAFSIAGGGDTLAAIDKYGVADQISYISTGGGAFLEFLEGKTLPAVAALQARSG

SEQ ID NO: 63503 - protein, 321 aa, Thermoanaerobacter tengcongensis MB4
MKTIGILTSGGDAPGMNAAIRAVVRTGIYYGLKVKGIMRGFAGLVEDEVIDLGLSSVGDIIQKGGTILRTARCEEFKQKEVRKKAYETLQKHGIEGLVVIGGDGSFRGAQLLSEEWNVNTICIPGTIDNDIPCTDYTIGFDTACNTVIDAINKIRDTATSHERANIIEVMGRNSGYIALYAGVAGGAEMIILPEVEWSIDELCDKITYGIKRGKLHHIIVLAEGVMSAPELAKMIKERLPKLDLRYTILGHIQRGGAPTVMDRVLASQMGARAVELLLENKTKRVISIRNNQIVDDDIDEALSMKKEFNRKLYELSKILSI

SEQ ID NO: 63504 - protein, 106 aa, Oryza sativa
EDLQLQAKAKKGGKGAADAAKTPVLSKELKSTTVFGANILKEGSDPKLQPDSEYPEWLWHLLDKRPMLSELRRKDAKTLPYEDLKRFVKLVNRARIKEQNALTAKN

SEQ ID NO: 63505 - protein, 287 aa, Glycine max
MAPAMRIVFGLLTFVTVGMIIGALSQLAIIRRLEDSYGTDSLPFRRLRGLDTDRHLQLPRGVPFWNNDKEAEILRLGYVKPEVLNWSPRIILLHNFLSMEECDYLRALALPRLHISTVVDTKTGKGIKSDVRTSSGMFLNSKERKYPMVQAIEKRISVYSQIPIENGELMQVLRYEKNQYYKPHHDYFSDTFNLKRGGQRIATMLMYLSDNIEGGETYFPLAGSGECSCGGKLVKGLSVKPIKGNAVLFWSMGLDGQSDPNSVHGGCEVISGEKWSATKWLRQTTHT

SEQ ID NO: 63506 - protein, 403 aa, Arabidopsis thaliana
MGFFGRLFGSKKKSDKAASSRDKRRWSFTTRSSNSSKRAPAVTSASVVEQNGLDADKHAIAVAAATAAVAEAALTAAHAAAEVVRLTSGNGGRNVGGGGNSSVFQIGRSNRRWAQENIAAMKIQSAFRGYLARRALRALKALVKLQALVRGHIVRKQTADMLRRMQTLVRLQSQARARASRSSHSSASFHSSTALLFPSSSSSPRSLHTRCVSNAEVSSLDHRGGSKRLDWQAEESENGDKILEVDTWKPHYHPKPLRSEKNNESPRKRQQSLLGPRSTENSPQVGSSGSRRRTPFTPTSRSEYSWGCNNYYYSGYHPNYMANTESYKAKVRSQSAPKQRVEVSNETSGYKRSVQGQYYYYTAVEEESLDVGSAGYYGGGGGDSDRLNRNQSAKSRMHSSFLV

SEQ ID NO: 63507 - protein, 655 aa, Magnetococcus sp. MC-1
MSTSDLDRLCINTLRMLSVDAIEAANSGHPGLPLGAAPMAYVLWSRIMRHNPKNPLWPDRDRFILSAGHGSALLYALLHTSGYDVSLDELKNFRQYGSKTPGHPEYGHTPGVECTTGPLGQGFAMGVGMALAERHLAQQVNRAEFHPIVDHFTYGIVGDGDLMEGITYEAAAMAGNLCLGKLIYLYDDNGISIEGSTEIAFTEDVTTRFEAAEWQVLTVEDGEDLDAIEAAILQAQQEEERPSLIRVKTVIGRGSPKQGTAATHGSPIKGADMVATRQVYAWPETRFYLPDEAQSHFAQMVKRGAEAEAEWNATREIYMSRFPTETELLLERLAGELTDGWDRSLDELTFAPSAATRSTSGQCLNAIAQDLPGLIGGSADLGPSNNTTLKHFPERTLHFGVREHAMGAVLNGLALHGGFHPYGGTFLVFSDYLRGAIRLSALMHLPVTYVLTHDSIGVGEDGPTHQPVEHVASLRAIPGLNVFRPCDGEETRAAWHWTLCHKAPAAMILTRQELPELGGGEGVMEGVARGGYIKVDCQGTPDLILLASGSEVSLAVAAAAQLSAKGHQVRVVSMPCMERFDVQDAAYKESVLPAAVATRLAVEAGSTMSWYKYVGLEGEVIGLDNFGASGPGDTLMEVYGFTTENVVAQAQELLG

SEQ ID NO: 63508 - protein, 155 aa, Brassica napus
MSLASPRILNPSSSSSTTSSSFRFSAIKPCVFVIRCSQAEGPLRRPSAPPTLREPSPPPPSPPLQKSVAVDGEGVTTVEFQRQKAKELQEYFKQKKLEASGQGPFFGFQPKNEISNGRWAMFGFAVGMLTEYATGSDLVDQVKILLSNFGIIDLE

SEQ ID NO: 63509 - protein, 681 aa, Lactobacillus sakei subsp. sakei 23K
MADKKPTFYVTTPIYYPSGKLTIGNSYTTIAADVIARYKRLMGFDVFFLTGTDEHGLKLEQKAAEKNLAPQAYVDGMAEEIQALWKTLEISNDKFIRTTDDYHVKAVQKIFDRLVEQGDIYLGQYEGWYSVSDEEYFTESQLTEVYKDENGKVIGGKAPSGHEVQRVAEETYKFKMSKYADRLLAYYEEHADFIEPSSRKNEMINNFIKPGLEDLSVSRISFDWGIHVTGNPKHVVYVWLDALSNYITALGYGSDDDQLFNKYWPADVHLVGKEIVRFHAIYWPIFLMALGLPLPKQIFGHGWLLMKDGKMSKSKGNVVYPEMLVERYGLDALRYYLMRAIPFGNDGVFTPEDFVSRINYDLANDLGNLLNRTVAMINKYDDGHVPSYQADVTAFDADLQATATQTIAQYSTLMDQLKFSDALDTIWQLISRANKYIDETEPWVLAKDDSRKAELDSVLAHLAESLRIVALLLQPVMTHAPREMFAQLGLDFDQEAQREMVYGRFPSDIKVIAKGTPIFPRLDLDEEVAYIKEQMMAAQKAGLVNEKVKAKQVAAEEVADFDPKATELVSEKDAIKFEDFDQSEIRVAEIKAVSKVEGADKLLKFRLDAGDQGDRQIISGIAEFYPDFEKLVGKKVLAVTNLKPRKLRGELSQGMLLSAEHGSDVELVVVPSNLVNGSQIG

SEQ ID NO: 63510 - protein, 442 aa, Medicago truncatula
MIRPTGITLFTHLARRSLFRAKDSVYQVVFQRGYRTFNSSSSVIGSSYTRNVRDGVNLKNWLLLGAANSYFGASRSIHGSASLARSYYDVLGVSKDASSSEIKKAYYGLAKKLHPDANKDDPEAEKKFQEVTLAYEVLKDGEKRQQYDQVGHDAYVNNQSGGFGGNGGFNPFEQMFRGGHDIFSSFFHQKFGGEDVKTVVELSFTEAIQGCTKTLSFQTDVLCNACGGSGLPPGTKPETCKRCKGSGVMFVQTGIFRMESTCATCKGTGKIVSSFCKSCQGAKVVKGTKSVKLHTYPGIDNNETLKVYGGGGADPDGSRSGDLYATIKVREDPVFRREGLDVHVDAVLSFTQAILGATIEVPSFTGSVMLKVHPGTQPGQKVVMKGKGIMKGINTFKYGDQYVHFNVSIPTNLTERQRELIEEFAKEEQEESDKRKAASASS

SEQ ID NO: 63511 - protein, 429 aa, Listeria innocua Clip11262
MQNYIKSEKAFKEAKKVLPGGVNSPVRAFNSVDASPVFMDHGKGAYITDVDGNEYIDYVLSWGPLILGHADPSVVNAITNSAMKGTSFGTPTEIETELAKLVIERVPSIEIVRMVSSGTEATMSAIRLARGYTKREKILKFEGSYHGHGDSLLIKAGSGVATLGLPDSPGVTKGLAADTITVPYNDVEGAKLAFEKFGEEIAAVIVEPVAGNMGVVPPIDGFLEGLRELTTEYGALLIFDEVMTGFRVDYYSAQGYYVVTPDITCLGKVIGGGLPVGAYGGKKEIMEQIAPAGSIYQAGTLSGNPLAMNAGFETVRQLTPQHYDVFRSLIKRMEEGLTEISNRHEVPLSINKAGSMFGFFFTDQKVTNFDTAKTSDLEFFRNYYREMLAQGIFLPPSQFEGVFISTMHTEKEIDATLEAFDVTCKMLRG

SEQ ID NO: 63512 - protein, 593 aa, Kluyveromyces lactis NRRL Y-1140
MYGNQQNNSNPYQMSYYRMNNGQGQGTNRWPQQLSHQEMLAGHSQQILNNNKPAGNQSKPPIVMASNNVFSIGPYRQRKDSSRISVLQKYEIIGYIAAGTYGKVYKAKARDYQNGMNRDNVIILDSPDSVSADSNLDINSINRSTRQQEANDNLTTMDFRKPSHKRFTPPNNSNSTQIRSNSGSETNVRINSSSITNNSRKPSQIQFYAIKKFKTEREGVEHYTGISQSACREMSLCRELDNNHLTKLVEIFLEKKSIYMVSEFAEHDLLQIIHFHSHPEKRLIPPRMLKSIMWQILDGVSYLHQNWILHRDLKPANIMVTVDGCVKIGDLGLARKFNNMVQTLYTGDKVIVTIWYRAPELILGARHYTPAIDLWAVGCIFAELIGLRPIFKGEEAKMESKKSVLFQANQFQKILEVMGSPDHKIWPNIDSYPEYLQLAKMPKYRDNLTAWYQTAGGKDKTALDILYRLLQYDPIKRIDAIDALDHVYFTNGDPPVCENVFEGLNYKYPPRRIHTNDNDITNVGNDNNQANHSQKQPMHGNNNNKNGNMNGLGVNKRILAAAAAAAAAAAVSGNGNNPTSNTATGGSARKKRK

SEQ ID NO: 63513 - protein, 268 aa, Arabidopsis thaliana
MSSDSSREENVYLAKLAEQAERYEEMVEFMEKVAKTVETEELTVEERNLLSVAYKNVIGARRASWRIISSIEQKEDSRGNSDHVSIIKDYRGKIETELSKICDGILNLLEAHLIPAASLAESKVFYLKMKGDYHRYLAEFKTGAERKEAAESTLVAYKSAQDIALADLAPTHPIRLGLALNFSVFYYEILNSSDRACSLAKQAFDEAISELDTLGEESYKDSTLIMQLLRDNLTLWTSDLNDEAGDDIKEAPKEVQKVDEQAQPPPSQ

SEQ ID NO: 63514 - protein, 515 aa, Arabidopsis thaliana
MAIEGEKEKPSKRTTNPGVRVVGGRIYDSSNGKTCHQCRQKTMDFVASCKAMKKDKQCTINFCHKCLINRYGENAEEVAKLDDWICPQCRGICNCSFCRKKRGLNPTGILAHKAKASGLASVSMLLEVEGHDNFAYQKKPKLVLKTITQILIFVNLALNVLLCLLDQYDVAKDKKKVVGKSKKANATHKLKEEIQFEAQLPQGISLISVSGVVIPTEEAGNVFQLFEFCSAFGKALELKEGQAETVVRELFSCGRNTRRQQYCSIIQLMIQLLDLISKDREMSLSLSVSDNWFTALGEILLQSEVLSDEFPPETFETGVAEYEKMDASRRLKLLNFVCDESLSTWAMRNCIKSQSTECKANNNEAKRKAAAAKEKEKQLKQKLQGDLAKAIMKKNGAPLSIEEHNEILSQIRAEAKEAHDGMMEAKGITSGMTRICDARRTEPIMVEDNGLVLWKLNCYDEEPKFLLQDLGTFDGLCSHEKWLAFKPEQKPDIENYISYKRRKVMQTLKNTNVVA

SEQ ID NO: 63515 - protein, 333 aa, Streptococcus pyogenes MGAS315
MMSETKLMALREAVNLAMTEEMRKDENIFLMGEDVGVYGGDFGTSVGMIEEFGPKRVKDTPISEAAISGAAIGAAITGLRPIVDVTFMDFLTIMMDAIVNNGAKNNYMFGGGLITPVTFRVASGSGIGSAAQHSQSLEAWLTHIPGIKAVAPGNANDAKGLLKSAIRDNNIVLFMEPKALYGKKEEVNQDPDFYIPLGKGDIKREGTDLTIVSYGRMLERVLQAAEEVAADGINVEVVDPRTLIPLDKELIIESVKKTGKLMLVNDAYKTGGFIGEIATMITESEAFDYLDHPIVRLASEDVPVPYARVLEQAILPDVEKIKAAIVKMANKGN

SEQ ID NO: 63516 - protein, 469 aa, Streptococcus pyogenes MGAS315
MAFEIIMPKLGVDMQEGEIIEWKKQEGDTVNEGDILLEIMSDKTNMELEAEDSGVLLKIVRPAGDTVPVTEVIGYIGAEGESVDTIASSEKTTEIPVPASADAGPAVAPKENVASPAPQVAATAIPQGNGGKVRATPAARKAAAEMGIDLGQVPGTGPKGRVHKEDVENFKGAQPKASPLARKIAADKGIDLATVSGTGFNGKVMKEDIMAILEAAKPAEAKAPAAKEEKVVDLPEGVEHKPMSAMRKAISKGMTNSYLTAPTFTLNYDIDMTEMIALRKKLIDPIMAKTGLKVSFTDLIGMAVVKTLMKPEHEYMNASLINDANDIELHRFVNLGIAVGLDDGLIVPVIHGADKMSLSDFVLASKDVIKKAQTGKLKAAEMSGSTFSITNLGMFGTKTFNPIINQPNSAILGVGATIPTPTVVDGEIVARPIMAMCLTIDHRLVDGMNGAKFMVDLKKLMENPFELLI

SEQ ID NO: 63517 - protein, 413 aa, uncultured Acidobacteria bacterium
MPGARILSRQNRAVQGQLVARRRSTDIVQLKFTLVAGPVPIIMSNHTRTDIAESERHELEHTLERLGHPRFHARQIFQWVYKRGITDFALMSDLGRDLRAQLAESCVITTPVVERQERSQDGTVKFLLRLADGRHIESVFIPDETPAGPDGSPRAARITFCVSTQVGCAMKCAFCLTGKMGIDRSLTAGEIAGQVRVLARELGFLETRFNIVLMGMGEPLHNYEETMKALRVLADEHGFAMSARRMTLSTVGVLPALERLATEPLMPNLAISLHATTEDQRDLLVPINRKYGLKELLDACRRFPLKRRERITFEYVLLREVNDTPEDARRLVKLLHGIKGKVNLLPLNEAAGIPFERPSDDRVNSFARILADHGIPVSVRKSRGRDIRAACGQLITESDRKAPGARLAMLMDQ

SEQ ID NO: 63518 - protein, 501 aa, Azoarcus sp. BH72
MDATSLLIRFGLSPETLHGGELEVRSPIDGRTVAQLRPASHRETDAAIGRAHEAWLEWRTIPAPARGTLVRHYADALRRHKTALAELITLESGKIRQESLGEVQEMIDICDFAAGLSRQLHGLTIASERPGHRLQELWHPAGVVGVISAFNFPAAVWAWNAALAWVCGDTVIWKPSPRTPLTALACASLFNDACATHSQGCEGLLEVLIGGNEPARQLAADRRVAVLSATGSTAMGREIAPVVASRFGRSILELGGNNAAIVTPSADLDLTERAVLFAAAGTAGQRCTTLRRLIVHEHIHDTLLARLQAAWAQLRIGNPMEPDVLVGPLIEASAGEAMTAALAEAEAEGGRVFGGEAYPVPGLGSGCYRRPALVAMPAQTPVVMRETFAPILYVLRYRTLEDAIAMNNAVPQGLASAIFTRDLGEAEAFISASGSDCGIVNVNTGPSGAEIGGAFGGEKDTGGGREAGSDVWKTYMRRATCTINGSGSLPLAQGIRFGPAR

SEQ ID NO: 63519 - protein, 304 aa, Gibberella zeae PH-1
MINSMASKRNSRAFVDDHAHPTEGQQTPNNTQFRSRQGSRSASKEDMKQEVEEVISSMNRSQSATTVAMEPSLSTQSSDSDSRSSSISRGGRVQSSEHVASLDGRPFNFGIVIPGVYRSSFPKSHDFDYIKGLGLKTIVSLVKKDDLDHDLETFITSEGIRQVVFNMKGTKKEAIPLDTMKGILNVVLDQSNYPLLIHCNHGKHRTGCVVGVVRKITGWDVARVVAEYNTYAEPKAREVDVTYLQGFDVSSLVLSNTLQREICSRRNRLQSRTFFRAIVFSTCVMLVWFMSGVRMTSVTPSGPL

SEQ ID NO: 63520 - protein, 456 aa, Bordetella bronchiseptica RB50
MTTLSSAQQQDIQYQLHSYTNAVKHRDVGPRIITHGEGVYVFDDQGNRYLEGMAGLWSVAVGFGEQRLVEAAARQFQELPYYHTFTHKSHPSVIALAERLIGYTDGRMAQAFFTNSGSEANDTVVKLVWYYNNALGRRDKKKIIARQRGYHGVTVASASLTGLPGNHKDFDLPLPQIRHTACPHYYRYGLPGETEEDFATRMAGELEAMILREGPDTVAAFIGEPVMGAGGVIVPPRTYWQKIQAVCRKYDILVIADEVITGFGRLGQRFGSQVFDIEPDIMVLSKQITSSYQPLGAVLLNARVADVVAEHSGRLGTFGHGYTASGHPVATAVALENLRLIDERGLIEHAAEMGALLHLELQALSSHPLVGEVRGVGLIAGVELVADKATRQPFDPLGKAGGYAYERAHDHGLIVRGIQDTVAFCPPLIITAEQVRDMVARFARTLDDVAAHVAQG

SEQ ID NO: 63521 - protein, 494 aa, Zea mays
MAENNVVATYYYPTAAPAAMEVCGAELGQGKPDKCFDDDGRPKRNGTMWTASAHIITAVIGSGVLSLGWAIAQLGWVAGPVVMLLFSLVTYYTSSLLADCYRSGDPSTGKRNYTYMDAVNANLSGIKVQICGFLQYANIVGVAIGYTIAASISMLAIRRANCFHQKGHGNPCKISSTPYMIIFGVAEIFFSQIPDFDQISWLSILAAVMSFTYSSIGLGLGVVQVIANRGVQGSLTGITIGVVTPMDKVWRSLQAFGDVAFAYSYSLILIEIQDTIRAPPPSESTVMKRATVVSVAVTTLFYMLCGCMGYAAFGDGAPGNLLTGFGFYEPFWLLDVANAAIVVHLVGAYQVYCQPLFAFVEKWAAQRWPDSAYITGEVEVPLPLPASRRRCCKVNLFRATWRTAFVVATTVVSMLLPFFNDVVGFLGALGFWPLTVYFPVEMYVVQKKVPRWSSRWVCLQMLSLGCLVISIAAAAGSIAGIASDLKVYRPFKSY

SEQ ID NO: 63522 - protein, 317 aa, Chenopodium rubrum
MEKYEKLEKVGEGTYGKVYKAKEKTTGQLVALKKTRLEMDEEGVPPTALREVSLLQMLSQSLYVVRLLLCVEHVDKKNTTTGISKPILYLVFEYLDTDLKKFIDSHRKGSNPRPLPPCQIQSFLFQLLKGVSHCHSHGVLHRDLKPQNLLVDKDKGILKIADLGLGRAFTVPMKSYTHEIVTLWYRAPEVLLGSTHYSTGVDIWSVGCIFAEMVRRQALFPGDSEFQQLLHIFRLLGTPTDEQWPGVTSLRTGMCIRNGSLRILLVQFHRWDLMVLISYLKCSNMIQLKGSRPRQLWIIPSLIILISLNSKNAIVSY

SEQ ID NO: 63523 - protein, 405 aa, Zea mays
MLRRSLPEAGSFFRRLLGRVSNEGGLAAGSSASVRHFVEQLVGGTAPISRVPSALAVASAERGTGGSNGASLTVHFLRHSCGLEEADAAKAAERVHLRSTKNAHAVVALLRDTLGMPPASVARLVSAYPAVLSSVTLGAKLNFYLRELGLSSAELRRFLLASPHRFLLAGIETRLRPNLSLLKDLLGTEENVLAAVKQSMELIYDNLEIVLLPKLQVLREHGVTEEVLVKLLTTHPRALVHRSTRFDEGLTAMKDLGVSPKSGAFPYAFGVFARMYQSKWDRRVENYVSLGWTEEQVRRAFVRHPYFMTVSEDKVKKRMQFIAEKLGWNPDVLSSYPTILSFSHEKRVLPRYRVLHILASRGVIKKGIRMSHLTMPEKKFKERYVDKHQEEIPQVLEAYGARTEA

SEQ ID NO: 63524 - protein, 530 aa, Magnetococcus sp. MC-1
MILAQHNVMEPFARRYVPMRLLSWLVQLNPVIWRHCRRTPLHIRLRLALEELGPTFIKFGQTLSTRLDILPDEIGQELKRLQDDVPPFDLATVRQSIEEDLKRPLHELFRSFDEKPVASASIAQVHHAFTHDGDEVAVKVLRPDVAARVETDIAMLMTMASLVEELMPEWRRLKPRGVVKEFAQTIRNEMDFLVEASRAQKLGENFKDDVGMMIPQVYWPLTSSRVFTMAWIEGVSIDELPRERVAGRPDPRVVAERLLSSFFKQVFHDGYFHADQHPGNILVREDGVVALIDFGIVSHVSEQTRQFLAEMVQGFITRDYKKVAQVHLDAGYIPHDTDMDAFEEACRQIGEPVFGQPLKDISVARLLAKLFKTTEQYNMEVQPQLLLLQKTLFTLEGVGRELHPDLNAWEIAEPLVMAWMKARIGPKGQLLKLRRQLEEMGYAMGAAPEMAFQVLERVANDRFHIRLHASSMERVEHEIVLGFKRVWSAVMAGFLFLGGAVMAAAGMSPWWFVPPLILAFFSFFRVIALL

SEQ ID NO: 63525 - protein, 194 aa, Listeria innocua Clip11262
MDVNNVELVISAVRPEQYPETDLPEYALAGRSNVGKSSFINTMIRRKSMARISQKPGKTQTLNFYKIEEALFFVDVPGYGFAKVSKTEREKWGVMIETYITSREQLRGVIQIVDLRHKPTEDDRMMYEFLKYYDIPVIVVATKADKIPRSKWQKNAKIVRETLDFDPDDKFVLFSSETKMGKDEAWQFIKEGME

SEQ ID NO: 63526 - protein, 300 aa, Brassica napus
  misc_feature (236)..(236): Xaa can be any naturally occurring amino acid
MDAFDAIPNHVVIDILNKVADVKTLIRCRSVSKRFNSLAAQSDSLLLQLDQFLGAAEPEPEVNSPVASFFRSIFKSILPIFSRSAKPAETPKSPAQILAGFNRIRNLDVELYGGDANLEKGAAVKWKAEFGETLKSSVIVAFRSATVNASATESPVNAVETDSEFVCGLKTRVVWTINALMAASTRHHLMGDLVKEHKEMERLTVRDRGEEGTVVMSAAGMKEYREAEARVDEKGXGLERVRDRTEVPNVRMSMRHAPMLKLKSGICLEAATLVVVRPSGVTSDDNDAELATEAFAADCM

SEQ ID NO: 63527 - protein, 457 aa, Arabidopsis thaliana
MKAKYGERSQGTYFMAGEDLISKLPDSLITQILLYLPIKDIVRTSSLSSRWKSLWLLIPRLDLDSEEFQDYNAFVGFMNKFIDFSGEEKICLDKLKLSSRKTVNDLPCVTRWIDFVVRRKLKHLDVECLVNRKFLEEMPLSLYVCDTLVNLRLHRVLLGKFEAVSLPCLKTMRLEENVYANDVVLESLISSCPVLKDLIILRMFEDNVKVLRVHSLTLTSLNIDFNFGEGDDFVDGFDKKVSGVLIDAPRLKYLKFQDDLSGSKIITNSGSLAKVNVVYVFNENDCADVVDIPRRNMVRNFLTSISGVSDMKISQHFVEFLYYYKDFDPLPQFCNLSRLKAEISLYFLEILPTILESCPNLKSLVMVLEFYLQEEDEPIIFSSVPRCLVSSLESVEIKKFNGRPAKMEVARYFLENSGVLQKLVLHLRCSTHEDGFYILKDLLALPRGSSTCRIVVC

SEQ ID NO: 63528 - protein, 517 aa, Zea mays
MAAIASASPRTLIPPRPRHHGAAPSPSTSDVSSLRLLRAHPRHVRRSRGVSISMPVARSRSFVFSPRAVADSKSSQTCLDPDASTSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPNWFQGTADAVRQYLWLFEEHNVMEFLILAGDHLYRMDYEKFIQAHRETNADITVAALPMDEKRATAFGLMKIDEEGRIIEFAEKPKGEQLKAMMVDTTILGLDDVRAKEMPYIASMGIYVFSKDVMLQLLREQFPEANDFGSEVIPGATSIGKRVQAYLYDGYWEDIGTIAAFYNANLGITKKPMPDFSFYDRFAPIYTQPRHLPPSKVLDADVTDSVIGEGCVIKNCKINHSVVGLRSCISEGAIIEDSLLMGADYYETEADKKLLAEKGGIPIGIGKNSCIRRAIIDKNARIGDNVKILNADNVQEAARETDGYFIKGGIVTVIKDALLPSGTVI

SEQ ID NO: 63529 - protein, 182 aa, Streptococcus thermophilus CNRZ1066
MTKVAVVFADGFEEIEALSPVDVFRRAGFDCSMLGLESASVTGSHGIQVTMDGVFEGNLDEYDLVVLPGGMPGSTKLRDHQALIASLQEVAKAGKYVAAICAAPIVLERAGLLEGRKFTCFPGVEEQIASGDHQTDLVVVDDNIVTSRGAGTALAFAYALVDLLGGDGQQLAHTMVYDRLFQ

SEQ ID NO: 63530 - protein, 282 aa, Pseudomonas putida KT2440
MSQQAILAGLIGRGIQLSRTPALHEHEGDAQALRYLYRLIDADQLQLDDSALPGLLEAAQHTGFTGLNITYPFKQAILPLLDELSDEARGIGAVNTVVLKDGKRVGHNTDCLGFAEGLRRGLPDVARRQVVQMGAGGAGSAVAHALLGEGVERLVLFEVDATRAQALVDNLNTHFGAERAVLGTDLATALAEADGLVNTTPVGMAKLPGTPLPVELLHPRLWVAEIIYFPLETELLRAARALGCRTLDGSNMAVFQAVKAFELFSGRQADAARMQAHFASFT

SEQ ID NO: 63531 - protein, 309 aa, Photobacterium profundum SS9
MTPITRVAIIGECMVELKKNDGSIEQSFGGDTLNTAVYLSRLTQQHGISTSYVTGLGRDPFSKEMLAAWREEGINTDMVYLSDDKLPGMYAIETTEDGERSFYYWRNDSAAKYWLRERAILTLAKELCQHQMVYLSGISLAILSEDCRQSLINLLALCCKDGLKIAFDNNYRPTLWESAEQAQTFYKQILAITDIAFLTFDDEQMLYGDDNEQQTIERTQALGVQEIVIKRGGDDCYVVTPGSLECVAPHPVGNIIDTTAAGDSFSAGYLAKRITGGTPHASALAGHLLAGNVIQHRGAIISRDDMPNI

SEQ ID NO: 63532 - protein, 448 aa, Candidatus Pelagibacter ubique HTCC1002
MSSENRTSVPNSLNEHWMPFTSNKDFKANPRLITEAKGVYLKTHHGKTQIDASSGLFCNPLGHGRREITEAVTKQLETLDYAQPFQQGFGGSFELATKISKHTPGDLNKMFFTICGSTAVETAIKIAVAYHRAKGHAERFRFVGRERGYHGMNIGCISVGGMVNNVKTFASVLMPGVQHIRHTHLPEHKFVSGQPETGDYLANDLETICQNFGGENIAACIVEPIAGSTGTLVPPKGYLQKLREICDKHGILLIFDEVITGWGRTGSKFAADEFGVTPDIMTMAKATTNGVVPMGVVACNDYIYDAVMDASPTGAVELFHGYTYSGIPVAVAAALAVQEIFEKDDIFNRAKNLSPYFQKGLFSLQDLESVDNIRGYGMMGGIDMKLNTKPGKAGYECFKACYEAGVNFKATGDCLIIAPQFICEEKHIDEIIEKLRTGITNYQKNQKN

SEQ ID NO: 63533 - protein, 661 aa, Brassica juncea
MQIAVLPIGKFMARTLPTTSHRLMGWEWSLNPGPFNIKEHIIITIFANCGVAYGGGDAYSIGAITVMKAYYKQSLSFICGLFIVLTTQILGYGWAGILRRYLVDPVDMWWPSNLAQVSLFRALHEKEHKSKGLTRMQFFLVALGASFLYYALPGYLFPILTFFSWVCWAWPNSITAQQVGSGYHGLGVGAFTLDWAGISAYHGSPLVAPWSSILNVGVGFIMFIYIIVPVCYWKFDTFDARKFPIFSNQLFTSAGQKYDTTKILTPRFDLDINAYNNYGKLYLSPLFALSIGSGFARFTATLTHVALFNGRDIWRQTWSAVKTVKLDIHGKLMQRYKQVPEWWFYVLLVGSVALSLLMSFVWKESVQLPWWGMLFAFAMAFIVTLPIGVIQATTNQQPGYDIIGQFIIGYILPGKPIANLIFKIYGRISTVHALSFLADLKLGHYMKIPPRCMYTAQLVGTVVAGVVNLGVAWWMLESIQDICDIEGDHPNSPWTCPKYRVTFDASVIWGLIGPKRLFGAGGMYRNLVWLFLIGAVLPVPVWAMSKIFPDKKWIPLINIPVISYGFAGMPPATPTNIASWLVTGTIFNYFVFNYHKRWWQKYNCVLSAALDAGTAFMGVLLFFALQNAGHDLKWWGTEVDHCPLASCPTAPGIIAKGCPVF

SEQ ID NO: 63534 - protein, 207 aa, Debaryomyces hansenii CBS767
MASNNPEALQDDELIPESVEGYHVGEKKTIEEYTKLDAEDESLAKWKASLGLSDNSNAYPVKAGDKRKVVIVEMSLQFPNQPELQPIVIDLEDAQGNTIAGKEIKFSIKEKSVYQFVIKFRVQHEIITGLKYLHLIKKTGIRVDKLEEPLGSYAPNTKEKPYYEKVFSEVEAPSGMLARGGYSATTKFVDDDKNVHLSFPWSFQITK

SEQ ID NO: 63535 - protein, 226 aa, Oryza sativa (japonica cultivar-group)
MDMGAMSDPERMFFFDLACQNAKVTYEQNPHDADNLTRWGGALLELSQMRNGPESLKCLEDAESKLEEALKIDPMKADALWCLGNAQTSHGFFTSDTVKANEFFEKATQCFQKAVDVAPELHMEIHRQMASQASQAASSTSNTRKIWHNFHMVDFKIYVDNDPTFSIPAKNPYPSQARDSEILWQSRKKKKDSDFWYDVFGWVVLGVGMVVWVGLAKSNAPPQAPR

SEQ ID NO: 63536 - protein, 375 aa, Salmonella enterica subsp. enterica serovar Paratyphi A str.
MAKRDYYEILGVSKTAEEREIKKAYKRLAMKYHPDRNQGDKEAEAKFKEIKEAYEVLTDAQKRAAYDQYGHAAFEQGGMGGGFNGGADFSDIFGDVFGDIFGGGRGRQRAARGADLRYNMDLTLEEAVRGVTKEIRIPTLEECDVCHGSGAKAGTQPQTCPTCHGSGQVQMRQGFFAVQQTCPHCQGRGTLIKDPCHKCHGHGRVEKSKTLSVKIPAGVDTGDRIRLAGEGEAGEHGAPAGDLYVQVQVKQHPIFEREGNNLYCEVPINFAMAALGGEIEVPTLDGRVMLKVPSETQTGKLFRMRGKGVKSVRGGAQGDLLCRVVVETPVGLSEKQKQLLKDLQESFGGPTGEKNSPRSKSFFDGVKKFFDDLTR

SEQ ID NO: 63537 - protein, 335 aa, Zea mays
MAPLGDGGAAAAAASNNLVVSFGEMLIDFVPDVAGLSLAESGGFVKAPGGAPANVACAIAKLGGSSAFVGKFGDDEFGHMLVNILKQNNVNAEGCLFDKHARTALAFVTLKHDGEREFMFYRNPSADMLLTEAELDLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAKAN

SEQ ID NO: 63538 - protein, 277 aa, Vibrio vulnificus YJ016
MTQQIDRYAVFGNPIEHSKSPFIHTLFARQTNQPLIYTAETAPKEGFVEAVKAFFAEGGKGCNVTLPFKEEAYQFASRLTERAQLAGAVNTLKKLDDGDIIGDNTDGAGLVQDLLQHQVVLAGARILVIGAGGAARGVLKPLLDQKPTSLTITNRTFSKAEELAVLFAAYGSVTAKEMNTVTEEYDVIINSTSASLSGELPALSSSIFAANSTSYDMMYGKGDTTFNQWAKQHGAAHAYDGLGMLVGQAAESFMLWRGLRPGSKQILRELRKNLEGL

SEQ ID NO: 63539 - protein, 440 aa, Clostridium perfringens str. 13
MGKPKLKKEIGLFTATALVVGNMMGSGIFMLPASLASVSGPGSTIMAWLLTGLGSLVLALTFANLGSKIPKTGGTYEYSRLAYGNFMGFMTAWLYWNGSWIGNATIFIVITTYLGEVITSLTNSPIIGFLFCSSILWICTYINIRGTKLAGRVASVITVFKVLLFIFFIVVGLIYFDPSNLTPMFPDGKGVSTIPVAASLTLWAFMGLETASVAGGEIKDPEKNVKRSTILGMLISTVLYILISVVAMGAMSQSELASSTAPISDIIVKVLNLKSLNFLNIAIAISILGTAMGWLLSTARVGYAAGEDGIFPSVFAKVHPKYNTPHVALIIGSIFINIIFLMNFTKGLAGAYSFIVVLATLSYLPIYAISTIAEIILMVKEEKKPTFKKHLGLIIRCLIGFAFAIWAIYASGAEIVMYGFILILLGVPIYGYMSIKKHFR

SEQ ID NO: 63540 - protein, 373 aa, Listeria innocua Clip11262
MTLSKGLENVYVAETSISSIIDDMLTYVGYGIDDLMENNASFEEVIYLLWHLRLPNKEEFKKFKLEIQENMAVSETIITSLRMQNHQKLHPMSVLRTTVSMLGVFDTEAELDDGEAVYRKGLRLQAKMPTIVAAFSRIRRGLDPIPPREDLNMAANFLYMITGEEADELSVEAMNKALVLHADHEFNASTFTARVCVATLSDVYSGVTSAIGALKGPLHGGANERVFDMLEEIDAAGDVRNYIQEKIDTKQKIMGFGHRVYRGGDPRAKHLREMSRKLTAEKGEEKWFDISLQVEEAVWELKHLKPNVDFYSASVYHALGIDRDLFTLVFSVSRVSGWLAHIFEQYRDNRLIRPRAIYVGPENRSYLPVEERI

SEQ ID NO: 63541 - protein, 319 aa, Listeria innocua Clip11262
MKRIAILTSGGDAPGMNAATRAVVRKAIYEGLEVYGINYGFLGLVNGDIRKLELGSVGDLLHRGGTFLYSARYPEFATEEGQLKGIEQLKKHQIDGLVVIGGDGSYHGAEALTKRGFPTIGIPGTIDNDISGTDFTIGFDTALNTVLDALDKIRDTATSHERTFIIEVMGRDAGDIALWSGLAGGAEAIIVPEESFNMDDVVDRLNKGRERGKKHSIIVVAEGVMSGNEFAKQLAEYGDYHARVTVLGHVQRGGSPTAFDRVLASRLGARSVELLLENRGGLAVGIRENRIVENNIGEILKEKHTLDQKLFDLASILSI

SEQ ID NO: 63542 - protein, 304 aa, Kluyveromyces lactis NRRL Y-1140
MVAPSQFKQLEKVGNGTYATVYKGLNKTTGVYVALKEVKLDSEEGTPSTAIREISLMKELKHDNIVRLFDVIHTENKLTLVFEFMDNDLKKFMDNRNKGNSHKGLEMDLVKYFQWQLLQGVAFCHENRILHRDLKPQNLLINNRGQLKLGDFGLARAFGIPVNTFSSEVVTLWYRAPDVLMGSRNYCTSIDIWSCGCILAEMIMGKPLFPGSNDEEQLKLIFDTMGTPVEQTWPQVTQLAKYNPLLPPHMPRDLKQLLQNNTEEVLDDNVVDLLHGLLQLNPDARLSAKDALNHPWFAEYNHAN

SEQ ID NO: 63543 - protein, 227 aa, Lactobacillus sakei subsp. sakei 23K
MDKNAMKKMAAERSVDYVEDNMILGLGTGSTVVYMVEALAKRVKAENLHLTCVCTSIRTAEQATSLGIPVKALNEVDHIDLTIDGADEVDDNFQGIKGGGAAHLFEKLVATTSTRNIWIVDEEKVVDTIGRFPLPVEVIPFGSQQVFNKFVKEGLNPEFRTTEDGQRVLTDSKNEVIDLHLEKITHPHLLATWLSEQVGVVEHGLFLDLVNEVVVGSPEGVKILKAR

SEQ ID NO: 63544 - protein, 295 aa, Wolinella succinogenes DSM 1740
MNTVTGAMSALITPFRNGRLDTETYEKLIQRQIRHGMDALVPVGTTGESATLSHSEHKECIEIAVKVCQGTGIKVLAGAGSNSTLEAIDLAKFAEKMGADGILCVTPYYNKPSQEGLFQHYKAVAESVGIPLMLYNVPGRTGVNLETCTIQRLFNEVKNIYGIKEASGSMERIVELNTKIPDFAILSGEDAINYPVLANHGVGVISVIGNLLPDKISALVHKALQGELDESRRINNSLYKINKALFVESNPIPIKAAMYLAGLTPTLEYRLPLVSPSQENMRMIEETLKDYEVKA

SEQ ID NO: 63545 - protein, 510 aa, Hyoscyamus niger
MYIEDTSEIFTIFFTHILLPLLSFFIIRCVISSRKKLPLPPGPFPWPIIGHLFYLGNKPHVSLAKLANVHGPHLMSIRLGGRLVIVASSPMATAEVLKTHDRLLSGRFVSHPMRVEGSYIRNLATETLEECDENWKKVRSMYQIVLFSHKAVESQVNIREKKVMELVKFVASKEGELVNIKGIAFVTILNILSNSTISNDLVDFEGKGIGEGMREWIRNYTKLEGVPQLADLFPILDGCTWDFQGTYKKLKDTFERISDVWRDIINKKRMEISNKYYEGEDFADALIRNGFEDKQINALLMELYSAGTETTITTVEWTLVELLKNPEAMKRLRNEIKKELTTIDDREIMIVKDSNLPNLPYLEACMKETLRLHPPAPLLFPHRAVQTCEVMGYRIPQDTQIIVNVWKMARDSEYWNDDPWSFKPDRFLDSSTDYKGHDFEFIPFGSGRRICAGQSLALRMLPMIVGSLVHNFELILPNNMNPMEMNMDDIIDVTMAKKDPLFIIPKIRNS

SEQ ID NO: 63546 - protein, 107 aa, Arabidopsis thaliana
  misc_feature (102)..(102): Xaa can be any naturally occurring amino acid
MASKALILLGLFAILLVVSEVSAARQSGMVKPESEETVQPEGYHGGHGGHGGGGHYGGGGHGHGGHNGGGGHGLDGYGGGHGGHYGGGGGHYGGGGGHGGWXGHYGG

SEQ ID NO: 63547 - protein, 165 aa, Oryza sativa (japonica cultivar-group)
MGLLSTAADAAVVLFSLAVAAAAPLIDAQAVLPRRLFPAPLVGLHRWYATEFGDYLAAEPPGFFRGLVWLELLLHWPLSVATLYGVLARRPWAGATALAAGVSVVTAMSAVLGEFLVSGRATHKLLQMYVPFAVLAVIAALRGLVVWSSQGTGLAPAPSSQKKRP

SEQ ID NO: 63548 - protein, 225 aa, Zea mays
MEAVCGSVWVTSSLPRSPKSTLSLFRSTHQHLTAFPSQSHLFLYHPPPYANAKTLRARTSSKPAIFLPHLIASLEQVDQTYIMVKPDGVQRGLVGEIISRFEKKGFKLTGLKLFQCSKELAEEHYKDLKQKSFFPKLIDYITSGPVVCMAWEGVGVVASARKLIGATDPLQAEPGTIRGDLAVQTGRNVVHGSDSPENGKREIALWFKEGEVCEWTPVQAPWLRE

SEQ ID NO: 63549 - protein, 195 aa, Tetraselmis suecica
AGGIAQMREHDPIVRERTDIALDSVGNTSAASGKGFDIASASLTALALFAAYVTFTGIDGINIFKAPVLAMLFMGGMVPVVFSALAMNAVGKAAMEMVYEVRRQFKEIPGIMEGTGKPEYDKCVAISTTASLKEMMLPGLLTIGFPLAIAFLPLAFGMETKAIAEMLGGYMAGVTVSGVLWAIFQSNSGGAWDNA

SEQ ID NO: 63550 - protein, 194 aa, Isochrysis galbana
AGGIAEMSDQEPIVIERTDILDSVGNTTAATGKGFAIASAALTSLALFAAYVTFTGIDGINIFKAPVLAMLFVGGMVPVVFSALAMNAVGKAAMEMVQEVRRQFKAIPGIMEGTGKPEYDKCVAISTQASLKQMMLPGLLTIGFPLIIAFAPLAFGMDRLAIAEMLGGYMAGVTVSGVLMGILQSQSGGAWDNA

SEQ ID NO: 63551 - protein, 493 aa, Candidatus Pelagibacter ubique HTCC1002
MTIDYKKISKNLKFEGRAFINGKYVDAIDGEKFENINPATGETLCSVAKCNHKDVDLAVKVSRKAFNSGVWSRTSPEFRKDVLLKFAELLRQTGEENSVLECVDTGKLIGDCINEVANDAPMHFQWYGELIDKVFGKVGPTEPSLTSLIVKEPIGVVAGVVPWNFPLMMAVWKMAPALAAGCSVIIKPAEDTPLTAIRVAQIAKEAGIPDGVLNIVPGFGDVGEALGRHNDVDAVSFTGSTEVGGLFMKYSGESNLKTIGLEMGGKSPFIVLEDAKITDDLIDNAINSAFWNGGQNCSANMRQIIHSKVKDEFLDKVSKKVKALKAGDPLDPESNMGSMISKKHLATVDGYIQKGIDEGAKLLFGGVSSSDQKGFFAKPTLFDDLKENMTIAQEEIFGPVLGVLTINSDEEALKIASNSKYGLHASVFTQDIDRAFHMAKSLPCGTVSVNTFSEGDIKTPFGGYRQSGSLSRDQGTEALDQYLQTKTIWISHS

SEQ ID NO: 63552 - protein, 210 aa, Phaeodactylum tricornutum
AGGIAEMMGLIPNSVEHTNDALDAVGNTTKTVTKGYTIGSAGLAALVLSAAYKEDNVCFIDKSPQSSMLYGIGAAMFPIVNPYVVIDLLVGGPMPIMLDGICLMTVGRPAQAVLEEIRPQYRERPGITTYHKKPFYGRAVDIASMSAIKEMIVPSILPVLSPSVLFIVIRGTAGPIGAPATVGAILLGVTVTGVFVAISMSNGGGAWDNA

SEQ ID NO: 63553 - protein, 477 aa, Thalassiosira pseudonana
MDFLSGDPFRTLVLAALVVIGFAAAWQCFYPPSIVGKPRTLSNGKLNTRIHGKLYDLSSFQHPGGPVALSLVQGRDGTALFESHHPFIPRKNLLQILSKYEVPSTEDSVSFIATLDELNGESPYDWKDIENDDFVSDLRALVIEHFSPLAKERGVSLVESSKATPQRWMVVLLLLASFFLSIPLYLSGSWTFVVVTPILAWLAVVNYWHDATHFALSSNWILNAALPYLLPLLSSPSMWYHHHVIGHHAYTNISKRDPDLAHAPQLMREHKSIKWRPSHLNQTQLPRILFIWSIAVGIGLNLLNDVRALTKLSYNNVVRVEKMSSSRTLLHFLGRMLHIFVTTLWPFLAFPVWKAIVWATVPNAILSLCFMLNTQINHLINTCAHASDNNFYKHQVVTAQNFGRSSAFCFIFSGGLNYQIEHHLLPTVNHCHLPALAPGVERLCKKHGVTYNSVEGYREAIIAHFAHTKDMSTKPTD

SEQ ID NO: 63554 - protein, 540 aa, Ralstonia solanacearum GMI1000
MSFSELGLSDKLVRAVAELGYAEPTPIQRQAIPAILKGGDLLAGAQTGTGKTAGFTLPLLHRLSAVQPNKVQTPHGMRYPIRALVLTPTRELAAQVEESVRAYGKYLPLKSMVMFGGVGINPQIDALKRGVDIVVATPGRLLDHVGQRTIDLSHIELLVLDEADRMLDMGFIHDIRKILNILPPKRQNLLFSATFSDDIRALADRLLDQPALIEVARRNTTAETVEQRIYPVDRERKRELLAKLVSDNDWHQVLVFTRTKHGANRLAEQLTRDGIPALAIHGNKSQSARTRALSEFKAGTLRVLVATDIAARGIDIDQLPHVVNFDLPNVPEDYVHRIGRTGRAGAQGEAISLVCVDEHGLLRDIERLIKRELPRTVLAGFEPDPTIAPEPIPNGRNSARAPRQGGGRSQPPRQAAGNAAPREPRAPREPRRESGASGQGQGQGQGQGRNGGGRQRQAQGQRDGQAAPKPRGGQGSGNGNGQSHARGQRQGNGQGNGQGGQRRASNTQAAQPTKVAQPAPKQPFNGLFAKAAALLGGRKA

SEQ ID NO: 63555 - protein, 267 aa, Humulus lupulus
MADANMGAGGGQFPDFPSVLTHGGQYVQFDIFGNFFEITTKYRPPIMPIGRGAYGIVCSVLNTELNEMVAVKKIANAFDIYMDAKRTLREIKLLRHLDHENVIGLRDVIPPPLRREFSDVYIATELMDTDLHQIIRSNQGLSEDHCQYFMYQLLRGLKYIHSANVLHRDLKPSNLLLNANCDLKICDFGLARPNIENENMTEYVVTRWYRAPELLLNSSDYTAAIDVWSVGCIFMELMNRKPLFAGKDHVHQIRLLTELLGTPTESN

SEQ ID NO: 63556 - protein, 583 aa, Bacillus anthracis str. A2012
MQKIQKTDTISSEPIKGGLGYMTTTTTVKSDIEIAQEANMKKIQEIAADLNILEDELEPYGHYKGKLSLDIFKRLQNEKDGKVVLVTAINPTPAGEGKSTVTVGLGQAFNKIGKKTVIALREPSLGPTMGLKGGAAGGGFSQVVPMEDINLHFTGDIHAITTANNALAAFIDNHIQQGNTLGIDTRKIVWKRCVDLNDRALRNVVIGLGGPVQGVPREDGFDITVASEIMAVFCLATDIQDLKARLSRIVVAYNFANQPVTVKDLGVEGALTLLLKDALKPNLVQTLENTPAIIHGGPFANIAHGCNSVIATTMAAKLGDYVITEAGFGADLGAEKFLDIKARAAGIKPEAVVIVATIRALKMHGGVAKDQLKEENVDALAKGMENLQKHVETIQSFGVPFVIAINKFITDTDAEVAYLQEWCNERGYAVSLTEVWEKGGQGGVDLAEKVLKEIEKGENNYAPLYELELPLEEKIRTIAQKVYGAKDIEFAPKARKQLAQYEGEGWSNLPICMAKTQYSLSDDATKLGRPSDFIVTIRELKPSIGAGFIVALTGTMLTMPGLPKQPAALQMDVNEDGKAVGLF

SEQ ID NO: 63557 - protein, 393 aa, Clostridium perfringens str. 13
MEGRLVSKKEIVAMILAGGQGSRLGVLTKNLAKPAVPFGGKYRIIDFPLSNCSNSGIYTVGVLTQYKPLKLNEHIGIGDTWDLDRRDGGVSILPPYQKEKGGDWYKGTANAIYQNIEFIERYDPEYVLILSGDHIYKMDYDKMLEMHKQKEADATIAVINVPMHEASRFGIMNTNEDLSIYEFEEKPEHPKSTNASMGIYIFNWKILKKFLEEDELDQSSSNDFGKNIIPKMLNSGKKLIAYPFNGYWKDVGTIESLWEANMDLLKYEDELSLYDSEWKIYSANPVRPAQFIGKDAEIKSSLTVEGCIVHGKVENSVLFQGVYVGKGAIVKDAVIMPNTKIEDNVLIEKAIIGSEAIVCKGCKIGDGNKISVIASKEVVIGSKEVIEECAMVK

SEQ ID NO: 63558 - protein, 548 aa, Morus alba
MELRRRPSKIQSRKPSQAPPKASDALPLPLYLTNAVFFTLFFSVAYYLLHRWRDKIRNSTPLHVVTFPEIAAIVSLIASFIYLLGFFGIDFVQSFIISPRASDDEEDDDLHVVVRDNACRPPPLVVPTLASEEDEEIIRSVVDGTIPSYSLESRLGDCKRGAAIRREALQRMTGRSIEGLPIEGFDYESILGQCCEMPVGYVQIPVGIAGPLLLDEFEYSVPMATTEGCLVASTNRGCKAIYMSGGATSVLLRDGMTRAPVVRFNSAKRASELKFFVEDPVNFDTLAVVFNRSSRFARLQGIQCAIAGKNVYMRFSCSTGDAMGMNMVSKGVQNALDYLQSDFPDMDIIGISGNFCSDKKPAAVNWIEGRGKSVVCEAVIKEEVVKKVLKTNVDALVELNMLKNLAGSAVAGALGGYNAHASNIVSAVFIATGQDPAQNIESSHCITMMEAVNNGKDLHISVTMPSIEVGTVGGGTQLASQSACLNLLGVKGANKESAGSNARLLATIVAGSVLAGELSLMSAIAAGQLVKSHMKYNRSSKDVTKVAS

SEQ ID NO: 63559 - protein, 143 aa, Azoarcus sp. BH72
MPTRKIAEVVKGQKILTADEHMTVLEASRRMTDLHVGSIMIVHDGHLSGIFTERDALVRVIAAGRDPARTRLSEVMTRDPQSISSDRPLGHAMHLMYEGGFRHVPVTDCGRPIGMISARDALGLEMVAFEEELEQRELITELL

SEQ ID NO: 63560 - protein, 368 aa, Clostridium perfringens str. 13
MNNCIGIINLDENESKIGELAKNRPLAAVPIAGRYRIIDFILSNMTNAGIESLGILSKNKSRSLVDHLTNGRPWDLHRKRDGLRVFNFGERDPYYDDITNLYENLEFLTKSRREYVIMSPSYMICNIDLKEALEYHKKNDNDITVIYKKVKDADSNFIDCDVLNFDECGFIKSIGKNLGREEESNISLEMYILRTDLLIEIIYECIRRGSHRKFKSYLKEFLDEIKVGGFEFKGYLSCVNSLKSYYKANMDLLEEKVYKELFIDNNPIYTKSRDEGPTHYTKNSEVTNSIIANGSYIEGKVENSIIGRRVYVGPEAVIKNCIIMQETVIGENAHLDKIITDKAAVIRDDEKIVGLEYCPMVLSKPNII

SEQ ID NO: 63561 - protein, 429 aa, Azoarcus sp. BH72
MSAIVDVIAREILDSRGNPTVEADVLLESGVMGRAAVPSGASTGSREAIELRDGDAARFLGKGVLRAVENVNTEISEAIIGLDAEEQAFIDRTLIDLDGTENKSRLGANATLAVSMAVARAAAEEAGLPLYRYFGGSGPMAMPVPMMNVINGGEHANNSLDIQECMIMPVSMGSFREALRCGAEIFHHLKKITDKKGYPTTVGDEGGFAPNVSGTEEALNLIQEAIAAAGYEPGRDVLLALDCAASEFYKDGKYELKGEGLSLTSEGFTDYLATLADKFPIVSIEDGMAEGDWAGWKHLTDRLGRKIQLVGDDLFVTNTKILEQGIDQGVANSILIKINQIGTLSETFAAVEMAKRAGYTAVISHRSGETEDSTIADIAVGLNAMQIKTGSLSRSDRIAKYNQLLRIEEDLGNTVVYPGKRAFYNLRSR

SEQ ID NO: 63562 - protein, 518 aa, Magnetococcus sp. MC-1
MQTHRPKPMTLVILDGWGLRDTQENNAIANASTPHMDDWLANRPHAQVRTSGRDVGLPDGQMGNSEVGHLNLGAGRVVYQEFTRVSCAIEDGSFMHNQVLLDAIRAANEAGGAVHLYGLLSPGGVHSHQDQILAAVQCAKQNGASEIYIHALLDGRDTPPQSAMEYMTRFEEGLQKLGAGRVATVCGRYFTMDRDKRWERVERGYRLMALGEGTPFDSACEAIQAAYDAQQTDEFVEPAVMVEQGQPIGMINDGDTLICMNFRADRVREISHVFTDTTFEPFVRDGLPKLSAYVCLTQYDVSLQNVQIAYPPVALTNILGQVMAQHGLTQLRAAETEKYAHVTYFFNGGQEQPGEGEDRLLVASPKVATYDMQPAMSAAELTDRVIEKIQSTPYDLVVVNYANPDMVGHTGVYEAAVQAIETVDTQLGRLTDAIVQMGGEVLITADHGNADQMVDEQGTAHTAHTLNPAPLIYLGRDAQLHDGRLSDVAPTLLALMGLPQPLEMDGVSLVQFTQPAVA

SEQ ID NO: 63563 - protein, 111 aa, Zea mays
MAKLLSLFLALSFVAAMFAIGSHADGDCENDLQSLISDCKTYVMFPANPKVPPSDACCGVIKKANVSCLCSKVTKETEKVVCMEKVVYVAEQCKRPFEHGFQCGSYKVPAN

SEQ ID NO: 63564 - protein, 442 aa, Colwellia psychrerythraea 34H
MKEDKLQLTKSLSLFGLVLFGLAYMTPMIVFGTYGVLYEESGGNVASSYLFALIAMLFTAGSYALMAHKYPSAGSSYTYVTKVFGDRIGFLVGWTILLDYLFLPMVIWLIGGIYLEAMAPGIPEWFWILSFIVVTSVLNLIGVNVAKKVNLVLMLLQIVVIVAFCALAVMYINASGGVIAAPSTDSFTGGNFSLIFSGAAIACYSFLGFDAVSTMAEETENPKKNVPKAIMLVTLIGGIIFVASSYILNSAFPDISVFAAESAAADIAKQVGGVIFSSIFVATLIIAQFTSGVSAQASASRLMYVMGRDGVLPKGIFGKLHATFKTPYMTILMVGFIGLLALKMDVATSTSFINFGAFIAFIFVNMSAFSEFFKLEKNERTLGATLIHIVFPSIGTIAVMKLLISLDSNAVMLGCIWLAIGLCYLAYLITKGQKLKMDIKES

SEQ ID NO: 63565 - protein, 845 aa, Arabidopsis thaliana
MEFSELKEAIEKIELVDAHAHNIVSLDSSFPFIGTFSEAAGDALTFAPHSLSFKRNLREIAQLYGTEVSLEAVEEHRKTSGLDSFTSKCFKEARISALLIDDGLKLDKKHDIEWHRNFVPFVGRVLRIETLAEQILEEECPGGYFYGSESTEPPYWLTLTTSVTLVPEIVALKTIAAYRSGLDIDTYVSKEVAENGLVEVLRAGKPVRIGNKGLIDYILTISLEVAVRRDLPLQIHTGFGDKDLDLRLSNPLHLRTLLEDKRFGKCRIVLLHAAYPFSKEASFLSSVYPQVYLDFGLAVPKLSVHGMVSSVKELLDLASIKKVMFSTDGYASPETYYLGAKKAREVIFLVLSDACASGDLSLMEAIDAAKDIFSRNSIGFYKLNIDTDSSSPQNIISPKLKIKEPDVQEDSSSFVRIIWVDTSGQQRCRAVQAQRFNRSVKKNGVGLTFASMGMTSFTDGPAEESKLTGVGEIRLVPDLSTKQTIPWTKQESMVLADMQLKPGEAWGYCPRETLRRVAKVLKDEFDLVMNAGFENEFYLLKNVVREGKEEYMPFDFGPYCATSSFDAASPIFHDIVPALESLNIEVEQFHAESGKGQFEVSLGHTIASHAADNLVYTREVIRSVARKQGLLATFVPKYDYCDIGSGSHVHLSLWKNGENVFPASNNSSSHGISSVGEEFMAGVLFHLPSILAIIAPLPNSYDRIQPNTWSGAFQCWGKENREAALRAASPPGTPDGLVTNFEIKSFDGSANPHLGLAVIMAAGIDGLRRHLQLPTPIDINPADVAATLNRLPETLSEAVEALDKDKVLHDLLGQKLLVAIKGVRKAEVEYYSKNPDAYKQLIHRY

SEQ ID NO: 63566 - protein, 121 aa, Glycine max
DGRNNRVALFDGIEEGGIRASSLYSSTSSHEIDEHDNEQALDGLQDRVNLLKRLSGDINEEVDSHNRMLDRMGNDMDSSRGVLSGTMDKFKMVFETKSSRRMFSLVASFVVLFLIIYYLTR

SEQ ID NO: 63567 - protein, 141 aa, Arabidopsis thaliana
  misc_feature (126)..(126): Xaa can be any naturally occurring amino acid
GAHARERRRETQEGAGLPLFLSSAAAVTSPAQATMGAPFTGLKASAALPVTRKTNKDITSIERNGGRVSCMKVWPPIGKKKGETLCYLPDLNDVQLAKEADYLVRNKWSACVECELKHRVVYRERXYTPRYYDGRDWTMWK

SEQ ID NO: 63568 - protein, 181 aa, Kluyveromyces lactis NRRL Y-1140
MNDRPTIYVIGGTCGTGKSTIAERVHQRLHENNPKIEFIEGDLLHPAENIRKMSHGIPLHDDDRWGWLEKVSDDSYKKSEECDTCIVTCSSLKKSYRDYIRSKHPEGRFVFFMLYGAKSEILKRMLQRESHFMKADMVDSQFNDLQLPAEDEQDSFVINVTSLSVEEVVDEIMKKINASLS

SEQ ID NO: 63569 - protein, 274 aa, Exiguobacterium sibiricum 255-15
MLKEAFHIAVPTAFFPDETLNVDGTIEHIRYLVDQGEKSILVCGSTGEQHSLELKEKLVLLEALMNESYLLNDEIEVLFGVSAIRQKEAVDLAHAIKETRIAGILLGYSPYLLPSQTEALRYSETIIQASQKDTILYNNPGRTGFDLSIESIIQLSSQDKVIGIKEAGNKNKVERLQEHISDFYYYAGGEVDLKDKVALGFNRLSSISGNVYPKEIRKWFFSLIEDTPLTESEQKEVTALINKVFAGSPIVHLKREINAKGIAIGICRSPLGNC

SEQ ID NO: 63570 - protein, 598 aa, Moorella thermoacetica ATCC 39073
MTLGSGAMTNSIAEISTYSDVIFIIGSNTAECHPLVARHVLKAKERGAKLIVADPRLTEMANKADIWLRVPVGYNIPLINGMLHLIIKEGLVKKDFIQKHAEGLDELVRAVEQYTPAYVEELTGIPQRDLIEAARLYGRAQAAMILYCMGVTQFSHGTGNVVSLSNLAVVTGNLGRPGTGVCPLRGQNNVQGACDMGGLPDVLPGYLNVTREEWRRRFEKEWKVKLPSKPGIRIPEVPEAILEGKIRALYIFGENPIMSDPDSDHLRHALEHLDLLVVQDIFLTETARLADVVLPAASWAEKDGTFTNTERRVQRVRKAVDLPGEARPDWQIFGMLAQKMGYMGLNYSNSQEIWDEVRRLVPEKFGGISYARLESVRGITWPCPQEEHPGTPILYEGGKFLTPSGKARLYPVIFYAKASNGASKEKAKAGNQVIVGTIAELPDEEYPFILTNGRRVYHYHTGTMTRKSWLLDQIGPNELVEINPQDARKMGINDGDFVKVSTRRGYVAVRAWVTERVPEGTIFMTFHYWEACCNELTNTANDAICSTPEFKLAAARMDKISPEEARAIYLEKKAKYLVDLEKANVPKTVIGEGGRVDA

SEQ ID NO: 63571 - protein, 460 aa, Kurthia sp. 538-KA26
MNSHDLEKWDKEYVWHPFTQMKTYRESKPLIIERGEGSYLFDIEGNRYLDGYASLWVNVHGHNEPELNNALIEQVEKVAHSTLLGSANVPSILLAKKLAEITPGHLSKVFYSDTGSAAVEISLKVAYQYWKNIDPVKYQHKNKFVSLNEAYHGDTVGAVSVGGMDLFHRIFKPLLFERIPTPSPYTYRMAKHGDQEAVKNYCIDELEKLLQDQAEEIAGLIIEPLVQGAAGIITHPPGFLKAVEQLCKKYNILLICDEVAVGFGRTGTLFACEQEDVVPDIMCIGKGITGGYMPLAATIMNEQIFNSFLGEPDEHKTFYHGHTYTGNQLACALALKNIELIERRDLVKDIQKKSKQLSEKLQSLYELPIVGDIRQRGLMIGIEIVKDRQTKEPFTIQENIVSSIIQNARENGLIIRELGPVITMMPILSMSEKELNTMVETVYRSIQDVSVHNGLIPAAN

SEQ ID NO: 63572 - protein, 308 aa, Ferroplasma acidiphilum
MHLMNMVDPDFNSLIELSKSAGDMTKIEPAMLRNFLDESSLSSRGAPVEIKEIKDYKIKLDGRTLNARMYDDNNAKSAILYYHGGGFLFGNIETYDNYCRFLAKESGVKIISIEYRLAPEHKFPDAFNDAYDSFHYIAKKKKDFGIEGRIGVAGDSAGANLAAALCLKCRDGKTEMPAVQVLFYPSLAPDNFSRSFIEYSDNYVLTGKMIRYFGNMYSKNMQDLINPYFSPLVADDFSNLPPAIMVTNEYDPLRDPEETYVKKLREAGVRAVGIRGIGMIHGSATDFEVSDGARNIVKMVARIIPDYL

SEQ ID NO: 63573 - protein, 303 aa, Debaryomyces hansenii CBS767
MSQQNWKNLSNELRRRASQGGGSGGSNRKSPFGAFAGIGGILLLGGVTMLAQNSLFNVDGGQRAIVYSRIHGVQPKIYPEGTHFVIPWFQRPIVYDVRAKPRNVASLTGTKDLQMVNITCRVLFKPDIFQLPNIYRTLGTDYDEKVLPSIVNEVLKSVVAQFNASQLITQRERVSRLVKENLIRRAGKFNINLDDVSLTFMTFSPEFSAAVEAKQIAQQDAQRAAFVVDKAIQEKQQLVVKASGEAKSAQLVGEAIKKSRDYVELKRLDTAREIAGILANSPNRILLDNDTLLLNTVVDGRNK

SEQ ID NO: 63574 - protein, 1060 aa, Pseudomonas aeruginosa UCBPP-PA14
MFKASHVLQGEDQTRSAAEFFPVISANYAVDEEAYLGELLQLADPGPDGIEAIRRNARALIETVRSRDNAVDTLDALLRQYSLDTQEGLMLMCLAEALLRVPDAATADALIRDKLSAADWQRHLGQSDNVLVNFAAWGLVMTGKVVNIDERTDGRAPSVISRLVQRSGEPVIRAAMNQAMKLMGKQFVLGRTISEALKNGRPCREQGYTYSFDMLGEAALTAADAEKYMADYRQAIDTVGAEPQVGPGPRPSISIKLSALHPRYEVAQRERVLSELFANVLELAVRARKLNVGITIDAEEADRLELSLELYEKLMRDPAIAGWGEFGLVIQAYSKRCLPVLVWLTLLGRELGARIPLRLVKGAYWDSEIKQCQVQGADGYPVYTRKEGTDTSYLACARYLLSEHTRGVIYPQFASHNAHTVTAILALADEARAAGGEERDFEFQRLHGMGDALYDTVIEKYRRNVRIYAPVGAHKDLLPYLVRRLLENGANSSFVHKLVDPRVPVETLIQHPVTQLRQFKTLANDRIPLPQAIFGAGRKNSQGINMNIQNQWNELELAYKPHLTRQWQAAPIVNGEKLSGPAHEVRCPYDLERLVGSVQYASAEQAGKALDVLQAAWPRWSATPVDERAGILERLADLLEAQRGELMALCTLEAGKSLQDGIDEIREAVDFCRYYAQQARQRLVREELRGPTGERNELFYEGRGIFACVSPWNFPLAIFLGQISAALVAGNTVLAKPAEQTSLIAARTVELMFEAGLPRDVIALLPGDGATLGGVFCRDARVAGVAFTGSTDTARIINRQLAEKPGAIATLIAETGGQNAMIVDSTALPEQVIKDAVQSAFTSAGQRCSALRVMYVQQDIAERVIELLKGAMAELKVGPTDVRVSDVGPVIDAEAKAGLEQHIAALKAAGKLIAETKVPGNLNGHFVAPVAFEISGIDELKKENFGPVLHVVRYAAQDLEKVVQAINATGFGLTMGVHSRNEETARRIEELARVGNLYINRNQIGAVVGVQPFGGHGLSGTGPKAGGPNYLLRFVSERTTSVNTTAVGGNASLLSLADAE

SEQ ID NO: 63575 - protein, 50 aa, Glycine max
AATTNRLLEKALSTSAAIISELEKKKQKKKEEQQRLNEDGAAIAEALALH

SEQ ID NO: 63576 - protein, 113 aa, Moorella thermoacetica ATCC 39073
MNIIETLEKEQLRTDIPDFRPGDTVRVHVKVVEGNRERIQIFEGVVIGRRGRGINETFTVRRVSYGVAVERIFPLHSPRLERIEVVRHGKVRRAKLYYLRERVGKAARIKEER

SEQ ID NO: 63577 - protein, 265 aa, Fusobacterium nucleatum subsp. vincentii ATCC 49256
MTTLDGQEFFAGDYNTKFTIQSISKIISLMLAILDNGEEYVFSKVGMEPSGDPFNSIRKLETSSRKKPYNPMINAGAIAVASMIKGKDDREKFLRLLDFAKLITEDDTLDLNYKIYIGESDTGFRNYSMAYFLKGEGIIEGNVNEALTVYFKQCSIEGTAKTISTLGKFLANDGVLSNGERILTTRMAKIIKTLMVTCGMYDSSGEFAVRVGIPSKSGVGGGICSVVPGKMGIGVYGPSLDKKGNSLAGGYLLADLSEKLSLNIF

SEQ ID NO: 63578 - protein, 516 aa, Oryza sativa (japonica cultivar-group)
MVIARGLLRSNASSSSSQAINLLKYVTSTGSLQGHTQNLCDASTRHFSSVPSPQYNSTEENGFKGHGMLAPFTAGWQSTDVHPLVIERSEGSYVYDIDGKKYLDSLAGLWCTALGGSEPRLVKAATEQLHKLPFYHSFWNRTTKPSLDLAKELLSMFTAREMGKVFFTNSGSEANDSQVKLVWYYNNALGRPDKKKFIARSKSYHGSTLISASLSGLPALHQKFDLPAPFVLHTDCPHYWRFHLPGETEEEFATRLANNLEELILKEGPETIAAFIAEPVMGAGGVIPPPKTYFEKVQAIVKKYDILFIADEVITAFGRLGTMFGSDMYNIKPDLVSMAKALSSAYVPIGAIMVSPEISDVIHSQSNKLGSFAHGFTYSGHPVACAVAIEALKIYQERNIPDHVKQISPRFQEGVKAFAGSPIVGEIRGVGLILGTEFADNKSPNDPFPAEWGVGAIFGAECQKRGMLVRVAGDNIMMSPPLIMTPDEVEELVSIYGDALKATEERVAELKSKKNN

SEQ ID NO: 63579 - protein, 247 aa, Saccharomyces cerevisiae
ARTFFVGGNFKLNGSKQSIKEIVERLNTASIPENVEVVICPPATYLDYSVSLVKKPQVTVGAQNAYLKASGAFTGENSVDQIKDVGAKWVILGQSERRSYFHEDDKFIADKTKFALGQGVGVILCIGETLEEKKAGKTLDVVERQLNAVLEEVKDWTNVVVAYEPVWAIGTGLAATPEDAQDIHASIRKFLASKLGDKAASELRILYGGSANGSNAVTFKDKADVDGFLVGGASLKPEFVDIINSRN

SEQ ID NO: 63580 - protein, 371 aa, Moorella thermoacetica ATCC 39073
MAAAAENLRTEEIQLNMGPQHPSTHGVYRALLTLDGEKVVGVENIIGYLHRGIEKLAEDRTYTQVIPYTDRLDYLAGMLNNLGYVQTVEKLLGLEVPERAEYLRVIMAELSRLASHMVMVASMALDLSGWTAWFPPFRERERILDLFEMTCGSRLTVSYMRIGGVAADIPPGFLPALESFLNDLPRMIAEMNGLITGNEIFKARCQGVGKIDLETALAYGITGPNLRACGLPFDLRKARPYSIYDRFDFDIPTLNNGDSYDRFVIRLLEMEQSARIIRQAMEQLPDGPVQAKVPRVLKLPRGEVYHQIEGAKGILGFYLVSDGGSKPYRLHIHSPSFVNLGALPRISVGGTIQDFVVNIASIDIVLGEVDR

SEQ ID NO: 63581 - protein, 338 aa, Clostridium perfringens str. 13
MRYIEFDEKRKFDIVPVGRVAIDFNPTDIHKPLSESRNFNKYLGGSPANIAVGLARLGKKVGFIGKVSDDRFGEFVVNYFKKEGIDVSEISKAKNGESLGLTFTEILSPTESSILMYRNGIADLQLDVDDIDEDYIKNTKAIVISGTALAMSPSREAALKALRLAKKNGTVVIFDVDYREYNWKNKDEIAIYYSIVGKESDIIMGSREEFDLMEGLIAKDSTDEETAKRWLDYGNKIVVIKHGKDGSTAYTRDGKAYRIKPFPVKLLKSFGGGDAYASAFIYGILEGWDMMDALEFGSASAAMLVASHSCSEDMPTVEAIKEFIKKEKEEYGEMVARS

SEQ ID NO: 63582 - protein, 102 aa, Oryza sativa (indica cultivar-group)
MAALPRRRRAGCRYPRIPAVDLDQNTAKRDNTQPCFPCSGSGAQVCRFCTGKGTVTVVIGGGETEVSNCVNCDGVGSLTCTTCQGSGIQPRYLDRREFKDDD

SEQ ID NO: 63583 - protein, 384 aa, Listeria innocua Clip11262
MKHVFPTYNRFPVDIVKGNGTVVKDATGKTYLDFTSGIAVCNLGHCPENVTEAIQSQLANIWHTSNLYECALQDSVAELITDGTDKLVFFCNSGTEANEAALKLARKYTGKEKIITFEKSFHGRTFGSMSATGQAKIHQGFGRLVPGFTYVPYNDIESFKTELDENTAAVMLEVIQGEGGVIPGNAAWLMEVQMLCKKAGALLIIDEVQTGLGRTGTLFGFQQTFLDPDIFTLAKGLGNGLPIGAMVGKEHLSSAFGPGSHGSTFGGNKLALAAAKEILLTMKQTGFLEEVNAKAAYFRNLLEEHFEQLENVVAIRGEGFLIGIELGSSAAPVVTELRDKGLLILTAGPNILRILPPLTVSYAEIDQAISILKSVLEKQLIGSE

SEQ ID NO: 63584 - protein, 383 aa, Xanthomonas campestris pv. campestris str. ATCC 33913
MWGMLAVLLVFTQLTIFAVTLYLHRSQAHRGVDFHPVIAHFFRFWTWLTTSMITREWVAIHRKHHAKVETEEDPHSPQTKGIGQVFWRGVELYREARAQRADIEQYGKGAPNDWIERHLYTPHANAGPIALLVVNSVLFGLPGIALWAIQMAWIPFWAAGVVNGLGHWWGYRNFESADTSTNLTPWALWIGGEELHNNHHAFPSSARFSMRRWELDIGWIAIRCLQALGLAKVLRVAPSLDIRPNIAVPDADTLKALLSHRFQAMTDYQRNVLKPALREEAAATGAKLRQLLPRRLRKGLVDDGRWLKPDAREQLQHWVAQRPRMRTLVEYRARLTAVLEARSHDASERLKQLQQWCHEAEASGNAALQAYAARLKGYALSGT

SEQ ID NO: 63585 - protein, 87 aa, Oryza sativa
SMVADAYRTLLYGGIFAYPADKKSPKGKLRILYECAPMALIFENAGGQAVDSKMNRMLEVVPEHIHDKAGIFMGSYDEVEKVKKFHN

SEQ ID NO: 63586 - protein, 339 aa, Arabidopsis thaliana
MLSGNNGNTAPPVFMNENQLQYQTNLRSNQLHSLGNMGGGCTVDPVNYFANDNLVPMIRPNKRGREAESISNNIQRQQQKLQMSLNYNYNNTSVREEVPKENLVSTGLRLSYDDDEHNSSVTSASGSILAASPIFQSLDDSLRIDLHRQKDEFDQFIKIQAAQMAKGVRDMKQRHIASFLTTLEKGVSKKLQEKDHEINDMNKKNKELVERIKQVAMEAQNWHYRAKYNESVVNVLKANLQQAMSHNNSVIAAADQGKEGFGDSEIDDAASSYIDPNNNNNNNMGIHQRMRCKMCNVKEVSVLIVPCRHLSLCKECDVFTKICPVCKSLKSSCVQVFFS

SEQ ID NO: 63587 - protein, 411 aa, Photobacterium profundum SS9
MSGDIIKFSRNTENAPQSSVSTQTVAFSHYNNISAQLPVDPKTGEIVVGSVKEQATQCLNNIKAIVESIGHVMDDVVKLNIFVKNISDIEAIDEIYTTFFQSALPTRTVVAVAALPMSDALVQIDALISNGEGTTPQAPCALIKVSRDTENAPKGLYSQTVAFSHYNNLASQLPVDPKTGALVAGGVKEQTEQCLNNIKAILESIDHVMDDVVKTTIFLKDIADVEAVNEVCAKFYPNYVPVRSIVNASALPMGALVQIDTSVSHGDGTPPQLPEDTRLLVIEANNTENAPKATYSHTVAFSHYNHVSGQLPLDPKTNELVAGDVKAQAEQCLNNIKAIIESVDHVMDDTVKINIQLKNIEDIDAVNEIYTTFFKGDLPARTVVGVSAIPMGALVQIDAVVSNCEGTPPQA

SEQ ID NO: 63588 - protein, 843 aa, Arabidopsis thaliana
MGASRKLQGEIDRVLKKVQEGVDVFDSIWNKVYDTDNVNQKEKFEADLKKEIKKLQRYRDQIKTWIQSSEIKDKKVSASYEQSLVDARKLIEKEMERFKICEKETKTKAFSKEGLGQQPKTDPKEKAKSETRDWLNNVVSELESQIDSFEAELEGLSVKKGKTRPPRLTHLETSITRHKDHIIKLELILRLLDNDELSPEQVNDVKDFLDDYVERNQDDFDEFSDVDELYSTLPLDEVEGLEDLVTAGPLVKGTPLSMKSSLAASASQVRSISLPTHHQEKTEDTSLPDSSAEMVPKTPPPKNGAGLHSAPSTPAGGRPSLNVPAGNVSNTSVTLSTSIPTQTSIESMGSLSPVAAKEEDATTLPSRKPPSSVADTPLRGIGRVGIPNQPQPSQPPSPIPANGSRISATSAAEVAKRNIMGVESNVQPLTSPLSKMVLPPTAKGNDGTASDSNPGDVAASIGRAFSPSIVSGSQWRPGSPFQSQNETVRGRTEIAPDQREKFLQRLQQVQQGHGNLLGIPSLSGGNEKQFSSQQQNPLLQQSSSISPHGSLGIGVQAPGFNVMSSASLQQQSNAMSQQLGQQPSVADVDHVRNDDQSQQNLPDDSASIAASKAIQSEDDSKVLFDTPSGMPSYMLDPVQVSSGPDFSPGQPIQPGQSSSSLGVIGRRSNSELGAIGDPSAVGPMHDQMHNLQMLEAAFYKRPQPSDSERPRPYSPRNPAITPQTFPQTQAPIINNPLLWERLGSDAYGTDTLFFAFYYQQNSYQQYLAAKELKKQSWRYHRKFNTWFQRHKEPKIATDEYEQGAYVYFDFQTPKDENQEGGWCQRIKNEFTFEYSYLEDELVV

SEQ ID NO: 63589 - protein, 134 aa, Moorella thermoacetica ATCC 39073
MFGQGLLKGLSITWHFCFGKAVTEQYPERRPNLPPASHGSFRLEREKCIACGICANACPNHVITVESERDEQKKRHLTGYRVKLGQCLFCGLCVESCPQGALHWQPDFELACYRHEDTEQDLLVGQAVEVKKGA

SEQ ID NO: 63590 - protein, 788 aa, Azoarcus sp. BH72
MTRYVIPFTELRMTDVDQVGGKNASLGEMISQLPSSVRVPGGFATTAAAYREFLAHGGLADRINAALDTLDVDDVDALVKTGAQIRQWIVDTPFPAALEADIKAAYEKITAEGEGSFAVRSSATAEDLPDASFAGQQETFLNIHGYENILHAMKEVFASLYNDRAIAYRVHKNFAHAEVALSAGVQRMVRSDTGASGVMFTIDTESGFSDVVFITASYGLGETVVQGAVNPDEFYVHKPTLALNKPAVIRRNLGSKLIKMVFADKAVAGKSVRTVDVPEADRNRFSLTDEDVLELARYAVIIEKHYGRPMDIEWGKDGEDGKLYILQARPETVKSQSNGLVMEKYRLKQYGKALTHGRAIGQKIGAGTVRVVKDASEMNRVQAGDILVTDMTDPNWEPVMKRASAIVTNRGGRTCHAAIIARELGIPAIVGCGNATEVLEEGDSVTVSCAEGDTGYVYRGKLEFEVITTDMGNLPEIPVKIMMNVGNPELAFEFAQIPNGGVGLARLEFVINNMIGIHPKAILELSQVPASLRDEITRRSRGYATPKQFFIEKLAEGVATIAAAFYPKPVIVRMSDFKSNEYRKLLGGEIYEPEEENPMLGFRGASRYIAHSFRDCFELECAAMKKVRNELGLTNVQIMIPFVRNVEEAAGVVDLLAEHGLKRGVNDLKLIMMCEIPSNALLADKFLEHFDGFSIGSNDLTQLTLGLDRDSGLVAHAFDERDPAVKLLLSMAISTANRLGKYVGICGQGPSDHADFAEWLMDEGIQTISLNPDTVVDTWLKLASHGKQ

SEQ ID NO: 63591 - protein, 282 aa, Halobacterium sp. NRC-1
MLTGVVLAATRNPYDAARPTRGMLTFVGLGLYDEASVTVAGRDAIAAADRVFAEFYTSRLIGTDVAALEAHHDTTIERRDRAGVEQHPEPILDAAADGDAVFLTAGDTMISTTHVDLRMRAADRGIDTRVIHAPTAASAAAGLTGLQNYRFGKATTLPFPWAHGADGVPGSVTDTIEANRERGLHTLVYLDIKVDHPRVDGDAYMTASQAADLLATNWDADALGVVVARAGAPDATVRADRLGALADADFGSPLHLLVVPGSLHHIERDALRELAGAPADAL

SEQ ID NO: 63592 - protein, 346 aa, Bacillus licheniformis ATCC 14580
MDGNMKALIKKPGEPGASFELVPIPKIDKHEVLIKVKAASICGTDVHIYNWDEWAKSRVKPPYVFGHEFSGEVVQVGENVTTVKEGEYVSAETHIVCGKCLPCLTGKEHVCKKTLILGVDTDGCFAEYVKMPAANIWKNPAGMPEDLASIQEPLGNAVHTVLTGMTAGVKVAVVGCGPIGLMAVAVAKASGAAQVIAIDKNEYRLDLALQMGATDIISVEKEDPLKNVSALTNGEGADLVCEMSGHPTAIRQSLKMAANGGRVHVLSLPEHPVCIDMTNDIVFKGLTVQGITGRKMFETWRQVSGLLQSGTIQIKPVITHRFPMEEFEKGFELMRKGQCGKVVLIP

SEQ ID NO: 63593 - protein, 1137 aa, Oryza sativa (indica cultivar-group)
MSSSRSNNRATCSRSSSARSKHSARVVAQTPMDAQLHAEFEGSQRHFDYSSSVGAANRSGATTSNVSAYLQNMQRGRFVQPFGCLLAVHPETFALLAYSENAAEMLDLTPHAVPTIDQREALAVGTDVRTLFRSHSFVALQKAATFGDVNLLNPILVHARTSGKPFYAIMHRIDVGLVIDLEPVNPVDLPVTATGAIKSYKLAARAIARLQSLPSGNLSLLCDVLVREVSELTGYDRVMAYKFHEDEHGEVIAECKRSDLEPYLGLHYPATDIPQASRFLFMKNKVRMICDCSATPVKIIQDDSLTQPISICGSTLRAPHGCHAQYMASMGSVASLVMSVTINEDEDDDGDTGSDQQPKGRKLWGLMVCHHTSPRFVPFPLRYACEFLLQVFGIQINKEVELAAQAKERHILRTQTLLCDMLLRDAPVGIFTQSPNVMDLVKCDGAALYYQNQLWVLGSTPSEAEIKNIVAWLQEYHDGSTGLSTDSLVEAGYPGAAALGDVVCGMAAIKISSKDFIFWFRSHTAKEIKWGGAKHEPIDADDNGRKMHPRSSFKAFLEVVKWRSVPWEDVEMDAIHSLQLILRGSLQDEDANKNNNAKSIVTAPSDDMKKIQGLLELRTVTNEMVRLIETATAPILAVDITGSINGWNNKAAELTGLPVMEAIGKPLVDLVIDDSVEVVKQILNSALQGIEEQNLQIKLKTFNHQENNGPVILMVNACCSRDLSEKVVGVCFVAQDMTGQNIIMDKYTRIQGDYVAIVKNPSELIPPIFMINDLGSCLEWNEAMQKITGIKREDAVDKLLIGEVFTHHEYGCRVKDHGTLTKLSILMNTVISGQDPEKLLFGFFNTDGKYIESLMTATKRTDAEGKITGALCFLHVASPELQHALQVQKMSEQAAMNSFKELTYIRQELRNPLNGMQFTRNLLEPSDLTEEQRKLLASNVLCQEQLKKILHDTDLESIEQCYTEMSTVDFNLEEALNTVLMQAMPQSKEKQISIDRDWPAEVSCMHLCGDNLRLQQVLADFLACTLQFTQPAEGPIVLQVIPRMENIGSGMQIAHLEFRLVHPAPGVPEALIQEMFRHSPGASREGLGLYISQKLVKTMSGTVQYLREAESSSFIVLVEFPVAQLSTKRCKASTSKF

SEQ ID NO: 63594 - protein, 302 aa, Xanthomonas campestris pv. vesicatoria str. 85-10
MSNAAFWHGVLPAITTPFTANGDIDHEFLGKHANQLVDAGCTAIVPLGSLGEAATLSVEDKLAILRTLGTALNGRVPVVPGIASLATGEAVALAKAAKDIGCGGLMVLPPYVYSTDWREMGAHVRAVIGATDLPVILYNNPVAYKTDFGPAQIAELAAEFPNLQAVKESSGDVRRFAALQELLGDRLALLVGMDDAIVEGLSMGAKGWIAGLVNAYPKESVRLFELARDGGYPAARELYHWFLPLLRLDTVPTFVQLIKLVQAKVGMGSEQVRAPRLVVAGAERDAALKVIDHAIATAPTLS

SEQ ID NO: 63595 - protein, 338 aa, Bradyrhizobium sp. BTAi1
MTAPEGTLESFLEGDCSVSEPLAITVTALAFVAETLAGVISSGPLNGRLGEEVGANSDGDRQKKLDVVADELFAGALAPTPVRWYASEERPTAEMLNPEGTLALAIDPLDGSSNIDVNISIGTIFSVFEAKESGVESFLRPGREQIAAGYVVYGPQTVFILATRTTLAQFVLHRGHFFLVSDSLRIPDRTTEFAINASNYRHWSRPIRAFVDDCIAGDEGPWGENFNMRWVASLVAETHRILTRGGIFLYPADARRGYGQGRLRLVYECAPIAFIVERAGGKATDGIDRILDLTPSELHQRTPLVFGTAEKVSQVCAYHDLPESEVSPLFGTRGLFRA

SEQ ID NO: 63596 - protein, 384 aa, Kluyveromyces lactis NRRL Y-1140
MTSATAGKPIECVAAVAYEAGKPLTVEKIIVDAPKAHEVRVQVTHTAVCHTDAYTLSGVDPEGAFPSILGHEGAGIVESVGDGVTNVKVGDHVVLLYTAECGKCKFCKSNKTNLCGSVRATQGKGVMPDGTTRFHNLKGEPLLHFMGCSTFSQYTVVADVSLVTIDPSAPLSSVCLLGCGVTTGYGAAVKTANVQEGDTVAVFGAGTVGLSVVQGAKSRGASKIIVVDVNDQKKQWSMDFGATGFVNPLKDLKEGETIVSKLIDMTDGGLDFTFDCTGNVKVMRDALEACHKGWGQSIIIGVAAAGEEISTRPFQLITGRVWKGSAFGGIKGRSEMGQLVTSYQKGDLKVDDFITHKRPFTEINNAFEDLHHGDCLRTVLDLAN

SEQ ID NO: 63597 - protein, 391 aa, Halobacterium sp. NRC-1
MRDGRDPAGMPSERAAAVTPFAAMDVLERAADRADVIHMEVGEPDFAPPAAATEAAVDALRAGDDDYTTSRGRRSLRDAISGYYAAEYGVSVPAERIVVTPGSSPALLTVLLATVDPGSAVVLSDPHYACYPNFVRLADGVVRTVGLAPDAGFQPAVSDYDAAIGDDTAAMLLNSPGNPTGAVIDGESLSALVALADRTDTAVVSDEIYHGLAFDAAAHSVLEYTDDAFVIDGVSKRYGMTGWRLGWVVCPRRYVDTINAIAQNTLICAPSFVQAGAEAAIRHGTDWLDGVRADYRTRRDILCAAAERWGFDPGYTPAGAYYMLLDVSRLGAAPAVADALLETAGVAVTPGPDFGANATEYVRASFAVSTDAVREAVARIDAVLASATTLT

SEQ ID NO: 63598 - protein, 447 aa, Lactobacillus plantarum WCFS1
MSTVGNTPRWLAVAALAKIKNGAYSNLQLNQLINDHQMDRRDINLLTNMVYGVIQHRLTLEYWLTPFVRHPHQIDPWVRELLLSALYQWQYLDKIPQRAVFNETIEIAKVKGHPGIRRFVTGVLHQMDRSGLPSFDAIKNPDERLSVTYSMPIWLIQELRRQLGAEKMERILSSLNQPAKQALRVNPALSTVEDVTTALINDGLTITPSEISPLGLIATDGQAINTEAMRYGMFTVQDESAQLVVPALNPQPNDRVLDACAAPGGKTTQIAASLDAEQGGTVVALDIHANKVKLIGQNAARMHVADRVEATELDARKVETQFNAESFDRILVDAPCSGLGLMRRKPEIRYEKQLQDSLNLQRIQLAILTAVAPTLKKGGIMTYSTCTILQQENQDVITKFLADHPDFELQTTPTERDLKTDRTEKTLSIYPDDYLSDGFFIACLRKK

SEQ ID NO: 63599 - protein, 671 aa, Bradyrhizobium sp. BTAi1
MNLVAERRAALDEAQMANAIRALAMDAVEAAKSGHPGMPMGMADVATVLFKHFVKIDPTQPNWPDRDRFVLSAGHGSMLLYALHHLLGFHDMPMDQLRRFRQLGSRTAGHPEFGHAAGIETTTGPLGQGIATAVGMALSERMLNARFGDDLVDHHTYVIAGDGCLMEGISHEAIDLAGHLGLGRLIVLWDDNQITIDGPTSLSTSLDQKARFVAAGWHVAAVDGHDGEAVANAIIEARADPRPSLIACRTIIGFGAPNKQGTSATHGAPLGKEEVAAARESLGWIYSPFEVPEAIVHAWRVVGARGTRIRAEWQERLARSPQREEFVAHLAPPDAARLHAALADHRRRLCGERPKVATRKASELALEVVNSTIPNMVGGSADLTGSNNTRTKGMRPVTRSDFTGNYIHYGVREHGMAAAMNGISLHGGLRPYGGTFLAFSDYCRGAIRLSALMGRPVIYVMTHDSIGLGEDGPTHQPVEHLASLRAMPNVYVFRPADAVETAEAWEVALAAAKTPSVLCLSRQDLPTLRTEHGDENMTARGAYLLRDPGEHRDLTIIATGSEVAIAVEAADELSADGLAVAVVSAPCWELFAAQEAGYRAAVLGEGPRVGVEAGVALGWAEWLGPNSIFIGMTGFGASGPAADLYNHFGITAERVAAEGWRLARKPGEEHE

SEQ ID NO: 63600 - protein, 395 aa, Legionella pneumophila subsp. pneumophila str. Philadelphia 1
MVFGFLNLSFWGYVLATFILTQITIASVTIYLHRNQTHRALTLHPVVSHFFRFWLWLTTGMVTADWVAIHRKHHATTDVEGDPHSPVVEGIRKVFWQGAELYREARKDRDMVAKYSHGTPTDWIERNVYSRHSSKGILLMLLLDLFFFGIPGMTVWAIQMMWIPLFAAGVINGIGHYWGYRNFECPDAATNIIPWGFWIGGEELHNNHHTFASSAKFSVKWWEFDIGWMYIRILSLFGLAKVKKLPPKLAMDEGKFHVDLDTVRAVISNRFQVMSNYYKNVIRPILKYEKNTGIETKEDKKLFQRAGRLLRREDKLLSTKAKTRLQKLLDAREQLRVVYSYKQSLQNVWLKTATTQKELVEALQQWCRQAEESGLDVLKQFAQQLKGYVPVYTRE

SEQ ID NO: 63601 - protein, 335 aa, Bradyrhizobium sp. BTAi1
MTVRVAINGFGRIGRNVLRAIYESGRGDIEVVAINDLGSVDINAHLLRYDSVHGTFPGAVKVNGASIDIGRGSPIRVTAERDPKTLPWKDVDIALECTGIFTAREKASLHLENGSKRVLVSAPAAGADKTIVFGVNHNSLSPGDNVVSCASCTTNCLAPVAAVLHRTIGIDKGFMTTIHSYTGDQPTLDTLHKDPYRARAAAMSMIPTSTGAAKAVGLVLPELNGKLDGVAIRVPTPNVSVVDFKFIASRETTAEEINSVVRTAAGADLEGILGFTDEPLVSVDFTHDPRSSIVHMDQTKVIDGRLCRVMSWYDNEWGFSNRMADTAVAMGRLIG

SEQ ID NO: 63602 - protein, 189 aa, Solanum demissum
MESTISSSSSRSVSPSSSSSPNSPPSPSVTMVVVSPCAACKILRRRCAEKCVLAPYFPPNDPIKFTTAHRVFGASNIIKFLQELPESQRADAVSSMVYEANARLRDPVYGCAGSICQLQKQVSDLQAQLAKAQAEIVNMQCQQANLMALICMEMGQSTPQAISPPQQSLDNFPMNYLDDNIGSWETLWT

SEQ ID NO: 63603 - protein, 446 aa, Streptococcus thermophilus CNRZ1066
MVQFFDRKETMKFPSDFIEKYKDLLGAEAEEFFTSFDQEAVSAYRINPLKKQQKDYPDPIPGTPWGYYGKISGKSSDHATGLVYSQEPAAQMVAQVAAPSKGSRVLDLAAAPGGKSTHLLSYLDNTGLLVSNEINFKRSKVLVENIERFGAKNVVVTNTSADKLAKVFKNYFDMIVFDGPCSGEGMFRKDPDAIQYWHKDYPSELAQLQKDILADGLKMLAPGGQLVYSTCTWSPEENEGVVAWILENYPDLELVAIPKLNGMSDGIDFPETARMYPHHFKGEGQFVAKFQDKRMPEQSCIKEGKTNLNKEQKQLWDDFVKKHLKLPLDGLLQVFGDNLYLLPRGLPDLSKVKIARNGLHLGIFKKKRFEPSFALGIALTSDEVVSSIELTQEQFAQYASGNVVTLDQTLENGWYQLLVDGNGFGFAKVIGNTLKNYYPKGLRFHI

SEQ ID NO: 63604 - protein, 433 aa, Methanothermobacter thermautotrophicus str. Delta H
MTQMDEAKKGVITDEMKAVAEAENVTPEFVRRGVASGKIAIPSNLNREEVAAVGIGAGLRTKVNATIGTSTDIVDFDMEEEKARIAIENRADTLMELSVGGDLDEIRRRILDLSPIPVGSVPVYQAAIETIREKGASIYMDEDVMFRAIEKQAKDGIDFMAIHCSVNRETLRRLKRQGREGGLVSRGGAFVSAWMVENGLENPLYENFDYILEIAKEHDFVLSMANAMRAGAIADSTDRAQVQELIVLGELIDRAREAGVQTIVEGPGHIPLNEIKANVILQKKLCRGAPFYMLGPIVTDIGAGYDHIVSSIGAAASAAAGADFICYVTPAEHLALPYPDDVKEGVIATRIGAYVGDMVKGIHNGEKDLEMANARKKLNWEAQFDAAMCPAEARRIRDERPPEDPDTCTMCGEYCAVKIVNEWLDSADTRIFD

SEQ ID NO: 63605 - protein, 306 aa, Burkholderia sp. 383
MSRNAIQWTGVFPAVSTQFKPDFSLDIDATHRVVKNLVNDGVSGLVVCGTVGENTSLSTSEKLQVIEAARDAAGGKIPVIAGIAEFTTEFARNTVREAQRVGVDGVMVMPALVYSAKPHETAAHFRAVATSTDLPVMVYNNPPIYKNDVTPDVLIALQDCENIVCFKDSSGDTRRFIDLRNAVGDRFVLFAGLDDVVVESIAVGAEGWVSGMSNAFPKEGETLFRLAKQKRFDEALALYRWFMPLLHLDARPDLVQCIKLCEELVGRGSAITRPPRLALQGDTLAEVKAIVAKALETRPALPDVGL

SEQ ID NO: 63606 - protein, 446 aa, Thermoanaerobacter tengcongensis MB4
METDVLVIGGSAGGILAALSVKKTYKDKKVTVIRMAERVMVPCGIPYIFGTLKDTSKNVIPDSMLTNAGVELVIDEVVSIDRQNKKVSTRKNGDISYKKLILATGSLPIVPTFIPGYDLDNVFTIKKDEEYLKFVQQKINEAEDVVVVGGGFIGVEMAEQVQLLGKNVTIIEVADKLLWQAFDPEFSDMAEAKLKEHGIKVLTGTKVTKFIGEKEVKEVEIHTGERIKADVVIVAMGVKPNTKLAEEAGIKLNEKGAITVDEYMRTNDPDIFAVGDCAEKKCFFTRKNVPILLASIAANEAKIAGVNAFELRLVRENKGTISAFSTKIYNTAFAAAGLTETQARAEGFDIVIGEFNTIDKHPGTLPNTMNVKIKLIFSRYSGVILGAQLAGGDNVGEMINILSLAIQKGTTASELTTFQVATHPLLTSSPVSYPISSAALDALSKI

SEQ ID NO: 63607 - protein, 306 aa, Brassica napus
MAMTTMEIREEDWKVCCGSSDFAKLMVKASPFNSLDAAIESARDIWFNQVNVAAWLEAFAAHPQIGKSPSPSSNSDFARRSVTEQSRAFATTSASALEELAEWNVLYRQKFGFIFIICASGRTHAEMLAELKGRYANRPIVELEIAAKEQMKITELRMAKLFSEKAKVVSQTESTKPQEAPKRSRPPITTHVLDVSRGAPAVGVEVHLEVWNGTTSPSFGHGGHGDWSMVGTSATDKDGRSGPLMDLVEALKPGTYRISFNTGKYCPGGFFPYVSIAFEVTESQKWEHFHVPLLLSPFSFTTYRGS

SEQ ID NO: 63608 - protein, 368 aa, Bacillus sphaericus
MEKRDYYEVLGLTKDEIKKAYRKLSKQYHPDLNKEPGADEKFKEIAEAYEVLSDDQKKARYDQFGHEDPNAGFGGGFGGGGFGGFEDIFSSFFGGGGRRQDPNAPRKGDDLQYRMNIKFEEAIFGKETEIEIPKDETCETCHGSGAKPGTQPETCSTCNGAGQINQAVDTPFGRMMNRRSCTTCHGTGKIIKEKCSTCRGEGKVQKRKKIKVSIPAGVDDGQQIRVSGQGEPGINGGPAGDLYIMFRVQGHNDFERDGDDIYFELKLTFPQAALGDEIEVPTVHGKVKLRIPAGTQSGAQFRLKDKGVKNVHGYGMGNQYVTVKVMTPEKLTEKQKQLLREFAEISGDIPEEQGSSLFDKIKKKFQGE

SEQ ID NO: 63609 - protein, 201 aa, Glycine max
MEFSQDDFDRLLLFEHTRKSAEANYAENPLDADNLTKWGGALIELSSFQAPKDAKAMIDDALSKLEEALLINPTKHDTLWCLGNANTSYAFLIPDITEAKGYFDKALDYFQKAVDEDPENDLYRKSLQVAIKAPELHMEIHKNGLGLMSNAGSSATSKEKESKRQKSNDFKYDIFGWIILAVGIVAWVGMAKSNIPPPPPR

SEQ ID NO: 63610 - protein, 336 aa, Moorella thermoacetica ATCC 39073
MLKHVVTLIPGDGTGPELIAAARRVLEASGAELEWEVMAAGEGAQEKYGSVLPEETLASIRKNGVALKGPITTPVGTGFRSVNVALRKELDLYANVRPFRNLPNVPSRYQGVDLVIYRENTEDLYAGVEHMVGEDAAESIKIITRKGSERIARAAFEYARRQGRKRVTAGHKANIMKFSDGLFLRTFYDVARDYPEITADDRIVDNLSMQLVQKPEQYDVLVLPNLYGDILSDLCAGLVGGLGVAPGANIGEKAAVFEPIHGSAPKYAGQNKVNPLATILSGVMMLEHLGEKEAAARIQRAILAVLAEGKYLTYDLGGSAGTSDMADAIVRRLEVE

SEQ ID NO: 63611 - protein, 382 aa, Zea mays
MENSAAAAAERPRLTRAAAKRSAVVTAVAVAAKRKRVALSQLPTLPNAVLGAHDDDDDKPVRKQRLLPAAKPKPKPKAAPAPAAPAAADDTDDDIQLCKPYASDIYSYLRSMESQAKRRLAVDYIAAVQIDVTPNMRGILIDWLVEVAEEYKLVSDTLYLTVSYIDRFLSAKVLNRQKLQLLGVSAMLIASKYEEISPPNVEDFCYITDNTYTKQEVVKMESDILNVLKFEVGSPTAKTFLRMFIRSAQEDNKKYPSLQLEFLGSYLSELSLLDYGLIRSLPSLVAASAVFVARLTLDPHTHPWSKKVQTLTGYKPSELKDCVAAIHNLQLNRTCQSMVAIREKYRQHRCTNCGKIFEQFKGVSALLPPVEIPASYFNTLKE

SEQ ID NO: 63612 - protein, 311 aa, Brassica napus
MAALSDKLADAYQNARPRYPIDWFTKLAARTGQHKLAWDVGTGNGQAAIGLAEYFEKVVATDINEAQLKRAVKHERISYHHTPKELSEDKMVALVGGDNSVDLIVAAQAVHYFDLQPFYNIAKRVLRKEGGLIAVWVYNDLVISPEVDAIMKRLVDSTFPYRTPVMNLAFDGYKTMPFPFQSIGMGSEGKPIQLDIPHKLSLKGFVGFLRSWQPAMKAKERGVELVTEDLINQFEDAWGDDDDVKDIFYKAHMIVGKLSSADIERHRKRFESNCVVTKLKDSNNSAVIASVTAAAFAGVAAYCAYSARKNT

SEQ ID NO: 63613 - protein, 675 aa, Mesorhizobium loti MAFF303099
MCGIAGIVALNAAAASPSREALMRMVGTLAHRGPDEHGLYRDKRAGLAHARLSVVDLSSGQQPLADTGDTSWIVFNGEIFNYVELREKLIALGHRFRTRSDTEVALHAYRAWGEAAFERMNGQWAIAIWDSIAGRLVLSRDRFGICPLHFCEHAGRLYFASEVKAIFAADPTIPRAFDPAGLDQTFTLWTVVPPQGVFQGIHELVPGHVRIYQDGTVREQVFWQPSYPENIGALQGEFTGSCDDAVDRVRDALEAATALRMVRADVPVGCYLSGGLDSSLVATLGRRFAGRRFQTFSLRFADAEYDETRFQRLVAEATGSEHHEVVVSRGDIAAIFPEVIHHTERPILRTAPAPLFLLSRLVRERGIKVVLTGEGADEMFAGYDLFREAKVRRFWGRQPASTRRSRLLERLYPYLTRSPVQQQAMARQFFGRGIEAYDAPGFAHDTRWRSTGAIKRLFSADLRAESQRRDAVSELLARLPAAFSRWSHLAQDQYLEVQTLMSGYLLSSQGDRMLMAHSVEGRFPFLDDELVRLANSLPPSYKLRVLDEKHVLKRVAQPIVPSEIVTRKKQPFRAPNALCFAADAAPEYIREALSETAIRKANVFDPVSVTRLLDKCQARTGDGDLSNADNMALVGVLSTQLLHQQFVASCPSATHVRGLSVDVDREHREERLHVA

SEQ ID NO: 63614 - protein, 460 aa, Salmonella typhimurium LT2
MRYRFPDNFWWGSACSALQTEGDSLNGGKSQTTWDVWFERQPGRFHQGVGPAETSTFYRHWKQDIALLKQLKHNSFRTSLSWARLIPDGVGEVNPQAVSFYNHVIDELLAQGITPFITLFHFDMPMVMQEKGGWENRDVVEAFGRYAQTCFTLFGDRVKHWFTFNEPIVPVEGGYLYDFHYPNVVDFKRAATVAYHTVLAHSTAVRAWRAGRYDGEIGIVLNLTPSYPRSQHPADVQAAHHADLLFNRSFLDPVLKGEYPADLVALLKTYDQLPACQPGDRQLIADGKIDLLGINYYQPRRVKCRDTAVNPQAPFMPEWLFDYYDMPGRKMNPYRGWEIYAPGIYDIITNLRDNYGNPRCFISENGMGVENEQRFVQAGQIHDDYRIDFISEHLKWLHKGISEGCHCLGYHMWTFIDNWSWLNGYKNRYGFVQLDLATQTRTVKKSGEWFAATAEHNGFD

SEQ ID NO: 63615 - protein, 264 aa, Thermus thermophilus HB27
MEPFLLYALLGGLFTWGLTAVGAASVFFAREPSRKLLDAMLGFAAGVMLAASVFSLLVPGMEMAEAQGKNPIFPAVVGFLLGGGLIRLLDRYLPHVHLGPKDAPEGLKTLWRRTTLLILAIALHNFPEGLAVGVAFGAAGLDPTGAATLGGAIALALGIGLQNLPEGLAIAWPLRRVGIGAGLAWFYGQLSAIVEPLGAVLGALLVAQMMALLPYLMAMAAGAMVFVVVEEVIPESQAEGNGDLATFGVMTGFALMMALDVALG

SEQ ID NO: 63616 - protein, 400 aa, Bradyrhizobium sp. BTAi1
MTLKSVHDVDISSRRLLIRADLNVPMNNGGVADATRIERFVAGLKPLLARGARAVVLSHLGRPDGQRRPELSLEPVAAALGRVLGKDVAFSEAISGPVAARSAAALGPGDVLVCENLRFDQREEANDASLAEELAELGDLYVNDAFSCAHRAHASTVAIAERLPAVAGPLMMAEISALTQALEAPQRPAVALVGGAKVSSKIDVLFNLIGKLDTVIVGGGMANTFLAANGLPIGKSPHESAKFETVRKILSRAQSCGCQIVLPVDIVWADRFERGAEAHIAELDCCPQHGMILDAGPRSIERIWDVLAEAKTILWNGPLGAFEIEPFDHATEAVAAEAARLTRVGKVKSIAGGGDTVAALNAAGVTEDFTYVSTAGGAFLEWLEGKELPGVSVLRTPQLA

SEQ ID NO: 63617 - protein, 373 aa, Desulfitobacterium hafniense DCB-2
MEPIKGEQRDGQSEIRKLAILTGGGDCPGLNAVIRAAVKTACHRGIAVVGIQDGFRGAVEGDFRPLELKDVSGILPRGGTILGTTNRDNPFAYPTQVGEERQVQDRSAEVLDRFKAEGIDALIAIGGDGSLSIAWEFAKQGLKVVGVPKTIDNDLMCTDLTFGFQTAVATAQDALDRLHTTAESHHRIMILEVMGRYAGWIALYAGVAGGADVILIPEIPYQLESIAEAVQRRARLGKHFSIIVVAEGAKPLGGDMVVERTMSGRTDPIKLGGIGAKLAADLEKVTDMETRVTVLGHLQRGGSPIAVDRVLSTRYGVAAVEAALAGDFGMMVALQGQDIVRVPMAEAVHKLKQVEPDDPVLNAARSMGIEFGD

SEQ ID NO: 63618 - protein, 393 aa, Ustilago maydis 521
MSANYWASTQCNNWLLDRPQLELARKEDLRYATRLECAALGVFFSNLLSLICKRLNLRQRVTASANVFFRRFFAKNSYSALDPFLVCATCVYVAAKVEESPIHIKSAVAEATRSFTEHGFRGMPTDHSSLAEMEFYLLEEMEFDMVLFHSYRSLIVMFEDYGSGSAVGSGNSIHERSAGAAGSGSGSGGSGMMIGLGIEAAAFGVTKGLASVEEGDAASAIAEEDKVQLNEFNDEVLLMCWFILNDTYKTDIPLMYPPYMVALASIWLGLSLHPPSFDKITASLHTMQTRRDEHHLSIQRILDNPASTPAELASAKREPSPPSQDALTFFASLNVSLPLLAEIVQEMVSAYSVQHQVQRLVSDGPGIVKLLERMRESRRVALIKDRDQTRTHA

SEQ ID NO: 63619 - protein, 430 aa, Coxiella burnetii RSA 493
MSNRKAKLSFENQSVEFPIYSPTLGKDVIDVKTLGNHGAYALDVGFYSTAACESKITFIDGEKGILLYRGYPIDQLADKSDYMEVCYLLMYGELPNKGEKEKFVRTIKEHTSVYEQVTKFFNGFHYDAHPMAMVLSTIGALSAFYHDALDITKPADRELSAIRLIAKMPTLAAMSYKYSIGQPFMHPRRAMNYAENFLHMLFGTPYEETEPDPVLARAMDRIFILHADHEQNASTTTVRVAGSTGANPFACISAGISALWGPAHGGANEACLNMLRKIGDEKNIGQYIKKAKDKNDPFRLMGFGHRVYKNYDPRAKVMQKTCYEVLDAVGRHNEPLFKLAIKLEKIALEDDYFIEKKLYPNVDFYSGLTLNAIGIPSNMFTVIFALSRTVGWISHWMEMMSSPDHRLARPRQLYTGETEREVISLDKRQA

SEQ ID NO: 63620 - protein, 865 aa, Methanothermobacter thermautotrophicus str. Delta H
MTVLEAALANDIYIPHLCFREGIEPFGGCRLCLVENTDGRLVTACETPVEDGAEFISESERINNIRRTVVSLLISEHSRDCLSCPSSGDCSLQEVSSYLNLTEDDLSRLRQDLPESEPDESNPFFIRNHDKCILCGLCVRVCRATGAEAIDFAYRGHDTRISTFMDRAITESSCVSCGECVEVCPVGALVSREEKPFTEVKTVCPYCGAGCGIYLGVRGDRVVSSRGDPDNPVNRGKLCVKGRFALKFVNSPERLKKPLIKVDGRFVEVEWDEALSTVAERLSEYSGEEFAAVASAKCTNEENYILQKFTRAVMLSGNIDHCARLCHAPSVRSLSMTLGSGAMTNSIAELEDSACILAVGTNPTETHPLTAYSVIRAIRSGAKLVVIDPRRTRISELADIHLQNRPGSDIPLIMAMCRFIIEEGLHDTEFIESRTENFDEFRDAVMALDLEEVESLTGVGVEDMRRAAITYASKKPASIIYSMGITQHAHGTDNVIALSNLALLTGNLGKPSAGINPLRGQNNVQGACDMGALPDLLPGYQTLDDSFRFSDKWGSTIPGPGMTLPEMFDAALEGRLRAMYIMGENPLLSEPETEKTRKALESLDFLVVQDIFMTETAELADVVLPACAWAEKDGTFTNTERRVQLIRKALDAPGEARTDWEIICMLAEKMGAEGFDYASSSEIFKEIAALVPSYAGISHERLQDGGIQWPCTSYEHGGTQYLHSERFSTPTGRASFLLPGYHVGEVSEEYPMVLVTGRNLYQYHTRSMTGRVPELDSFSDREELLINPLDAAKLGVEDGGTVLVKSEGGSLEVRARVSGDVMEGVVFMTFHFAETPANVLTGGDRDPVSGMPELKFTPVSIRPVE

SEQ ID NO: 63621 - protein, 88 aa, Triticum aestivum
GILQAISHVIALFLLPMHFRTHIALLFIEAVWTANIHDCIHGKIWPVMGAGYHTIHHTTYRHNYGHYTVWMDWLFGTLREPEDLLKKD

SEQ ID NO: 63622 - protein, 419 aa, Ralstonia solanacearum GMI1000
MASGKIAAFRDFSAAAMPNVLRLTDLISEGKLAGKRVFIRADLNVPQDDAGNITEDTRIRASVPAIRAALDAGAAVMVTSHLGRPTEGEFKPEDSLAPVAVRLSELLGCEVKLVQNWVDGVDVAPGQVVLLENCRVNKGEKKNSDELAQKMAKLCDVYVNDAFGTAHRAEATTHGIAKFAPIACAGPLLGAELDALGKALGQPARPLVAIVAGSKVSTKLTILKSLADKVDNLIVGGGIANTFMLAAGLKIGKSLAEADLVGDAKAIIDLMAARGASVPIPVDVVCAKEFSATAAATVKDVKDVADDDMILDIGPKTAAQLADQLKASGTIVWNGPVGVFEFDQFGNGTKVLAEAIAASSGFSIAGGGDTLAAIAKYGIADRVGYISTGGGAFLEFLEGKTLPAVEILEQRAQRQEALA

SEQ ID NO: 63623 - protein, 306 aa, Zea mays
LGSPPAGPANLQPAEHSQLTQAPYLCSIVGTRVSRARRDSAGMARWRARRLLPLATFVTLGMILGSLLQLALLHRLDGYSVHADSDPEAVLLRLGYVKPEVISWTPRIIVFHNFLSSEECDYLMAIARPRLQISTVVDVATGKGVKSDVRTSSGMFVNSEERKSPVVQLAIEKRISVFSQIPKENGELIPVLRYEASQYYRPHHDYFSDTFNLKRGGQRVATMLMYLTDGVVGGETHFPQAGDGECSCGGNVVKGLCVKPNKGDAVLFWSMGLDGNTDPNSIHSGCPVLKGEKWSATKWMRQKMTF

SEQ ID NO: 63624 - protein, 454 aa, Legionella pneumophila subsp. pneumophila str. Philadelphia 1
MTMKTKHFDLIVLGGGSGGIASAVRAAQYGAKVAVIEQNHLGGTCVNLGCVPKKIMYNASSIAETLHKSPDYGFFLENNAKLDWKRLVNKRNAYIERLRENYEKRFSQHKITLIQGKGIFHDQSSITIDHTIYQAEHIIIATGSEPALPAINGIKHAIDSDGFFSLTKLPAKVAVIGSGYIGVELAGILNSLGSETHLLMRGTRPLSRFDHMIGDTLMEIMQKQGICIHQNHKAQAIHLHSDGRKSILCQSGSIIENIDVIISAVGRKPRTGNLNLDKINVNMDDKGLILVDAFQNTSVKGIYAIGDVTNAPALTPVAIAAGRRLADRIFGNQPDACLNYDNICSVVFSHPPSGSVGLTEHEAIEKYGKNKIKIYQTRFIPMYDALSIDKTPTAMKLVTLGKKEKIIGLHVVGYSADEMLQGFGVAIKMGACKKDFDNTIAIHPTSAEEFVTMV

SEQ ID NO: 63625 - protein, 370 aa, Rhizobium leguminosarum bv. viciae 3841
MTARNLFLLPGDGIGPEAMGEVRKIIAYMNEAMNAGFVTDEGLVGGCAYDAHGAAISEADMQKALAADAVLFGAVGGPKWDSVPYEVRPEAGLLRLRKDLQLFANLRPAICYPALAAASSLKPELVEGLDILIIRELTGGVYFGEPKEIIDLGNGQKRGIDTQVYDTYEIERIAGVAFEMARTRQNRVCSMEKRNVMKSGVLWNQVVTETHKAKYSDVQLEHMLADAGGMQLVRQPKQFDVIVTDNLFGDMLSDVAAMLTGSLGMLPSASLGAPDGKTGKRKALYEPVHGSAPDIAGKGIANPIAMIASFAMCLRYSFNLVKEADDLEKAIANVLDKGIRTGDIMADGARQVGTVEMGDAILAEFKTLSA

SEQ ID NO: 63626 - protein, 447 aa, Oryza sativa
  misc_feature (10)..(10): Xaa can be any naturally occurring amino acid
  misc_feature (77)..(77): Xaa can be any naturally occurring amino acid
MAATIVSVKXARQIFDSRGNPTVEVDVCCSDGTFARAAVPSGASTGVYEALELRDGGSDYLGKGVSKAVDNVNSVIXPALIGKDPTSQAELDNFMVQQLDGTKNEWGWCKQKLGANAILAVSLAICKAGAIIKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIADLAVGLATGQIKTGAPCRSERLAKYNQLLRIEEELGAAAVYAGAKFRAPVEPY

SEQ ID NO: 63627 - protein, 801 aa, Bacillus anthracis str. A2012
  misc_feature (387)..(387): Xaa can be any naturally occurring amino acid
MKKRLVMIGNGMAGIRCMEEILKHDCDSYEITIFGDEPHPNYNRIMLSHVLQGKTNIQDIIMNEYSWYEENEITLYTNERVQSIDREEKVIMTEKNRTLTYDKLIIATGSSAFILPVEGSTLPGVTGFRTIEDTQFMMDTAKEKKKAVVIGGGLLGLEAARGLIDLGMDVHVVHLMPSLMEQQLDTKAASLLREDLEAQGMKFLMEKKTVKILGTNHVEGIQFEDGEVVDCDLIVMAVGIRPNTQIARDAGLIVNRGIVVNDYMLTNDESIYAVGECAEHDGIAYGLVAPLYEQGAILAKHISNLQTDGYSGSIVGTQLKVAGCDLFSAGQIYEDDQTKAISIFNECKRSYKKVLIRDNKVVGIVLYGDTADGTRLFSMLKKEEDIXEYTPASILHKAGEESELDVATMSADDTICGCNGVTKGTIVHAILEQELTTFEEVKGCTKAAGSCGKCRPLVEQVLSHTLGDAFDASAQSAGMCGCTPLSRDEVVAAIHEKGLKSPKEVRNVLGFVHEDGCSKCRPALNYYLRMAIPEEYEDDKASRFVNERMNGNIQHDGTFSVIPRMYGGVTTADDLMKIAEVAKKYDVPLVKITGASRIGLYGVKKQDLPNVWADLNMTSGYAYSKSLRNVKSCVGSRFCRFGTKDSLGLGMLLEQSLEMVDTPHKMKMGVTGCPRNCAEVLTKDFGVVCVENGYQLYIGGNGGTEVREADFVMIVPTEDDVLHIATAYMQYYRETGIYGERTAYWTERLDFDHIKEILQDANMVTKLNERFQTARGTYKEAWGQALETKSLKAMYEVETVK

SEQ ID NO: 63628 - protein, 158 aa, Brassica napus
MASATQLLSRPPPLRGNLNRYQSSLPRISVLSLKSTSKPLNRLSVKAAAAASQNSVKTPTKDAAFKHCFKKSSDGFLYCEGTKVEEIMESVERRPFYLYSKPQITRNVEAYKEALEGVRSVIGYAIKANNNLKILEHLRSKGCGAVLVSGNELRLALI

SEQ ID NO: 63629 - protein, 233 aa, Brassica napus
EFMNGLKLLSSMSHENLVKLRGFCCSRGRGECFLIYDFASKGKLSSFLDLQERETGRVLAWPARVSILKGIAKGIAYLHGSDQENKHAIVHRNISVEKILLDELFNPLIADSGLHNLLADDLVFSALKTSAAMGYLAPEYVTTGRFTEKTDVFAFGVIILQILSGKLMLTSSLRTAAENGEHFGFMDEYLGEGFDKTEAVALARMGISCTQEIPNNRPNIESLLREITCMKSE

SEQ ID NO: 63630 - protein, 665 aa, Mesorhizobium loti MAFF303099
MCGIAGILLAPDAANTNALRAIGPMMMALRHRGPDGEAFWMSREAGIAFGHRRLAIVDLSEAGRQPMHSASGRYVITFNGEIYNFRDLRRELEGAGHHFRGTSDTEVMLCAIESWGLEAALARFAGMFAFGLWDLKNRTLHLARDRMGKKPLYVASTPEALVFASELKAITCFPGFTPELDVDAAATMLSKGWVPDDRCIWQGVFKLPPGSVLSVTAADFANARGAGSLAHRIRRWWSLADVACKAQRDPIAGSDEDLTTELDSLLRLAVKERMVADVPLGAFLSGGIDSSTVVALMQAQSPTPVRTFTIAFGESGFDEAPHAAAVARHLGTDHTELHLSPAAALEVIPELPRIWDEPFADESQIPTLLVSRLARRHVTVALSGDGGDECFAGYSRHFLATRLRRQHELPSSFRRMLAAGAGLLAQASQKDIFGSLPLSANMRHGLRGDRLNRLARLFAAANEDQLLQRLTESSTNKLIHHKPAASNASATQLDGLLSRLLFDDMTGYLPGDILVKLDRATMANSLEGRCPILDHRVVEFAWRLPTDAKVRSGKGKWILRQLLDRYVPRRLVDRPKQGFDVPVGAWLRGPLRDWATDIIATTRLSGDGVIDCAKVDACWRDHLHGNQDHFRDLWPLLMFQAWRNDAMRPSAPATHASYDIELTGD

SEQ ID NO: 63631 - protein, 359 aa, Oryza sativa (japonica cultivar-group)
MAGKWRKVVGGGTNGGGRHAMGRRRGTWRPVEVGHGDPEVVRRLGKQTWRGGDGGNSGGVEEAHRPPLSPGGHGRRGGARRSMALPSPSLVGLLFLPAAMDDEEENGACAALPSPSMSSPLLADPLSLPVAMNSKEEHNAAWRYRLPQCYPPCSQAWDIVNATRDRDGARGGEGQQKGHEGESADIDEKEIRKEKPEELVVALAHAKADAIMEKLRDNGMMKEILDSQETTLLITADQVVVHDGVIREKPSTPEEARKFIKGYSESHAATIGSVLVTNVKSGARKEGWDKAEVYFHKIPDEVVESLIEEGDVFYVAGGLLVEHPLTSPLVEAIVGTIDSVMGLPKSLTEKLIKESLEEP

SEQ ID NO: 63632 - protein, 396 aa, Azoarcus sp. BH72
MSHVMNTYARLPVAFERGEGVWLYDDAGKRYLDALSGIAVSTLGHNHPRLVRAIAEQAAAVLHTSNLYRIPLQEKLADRLGAISGMDEVFFCNSGCEANEAAIKLARFYGHKRGVAQPTIIVMENAFHGRTLATLSATGNRKAQAGFEPLVSGFIRVPYRDIQAIRQVAEHNQDVVAVMLEMIQGEGGINLAEAGFQRELRELCDARGWLLICDEVQCGVGRTGKWFGWQHADVRPDVVTLAKGLGSGVPIGACLTSGAAAGLFGPGNHGSTFGGNPLACAAALTTLEVIEESGLMAQAEAVGETICSGLREALAGCEGVVEIRGRGLMIGVELDRPCGALVTKALENGLLINVTAERVVRLLPALVFTAADAQALVGALAPLIRDFLSQQGKGTA

SEQ ID NO: 63633 - protein, 462 aa, Desulfitobacterium hafniense DCB-2
MFIRIQTYPVCIFYIRLFYIFIYIKEGVVSLTQLQEARKGIITPEMVQAAELEGITGEELRQKIAIGEAVLPCNINHQGLRPMAVGKGLSTKVNANIGTSDAYPELAPELSKLEIAVAAGVHSIMDLSTGGDIDEIRRRIIQDSPVMVGTVPLYQVMVDTHKAGRGLVEMTDDEIFAGIEKHCRDGADFITVHCGVTLEVIQELREQGRVMDIVSRGGSFITAWMLHHQRQNPLFEQYDRLLNIALHYDVTLSLGDGLRPGCLADATDGPQIKELITLGSLVKRAQEAGVQVMVEGPGHVPLHQIETNMQLAKTLCHNAPFYVLGPLVTDVAPGYDHITSAIGGAIAASSGADFLCYVTPAEHLGLPTEEDVKEGVIAARIAAHAADLVKGIKGAWEWDLEMAKARKALDWPKQIQLSIDPEKAGRMRKAKNEDSQERCTMCGKFCAYQLISDYMGTPFKGC

SEQ ID NO: 63634 - protein, 336 aa, Methanothermobacter thermautotrophicus str. Delta H
MERTGEENRKLIFQDCLCAVCGLCGEICPVNAIEVNPTGAMVRTEQDESKICIDENKCVLCGMCSSICPFQALDLQIDGTSIKELAEYPKIIKSAEIDDETCIQCKACETACPQDAITITRDLPERKDLITGEIEIDKETCIYCGMCEEMCPVDAIEIDHQVPTSSSPAVATDIRVDEDKCVHCGICKRICPVDAITQVCRICPYGEYEIKVPEVTGTSYIDPELCVNCGWCQEICPVDAATVTKPFEGELIIDEDTCQACETCVMACPCNVLSFPKPEKPGEKPAKLYKDERFCIYCGACERSCPVDAIEVKRSRINTTPIKSKAWKNAFESLLK

SEQ ID NO: 63635 - protein, 364 aa, Prunus tenella
MTFTIRKKEILIDILVRLPTKSLVRFLCTCKSWSDFIGSSSFVSTHLDRNVTKHAHVYLLCLHHPNFECHVDPDDPYVKKEFQWSLFPNQTCEEFYKLSHPLGNTEHYGIYGSSNGLVCISDEILNFDSSIHIWNPSVRKLRTTPISTNINMKFSLVSLQFGFHPGVNDYKAVRMMRTNKGALAVEVYSLRTDSWKMIQEIPPWLKCTWQHHKGTFSNGVAYHIIEKGPIISIMSFNSGSEEFEEFITPDAICSSWRSCIGVYKEQICLLLDFYPCEEEGMEKFDLWVLQGKRWKQLCPFIYSSDYCYRTIGISIDDELLMARRGFDKGVADLCLCNYETNQLLETGIKLAIMRYGEIEFLFAI

SEQ ID NO: 63636 - protein, 302 aa, Pseudomonas putida KT2440
MNAKVVVVGSLNMDLVVRAQRLPRAGETLPGDSFFTVPGGKGANQAVAVARLGGSVAMIGNVGDDDYGRQLHRALYVEGIDCQGVSTCPAMSSGVALITVDAASQNCIVIIPGANGLLTPQSVRRFDALLQAAEVIICQLEVPASTVAWTLARGHELGKQVILNPAPATGPLPADWFAHIDYLTPNESEAEALTGVVVTDQDSARRAGERLLQLGAGKVIITLGAQGALLVTAQGHQHYPAPHVQPLDTTAAGDTFIGGFAAGLVRGLEEGEAIAFGQRAAALSVTRAGAQPSIPYLAELTP

SEQ ID NO: 63637 - protein, 418 aa, Rhodococcus sp. Q15
MTAVSEPDTRTVVIVGTGIAGSGAAQALRKEGFGGSIILIGSEPEEPYRRPALSKELLSGKASIDRARLRPSTFWTEQGIDLRIGATVTSIDTDSRTVLLADGDSIDYDVLILATGGRSRRLENEDSERVHYLRDIADMRRLQSQLIEGSSLLVVGGGLIGSEVASTARDLGCSVQVLEAQPVPLSRLLPPSIAEKIAALHASAGVALQTGVDLETLTTGADGVTARARDGREWTADLAVVAIGSLPDTDVAAAAGIAVDNGISVDGYLRTSVVDVYAIGDVANVPNGFLGGMHRGEHWNTAQDHAVAVAKTIVGKEEPFESVPWSWSNQFGRNIQVAGWPGADDTVIVRGDLDSYDFTAICMRDGNIVGAVSVGRPKDIRAVRTLIERSPDISADVLADTNRDLTELAAGLVASPVL

SEQ ID NO: 63638 - protein, 118 aa, Lactobacillus plantarum WCFS1
MRQNQLIEKITNEQLRTDIPDFRAGDTVRVHARVVEGTRERIQLFEGVVIKRHGSGISETYTVRKISNGVGVERTFPLHTPRVAAIDVVRQGRVRRAKLYYLRNLHGKAARIPERRRG

SEQ ID NO: 63639 - protein, 372 aa, Ustilago maydis 521
MAQQLVIDNGSGMCKAGFAGDDAPRAVFPSVVGRPRHQGVMVGMGQKDSYVGDEAQSKRGILTLKYPIEHGIVTNWDDMEKIWHHTFYNELRVAPEEHPVLLTEAPLNPKANREKMTQILFETFNAPAFYVAIQAVLSLYASGRTTGIVLDSGDGVTHTVPIYEGYSLPHSILRLDLAGRDLTEYLARILTERGYPFTTTAEREIVRDIKEKLCYVALDFEQEMLTATQSSALEKSYELPDGQVITIGNERFRTPEVLFQPAFLGLEAAGIHETTYNSIMKCDLDIRKDLYGNIVMSGGTTMYAGISDRMQKEITALAPSSMKVKIVAPPERKYSVWIGGSILASLSTFQQMWISKQEYDESGPSIVHRKCF

SEQ ID NO: 63640 - protein, 498 aa, Rhodococcus sp. Q15
MAVKDEQAGSGRSKLFRTKSIEQSIKDTDEPETKLRKELNSWDLTVFGVAVVIGAGIFTLTARTAGNVAGPSVSLAFVIAAIACGLAALCYAEFASTVPVAGSAYTFSYATFGEFVAWIIGWDLILEFALASSVVAKGWSLYLGEVMGSRSPIVELGPISFDWGAVLVIAVITILLATGTKLSSRVSLVITAIKVAVVLLVIVVGLFYIDTDNYSPYIPPSEPGSTGEGIHQSLFSYVTGAGGSTFGWYGLLAAASLVFFAFIGFDVVATTAEEAKEPQKALPRGILGSLLIVTVLYVAVTLVLTGMVKYTELEGDTSNLATAFAFHDITWAKNVISFGALAGLTTVVMVLMLGQTRVLFAMARDGLMPRRLAPTGKHGTPVRITILVGVVVAVLAGVFPIGTLEEMVNIGTLFAFVLVSIGVLVLRRTRPDLPRGFRVPLVPLVPILAVLACLWLMFNLSVETWMRFVVWMALGVVIYFAYSRQHSMIGKRERGEIE

SEQ ID NO: 63641 - protein, 322 aa, Thermus thermophilus HB27
MKRIGVFTSGGDAPGMNAAIRAVVRQAHALGVEVIGIRRGYAGMIQGEMVPLGVRDVANIIQRGGTILLTARSQEFLTEEGRAKAYAKLQAAGIEGLVAIGGDGTFRGALCLVEEHGMPVVGVPGTIDNDLYGTDYTIGFDTAVNTALEAIDRIRDTAASHERVFFIEVMGRHAGFIALDVGLAGGAEVIAVPEEPVDPKAVAEVLEASQRRGKKSSIVVVAEGAYPGGAAGLLAAIREHLQVEARVTVLGHIQRGGSPTAKDRILASRLGAAAVEALVGGASGVMVGEVEGEVDLTPLKEAVERRKDINRALLRLSQVLAL

SEQ ID NO: 63642 - protein, 2037 aa, Populus trichocarpa
MASGQVFAKERLHRIKNHKHYRFRQEEWYCTLPLLGIGRARPLTMVLLQLMAVAQTNGRVPTGASITATDDSPSWPSASGEFAFGFRQLENKDYFLLSIWYEKIPEKTVVWYAIGEDPTDDPAVPRGSKLELTDDRGLLLADPQGNQIWSSGIPPGAAVSSGVMNDTGNFVLQNRNSFRLWESFNNPTDTLLPTQIMEVGGVVSSRRTETNFSLGRFQLRLLDNGNLVLNYMNLPTKFVYDDYYSSETSDASNSSNSGYRLIFNESGYMYILRRNGLIEDLTKTALPTIDFYHRATLNFDGVFTQYFYPKASSGNRSWSSVWSKPDDICVNMGADLGSGACGYNSICNLKADKRPECKCPQGFSLLDQNDKYGSCIPDFELSCRDDGLNSTEDQYDFVELINVDWPTSDYERYKPINEDECRKSCLNDCLCSVAIFRDGCWKKKLPLSNGRFDIGMNGKAFLKFPKGYVPLDRPPPQLPGEKKKPDIKFITGSVVLGTSVFVNFVLVGAFCLTSSFIYRKKTEKVKEGGSGLETNLRYFTYKELAEATNDFKDEVGRGGFGVVYKGTIQAGSTRVVAVKKLDKVVQDGEKEFKTEVQVIGQTHHKNLVRLLGFCDEGQNRLLVYEFLSNGTLANFLFGCSKPNWKQRTQIAFGIARGLLYLHEECGTQIIHCDIKPQNILLDNYYNARISDFGLAKLLVMDQSKTQTAIRGTKGYVAPEWFRNRPITVKVDVYSFGVMLLEIICCRRNVDLEIGEVENPVLTDWAYDCYMDGSLDVLIGDDTEAKNDISTLERLLKPARQNRIRASSNSPNAAATPVALAPAAPPPLGRHTFSPLDLPPWSNPRSQQIMATKVTGILTAGKKVKRGGSRSRPPWFLRFSCTHAPPVAEAATPNEPIKANNITKKSPVDIARVTCDKIYGVGNTKTGMGQASREFELMKMKDNESVKDYSGRLMDVVNQMRLLGKAFTDHKVVEKIMVSVPQKFEAKISAIEESCDMNNLTIAELTSKLHVQEQRVQMRDEEAIEGAFQANTKERSSGYLQRKKSFKFTKGKTEMSSRKQNYSPCSHCKRTNHAEKDCWYKDKPSFKCTFCNNLGHSEKYCRAKKKQSQQHIHQNANVSEKEKEDDEHLFMASQVISSHEQNIWLIDSGCTSYMTKHLAIFSSIDKSIQPKVKLGNGDVVQAKGRGTIAVSTKRGYRIYNLSAAKVQISIDVHFNENSCWKWDLKEVDRTTTAALEPAVGGTGDQSDIEGTSDTSILKVRPLSDVYERCNPVYAKPTSYTEAARFPAWIDAIKSEIDSIERNGTWKLTELPQNKKEIGVKWVFKTKFNPDGSIFRHKARLVVKGFAQVAGVDYDDTFAPVARHDTIRLLLALAGQKKWKVYHLDVKFAFLNGILLEEIYVQQPEGFVVTSHEHKVYKLHKALYGLKQAPRAWYNRIDTYLIQLGFKRSENEVTLYLKQDQDGLQLVISLYVDDMLVTGSNVKLLAEFKREMQDVFEMSDLGIINYFLGMEIHQCSSGIFISQRKYAVDILKRFKLESCKEVTTLMAQNEKISKNDGEKLEEPSAYRSLVGSLLYLTATKPDLMFLAGLLSRFMSSPSNFHMGVAKRVLKYIRGTTNLGILYSKSGGVNLSGYADSDWAGSVDDMKSTFGYVFTIGSGTICWNAKKQEVVAQSTAEAEYIFLAAAANQAIWLNKLLAKNKVHQLSFIVITFAMLLSAVAFESEIRSFLGLAGYYRRFVENFSRISAPLTKLTQKNVKFQWSEACEKSFLELKERLTTAPVLAVPSGSGGYTVYCDASRVGLGCVLMQHGKVIAYASRQLKKHEQNYPTHDLEMTAVIFALKIWRHYLYGETCEIFTDHKSLKYIFQQRDLNLRQRRWMELLKDYDCTIHYHPGKANVVADALSRKSSGSLAHIQEVRRPLIRELHELVDEGVRFDLSEAGAMIAHFQVKSDLFDKIKAAQKKDDSLLRIRNEVEQGKAAGFVIGDDDVLRYKDRLCVPDVDDLRRELMVEAHQTVYTVHPGSTKMYKDLKVFDLSEGKG

SEQ ID NO: 63643 - protein, 294 aa, Bacillus cereus ATCC 10987
MKQTILGAICLSLAASIWGGMYVVSKYVLDFIPPLTLVWLRFIIAFIVLYMILKIAEKKQKKTVTIHKKDWLLFAWIGFIGYFISITCQFIGTKLSDAHTGSLVTSATPAFMVIFAAIILKEKLTARRLLSTIIATIGVIIVIGWDIEIGSYFIGTIILVGAAITWALLSIYVKIASARFSSLVITTYAIFFSLFFITPFMVWEFQSNPIEHMNLYVVLGVLYLGIVSTAGAFFLWNKGLELMDASIGSLFFFFQPIVGSLLGWLLLNETLNSNFFIGGILIVCSVFITTFEKK

SEQ ID NO: 63644 - protein, 213 aa, Rhizobium leguminosarum bv. viciae 3841
MQRFPNPLLDGYRNFMNGRYADARDRYRQLAENGQSPHTLVIACSDSRAAPELIFDAGPGELFVIRNVANMVPPYEPDGHFHSTSAALEFAVQVLKVSDIVVMGHGRCGGIRSALDPNAEPLSPGDFIGRWMSLVKPAAEQIQSNDVMTAAERQTALERVSIRNSINNLRSFPDIKALEEAGKIHLHGAWFDISTGELWVMDAETRDFIRPEI

SEQ ID NO: 63645 - protein, 143 aa, Cicer arietinum
MPRGTLEVVLISAKGLEDNDFLSSIDPYVILSYRAQEHKSTVQEGAGSNPQWNETFLFTVSDSASELNLRIMEKDNFNNDDNLGEAIIPLEAVFEEGSLAENAYKLVKEQEYCGEIKVALTFTPERNDEEETCGGWKESTRDF

SEQ ID NO: 63646 - protein, 281 aa, Oryza sativa (japonica cultivar-group)
MAAMLLRLHPCPLLFPPPPPHPHLRRQLAVYSIPKSSFRSAAAAARARNPPRLASVGGAERRRVGDDYDEEEEDLGQALERTRQLVECAMFASVAGLAYFLSNSLAIENYFSCFFPLPIVISSLRWGLEAGRKTAVATVLLLFTLSGPVKASTYLLMHGVVGLAMGTMWRLETNWIVSIILCSITRALGACGYVLLSSFLIRENILGLITVNIHASLTYILAAAGVNTIPSMDAIYVLFGTLLLLNCGFFIFLLHIMYTIFLTKLGIKPSLRPPRWLDKAI

SEQ ID NO: 63647 - protein, 463 aa, Salmonella typhimurium LT2
MLAFLNQVRKPTLDLPLDVRRKMWFKPFMQSYLVVFIGYLTMYLIRKNFNIAQNDMISTYGLSMTELGMIGLGFSITYGVGKTLVSYYADGKNTKQFLPFMLILSAICMLGFSASMGAGSTSLFLMIAFYALSGFFQSTGGSCSYSTITKWTPRRKRGTFLGFWNISHNLGGAGAAGVALFGANYLFDGHVIGMFIFPSIIALIVGFIGLRFGSDSPESYGLGKAEELFGEEISEEDKETEENEMTKWQIFVEYVLKNKVIWLLCFSNIFLYVVRIGIDQWSTVYAFQELKLSKEVAIQGFTLFEVGALVGTLLWGWLSDLANGRRALVACVALALIIATLGVYQHASNQYVYLASLFALGFLVFGPQLLIGVAAVGFVPKKAIGAADGIKGTFAYLIGDSFAKLGLGMIADGTPVFGLTGWAGTFAALDAAAIGCICLMAMVAVMEERKIRREKKIQQVNIA

SEQ ID NO: 63648 - protein, 442 aa, Salmonella typhimurium LT2
MLSFLKAPANAPLITDKHEVDARYRYWRRHILITIWLGYALFYFTRKSFNAAAPEILASGILTRSDIGLLATLFYITYGVSKFVSGIVSDRSNARYFMGIGLIATGVVNILFGFSTSLWAFALLWALNAFFQGFGSPVCARLLTAWYSRTERGGWWALWNTAHNVGGALIPLVMAAVALHYGWRVGMMVAGLLAIGVGMVLCWRLRDRPQAIGLPPVGDWRHDALEVAQQQEGAGLSRKEILAKYVLLNPYIWLLSLCYVLVYVVRAAINDWGNLYMSETLGVDLVTANTAVSMFELGGFIGALVAGWGSDKLFNGNRGPMNLIFAAGILLSVGSLWLMPFASYVMQAACFFTTGFFVFGPQMLIGMAAAECSHKEAAGAATGFVGLFAYLGASLSGWPLAKVLEIWHWTGFFAVIAIAAGISALLLLPFLNAQAPRETHEA

SEQ ID NO: 63649 - protein, 460 aa, Rhizobium leguminosarum bv. viciae 3841
MNSDGTKKPFRKRKPSTERSAPDKLGLQARAAAAKILAAVVDRKLPLDGALDHEHGNPAYRALGESDRALVRAILNTTLRHLPRIDAAIAGLLDSPLPEGARALHHVLAIGAAQILYLDVPDHSAVDLAVEQANQDPRNRRFAKLVNAILRRLGREKEQVLADIGKVAPMPAWFIARLEKAYGRDAALAISESQLEPAAIDLTVKSDPEGWAKRLNGVVLPTGGIRLAAFDGGIPSLEGFDEGAWWVQDAAASIPAKLFGDLAGKRTADLCAAPGGKTAQLILAGGAVTALDQSENRLRRLRSNLDRLGLKAETIAADLTTFGPTERFDAILLDAPCSSTGTTRRHPDVLWTKGPEDIARLAALQERLLRHALTLLKPGGTLVFSNCSLDPVEGEDVVARVLSDTDAVERVPIGAGDWPGLEAAITPLGEFRTLPTMLKMPDGIGSGLDGFYAAVLRRLG

SEQ ID NO: 63650 - protein, 401 aa, Acinetobacter sp. EB104
MQTIVIIGASHAAALAASLRPDGWQGEIVVIGDEPYLPYHRPPLSKTFLCGAQLVDELLIRPAAFYQKNQIEFRHGRVVAIDRAARSTLQDGSTLAYDQLALCTGARVRTVSLAGSDLAGVHYLRNSDVQANQPFVQPNGKAVVIGGGYIGLETAAALTEQGMQVVVLEAAERILQRVTAPEVSDFYTRIHREQGVTIHTGVSVTAITGEGRAQAVLCADGSMFDADLVIIGVGVVPNIELALDAGLQVDNGIVIDEYCRTSAPEIVAIGDCANAFNPIYQRRMRLESVPNANEQAKIASATLCGLQRTSKSLPWFWSDQYDLKLQIAGLSQGYDQIVIRGDVQQRRSFAAFYLQAGRLIAADCVNRPQEFMLSKKLITAGTAVDPLRLADESIAVQALMG

SEQ ID NO: 63651 - protein, 304 aa, Synechococcus sp. CC9311
MRLFLSDAGLTSKADAGARLAIRLLQDAAQSGTLDPWDVDVISVVDGFLDQLRQRIEVPRRVAAQLGQQGGSYERDLAESSEAFLAASVLVGLKAEVLEASTLPPEPMMEEAFDPDFMEQGWLDPRFNLPRHPERHLLRRPVAPPPLRRPVTLGELIEQLETIAEQLETDELDMRRRQRQKRFSNREAIAQVAALAHREKLPETTAALGVFLKEWEQALHWVDFEFLVRRWAEAAEPDLDTDRVGVFWALLFLSSQSQVELEQVGSLHAPIRLKRLLVAGEITQLPINSLEVPDITPTLPAIAA

SEQ ID NO: 63652 - protein, 481 aa, marine gamma proteobacterium HTCC2207
MSHEIFQNYINGQWVGSSAAIENINPSDTSDIVGHYAKASSEDCLAAIAAANAAFADWSKSGLEQRKQVLDFIGAELIARSAEIGEILAREEGKTRAEGVGEVYRSGQFFQYYGAEALRLMGENTQSVRPGVDVEVHREALGVVGIVTPWNFPMAVAAWKVAPALAYGNAVVLKPAELVPASAWILADIISRSGLPAGAFNLVMGSGRDVGETLCTSPDIQAVTFTGSVGVGRHIARNAIDNMARVQLEMGSKNALVVLDDADMDTAVNCALAGGYFGTGQKCTASSRIIVQSGIHDAFVEKLSAAVSKLVVGHALGEGSQIGPVVDARQLQQNLDYMQIAKDEGAELLVGGERLNLDTDGFFMSPALFVNTTNQMRINREEVFGPIACVIKVDSYEQALEVSNDSDFGLTSGIITNSLHHAGHFKRHSQSGCVMVNLPTAGTDYHVPFGGRKNSSYGPREQGSSAREFYTIVKTNYSKPY

SEQ ID NO: 63653 - protein, 337 aa, Bradyrhizobium sp. BTAi1
MCGTCGCGSKAETRLLNLQTGEETTLDDERPHMHAHGDDMVHRHGHDHRHDHGDGHVHDHEHPHGHVHDHIHGHEHGHDHRSEHAHEHHHHDDHAHDDVELHGHDHPHDHDHPHSHGHSSVIELETRILAKNDALAARNRGWFAGREILALNLVSSPGSGKTTLLERTIRDLKDKIPIAVIEGDQATTNDGERIRAAGAAAVQVNTGAGCHLEADMVAKGLAELKPAFGSVVIIENVGNLVCPAMFDLGEHAKVVILSVTEGDDKPLKYPHMFRAAEIMVINKIDLLPHVDFDVDIANANARQVNPEIVTFSVSARTGEGLGGWYDWLGTQASQAWL

SEQ ID NO: 63654 - protein, 259 aa, Triticum aestivum
MAVRVWLSAFLLAFLLAFLLAASPFAQVARAQSEEDAAMQEVVDGADLGYVGDDTPVSSEEPLSPAPGVETVCVFPKNAGKIVPAGEETELLVGLQNEGESNLNVVAVHSTLHLPYDHKMYGQNLTVQSFYNASVPVSVQATFPYTFAVSKFLQPGAYDLVGYIVYEIDQHPYQNVFYNGTIEVVEVGGLLSVESVFLITLGIALLGLLGLWAYGQVQQLSKKTKKGPKVELGTGTTDANMDEWLEGTAFAKDKAKKNK

SEQ ID NO: 63655 - protein, 161 aa, Halobacterium sp. NRC-1
MTDHDERTFVMVKPDGVQRGLIGDIVTRLETKGLKMVGGKFMRIDEELAHEHYAEHEDKPFFDGLVSFITSGPVFAMVWEGADATRQVRQLMGATDAQDAAPGTIRGDYGNDLGHNLIHGSDHEDEGANEREIALFFDDDELVDWDRDASAWVYEDLADHD

SEQ ID NO: 63656 - protein, 793 aa, Pseudomonas putida KT2440
MKFSEQWLRGWVNPQVSRDELVARLSMAGLEVDSVTPAAGQFSGIVVGEILATEQHPDADKLRVCQVSSGQETFQVVCGAPNARPGIKIPFAMIGAELPGDFKIKKAKLRGVESFGMLCSAAELQISEENDGLLELAADAPVGEDIRTYLSLDDASIEIGLTPNRGDCLSIAGLARDVSALYDTPVTRPVVPAVAAAHDEVRPVEVSAPAACPRYLGRVIRNVDLSKPTPLWMVERLRRSDVRSIDAAVDITNYVMLELGQPMHAFDLAEINGGIRVRMAEEGEKLVLLDGQEVALRADTLVIADHTRALAIAGVMGGEHSGVNTEKTRDLFLESAFFEPISVAGKARSYGLHTDASHRYERGVDSQLAREAMERATQLLLDIVGGEAGPVVEAVSEQHLPQVAPVTLRAERITQMLGMEMDPAQVEQLLNALELTTTKSGEGQWTVSVPSHRFDISLEVDLIEELARLYGYNNLPVRYPQARLAPQGKPETRGDLPTLRRLLVARGYQEAITYSFIDPKLFELFSPGVEPLLLANPISSDMAAMRASLWPGLVKALQHNLNRQQDRVRLFESGLRFVGQLGDLQQQPMIAGVITGSRLPEGWANGRDGVDFFDVKADVEALLGYSGALSDFTFSAGKHPALHPGQTAVIERDGKLVGYLGAIHPELAKALGLDRPVFLFELVLGDVVEGRLPKFSELSKFPETRRDLALIAGRDVASSAVLELIRDNAGEWLTDLRLFDVYQGKGIDPDRKSLAVGLTWQHPSRTLNDDEVNTTLQNILTSLEQRLNTTLRK

SEQ ID NO: 63657 - protein, 442 aa, Methanothermobacter thermautotrophicus str. Delta H
MSDKIGRIIAKMDECGVKFVRLQFVDIHGKPKNMAIPLVRPDQIEDIIKDGLLFDGSSVEGFVDINESDLVLKPDPDTFSTLPWRPEEKGVCRFICDIYWPDGKPFEGDPRYVLKRALDKYAHLGYEYNVGPEPEFFILDQDEDGNIIPHDCGAYFDVEPVDQGTDFRRKLVMDLEALNFDVEVSHHEVAPGQHEIDFKFDKALKTADAVITFKQAIKAIVDKIGYMVTFMPKPFFGENGSGMHCHQSLFKDGENVFYDPDTETQLSEEALYFIGGLLKHAPALTAVCAPTVNSYKRLVPGYEAPVYIAYGLKNRSTLIRIPASRGKGTRVELRMPDPSCNPYLAFAAMLEAGMNGIQNKIDPGEPTEIDVYEKSMSELREMGIETLPSSLWEAYHALEEDDVIKGALGGHVYEKFMEIKHREWDDYRVRVFKYELERYLDI

SEQ ID NO: 63658 - protein, 271 aa, Legionella pneumophila subsp. pneumophila str. Philadelphia 1
MPTRVIEDKGDMTPSFGIDDRIFLGEGLFETIRVNSSKPSFAYMHWERLGNSARQLGIPFEISFDDWFEHLIQKIQKDNLYHGGIKAILSGGPASRGLAERGQVSQLIFQTFNYSIQKHPVRLISINWLRDKANPLYQLKSVNYLEAIIAQRQAIAVGADDALFFNTENHVTETTCANLFLIENNILYTPRVEDGILPGITRARLISHCQQHKMSVQEISLTKKRIEDADAVFLTNSLQGIRRVLSLDNIIFEVNHPIIDKLIFLLNQDES

SEQ ID NO: 63659 - protein, 344 aa, Pseudomonas putida KT2440
MPQSKLINRRVVLASRPHGAPLEANFRIEQSPIPEPAEGQVLLRTVYLSLDPYMRGRMSDAPSYAAPVEIGGVIVGGTVCRVEASKNPAYKVGDWVLSFAGWQDYTLSDGSDLTALGESPAHPSYALGIFGMPGFTAYMGLLDIGRPQAGETLVVAAATGPVGATVGQIGKIKGCHVVGVAGGAEKCRHAVEVLGFDACLDHRAPDFAEQLAKACPAGIDIYFENVGGKVFDAVLPLLNTKARVPVCGIIAHYNDTALPNGPDRLPALMGSILRKRIHVQGFIIFDDYGHRYNEFFNDMSSWFAQGRIKYREELVSGLEEAPKAFIGLLEGRNFGKLVVRVSED

SEQ ID NO: 63660 - protein, 531 aa, Triticum aestivum
  misc_feature (127)..(127): Xaa can be any naturally occurring amino acid
  misc_feature (139)..(139): Xaa can be any naturally occurring amino acid
  misc_feature (269)..(269): Xaa can be any naturally occurring amino acid
MAAAVKTSGGFCNTQQQWLHSTRDLFLHGSTRSNAKECKSKKAKKPTSLRVKATSTKVELDFNDPSWKQNFQEDWDNRFNLPRITDIYDLKPRPTTFSLKKQRTPTGDEDSTPMDMWNGYVNNDDRXALMKVIKDSSPXSAGAECIDPDCCWVEQWVHRAGPRKDIYYEPNEVKAAIVTCGGLCPGLNDVIRQVVFTLETYGVKNIVGIPFAFRGFFEKGLKEMPLSRNLVENINLAGGSFLGVSRGGAKTSEIVDSIQARRIDMLFVXLGGNGTHAGANAIHDECRKRKLKVSVVAVPKTIDNDIPLMDKTFGFDTAVEEAQRAINSAYIEARSAYHGIGLVKLMGRSSGFIAMHASLSSGQVDVCLIPEVSFALDGEYGVLQHLEQLIKNKGFCVVCVAEAAGQELLQNSGATDASGNAILSDIGVHMQQKIKTHFKGIGVHADIKYIDPTYMVRACRANASDAILCTVLGQNAVHGAFAGFSGITSCICNTHYVYLPVTQVITAPKRVNHKGRMWHRCLTSTGQPDFR

SEQ ID NO: 63661 - protein, 408 aa, Streptococcus thermophilus CNRZ1066
MLATDFGLENLTGYFYQYRIKRGDQSIIVLDPYAKSLAAWNSDDASKGPEHKIAKAAFVDLANYGPKDLDYAKIPNFKSREDAIIYEAHVRDLTSDKAISAELKHQFGTFAAFAERLDYLKDLGVIHIQLFPVLSYYFVNEMQNGKRLDAHASSNSNYNWGYDPQNYFSLTGMYFEKPSDPDKRIEEFKNLVSAIHAHGMDVILDIFYNHTAKTAIFEDLEPNYYHFMDADGTPRSSFGGGRLGTTHYMSRRVLVDSIAYLTKEYKVDGFRFDTMGYHDAESIEKDYHAARALNPNLIMLGEGWVTYAGDENSPIQPADQSWMKNTDTVAVFSDDIRNILKSGYPNDGTPAFITGGKRDINKVFDNIKAQPTNFEADSPGDVVQYIAAHDNLTLFDIIAQSINQSRRI

SEQ ID NO: 63662 - protein, 130 aa, Oryza sativa (japonica cultivar-group)
MVRVSVLNDALKTMYNAEKRGKRQVMIRPSSKVIIKFLIVMQKHGYIGEFEFVDDHRSGKIVVELNGRLNKCGVISPRFDVGVKEIESWTARLLPSRQFGYIVLTTSAGIMDHEEARRKNVGGKVLGFFY

SEQ ID NO: 63663 - protein, 664 aa, Bacillus cereus ATCC 10987
MTQNINQLAVNTLRTLSIDAINAANSGHPGLPMGAAPMAYALWANHLNHNPNHPKWFNRDRFVLSAGHGSSLLYSLLHLAGYDVSIDDLKSFRKLNSKTPGHPEFGHTSGVEATTGPLGQGIANAVGMAMAEAHLAAKFNKDGHSIIDHNTYALVGDGDLMEGVAYEAMSMAGHMKLGKLIVLYDSNEISLDGELNIAFSEDMQKRVESAHWQYVRVEDGNDVDAITKAIQLAKDNTDQPTLIEIRTIIGYGSPKVAGTNKAHGNPLGVEEATATKQAYGWHYEEDFFVPEEVTAHFNELKQKGIEKENKWNEQFNVYRESNPALADELEKAITGEVLIEAKDILSFDTEKTISTRVASGEAINHYVKSIPSIFGGSADLSHSTMTDIKGEAVYAVESYAGRNIYFGVREHAMGAAANGLALHGGVKPFVSTFFVFNDYLRPSIRLAALQKLPVTYVFTHDSIAVGEDGPTHEPIEHLAALRAIPGLTVIRPSDANETASAWAYALQQTEGPVVLVLSRQNLPVFHETKANIENLSKGAYVLTQTNENPDVILIATGSEVSLAASAKAKLEEDQVSVRIVAMPSWELFDRQSKEYKESVLPSSVTKRVSLEMGVSLGWERYVGQEGKVLSIETFGASGTGAEVMNLFGFTTENVVQITKNVLNS

SEQ ID NO: 63664 - protein, 217 aa, Triticum aestivum
MPPSPGQHEQGHRTVSWDPPKRPAGRTKFHETRHPLYRGVRRRGRVGQWVCEVRVRGTNETRLWLGTFHTAEMAARAHDSASLALSGSAACLNFADSAWRMLPVLAAGSFGFGSAREIKLAVAVAVVAFQQQQIILPVACPTVEAAASPSNSLFYMSSVDLLELDEEQWFGGMDAGSYYESLAQGMLVAPPDDRARREDAEQTGVETPTPLWSYLFD

SEQ ID NO: 63665 - protein, 524 aa, Bordetella parapertussis 12822
MAPPGHVVPSPANGHRHDARPATRLPEPTSLRRTLSARHLTMIAVGGSIGTGLFVASGATIAQAGPGGALLAYLLVGIMVYFLMTSLDELAASMPVAGSFSTYGAKYVDEGFGFALGWNYWYNWAVTVAVDLVAAQLVMAYWFPEMPGVLWSAAFLALIVGLNALSARGFGEAEFWFALIKVIAVLAFIAMGVLMLLGIIRGGEHGGLAYWTLDDAPFAGGFAALIGVAMVVGFSFQGTELIGIAAGESKDPARNLPRAVRQVFWRILLFYVLAIAVIGLLIPYTDPQLLRNEVSDVSVSPFALIFERAGLLAAASIMNAVVLTSVLSAGNSGMYAATRMLYSLARDGKAPARFGRLSRSGVPLWALLATTAVAALCFLSFLFSPKAVYIWLLNTSGMTGFIAWLGIAISHYRFRRGYVAQGNNLADLPYVSPFFPFGPLFAFVLCLVITLGQNYHAFLQDRIDWTGAAATYVGIPLFLAIWAGYRLVRGSRFVRYRDMQFPDLRMRNRELNAMLSGDCAEPRR

SEQ ID NO: 63666 - protein, 165 aa, Glycine max
MVFFFATAGIMFQDITTLLLDPKAFKDTIDLFVERYKGKNISVVAGIEARGFIFGPPIALAIGAKFVPLRKPKKLPGKVISQEYILEYGRDCLEMHVGAVEPGERALVVDDLIATGGTLCAAMDLLERVGAEVVECACVIELPELKGRERLNGKPLYVLVEYVEI

SEQ ID NO: 63667 - protein, 726 aa, Erythrobacter sp. NAP1
MAKAREEGSYKGAHMKKIVILAALAALIAAYFFFDLGAYLTLDGIKQVSDDASAFYDENPALVLGVFFAAYVAVTAASLPGAAIMTLAAGALFGLVTGTILVSFASTLGATLAFLSSRYVLRDTIESKFGERLKAINNGLERDGAFYLFTIRMIPLFPFFVVNLVMGLTRIKTWTFAWVSQAGMLLGTIVYVNAGTQLAQIDSLSGIASPAVIGSFVLLGIVPWIAKGIIGLMKRRKVYAGYTKPKSFDRNMVVIGAGSAGLVSAYIAATVKAKVTLVEANEMGGDCLNTGCVPSKALIKSAKVAAMMEHADRYGITPVKPEVPFRQTIARVMEIIKTIEPHDSVERYEGLGVDVIKGYATIIDPWTVEIALNDGGTQRLTTRSIVIASGAEPVVPPIEGVESSGYLTSETMWDAFSQMDKAPARVAVLGGGPIGCEISQALSRLGSQVTQVEMGEQLLGREDEDVAEIAKSSLEASGVKVLTGHKAVRLADKVLTAEGPEGSVDIPYDALILAVGRKARLKGFGLEKLGVDTDKTVNTDEFLATKFPNIFAAGDVAGPYQFTHTASHQAWYASVNALFGQFKKFKADYRVIPAVTFTDPEIARVGLNETEARDEGIEFEVTTYGLDDLDRAIAESETKGFVKVLTPPGKDTILGATIVGSHAGELLAEYTLAMKHKLGLNKILGTIHPYPTMAEANKFAAGNWKKANKPEKLLEWVEKYHGWRRG

SEQ ID NO: 63668 - protein, 516 aa, Thermus thermophilus
MTVEPFRNEPIETFQTEEARRAMREALRRVREEFGRHYPLYIGGEWVDTKERMVSLNPSAPSEVVGTTAKAGKAEAEAALEAAWKAFKTWKDWPQEDRSRLLLKAAALMRRRKRELEATLVYEVGKNWVEASADVAEAIDFIEYYARAALRYRYPAVEVVPYPGEDNESFYVPLGAGVVIAPWNFPVAIFTGMIVGPVAVGNTVIAKPAEDAVVVGAKVFEIFHEAGFPPGVVNFLPGVGEEVGAYLVEHPRIRFINFTGSLEVGLKIYEAAGRLAPGQTWFKRAYVETGGKNAIIVDETADFDLAAEGVVVSAYGFQGQKCSAASRLILTQGAYEPVLERVLKRAERLSVGPAEENPDLGPVVSAEQERKVLSYIEIGKNEGQLVLGGKRLEGEGYFIAPTVFTEVPPKARIAQEEIFGPVLSVIRVKDFAEALEVANDTPYGLTGGVYSRKREHLEWARREFHVGNLYFNRKITGALVGVQPFGGFKLSGTNAKTGALDYLRLFLEMKAVAERF

SEQ ID NO: 63669 - protein, 756 aa, Rhodopseudomonas palustris
MHSGLDNSAELRVSDFDPITLAGGTRTEVLPGAIQPHAALLALAPADLTIVHAAGATASLLGAAAELLPGTAASTAFSSDQIARLQALATAERWIERPQHAFTLNAPDATPIDVIVHHASGLLVVELDPRREPAPENSLALVQSMIRRARPAPNLQGFCDAMAAELRSVTGFDRVMVYRFARDGSADVIAEARGPETSPFLGLRDPQPDISNQPGSISRIRVQPDVHAPAAPLWPAHSPRNGLALDLSFSATRSASPEHRLYLAQLGVAASLSLSLVVEGELWGLIVCHHATPRFLPYRMREACALFAEMASLQLETRLAADQLAARLRSTRIHEELVTRMSQESDLAEGLIRFYPNLLDFIPAAGVGLWIDGQFTGIGATPGPAQVAAMMGWLHGVPHDGVYHTDCLALAYPPAKAFAGCASGLLALSLSNTPHNYVLWFRPEVVRVVTWAGMPNKPVGVDAGAPRTPKGCASSWQESVRLHGEPWLDTDVDAAHRLRESLLDVVLRRIDGIARERRSAQLLQEQLMRQVELGLSRSKDVAKTLQEEKRRRVLVEADLSKVLRRTVEDQEAERLRIARELHDTLGQSLTLLQLGFDKLGQAAGDNPELQQRIAEMKSLTADVGRQANRLAWEIRPTALDDLGIQTAIQNLLDSWSEKSSIEFDLHMTLGSRRLPSPVETTLYRVLQEALTNVVRHASARHVSVILQLGDDQVTMIVEDDGCGFVTAGRKPPSGRLGLLGIRERLSLVGGSLEIES

SEQ ID NO: 63670 - protein, 524 aa, Glycine max
MASSASTTLSSPFLRLELPSRTKKRSSSIIPVPSIRASVSEKPPLPAVSVTSPEPSKLPIRKIPGDCGFPVIGPLKDRQDYFYKQGRDEFFKSRIQKYQSTVFRTNMPPGPFLAPNPNVVVLLDAKTFPILFDNSKVDKRDVFTGTFMPSTQLTGGYRVLSYLDPSEPKHSLLKQLMFFLLKSRRAHVISEFHASYKDLFHELEANLAEAGKASFGDANDQAAFNFLARSLFNSNPADTKLGRDGPKIVQKWVLFQLGPILRLGLPQFLEESTIRSFRLPFSLIQKDYQRLYDFFYQSSGSVLDEAERLGITRDEACHNLLFATCFNSFGGMKLFFPNVLKWIGRAGVKLHARLAEEIRSAVRGAGGEITMAAMENMPLMKSVVYEAFRIDPPVPLQFGRAKRDLIIESHDHAFQVKEGEMLFGYQPFATKDPRIFERAEEFVGDRFVGEEGEKLLKHVLWSNGPETESPTIGNKQCAGKDFVTLVSRLLVVEFFLRYDSFEIQVGTSPLGSSVTITSLKRASF

SEQ ID NO: 63671 - protein, 394 aa, Zea mays
MAWRWLRSATRRRGWWNAAPSGTPLFAAEQRATLVNVKVKWVKDRALDAAVSRERHLRTAHHLLDLVFSRPGHRVSRSDLLAEKSARRICGSAHSLLEFLRRYHTMFTLSRGGVSPTDMAFVLRQREVDCLFATEDDLVARLRRLLMLTLPRSLPLHTVDLLRWDLGLPSDYQDSILPRYPDHFALEQPEGDERVWLRLLSWDDLLAVSELEKSADGGDTTCIPFPVSFTRGYGLRSKCMSWLREWQALPYTSPYADASGLDRRTDVSEKRNVGVFHELLHLTVAKRTERQNVSNMRKLLGMPQKFTKVFERHPGIFYLSRVCGTQMVVLREAYGGGSQLLEKHAHPLVAIREEYSTLLRAALPPRTRGRERHGSFSRQHEGCVVGGDEFELSK

SEQ ID NO: 63672 - protein, 424 aa, Methanothermobacter thermautotrophicus str. Delta H
MTQMEEARKGNITPEMEEVARKENLDIQMLIRGIANGRIVIPSNINRESSPCGIGENLSTKINANIGSSSKMEDIELEVDKALAAVEYGADAVMDLSTGPMLRDVRKAVLEAVDVPVGTVPIYEAGVEAFMSDGAVVDMDEDDMFRAIENQARDGVDFMTVHSGITLETVERAQRSGRIMGIVSRGGAFLAAWIMQNQEENPLYSNYEYLLEVAYEYDVTLSLGDGLRPGCLADASDIPQISELLTLAELVERARDADVQCMVEGPGHMPLDQIAANMKIQKEVCDGAPFYVLGPIVTDMAPGYDHISAAIGGAVAAMNGADFLCYVTPAEHLAIPGVQDVIEGVIASRIAAQAADAARKLPGAWDSELEMADARRSFDWDKQFKLAFDSKKPYEYRMQCPIEDSEMCSMCGEYCALRILREDR

SEQ ID NO: 63673 - protein, 357 aa, Moorella thermoacetica ATCC 39073
MYKIAVLPGDGIGPEIVPEAVKVLEAVSRRVGIEFQFTEALVGGAAIDARGIALPPETLELCRQSDAVLLGAVGGPKWDTLPPAERPETAALLPLRKELGLYANLRPAFLYDSLVEASPLKKEIVTGTDLIIVRELTGGLYFGAKKREQTAEGEMAYDTMYYTRAEIERIVRLAFTIARQRRCHLTSVDKANVLTTSRLWRDTVEDIKGEFPEVTVEHMYVDNCAMQLVRRPAQFDVIVTENTFGDILSDQASVLTGSIGMLPSASIGGAVALYEPCHGSAPDIAGQQKANPLATILSAAMMLKYSFKMDQAAAAIEAAVGRVLAKGYRTPDLYVPGTQLVGTAEMGQLVRRELEEG

SEQ ID NO: 63674 - protein, 347 aa, Lactobacillus plantarum WCFS1
MKSTIFEKAGLVSVQEVDKPTLQSDDDVIVRIVRTCVCGSDLWSYAHGDDKAAHSINEGHEAIGIVEAIGSAITTVKPGDFVITPFTHGCGECAACLAGFDGTCDRHPGHTNWSNGFQAEYIRFTYGNWALVKIPGQPSDYTEGMLKSLLTLADVMPTGYHAARCANVQKGDKVVVIGDGAVGQCAVIAAKLRGAAQIVLMSRHEDRQQMALASGATAVVAERGDEGIAKVREILGGGADAALECVGTEAAIDQALGVLHNGGRVGYVGVPHYNNRPLGSTFAQNIAVAGGSASVTTYDKQFLLKAVLDGNINPGRVFTQTYPLADINQAYQDMQNRKTIKAMITID

SEQ ID NO: 63675 - protein, 163 aa, Coxiella burnetii RSA 493
MRRLKQIIKSFTLWELLKGLSLTLRYFYRKKVTIHYPDEEVPSSFRFRGMLALRRYPNGEERCIACKLCEAVCPACAITIEAGPREADGSRRTTLYDIDAFKCINCGFCEEACPVDAIVLTPEMHYSIKDRGENILTKEKLLMIGDRYEEQIARDRAKDKKYR

SEQ ID NO: 63676 - protein, 792 aa, Xanthomonas campestris pv. vesicatoria str. 85-10
MKFSENWLRSHVPIQATRDELAATLTAIGLEVEEVTPLGESLGQVVVARIVEAVRHPEADRLQVCSVDAGQGELLQIVCGAPNARAGLVAPLALVGAKIGELTITAAKLRGVASNGMLCSAKELGLDSDASGLFELPDDAPVGQALAEYLGLPDASIEIKLTPNRADCFSVRGIAFDVAAACASEVVAFDAGMVAPVSTRTLAVELDAGKDAPRYCGRVIEGIDPSAKTPVWLAERLRRSGVRPVSLLVDITQYVMLELGQPMHAFDLDTLQGPIGVRHSRVGEQLVLLDGRQVTLDESFLTITDAGRPVALAGLMGGLDTRVTDTTRNVFLESAYFAPEAIMGRGRKLGLHTDAGHRFERGVDPALPPQAIEVATRLVLELAGGTPGPVVHAQLPEHLPQPARIRLRRARIARVLGIQIDDADVVRMLRALGMHVEAVAEGWEVMAPSRRFDIAIEEDLIEELARIHGYDRVPTTLPGGASRIAMPSETQLDELSVRRQLVARELQETINYAFVDAALLERWQLTEGLVPLANPLSAELAIMRLRLLPGLVATLGRNAARQAGRVRLFELGKVFAAAADAGAAPGESQHVAAAVCGDALALQWGEPARKVDFHDLKGDLMALAAASGAQLEFQPSTQPFGHPGRSADIYRNGVCIGWIGQVHPRLAKALDIDVDVIAFELQLMPLVQRALPRAGELSRFPSVRRDLAFLVPDEVSWAAVSASVRTTVGPLLREVQLFDRYVGQGVEPGFKSLAMGLILQDNSRTLTDRDVDAVVTDVVAVIEREHRARIRS

SEQ ID NO: 63677 - protein, 417 aa, Coxiella burnetii RSA 493
MAEVRNYTFNFGPQHPAAHGVLRLIVEVDGEVIQRIDPHIGLLHRATEKLAESKPYNQTIGYMDRLDYVSMMANEHGYVLAIEKLLGIEPPIRAKYIRTMFDEITRILNHLLWLGAHALDVGAMTVFLYCFREREDLMDCYEAVSGARMHATYYRPGGVYRDLPDSMPKYKPSRWHNEKAVKKMNEAREGSLLDFIWDFTARFPNLIDEYESLLTDNRIWKQRTVGIGVVSAERALQLGFTGPMLRASGVEWDLRKKQPYAAYDRVDFDIPIGREGDCYDRYLVRIEEMRQSNRIIRQCVEWLRKNPGSVMIDDYKIVPPQREVMKRDMEALIHHFKLFTEGYIVPEGEAYAAVEQPKGEFGVYIVSDGANKPYRVKVRAASYPHLAAMNEMCRGHMIADLVAIISSIDIVFGEIDR

SEQ ID NO: 63678 - protein, 385 aa, Vibrio harveyi
MSKRDFYEVLGVSRDASERDIKKAYKRLAMKYHPDRNQGDESAADKFKEVKESYEILTDPQKKAAYDQYGHAAFEQGGGGFGGGGFGGGGADFGDIFGDVFGDIFGGGRRGGGQQRAQRGADLRYNMELSLEEAVRGVSKEIEVPTLVHCDTCDGSGAKKGSSAETCGTCHGHGQVQMRQGFFAVQQTCPTCHGKGKIIRPCNECHGQGRKQKTKTLNVKIPAGVDTGDRIRLSGEGERGEMGAPAGDLYVQVHVKEHHIFEREGNNLYCEVPVSFLMACSMAALGGEVEVPTLDGRVNLKVPTETRAGRMFRMRGKGVKGVRGGGVGDLIVKLVVETPVNLSARQKELLKEFDESCGGDAQLSTNQNLKGFFNGVKKFFDDLTS

SEQ ID NO: 63679 - protein, 337 aa, Zea mays
MAKIKIGINGFGRIGRLVARVALQSDDVELVAVNDPFISTDYMTYMFKYDTVHGQWKHHEVKVKDSKTLLFGEKEVAVFGCRNPEEIPWGSVGAEYVVESTGVFTDQEKAAAHLKGGAKKVVISAPSKDAPMFVVGVNEKEYKSDINIVSNASCTTNCLAPLAKVINDKFGIVEGLMTTVHAITATQKTVDGPSSKDWRGGRAASFNIIPSSTGAAKAVGKVLPVLNGKLTGMSFRVPTVDVSVVDLTVRLEKSATYDEIKAAVKAEAEGSLKGILGYVEEDLVSTDFQGDSRSSIFDAKAGIALNGNFVKLVSWYDNEWGYSTRVVDLIRHMNSTK

SEQ ID NO: 63680 - protein, 384 aa, Rickettsia bellii
DISKVYSEADCFTYDPGFMSTASCRSTITYIDGDQGILRHRGYDIKDLAEKSDFLEVAYLLIYGELPNNKLYNDFTKKVAHHALVNERLHYLFQTFCSSSHPMAIMLAAVGSLSAFYPDLLNFFKEADYELTAIRMIAKIPTIAAMSYKYSIGQPFVYPDNSLDFTENFLHMMFATPCEKYKVNPVIKNALNKIFILHADHEQNASTSTVRIAGSSGANPFACVSTGIASLWGPAHGGANEAVINMLKEIGSVENIPKYIAKAKDKNDNFRLMGFGHRVYKNYDPRAAVLKETCKEVLKELGQLDNNPLLQIAIELEAIALKDEYFIERKLYPNVDFYSGIIYKAMGIPPQMFTVLFATARTVGWMAQWKEMHEDPEQKISRPR

SEQ ID NO: 63681 - protein, 584 aa, Streptococcus thermophilus CNRZ1066
MAFEIIMPKLGVDMQEGEIIEWKKQEGDVVNEGDILLEIMSDKTNMELEAEDSGVLLKITRQAGETVPVTEVIGYIGAEGEVVADNSTSAPAAEATAQLEAAGLEVPKAPSQPSPATAEKAALADNEYDIVVVGGGPAGYYAAIRGAQLGGKVAIVEKSEFGGTCLNKGCIPTKTYLKNAEILDGLKIAAGRGINLASTNYTIDMDKTVDFKNSVVKTLTGGVQGLLKANKVTIFNGLGQVNPDKTVTIGSETIKGRNIILATGSKVSRIDIPGIDSQLVMTSDDILDLRELPKSLAVMGGGVVGIELGLVYASYGVDVTVVEMADRIIPAMDKEVSLELQKILSKKGMKIMTSVGVSEIVEGNNQLTLKLNNGEEIVAERALLSIGRVPQLNGLENLNLELDRGRIKVNEYQETSIPGIYAPGDVNGTKMLAHAAYRMGEVAAENAMHGNVRKAHLDYTPAAVYTHPEVAMCGLTEEDARAKYGDVLIGKSSFAGNGRAIASNEAHGFVKVVADAKYHEILGVHIIGPAAAELINEAATIMENELTVDELLQSIHGHPTFSENMYEAFADVLGEAVHNPPKRK

SEQ ID NO: 63682 - protein, 383 aa, Lactobacillus sakei
MAEKRDYYDVLGVGRDASDDEIKKAYRKLSKKYHPDINKAPDAEAKFKEVTEAYEALSDPQKRAAYDQYGHAGMNGGFGGGAGAGQGFGGFGGGAEGFGGFDDIFSSFFGGGARQQPNGPRQGSDLQYRMDLKFEEAVFGKETKISYSREAECHTCHGSGAKPGTSAETCHKCHGAGQIQVERQTPLGRMMSRETCDVCGGTGKEIKSKCDTCHGTGREEERHTVKVKVPAGVEDGQQMRLQGQGEAGSNGGPYGDLFIVFRVAPSDEFERDGAQIFVEVPISFVQAALGDEIEVNTVHGPVKLKIPAGTQTNTVFRLRGKGAPKLHGTGNGDQKVTVNVVTPKSLNSKQRDALKAFAVASGDSVNPQDNNLFDKILNKKHKK

SEQ ID NO: 63683 - protein, 761 aa, Rhodopseudomonas palustris
MHSGLDNSAELRVSDFDPITLAGGTRTEVLPGAIQPHAALLALAPADLTIVHAAGATASLLGAAAELLPGTAASTAFSSDQIARLQALATAERWIERPQHAFTLNAPDATPIDVIVHHASGLLVVELDPRREPAPENSLALVQSMIRRARPAPNLQGFCDAMAAELRSVTGFDRVMVYRFARDGSADVIAEARGPETSPFLGLRDPQPDISNQPGSISRIRVQPDVHAPAAPLWPAHSPRNGLALDLSFSATRSASPEHRLYLAQLGVAASLSLSLVVEGELWGLIVCHHATPRFLPYRMREACALFAEMASLQLETRLAADQLAARLRSTRIHEELVTRMSQESDLAEGLIRFYPNLLDFIPAAGVGLWIDGQFTGIGATPGPAQVAAMMGWLHGVPHDGVYHTDCLALAYPPAKAFAGCASGLLALSLSNTPHNYVLWFRPEVVRVVTWAGMPNKPVGVDAGAPRTPKGCASSWQESVRLHGEPWLDTDVDAAHRLRESLLDVVLRRIDGIARERRSAQLLQEQLMRQVELGLSRSKDVAKTLQEEKRRRVLVEADLSKVLRRTVEDQEAERLRIARELHDTLGQSLTLLQLGFDKLGQAAGDNPELQQRIAEMKSLTADVGRQANRLAWEIRPTALDDLGIQTAIQNLLDSWSEKSSIEFDLHMTLGSRRLPSPVETTLYRVLQEALTNVVRHASARHVSVILQLGDDQVTMIVEDDGCGFVTAGRKPPSGRLGLLGIRERLSLVGGSLEIESAPGKG

SEQ ID NO: 63684 - protein, 757 aa, Rhodopseudomonas palustris
MYSGLDNSAGLRVSDFDPITLAGGTRTEVLPGAIQPHAALLALAPADLTIIHAAGATASLLGAAADLLPGTAASSVFSSDQIARLQTLAAAERAIERPQHVFTLSAPDATPIDVVVHHASGLLVVELDPRREPAPENSLALVQSMIRRVRPAPNLQAFFDSMAAELRNVTGFDRVMVYRFAPEGSADVIAEARDPDASPFLGLRDPQPDIPHRPGPASRIRVQPDVHAPAAPLVPAQSPRSGTALDLSFSAIRSCSPEHRLYLAQLGVAASLSLSLVVEGEVWGLIVCHHGTPRFLPYRMREACALFAEMASLQLEARLAADQLAARLRSTRIHEELVTRMSQESDLAEGLIRFYPNLLDFIPAAGVGLWIDGQFTGIGATPGPAQVAAMMGWLHGVAHDGVYHTDCLALAYPPAKAFAGCASGLLALSLSNTPHNYVLWFRPEVVRVVTWAGMPNKPVGVGADGSRTPKGCASSWQESVRLHGEPWLDAEIDAAHRLRESLLDVVLRRIDGIARERRSAQLLQEQLMRQVELGLSRSKDVAKTLQEEKRRRVLVEADLSKVLRRTVEDQEAERLRIARELHDTLGQSLTLLQLGFDKLGQAAGDNPELQQRIAEMKSLTADVGRQANRLAWEIRPTALDDLGIQTAIQNLLDSWSEKSSIEFDLHMTLGSRRLPSPVETTLYRVLQEALTNVVRHASARHVSVILQLGDDQVTMIVEDDGCGFVTAGHKQPSGRLGLLGIRERLTLVGGSLEIESR

SEQ ID NO: 63685 - protein, 755 aa, Rhodopseudomonas palustris
MYSGLDNSAGFRVSDFDPITLAGGTRTEVLPGAIQPHAALLALAPADLTIIHAAGATASLLGAAADLLPGTAASSVFSSDQIARLQTLAAAERAIERPQHVFTLSAPDATPIDVIVHHASGLLVVELDPRREPAPENSLALVQSMIRRVRPAPNLQAFFDAMAAELRNVTGFDRVMVYRFAPEGSADVIAEARDPDASPFLGLRDPQPDIPHRPGPASRIRVQPDVHAPAAPLVPAHSPRSGTALDLSFSAIRSCSPEHRLYLAQLGVAASLSLSLVVEGEVWGLIVCHHGTPRFLPYRMREACALFAEMASLQLEARLAADQLAARLRSTRIHEELVTRMSQESDLAEGLIRFYPNLLDFIPAAGVGLWIDGQFTGIGATPGPAQVAAMMGWLHGVAHDGVYHTDCLALTYPPAKAFAGCASGLLALSLSNMPHNYVLWFRPEVVRVVTWAGMPNKPVGVGADGSRTPKGCASSWQESVRLHGEPWLDAEIDAAHRLRESLLDVVLRRIDGIARERRSAQLLQEQLMRQVELGLSRSKDVAKTLQEEKRRRVLVEADLSKVLRRTVEDQEAERLRIARELHDTLGQSLTLLQLGFDKLGQAAGDNPELQQRIAEMKSLTADVGRQANRLAWEIRPTALDDLGIQTAIQNLLDSWSEKSSIEFDLHMTLGSRRLPSPVETTLYRVLQEALTNVVRHASAHHVSVILQLGDDQVTMIVEDDGCGFVTAGHKQPSGRLGLLGIRERLTLVGGSLEIE

SEQ ID NO: 63686 - protein, 477 aa, Bordetella parapertussis 12822
MRTITSLIDGQWAGGAGDSENINPSDLSAPVCLVAQASAQQAAQAVEAARRAQPGWAATGLAARAQILKDIGRGIVANSQQLAHILASEQGKTLPEARGEVQRAADIFDYYAGEVFRLGGEMFPSIRAGVEVEISREPLGVVALITPWNFPIAIPAWKTAPALACGNAVVLKPSEFTPATAVMLAEIIRAAGVPDGVFNLVLGTGADVGQVLTGHPAVAGVSFTGSSATGRKIAASAVAGHKKLQMEMGGKNPLVVLDDADLEIALACALDGAFHATGQRCTASSRLIVTPGIHDRFVQELAQRVMALNVGHALDERSQIGPVSNGAQFDKDLSYIALARDEAQRVIGGAALQRAQRGYYLQPCLALDVSLDARIAREEVFGPLACVLRAQDYEHALAIANDTEYGLSAGICTQSLKHATHFRRHVQSGLAMVNMPTSGVDFHVPFGGRGASSYGSSEQGHYAREFFTSLKTSYIRP

SEQ ID NO: 63687 - protein, 572 aa, Magnaporthe grisea 70-15
MTNNRCELIAQAPHISAPQGPGRGRPKITSAMEEPRPFPPKLLKTHFDFVGAVVWPIWFLINSGCPALPERARLVDSAQSFMDSAVAGAADIGRYGRRIVRMIWDPEPTNDPIANRPAWCLGYEYTLETNITSKTKGEDSKLSTATSSDQQRPPAQANKVPQMPSAQLPTEAAATALSGNTTPPTPEAALEPTKITSQPAAIDTPPDSVDSSFDSSMAYDDVPDDGGWPPAFLNDFESRIWMTYRSGFEPIPRSTDPTASSRMSFAMRLKTMADQQAGFTTDSGWGCMIRTGQSLLANSLLTCRLGRSWRRGQAPDEERKLLSLFADDPRAPYSIHNFVAHGAAKCGKYPGEWFGPSATARCIHALANATENSFRVYSTGDLPDVYEDSFMEVAKPDGKTFHPTLILISTRLGIDKINQVYWESLTATLQLPQSVGIAGGRPSSSHYFVGAQRSDEDQGSYLFYLDPHHTRPALPFHEDPQLYTPSDVDSCHTRRLRRLHIREMDPSMLIGFLILDEENWHAWKSSVKHVQGKSIITVSEHDPSKGSASGRPSAIDEVETLSDDDGDTVLDG

SEQ ID NO: 63688 - protein, 768 aa, Rhodopseudomonas palustris
MYSGLDNSAGFRVSDFDPITLAGGTRTEVLPGAIQPHAALLALAPADLTIIHAAGATASLLGAAADLLPGTAASSVFSSDQIARLQTLAAAERAIERPQHVFTLSAPDATPIDVIVHHASGLLVVELDPRREPAPENSLALVQSMIRRVRPAPNLQAFFDAMAAELRNVTGFDRVMVYRFAPEGSADVIAEARDPDASPFLGLRDPQPDIPHRPGPASRIRVQPDVHAPAAPLVPAHSPRSGTALDLSFSAIRSCSPEHRLYLAQLGVAASLSLSLVVEGEVWGLIVCHHGTPRFLPYRMREACALFAEMASLQLEARLAADQLAARLRSTRIHEELVTRMSQESDLAEGLIRFYPNLLDFIPAAGVGLWIDGQFTGIGATPGPAQVAAMMGWLHGVAHDGVYHTDCLALAYPPAKAFAGCASGLLALSLSNTPHNYVLWFRPEVVRVVTWAGMPNKPVGVGADGSRTPKGCASSWQESVRLHGEPWLDAEIDAAHRLRESLLDVVLRRIDGIARERRSAQLLQEQLMRQVELGLSRSKDVAQTLQEEKRRRVLVEADLSKVLRRTVEDQEAERLRIARELHDTLGQSLTLLQLGFDKLGQAAGDNPELQQRIAEMKSLTADVGRQANRLAWEIRPTALDDLGIQTAIQNLLDSWSEKSSIEFDLHMTLGSRRLPSPVETTLYRVLQEALTNVVRHASARHVSVILQLGDDQVTMIVEDDGCGFVTAGHKQPSGRLGLLGIRERLTLVGGSLEIESAPGKGTALYARN

SEQ ID NO: 63689 - protein, 338 aa, Glycine max
MGKVKIGINGFGRIGRLVARVALQRDDVELVAVNDPFITTDYMTYMFKYDSVHGHWKHHDVTVKDEKTLLFGDKPVTIFGHRNPEEIPWGSTGADIIVESTGVFTDKDKAAAHLKGGAKKVIISAPSKDAPMFVVGVNEHEYKPELDIISNASCTTNCLAPLAKVINDRFGIVEGLMTTVHSITATQKTVDGPSAKDWRGGRAASFNIIPSSTGAAKAVGKVLPALNGKLTGMAFRVPTVDVSVVDLTVRLEKEASYDEIKNAIKEESEGKLKGILGYTEDDVVSTDFIGDSRSSIFDAKAGIALNKNFVKLVSWYDNEWGYSSRVIDLLVFVAKKSL

SEQ ID NO: 63690 - protein, 592 aa, Prosthecochloris aestuarii DSM 271
MCGIAGELRFDSAAASSTTVDAMLGILEPRGPDAQGVFAHNRICFGHRRLKIIDLSDCASQPMVDSALGLVLVFNGAVYNYRELCTELVGKGYSFFSQSDTEIIIKAYHAWGEDCVGHLQGMFAFAIWERDTGRTFFARDRLGIKPLYFTEDNASMRFASSLPALLKSGAVDTAIDPAALDCYMSFHSVVPAPWTIFRGIRKLPPATTMMVEPDGRKQQRTYWQPDYSRSDEERRRSAGEWIDAVHDALKLAVQRRLVADVPVGVLLSGGLDSSLVVGLLSELVQRHLSTFSVGFEDVAEEEGNEFRYSDIIAERYSTDHHKIFVDHRELQTHLSDCVRAMSEPMVSHDVIGFYLLSREVSQHVRVVQSGQGADEVFAGYHWYPPMMNTPPTEAYSTYSGVFFDRDFNEYRQAVNSSFITEDHAAAFVRNHFAMPGAEEPIDKALRLDSTIMLVDDPVKRVDNMTMAWGLEARVPFLDHELVELAAKIPAEYKVKDGGKYVLKEVGRRIIPHEVIDRPKGYFPVPALKYLEGEYLDMAKNILNQDAAKQRKIFNREYVDMLLNAPQDHITPLRGSKLWQITLLEYWLQEQGL

SEQ ID NO: 63691 - protein, 372 aa, Candida glabrata CBS 138
MLRGSATRLTAMRGFSSTRLAQKALTIGLIPGDGIGKEVIPAGKQILEKVGPKFDLDFKFIDLHAGWETFQNTGKALPDETVEVLRRDCQGALFGAVQSPTTKVEGYSSPIVALRKAMGLFANVRPVKAVEGTNDRPVDMVIVRENTEDLYIKIEKTYTDPATGTRVAEATKRISEVATRRIATIALDIALQRLQSRGHATLTVTHKSNVLSQSDGLFREICKDVYESNKDKYGKIQYNEQIVDSMVYRMFREPECFDVVVAPNLYGDILSDGAAALVGSLGVVPSANVGPEIVIGEPCHGSAPDIAGRGIANPIATIRSTALMLEFLGYPEAAQPIYKAVDSNIRENQIKTPDLGGKSTTQQVVDDILSKI

SEQ ID NO: 63692 - protein, 450 aa, Erythrobacter sp. NAP1
MAVTDHVNLEQFMEGVKKRNPGQPEFVQAVHEVAQDIFEFMEDKVEYHEAQILRRIAEPDRIVSFRVCWEDDNHNIRVQRGWRVQNNNAIGPYKGGIRFHPSVTESVLKFLAFEQTFKNSLTGLPMGGGKGGANFNPKGKSDAEVMRFCQSFMTELYRHIGPDTDVPAGDIGVGGREIGYMFGQYKRITNRWEGVLTGKGQEYGGSQMRPEATGYGAVYFLQNMLKHQGKDVEGHTAVISGSGNVATHAAEKITQLGGKVLTLSDSGGFIHDPDGIDQEKIDWVKHLKTVKRGRISEYVDEFKSATFHEGRPWNIAADLALPCATQNELNEDEAKALVSNGCKGVSEGANMPTTLEGVKVFHDAKILYGPGKAANAGGVAVSGLEMSQNSERISWNHERLGEMLTDLMSGIHEKCTEYGEQDGGYVDYVKGANIAGFKKVADAMLAFGVV

SEQ ID NO: 63693 - protein, 445 aa, Corynebacterium efficiens YS-314
MSVWLSAVLVLVFVLIGGVFAATEMALVSLRESQIRRLERSKGAGRTVAGLARDSGLFLSAVQIGVTFAGFFSSAFGASTIAPQLTPVLQGWGVPGDVAGVISLVVLTLIVSYLSLVLGELVPKRIAMQKAERVSLIVAPPLNIFARLMRPVIWLINGSSNLLLRLLGFDPDARTEDMTEEEVVEIVTSFEGFEQGEREIVADVFEANDRLVTEIMRHRSDVVAFEASESVAEVVDAIRNQPYSRYPVYEETIDDTIGFIHVRGLLEAATRGEGDLPLREIARPIQYFPGTLRLPAAMRQMRASGNHIAMVVDEYGGTDGLVTLEDLLEELVGEIWDEYDRDEHRAVMQLHESQLMDASTNLEDFADVSGILLPEGPYETVAGWIVMKLGRLGRVGDVVEIPADYTIDAEDDAGDIRYELEIAEVRGNRITRVKLSKTDGPPTQE

SEQ ID NO: 63694 - protein, 340 aa, marine gamma proteobacterium HTCC2207
MSHVNKSIVLASRPVGQPTADNFRLETTSVAPITEGQILIKTLYLSLDPYMRGRMSAAKSYADPVAIGEVMTAESAGVVVESKSALYAVGDHVCSRSGWQEYFVSEENDPLTYKVDAAKVPLSAYLGVCGMPGRTAYFGLKTQGKPQAGETLVVSAASGAVGSAVGQIGKKLGLHVVGVAGGPDKCAYVKDELGFDQVVDYKAGNLDADLAAACPNGIDIYFESVGGALTEAVAKQLNAGARVPICGYISNYNSTDISKERTPFHIFGELETPPAHKFFLVFDYMDDYAEANNVLTDWVANGELKYKETLVEGLEKAPEYFSWLFSGKNFGKLVVKIADQ

SEQ ID NO: 63695 - protein, 423 aa, Methanothermobacter thermautotrophicus str. Delta H
MQAVILTAGEGTRMRPLTLTRPKTMLPVAGKPILQYSVDALRDNGVHDIVMITGYHEEAVRSHFGDGSGSGVNITYVRQEERLGTAHAIGQASELIDDEFIVLNGDIITDPGLMGDLIGSYHERKPETLMVLREVPDPSSFGVVKVEGDRVREIIEKPGPDAGAGNLINTGIYVFSPAVFDYIERTPLSRRGEYEITDTIMMQVRDDLPVRAIISDRDWIDVGRPWELLEASERLMKDLEDSVEGDVEDGVTIHGPVAIGEGTIIRSGTYIQGPVYIGRNCDIGPNSYLRAHTCIGDGVSIGNAVEVKNSIIMDGTNINHLSYVGDSVIGMNCNIAAGTNIANLRFDDGPVRMVVKDDVVETGRRKLGAVFGDGVKTGINSSFNPGVKVGKDSCIGAGCVISRDVPSDRLVILRQEHTTMEYR

SEQ ID NO: 63696 - protein, 255 aa, Coxiella burnetii RSA 493
MQRRPLVAGNWKMHGSRESVGQLLRALKHGCERLETAELAVFPPFVFLQQCEEALMRTQISWGAQDVSEFERGAYTGEVSAAMLRDFHCRYVIVGHSERRQRHGETNEQVAAKVRAALRCGIRPIICVGETEKQRNANQTLSVIKEQLAVVLQMNDNLASLEGMVVAYEPIWAIGTGKNATPSQAEEVHAALRDQLHRQDATLAESTRLLYGGSVKPDNAAALFEMPNIDGALVGGASLEAEQFLKIGQQCNQSF

SEQ ID NO: 63697 - protein, 435 aa, Ustilago maydis
MLSSGAGSSIRKKRNFKGLQLAESPLASPVDASATTPSHKPGEGSAASNASTIGKSSAVTPGGSLALPVKNGLDTEPNSGANYHNKLTQQLANLELGVEYKLDLKNEDLKTLSELGAGNGGTVTKVLHEKSGTVMAKKVVFIDAKPSVRKQILRELQILHECNSPYIVSFYGAYLNEPHICMCMEFMQKDSLDGIYKKYGPISPEICGKIAVAVSHGLTYLYDVHRIIHRDVKPSNILVNGAGQIKICDFGVSGELINSIADTFVGTSTYMSPERIQGDQYSVKSDVWSLGVSIIDVALGRFPFAENEEDDDSDADNNYTNEDLAGTLSPTKPAPMISLGQNEKQRRRKSKPAGVTLEGSSHQMSILDLLQHIVNEPPPKLPEGRFPKHMEEFVNLCLLKDPAKRPTPKDLTKHQYVIDADAAKVDLQAWADGMK

SEQ ID NO: 63698 - protein, 383 aa, Rickettsia amblyommii
DISRVSAEADCFTYDPGFMSTASCQSTITYIDGDQGILRHRGYDIKDLAEKSDFLDVAYLLIYGELPSGEQYNNFTKQVAHHSLVNERLHYLFQTFCSSSHPMAIMLAAVGSLSAFYPDLLNFKEADYELTAIRMIAKIPTIAAMSYKYSIGQPFIYPDNSLDFTENFLHMMFATPCTKYKVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAAVLKETCKEVLKELGQLDNNPLLQIAIELEAIALKDEYFIERKLYPNVDFYSGIIYKAMGIPSQMFTVLFAIARTVGWMAQWKEMYEDPEQKISRPR

SEQ ID NO: 63699 - protein, 310 aa, Salinibacter ruber DSM 13855
MSTRPESLATVTDIDCTGQTALVTGSTSGIGRVAAYALGRLGAEVIVHGRDREAGEAVVEGIREEGGEAAFVAADFTEAAAIRTLAETVRTETDGLDLLLNNAGGLFREGRLVEGIERTFYVNHLAPYLLTAELLDHLREDARVVTMASDAHRGAELDLDRVRTVDGYSGMGAYAHSKLANVLFASELARRLDAAGRPAVSNSLHPGFVPGSQFGRFLPGPLSGLFQMLGVVPGTSSVADGAAELLHVAVSPDTADVSGRYFSGQSPTTPAAAARDRAAAERLWHRSAELLGMDVPLSDAVSGSAATDAS

SEQ ID NO: 63700 - protein, 358 aa, Moorella thermoacetica ATCC 39073
MTYMIPEKMKALVLFGPNDVRLVEKPVPKPGPGEVLVRVAACGICGTDVKIITKGMPKMPPYGEFTFGHEWAGTIVALGETVDEFQVGDRVAIEAHKGCGRCENCIDGKYTACLNYGRLDKGHRAAGMTVDGGFAEYAVQHVNSVYKIPDNITFNEATYVTTAGCALYAIDKSGGYIAGDTVLVIGPGPIGLSVVQGARSLGAEKIILMGTREDRLVKGRELGATHTINIREVADPVAEVMAITGGKGCERVFECAGNSQSFEYGIKAAKKGGVMVLVSFYKEPVMANLDYVVLNQISLLTVRGEGNQNCKRALSLMAQGKIDAKPIMTHAFPLEEFQKGLDYFVNRKDGAMKVVINP

SEQ ID NO: 63701 - protein, 486 aa, Streptomyces coelicolor A3(2)
MSGRTPAADRSLETGVAHMHGGRDVANDASTVFDLVILGGGSGGYAAALRGAQLGLDVALIEKNKLGGTCLHNGCIPTKALLHAGEVADQSRESEQFGVKTSFEGVDMAGVHKYKDEVIAGLYKGLQGLVASRKITYIEGEGRLSSPTSVDVNGQRVQGRHVLLATGSVPKTLPGLEIDGNRIISSDHALTLDRVPKSAIVLGGGVIGVEFASAWKSFGSEVTVIEGLKHLVPVEDENSSKLLERAFRKRGIKFNLGTFFQKAEYTQDGVKVTLADGKEFEAEVLLVAIGRGPVSQGLGYEENGVATDRGFVLVDEYMRTNVPTISAVGDLVPTLQLAHVGFAEGILVAERLAGLKTVPVDYDGVPRVTYCHPEVASVGLTEARAKEVYGADKVVSIKFPLGGNGKSRILKTAGEIKLVQVKDGAVVGVHMVGDRMGEQVGEAQLIYNWEALPAEVAQLIHAHPTQNEALGEAHLALAGKPLHMHD

SEQ ID NO: 63702 - protein, 590 aa, Streptomyces coelicolor A3(2)
MAVSVTLPALGESVTEGTVTRWLKAEGERVEADEPLLEVSTDKVDTEIPAPASGVLSSIKVAEDETVEVGAELALIDDGSGAPAAAPAPQAEQVAEPAPEPAPAAPSTEQAAPAPAPTADAAAGGSAQGTDVVLPALGESVTEGTVTRWLKSVGDSVEEDEPLLEVSTDKVDTEIPAPASGTLLEIVVGEDETAEVGAKLAVIGAAGAAPAAAPAAPAAPAQEAPAAPAQPEPTPAPAPAQAAPAPAPQAPAAPAPQPAAPAPAPAPAAAPAAPAAAQPVDDGAYVTPLVRKLAAENGVDLSTVKGTGVGGRIRKQDVAAAAEAAKAAAPAPAAAPAAPAAKKAPVLEASPLRGQTVKMPRIRKVIGDNMVKALHEQAQLSSVVEVDVTRLMKLRARAKDAFAAREGVKLSPMPFFVKAAAQALKAHAPVNAKINEAEGTITYFDTENIGIAVDSEKGLMTPVIKNAGDLNLAGIAKATADLAGKVRASKISPDELAGATFTISNTGSRGALFDTIIVPPGQVAILGIGATVKRPAVIETEDGPVIGVRDMTYLTLSYDHRLVDGADAARYLTAVKAILEAGEFEVELGL

SEQ ID NO: 63703 - protein, 444 aa, Pseudomonas syringae pv. phaseolicola 1448A
MLPPETQRLIEQHGIKYVLAQFVDIHGSAKTKSVPVTGLEMVAEDGAGFAGFAICGMGMEPHGPDFMARGDLSSLTPVPWQPGYGRVVCIGHVDGKPWPYDSRYVLQQQVERLSQRGWTLNTGLEPEFSLFKRDAAGSLQMVDASDNLDKPCYDYKGLSRSREFLERLTEALQPVGFDIYQIDHEDANGQFEINYTYSEAMESADRFTFFRMAAGEIANDMGMICSFMPKPDPKRAGNGMHFHLSIASASSKNLFHDASDPSGMGLSKMAYHFAAGLLAHGPALCAFAAPTVNSYKRLVVGNSLSGATWAPAFIAFGANNRSAMVRVPYGRLEFRLPDAGCNPYLVSAAIIAAGLDGIDRQLEIDHVCNENLYTLSLEEIAARGIKTLPQSLKEACDALEADPLFAEVLGNEIVGEFLRLKRMEWVEYSRHVSDWEVKRYIEFF

SEQ ID NO: 63704 - protein, 899 aa, Streptomyces coelicolor A3(2)
MTTDPKAIQPSELDQLPDRDPEETAEWQASLDAVTQAAGPHRAAYLMRRTLERAEGAGLALPKLLETDYVNSIPTADEPTVDGDEAMEQRITAWNRWNAAAMVTRGSKYGVGGHIATFASAAWLYETGFNHFFKGKEGDGSGDQLYIQGHASPGIYARAFLDGRLNEEQLDNFRREAGGNGLPSYPHPRRLPWLWEFPTVSMGLGPISAIYQARFNRYLTSRGIKDLTNSHVWAFLGDGEMDEPESTTALTLASREGLDNLTFVINCNLQRLDGPVRANFKIVQELEAQFRGAGWNVIKSLWGTAWDELFQLDTTGALVRRLREVPDAQVQTYQTRDAAYIREDFFNKDPQLAEMAKLLSDDKILDCFHFSRGGHESRKVYAAYRAALAHKGAPTVILAQTVKGHTLGRGFASKNANHQMKKLSVDEFKDMRDLLGLPIADSAFVDGVVPYGHPGADSPEVRYLQERRAALGGPAPARRVHPLAPLPAPADKAFASFDKGSGSQNVATTMAFVRLVKDLVRDKETGKRWVPIVPDEARTFGMESLFPSLGIYSPKGQTYEPVDRDQLMYYKEAKNGQILNEGITEAGSMADFIAASTAYATHGEAMIPFYIFYSMFGWQRTADQMWQLGDQLGRGFLVGATAGRTTLTGEGLQHADGHSPAIAATNPAALSYDPAFAYEIAAIVKDGLRRMYGEAAPGEDPNVFYYLTVYNEPMPQPAKPSGVDEGIVKGLYRFNTAETAGLTPAANAPRIQLLGSGTAIHWTLKAQRLLAEEWGVAADVWSATSWTELRRDAMDADAALLRGEDRVPYVRRALQGAEGPVLAVSDYMRQVPDQIAQWVEQDYSSLGADGFGLSDTRDAARRHFGVDAESIVVAALAQLARRGEVKATAVKEARERYGL

SEQ ID NO: 63705 - protein, 322 aa, Pseudomonas syringae pv. phaseolicola 1448A
MQPQAFYRAVADDFSAVDLIIKKQLTSRVPLVSKIGDYITSAGGKRLRPLLVLLCGKALGREGDDLRLLAATIEFLHTATLLHDDVVDMSGMRRGRSTANALWGNAPSVLVGDFLYSRSFEMMVELGSMEVMRILSKATRIIAEGEVLQLSKIRDASTTEETYMEVIRGKTAMLFEASTHSAAALCNAPEVQSEALRTFGDHLGVAFQLVDDLLDYRGDAETLGKNVGDDLAEGKPTLPLIYTMREGSPEQAALVRQAIQKGGLEDLESIRDAVESAGALDYTAQLARDYAARAIACLDALPPSEYRDALVELSEFAVARTH

SEQ ID NO: 63706 - protein, 153 aa, Zea mays
MATKDPAATGGEPAIGIPYHPAPGAQGHYYYAPPPNPYAAGMPPPNAIYAGAPKGVPLQQTMFRDTPAPFHCQACGEAAVSSVRSKPSLASVVACMMPFMLGVCFLCPSMDCLWHKYHYCPSCGEKVGEFRKSDPCLVVDAARWSEPSFAVPA

SEQ ID NO: 63707 - protein, 324 aa, Zea mays
MYVARESTKLWRRVCAETTAELQLLLQKWQLLLAGLVFQYIHGLAARGVHYLHQPGPLLQDLGFMALPELGQEKGYLSESVFTFIFISFLLWSFHPFIYHNKRFYTVLLWRRVLAFLVASQFLRIMTFYSTQLPGPNYHCREGSKLATLPPPNNALEVLLINFPRGVLFGCGDLIFSSHMIFTLVFVRTYHKYGSNRLIKLLSWLMAVIQSLLIIASRKHYTVDVVVAWYTVNLVVFFVDKKLPEMPDRTNGLSLLPVSTKDKDGRMKEELHKLEKDGRMMDEFPKLLNGNSVDATDWRQRVQMNGKHGEDTTHTVADATSAGT

SEQ ID NO: 63708 - protein, 101 aa, Triticum aestivum
AVDSRTVLSFAMACGGDEKGKRESSSSHAASVEGGVQDACDDARSICLESFCESDRSAVTGCKHEFHIQCILGRGQRSSQWSMSGRTLSRKDLSAESAGNI

SEQ ID NO: 63709 - protein, 395 aa, Salinibacter ruber DSM 13855
MGLLLLYVALAIGVSFLCSVMEAVLLSVTPSYVAALEREGSTVGKRLHQFKENVDRPLAAILSLNTIAHTVGAAGVGAQAAVVFGEAYTGIVAGVLTLLILVLSEIIPKTLGAVYWRTLTPALVRLLTATIIVMWPLVKLSQGLTYLLSQDEDEAAFSREEFTAMAELGEEEGVFEEKESRILRNLFRFNSLRVKDVMTPRTVIFQMPEHRTIGDVVEEHDEFRFSRIPVYDDDPDDITGYVLKDEMLLRAAQEEFDVSLSEISRDILVVHETLALPDLLERLLDRLEHIALVVDEYGGVAGVVTMEDVVETLLGLEIVDEADSVEDMQALARKQWFKRARELGMVSDEALEAPTNAEAEASSETVLESDTTAETESQVAAEMARRSSSESPSDE

SEQ ID NO: 63710 - protein, 470 aa, Salinibacter ruber DSM 13855
MADDTSAPNSSSGSNGSLNGGADFPEGFPHASRLKQAGVTSLADLRDVESLEDLSGIGPAYAQDIQNALEGAGTGAPTTGGANGTSTGAATTEKRPSPLSEGDADSSAGGAATRQTIDIPEGPLEETVTYETYPADTYGHDELGIADDEVLDLLRNMLLQRRFENRCRQMYQRQKISGFLHLYIGQEAVSTGSVNAIELGDDSVITAYRDHGMGLAMGITPEAGMAELFGKETGCSKGKGGSMHFFDAEKKMMGGHAIVGAHLPLGAGLAFAHKYRGEDNVCLCFFGDGAMHQGAFREACNLAGIYELPIVFVCENNQYAMGTAVDRAFSKPDLFKHGYNFDFPASLASGMDVFSVNKAVQDHVENYARNDQPSLLEVRTYRYQGHSITDPAEYRGEGELDQRQSQDAINRLQDYILDRGLATEADMEAIDEEVKERVKDAIDAANEASFPDEEAIYDDIYTQEDYPFIA

SEQ ID NO: 63711 - protein, 495 aa, Shigella flexneri 2a str. 2457T
MNFHHLAYWQDKALSLAIENRLFINGEYTAAAENETFETVEPVTQAPLAKIARGKSVDIDRAVSAARGVFERGDWSLSSPAKRKAVLNKLADLMEAHAEELALLETLDTGKPIRHSLRDDIPGAARAIRWYAEAIDKVYGEVATTSSHELAMIVREPVGVIAAIVPWNFPLLLTCWKLGPALAAGNSVILKPSEKSPLSAIRLAGLAKEAGLPDGVLNVVTGFGHEAGQALSRHNDIDAIAFTGSTRTGKQLLKDAGDSNMKRVWLEAGGKSANIVFADCPDLQKAASATAAGIFYNQGQVRIAGTRLLLEESIADEFLALLKQQAQNWQPGHPLDPATTMGTLIDSAHADSVHTFIREGEGKGQLLLDGRNAGLAAAIGPTIFVDVDPNASLSREEIFGPVLVVTRFTSEDQALQLANDSQYGLGAAVWTRDLSRAHRMSRRLKAGSVFVNNYNDGDMTVPFGGYKQSGNGRDKSLHALEKFTELKTIWISLEA

SEQ ID NO: 63712 - protein, 255 aa, Salinibacter ruber DSM 13855
MRNAWHPTDTKYGIQNTRHERPLMPTVVEPPLFFLDYDGTLAPIVDDPAAAVPHPEAPDLLRDLDAQFPLWIVTGRDLQALSSFLDRPYSAIGLHGAQEGVVGRDIHNRMSDEAAAALRRLRASVPSVDGLRVEDKARSFAVHYREARDESGARDQLKDWLADLPEVLDAIWGKKVVELRPDGLTKGTAVRRIAAQHPDHVPVYLGDDVTDEDAFAALQEMDRDAVSIKVGPGDTRADARLDGPDAVMAYLRRYV

SEQ ID NO: 63713 - protein, 421 aa, Shigella flexneri 2a str. 2457T
MSNNEFHQRRLSATPRGVGVMCNFFAQSAENATLKDVEGNEYIDFAAGIAVLNTGHRHPDLVAAVEQQLQQFTHTAYQIVPYESYVTLAEKINTLAPVSGQAKTAFFTTGAEAVENAVKIARAHTGRPGVIAFSGGFHGRTYMTMALTGKVAPYKIGFGPFPGSVYHVPYPSDLHGISTQDSLDAIERLFKSDIEAKQVAAIIFEPVQGECGFNVAPKELVAAIRRLCDEHGIVMIADEVQSGFARTGKLFAMDHYADKPDLMTMAKSLAGGMPLSGVVGNANIMDAPAPGGLGGTYAGNPLAVAAAHAVLNIIDKESLCERANQLGQRLKNTLIDAKESVPAIAAVRGLGSMIAAEFNDPQTGEPSAAIAQKIQQRALAQGLLLLTCGAYGNVIRFLYPLTIPDAQFDAAMKILQDALSD

SEQ ID NO: 63714 - protein, 399 aa, Arabidopsis thaliana
  misc_feature (60)..(60): Xaa can be any naturally occurring amino acid
  misc_feature (74)..(74): Xaa can be any naturally occurring amino acid
  misc_feature (277)..(277): Xaa can be any naturally occurring amino acid
MASVTFSVPKGFTEFSGLRSSSASLPFGKKLSSDEFVSIVSFQTSAMGSSGGYRKGVTEXAKLKVAINGFGRIXGRNFLRCWHGRKDSPLDIIAINDTGGVKQASHLLKYDSTLGIFDADVKPSGETAISVDGKIIQVVSNRNPSLLPWKELGIDIVIEGTGVFVDREGAGKHIEAGAKKVIITAPGKGDIPTYVVGVNADAYSHDEPIISNASCTTNCLAPFVKVLDQKFGIIKGTMTTTHSYTGDQRLLDASHRDLRRARAAALNIVPTSTGAAXKAVALVLPNLKGKLNGIALRVPTPNVSVVDLVVQVSKKTFAEEVNAAFRDSAEKELKGILDVCDEPLVSVDFRCSDFSTTIDSSLTMVMGDDMVKVIAWYDNEWGYSQRVVDLADIVANNWK

SEQ ID NO: 63715 - protein, 450 aa, Helicobacter hepaticus ATCC 51449
MSYASNVLNKLKEQYPSQTLFHQAVAEVFESLEPALQKDKKYETYAILERLTIPDREIHFRVSWTDDNGKIQTNRAYRIEFNAAIGPYKGGLRFHPSVNEGVIKFLGFEQILKNSLTTLAMGGGKGGSDFDPKGKSEGEIMRFCQAFMNELYRHIGATTDVPAGDIGVGGREIGYLFGQYRKLTNCFEGVFTGKAIPWGGSLVRTEATGYGCVYFAQEMLKDRGESLEGKVCSVSGAGNVAIYTIEKLLQLGAIPVTASDSQGMIYDKEGIDLALLKEVKEIKRLTLAEYAKARPQAVYTKVADYPKDSNPVWAIPCFAAFPSATQNELNGNDAKTLLANGCKCVSEGANMPSTIEAVHQFLDAKICYGPGKAANAGGVAVSGLEMAQNASMNPWTFEVVDKRLHTIMESIYANASETAKEFGEPTNLVLGANIAGFRKVAGAMIDQGVI

SEQ ID NO: 63716 - protein, 401 aa, Helicobacter hepaticus ATCC 51449
MKPKILIVGGGYGGLRTAITLQEQLKVDADVTLISKHDYHYQTTLLHKVAIGTLSARKSRVYFRKILDLQKVHFIKDKILSFEPESKRVIGNGGAYEYDYLVIALGFKPDDFGIKGVEEYAHKLSSLNAALKLDKLIEYRFKEYCHTKNADDLSVIVCGTGFTGIEFAAELGSRLDDLCLIGGIPRDVPKVTCIGRSDRILPMFSKKGSALAQKKLEAFGVEVICGGDVQECRSDGVMIKHNGEIKHIKGNTILWSAGVKGNDSLERSCFETTKGRIKVDPYLRCPQYENIYVVGDCAISASRDAIHAPTAQLAAQMGDYVGKSLIKILNNKPQKKVFAFKHRGTVCSIGHTDGVGIIYKKSISGEVAAFLKNFIENKWLFGIGGAELVFKKGQFRYRTSN

SEQ ID NO: 63717 - protein, 268 aa, Helicobacter hepaticus ATCC 51449
MLGFFAVYGNPITHSKSPFLHNYAFTKLGLSGYYSRILLDKGANLRQNFLSNGLSGANITLPFKEEAFNQCDEVRGVAQNIGACNTWVLEDKNHLVGYNTDAQGFYECIKEYKIKNALIIGAGGSAKAVAMILQSHNIPTTLINRSVQNLSFFVHKGFECYVNSEFKPTCSYDILINTTSAGLNDNLLPCDESQLKELCSCGKYAFDLIYGKCTPFLALAQSFHLSCSDGKEMLINQAALSFELFCKQKYNKGNLEIQRIASFMNEIL

SEQ ID NO: 63718 - protein, 207 aa, Citrus sinensis
MEVAAAAGPGATPTEKRRWSRRPSSSSSFRLRCPSLNTLRLRRVFDMFDKNGDGMITVKELHQALNLLGLETDLSELESTIASHVKPGNDGLEFEDFVSLHESLDETFFPLNDLTSTATTDADEGNKKVLSQEEADLSEAFKVFDEDGDGFISAHELQVVLGKLGLTEGNEIARVQQMIGSVDRNHDGRVDFFEFKNMMQSVLVRSS

SEQ ID NO: 63719 - protein, 331 aa, Thermus thermophilus
MKVGINGFGRIGRQVFRILHERGVEVALINDLTDNKTLAHLLKYDSTYGRFPGAVGYDEENLYVDGKAIRATAIKDPREIPWKQAGVGVVVESTGVFTDGEKARAHLEAGAKKVIITAPAKNEDITVVLGVNHEQYDPAKHHILSNASCTTNSLAPVMKVLEKAFGVEKALMTTVHSYTNDQRLLDLPHKDLRRARAAALNIIPTTTGAAKATALVLPSLKGRFDGMALRVPTPTGSISDITALLKREVTAEEVNAALKAAAEGPLKGILAYTEDEIVLRDIVMDPHSSIVDGKLTKAIGNLVKVFAWYDNEWGYANRVADLVELVLKKGV

SEQ ID NO: 63720 - protein, 660 aa, Bacillus cereus ATCC 14579
MTEENKSFYITTPIYYPSGKLHIGHAYTTVAGDAMARYKRMQGYNVHYLTGTDEHGQKIQKKAEELNITPQAYVDNIVAGIKELWEKMNISYDDFIRTTEDRHKDVVEKIFKQLVDQGDIYLDEYEGWYSVQDETFYTEHQLVDPIMEGDKVVGGKSPDSGHDVELVREESYFFRMGKYVDRLLKFYEDNPHFIQPESRKNEMINNFIKPGLEDLAVSRTSFDWGVRVPGNPKHVIYVWVDALSNYITALGYGTANEEKYKKFWPADVHLVGKEIVRFHTIYWPIILMALDLPLPKKVFAHGWILMKDGKMSKSKGNVVDPVTLIDRYGLDALRYYLLREVPFGSDGVFTPEGFVERINFDLANDLGNLLNRTVAMIDKYFSGEIPAFKANVTEFDETLVAFAQDTLKKVEEAMENMEFSVALGSIWQLVSRTNKYIDETQPWVLAKDENDREKLASVMAHLAEVLRQTGIMLMPFLTVAPSKMFAQLGLTDEAHKSWESLSTIGCIPAGTKVEKGNPIFPRLEMEVEVEYIKEQMKSSAPKVEEKKEEEPKAEEITIDDFFKVELRVAEVLSAEPVKKADKLLKIQLDLGTEKRQVVSGIAKFYSPEDLKGKKVICVTNLKPVKLRGELSQGMILAGEENGVLSLASIDQNLPNGTKIK

SEQ ID NO: 63721 - protein, 409 aa, Bordetella parapertussis 12822
MAMDSIAIIGAGQAGAALAARLRQAGFQGGIDVFGAESAPPYQRPPLSKKYLAGDWEQERLWLRPAQFWREQGIALHLGGTVEALDLASRTLRCGGRRHGWRKLALTTGAAPRPLPAAFAGRSNVFELRNLADVQRLQPAFLAGRRLLVLGGGYIGLETAAVAAQAGLSVQVVERASRVLERVACPATAAAIRALHQRHGVLIHEGRTVAGTEGDEALTGVELDNGLRIACDLVVAGVGVAPQTALAEAAGIDCDDGILVDAYGRTSAPDVWAAGDCARFVLGGEPARLESVQNAIDQAEAVADDMLGQGRPYQPVPWFWSDQYDMKLQIVGLNRGYDAVVSHASAKGESHWYFRADRLISVDALNDGRAYMVGKKLLEAGRAVGRGEVERPGFEPMQLLRDQAESRLR

SEQ ID NO: 63722 - protein, 684 aa, Arabidopsis thaliana
MAKTSCEIILCFFFFILSFRVISVSAQQTCDNTAGSFKPNSTYDNNRRLLLSTFASNVTAQNGYFNGSFGLGTDRVYAMGMCAPGAEPDVCSNCIKNTAEGLLQICLNQTDGFSWSGEETLCLVRYSNKSFSGLLGLEPSNDFFNVNEIRKEDQKEFDSVFDELMFRTIQGASSSVRNNSNSLSLSGKYYAKDVAPEPVYGNISVVMQCTPDVSSKDCNLCLERSLDFYKKWYNGKRGTIILRPSCFFRWELYTFFGAFDSINARHPPPPPRPLSPPPLKTPSVTNQTNITKKNGKSFFGISGGTIAAIVVVVVVTIILIVVGLVICKRRKQKQEIELPTESVQFDLKTIEAATGNFSEHNKLGAGGFGEVYKGMLLNGTEIAVKRLSKTSGQGEIEFKNEVVVVAKLQHINLVRLLGFSLQGEEKLLVYEFVPNKSLDYFLFDPNKRNQLDWTVRRNIIGGITRGILYLHQDSRLKIIHRDLKASNILLDADMNPKIADFGMARIFGVDQTVANTARVVGTFGYMSPEYVTHGQFSMKSDVYSFGVLILEIISGKKNSSFYQMDGLVNNLVTYVWKLWENKTMHELIDPFIKEDCKSDEVIRYVHIGLLCVQENPADRPTMSTIHQVLTTSSITLPVPQPPGFFFRNGPGSNPSSQGMVPGQSSSKSFTSSVDEATITQVNPR

SEQ ID NO: 63723 - protein, 508 aa, Rickettsia sibirica 246
MNNTYYITTPIYYVNDIPHIGHAYTSVASDVIARFMRLRGFDVMFLTGTDEHGQKVEKAAINKNIDPQKFTDQTSESFRHLMTAMHISNDDFIRTTEHRHKEAVAVFWQKLLDNGTIYEGFYEGWYAVQDEAFFDESELTRDGLAPTGAPVEWVKEPSYFFNLSKWQDKLLEFYEANPDFIRPISRRNEVISFVKSGLKDLSVSRTTFNWGIKVPNNEKHVIYVWLDALANYISALGYLDEQSNYNKFWPADLHVVGKDILRFHAVYWPAFLMAAEVPLPKTIMAHGWWTNEGQKISKSLGNTIDPIKLIDEFGVDQVRYFLMREVTFGADGNFARSNLITRINSELSNKIGNLLQRTTSFVYKNNDAKVPLLTQGVIDKIYELPILKTASKVVEQNILLMDKTEINKILENIINLAEEANIYIDSEAPWNLKKIDPDKTLEVLYALLEVLRYIAIMLLPFIPSSANKMLDQLGVNKEERLFKHLIRDYTLTAGSNILEPTIIFPKFE

SEQ ID NO: 63724 - protein, 308 aa, Oryza sativa (japonica cultivar-group)
MVAAAGDRLDLPVVDLASSDLRSSAESIRKACVECGFFYVVNHGIEEGLLEKVFAENRRFFEQPLEEKMALLRNSSHLGYTPPYTEKLDASSKFRGDLSETFKIGPIGDEGFQNDANQWPSEERLPCWKETMKLYRGTALGTGKRILSLVALSLNLDAEFFDCPLAFLRLLHYPGEINESDDGNYGASAHSDYGILTLLATDGIPGLQICREKDRHPQLWEDVHHIDGALIINIGDLLERWTNCVFRSTLHRVVAVGKERYSVAFFLDPDPDLVVQCLESCCSEACPPRFPPIKSGDYLEERLSSTYK

SEQ ID NO: 63725 - protein, 444 aa, Bacillus licheniformis ATCC 14580
MAKYTRDDIVKLVNEENVKYIRLQFTDILGTIKNVEIPVSQLEKALDNKVMFDGSSIEGFVRIEESDMYLYPDLDTFVIFPWTAEKGKVARFICDIYNPDGTPFEGDPRNNLKRILKEMEDMGFSDFNLGPEPEFFLFKLDEKGEPTLELNDKGGYFDLAPTDLGENCRRDIVLELEEMGFEIEASHHEVAPGQHEIDFKYAGAIRACDDIQTFKLVVKTIARKHGLHATFMPKPLFGVNGSGMHCNLSLFRNGANAFFDKDADLQLSETAKQFIAGIVKHATSFTAVTNPTVNSYKRLVPGYEAPCYVAWSAQNRSPLIRIPASRGISTRVEVRSVDPSANPYLALSVLLAAGLDGIKNKLEAPAPIDRNIYVMTKEERLENGIVDLPATLADALEEFKSNEVMVKALGDHLFEHFVEAKEIEWDMFRTQVHPWEREQYMSQY

SEQ ID NO: 63726 - protein, 416 aa, Halobacterium sp. NRC-1
MTESGPLENMLAQMEQAREYVDIDDGIYERLKSPERTLSVSLPVRMDDGSVEVFDAYRCQFDSARGPYKGGIRYHPTVSEEEVSALAGWMTWKTALVDLPFGGAKGGIVCNPKELSDNEIEQLTRRYTEGIRRMIGPETDIPAPDMNTDPRTMAWVMDTYSVYQGYAVPEVVTGKPPEIGGTDGRVEATGRGVSIITEETFEYFDTDIQDADVAIQGFGNVGSVTADLLSERGANIVAVSDVTGAIHDPTGLDIADVQAYADANGGRLEGYDAEPISNDDLLTLDVDALIPAAIEDVITVDVAERLAADVIVEAANGPTTFDAAQVLSDRGVPVVPDILANAGGVIVSYLEWVQNSQQYSWDVEEVNRDLRQRLTGAFDEMLVAYEDRNIPTLRTAAYTIALERSADAHEFRGLFP

SEQ ID NO: 63727 - protein, 166 aa, Oryza sativa (indica cultivar-group)
MASRVSSLLRAAAAAVSVPGRSRSLSAAAATAAKKPAGDYVPVYVAMGMIAVSVSLGLATARQQLAHAPNVRLDKKKRETVPEVAAPDMALDEAERFVGGSLFRKVAHVQDDASLRAGVAADPVAEYPARKAVTLKDAGVEPPGIEQGREGILEVLGKKTKPAAAA

SEQ ID NO: 63728 - protein, 1071 aa, Erythrobacter sp. NAP1
MATNATLTPIPQPPGKPLIGNALTVDASQQIQSLMELAEEYGPIFQLDMMGTPIVIISGADLVAEVCDEKRFDKSVRGPLKRLRLIGGDGLFTGDTDAPNWSKAHNILLPSFSQKAMGSYLPMMTDIATQLVMKWERMNSDDVIDVPKDMIRLTLDTIGVCGFGYRFNSFYREDFHPFIRALTRTLETTQKIRGIPGEKLLKGDAVKQLHRDAKYMNNLVDEIIRERQRSGGDGPEDLLDFMLSGRDPLTGERLSDENIRYQINTFLIAGHETTSGLLSFTLYYLLKNRDVLTRAYAEVDTVLGRNIDQPPSLKQIGQLPYIRAILFEALRLWPTAPAFGLAPFEDEVLGGKYLIPKGTFTTVLIPSLHRDKSVWGENPEVFDPENFTAEAEAARPPHAYKPFGNGQRACIGRQFAIQESILVLAMILQRFELFDHSDYKLDIKETLSIKPDEFTIKARMRKDVERGGKATEDAEEASTEPAEPKVPKHDTPLLVLYGSNLGSSESFAREVAQKGEFSGFEVEMAPLDDYVGKLPEDGAVAIACASYNGMPPDNAAKFIDWIEGKDGAAPDLSGVSYMMLGCGNSDWAATFQAVPRLIDARMEELGAKRIVPTTELDARSDVDTQFHTWLDALMPQLGEHFDLDLSGEAAGIAEPLYKVEVTQSVTANTVASRVGAHAVKMVANRELKNTDIGEGRSTRHIEVELAQGETYQPGDHLCVVPENDDAVVERLLRRFNLDADTYVRIESRSEMRGPFPSGSTFSVYNLAKTAGELQAVATRKDIATLALYTECPNSKPALEKLAQPPQEDGTDQYATDVLAKRKSVLDLLEDYPACDLPLAVFLEMIPFLSPRYYSISSAPGDTPQTCSITVGVVKGPALSGKGTFKGTCSNYLAELEPGASFNAVVREPTANFRLPDDPKVPLIMVGPGTGLAPFRGFLQERDALASSGEELGPARLYFGCRTPDEDFLYRDELEDYDKRGIVTLRTAFSRVDEGKCYVQDHIADDADAIWEMLEAGGRIYVCGDGARMEPDVRAALAKIHSDKTGSTPAEAQSWVGDLITNERYSLDVWVG

SEQ ID NO: 63729 - protein, 396 aa, Oryza sativa (japonica cultivar-group)
MATFSGTDRLRDLHAFDDTKAGVKGLVDAGVTTVPYFFRHHPDPLPVAAPSEAAAAIPLIDLAKADVDRGHVVSQVRSAAESAGLFQVVNHGVAGELMDAMLAAARRFNEQPAEAKAPYYTRDLGSKVRFFCNFDLFQSPAAQWRDTLYVEMVPDAPSPEEIPPPLRGVAEEFAAAVWRLGERVTELLSEALGLPPGYLAEHAGCMDGMSMVAQYYPPCPEPEKTMGTTRHSDPSFLTVLLQDESGGLQAVLPRPPEERWVDVPPVAGALVVNVGDLLQLVSNGRLRSMEHRVLPTAASAARARVAVACFFRLEYSASLTRPRSYGPIVDSGEGGARRAAAVYRSTTPRDFLAYFNGKGLDGRSALEHFRIPEAAAASSAVDVVSSSTTAAASIPR

SEQ ID NO: 63730 - protein, 448 aa, Streptococcus pyogenes MGAS10394
MAITVADIRREVKEKNVTFLRLMFTDIMGVMKNVEIPATKEQLDKVLSNKVMFDGSSIEGFVRINESDMYLYPDLDTWIIFPWGDENGAVAGLICDIYTAEGKPFAGDPRGNLKRALKHMNEIGYKSFNLGPEPEFFLFKMDDKGNPTLEVNDNGGYFDLAPIDLADNTRREIVNILTKMGFEVEASHHEVAVGQHEIDFKYADVLKACDNIQIFKLVVKTIAREHGLYATFMAKPKFGIAGSGMHCNMSLFDNQGNNAFYDETDKRGMQLSEDAYYFLGGLMKHAYNYTAITNPTVNSYKRLVPGYEAPVYVAWAGSNRSPLIRVPASRGMGTRLELRSVDPTANPYLALAVLLEAGLDGIINKIEAPEPVEANIYTMTMEERNEAGIIDLPSTLHNALKALQKDDVVQKALGYHIYTNFLEAKRIEWSSYATFVSQWEIDHYIHNY

SEQ ID NO: 63731 - protein, 135 aa, Triticum aestivum
MAAILARKSLLALRARQLAVSGQGLHSSQNYGLRLSAHSYSTKREDEEREQLAKEISKDWSSVFERSINTLFLTEMVRGLMLTLKYFFETKVTINYPFEKGPLSPRFRGEHALRRYPTGEERCIACKLCEAICPA

SEQ ID NO: 63732 - protein, 427 aa, Oryza sativa
  misc_feature (144)..(144): Xaa can be any naturally occurring amino acid
MASSGCSSNRLRQTIVVALLLLASSSCLASAKHRGNGTTTTVPFHGKDELRRYRKIMAQVARLKKASVKTIQSPDGDVIDCVPARLQPAFDHPKLRGQKPEAEPEERPKVGGAAAAEAEEEAVFPQAWTDGGESCPEKTVPVRXTRRRDVLRSSSAVRFGMKQPRAAGVVRRDSTSDGHEHAVGYVTGDQFYGAKASLNVWSARVATAAEFSLSQIWVISGSFGNDLNTIEAGWQVSPELYGDNNPRFFTYWTTDAYQATGCYNLHCSGFVQTNNRIAIGAAISPTSVYNGRQFDISLLIWKDPRRGHWWLQLGSGPLVGYWPPPSLSSSLRRANMVQFGGEVVNTRPSGSHTPTQMGSGHFPREGFNRAAYFRNLQVVDWDNNLLPAAALRLVADHPSCYDIQGGYNRAWGNYFYYGGPGRNVRCP

SEQ ID NO: 63733 - protein, 487 aa, Sinorhizobium meliloti 1021
MRAQPKASHFIDGEYVEDAAGTVIESIYPATGEIIARLHAATPGIVEKAIAAAKRAQPEWAAMSPTARGRILKRAAELMRQRNRELSELETLDTGKPIQETIVADPTSGADSFEFFGGVAPAALNGDYIPLGGDFAYTKRVPLGVCVGIGAWNYPQQIACWKGAPALVAGNAMVFKPSENTPLGALKIAEILIEAGLPKGLFNVIQGDRATGPLLVNHPDVAKVSLTGSVPTGKKVAGAAAAELKHVTMELGGKSPLIVFDDADLESAIGGAMLGNFYSTGQVCSNGTRVFVQRKIKEPFLARLKERTEAIVIGDPLDEATQLGPMVSAAQRDKVFSYIGKGKAEGARLVTGGGIPNNVSGEGTYIQPTVFADVTDGMTIAREEIFGPVMCVLDFDDEVEVIARANATEFGLSAGVFTADLTRAHRVADRLEAGTLWINTYNLCPVEIPFGGSKQSGFGRENSVAALNHYTELKTVYVGMGPVEAPY

SEQ ID NO: 63734 - protein, 344 aa, Triticum aestivum
  misc_feature (318)..(318): Xaa can be any naturally occurring amino acid
  misc_feature (336)..(336): Xaa can be any naturally occurring amino acid
GLTRPQAVKAIPKLSHLKSPANPDAVRSFLAGLGLSGADVAAVVAKDPQLLCASVEKILARNVDELTGLGLSRNDIKRLISLTSGGGHFRCRAIVPKLQYYLPLFGSPENLLRALSRSFYLIGVDIERTIKPNVALLQECGLGACDIAKLCRYAPRMLNTSLESIQAMVECAEGLGVPRGSAMFKHVRELVSFLSEEKIATKVDYLKKTFRWSDAEVGIALSRAPSLLRRSKDALQSKSEFLISEVGLEPEYIAQRPAMLNYSLDGRLRPRYYVVKFLKANGLLARERDYYSVFSHVEKVFVQRYICPYKEAAPHLAXDYDAAHSGEVPANFKFTXPRTGHENW

SEQ ID NO: 63735 - protein, 316 aa, Aspergillus oryzae
MAPIGTSAKRALTPGFYVPTVAFFAGPDEDVDVSTVEKHAAYLAQSGITGLVVQGSNGEAVHLDRDERKTITAATRRALDAHGAESMPVIVGCGGSSTRETIQLCKDAGESGGDYALVLPPCYYKSLVSTEALRDHFRAVASASPVPVLIYNFPGASSGLDLTSDDILALSEHPNIVGVKLTCGNTGKLARIAAQAKPEFLTFGGSADFTLQTLVAGGAGIIGGLGNLIPRSCVYVMKLYNEGNVKEAQAAQAVVARADWHAIKGGFVAVKSALQSYRGYGAQPRRPCVEPSAEEAAALKEAFSEAVELERRLEKA

SEQ ID NO: 63736 - protein, 323 aa, Oryza sativa (japonica cultivar-group)
MAMITLPVAAHAPSPWLPPSILRLRSTSTTTTIPAAAARSSAPHPLPDELHLVADIRSPHNHIRVADVSRTASGAGHPLAGARLLLLDAPGNIHSLSFPRSPCPLTSTYLDVFATLPPLLPASASSLAVLGFGAGSAARAVLHFFPDISVHGWEIDPAVVSASRDFFGLAELEAEHAARLSIHVGDALEASADAVAVPGGFGGVLVDLFAGGSVLPELQEMDTWRRIGRRMVAPGGRVMVNCGGPCVEAEEEGRGGEAVKDATLRALTAAFGHGMVSVMDMDESWVAMTGPAVSSAPEEAAAWKAKLPPELRRYVDMWRPCLL

SEQ ID NO: 63737 - protein, 469 aa, Streptomyces coelicolor A3(2)
MFQNADDVKKFIADEDVKFVDVRFCDLPGVMQHFTLPATAFDPDAEQAFDGSSIRGFQAIHESDMSLRPDLSTARVDPFRRDKTLNINFFIHDPITGEQYSRDPRNVAKKAEAYLASTGIADTAFFGPEAEFYVFDSVRFATRENESFYHIDSEAGAWNTGALEDNRGYKVRYKGGYFPVPPVDHFADLRAEISLELERSGLQVERQHHEVGTAGQAEINYKFNTLLAAADDLQLFKYIVKNVAWKNGKTATFMPKPIFGDNGSGMHVHQSLWSGGEPLFYDEQGYAGLSDTARYYIGGILKHAPSLLAFTNPTVNSYHRLVPGFEAPVNLVYSQRNRSAAMRIPITGSNPKAKRVEFRAPDASGNPYLAFSALLLAGLDGIKNKIEPAEPIDKDLYELAPEEHANVAQVPTSLGAVLDRLEADHEFLLQGDVFTPDLIETWIDFKRANEIAPLQLRPHPHEFEMYFDV

SEQ ID NO: 63738 - protein, 106 aa, Glycine max
MGRKKGYVEFEESPPDDFDPAHPYKDPVAMLEMREHIVREKWIQIEKAKIIREKLRWCYRIEGVNHLQKCRHLVNQYLESTRGIGWGKDGRHPSLHAPKVEPVESD

SEQ ID NO: 63739 - protein, 124 aa, Bacillus cereus ATCC 14579
MKVVQTSKAPQAIGPYSQGIIVNNMFYSSGQIPLTANGELVTGDVTVQTEQVFQNLQAVLEEAGASFDTVVKTTVFLKDMDDFNAVNEVYSSYFSTHKPARSCVQVAKLPKDVSVEIEVIALVK

SEQ ID NO: 63740 - protein, 406 aa, Magnaporthe grisea 70-15
MAYHHHSRADGTFFVESDDIAMSRMSAREAAKILARNRREVIGNELSRLAGEEYLEDIMQHMRHMEDETLPDASLIDMQREIQWFMRPYLIDFLVEAHAAFQLLPETLFLTVNLLDRYCSKRVVYKQHYQLVGCAALLIAAKYGDKKDRVPQINELNNMCCGLYDAGMFTQMEMHVLNTLDWTVGHPTVDFFAQLIVAEERDDKEVEYMAAYISEISLYYRDFVSTKPSTMARASLALARAILGRQEVNDGEWDHDQNATLVTLSQHVHQPSVTLSRKYASTHYLQVSNKLSDFLAHQAAINRAAALPENPLTPTTNELMAAKANIYSTPQKGLGSVPGVADGYLTPPITPDGQYGAPNPHGLPPRCPVTPTPQHQQQQHQQQQRYYPNCYQPTQQQQTSNHGSYL

SEQ ID NO: 63741 - protein, 385 aa, Arabidopsis thaliana
MLSLFFNFLTSCLWPSSSTTSHTYSDSKGKQDGLLWYKDSAHHLFGDFSMAVVQANNLLEDQSQVESGPLTTLSSSGPYGTFVGVYDGHGGPETSRFVNDHLFHHLKRFAAEQDSMSVDVIRKAYEATEEGFLGVVAKQWAVKPHIAAVGSCCLIGVVCDGKLYVANVGDSRAVLGKVIKATGEVNALQLSAEHNVSIESVRQEMHSLHPDDSHIVVLKHNVWRVKGIIQVSRSIGDVYLKKSEFNKEPLYTKYRLREPMKRPILSWEPSITVHDLQPDDQFLIFASDGLWEQLSNQEAVEIVQNHPRNGIARRLVKAALQEAAKKREMRYSDLNKIERGVRRHFHDDITVVVLFLDTNLLSRASSLKTPSVSIRGGGITLPKKL

SEQ ID NO: 63742 - protein, 228 aa, Brassica napus
  misc_feature (189)..(189): Xaa can be any naturally occurring amino acid
GLSGKGGLFGKGGLIVFDVYSENASYHLGDVLPVLLLGFFGGILGSIYNFLLEKVLRAYNYIYEKGVAWKIILACAISIFTSCLLFGLPFLASCQPCPADALEECPTIGRSGNSKKYQCPPGHYNDLASLIFNTNDDAIKNLFSKNTDFEFHYLSVLVFFITCFFLSILSYGIVAPAGLFVPVIVTGAXSYGRLVGMLLGSKNLNDGLYAVLGACSFLGGSMRMTVSL

SEQ ID NO: 63743 - protein, 478 aa, Rickettsia sibirica 246
MISNFFNLIRIFRIISKKQILIDSRSPKYCRFIGYILALFFAPVSLIKKSREDYGKRLIDCLSDLGPIYIKFGQTLSTRADLVGTEIAGYLRLLQDNLPPFDGGVARRLITSLRGDIYVDEAISASKQKIATQSMTVSHDALPFLHLDDTPIAAASISQVHKAQLITGEYVAVKILRPGIHKKYNRDIKLLYFLAKIISKFSKAKRLKPIKVVDKFHETMKFELDLRLEAAAASELTDNMRNDINVIIPKIYWDLTSENILTTEWLDGTSIYDTLLLKEMGLEPAKISQDFAVMFFNQAYRDGFFHADLHAGNILVNKQGKIILLDFGIMGRLKEKDRLAVAESLFGFLRRDYKLVAKVHLRAGYIPSNTDLALFAQSCRAVTEPIVGTPIKNISIGKLLAHLFKITEDFGMEVQPELLLLQKTLIMVEGIGRQLDGNVNMWQLAEPWIKKWAVKNLSPEAKLLRLVKHDLDSLEDII

SEQ ID NO: 63744 - protein, 460 aa, Aspergillus fumigatus
MKANTLVPLLGLSSSAAAAAVAASGNTPFGYASGSKESIANLKDKIENVVWILLENRSFDNILGGVKRKGLDNVVNNGPFCNPQNVSDPSSTKWCSVYKDFDSVKHDPDHSVTGYNMELYGTYTPSNDAIANGTLKPTMNGFVEQQLVHHKGLDPKVADEEVMGYYSEDEIPTLVNLVDEFTTFNYWHSCVPGPTNPNRLCALSGTSDGHGTNDNSFDVSGVDISSIFQVASEKDITWKNYDGTNGAFLSDALFFNWTAQNAKHNVVPLENFYQDAYLGLLPQLSYINPSCCDLDTNSMHPSGNVSFGQVLVKQIYDAVRTGPQWDKTLLLVTFDETGGFYDHVEPPLAVRPDSKTYTETAADGSSYTFNFDRLGGRMPTWLISPYTPKGHIENYGVDPATGKSASYSATSVLKTLGYLWDLDDFTPRVSHSPAFDHLIGPKKRNTPATLANPHPFPDAV

SEQ ID NO: 63745 - protein, 418 aa, Oryza sativa (japonica cultivar-group)
MAQLLNREEEERLMEKKGAPFQASFSRSCEPYRVLTTPPVLTTRARPHMATVSGTDRLRDLHAFDDTKAGVKGLVDAGVTTVPYFFRHHPDPLPADVDLAKADVDRGRVVAEVRAAAETVGFFQVVNHGVAGELMEEMLAAVRRFHEEPLEAKVPYYTRDVASKVWFNSNFGLFRNGFRSPEANWRDTMFVEMFPEAPSPEEIPPPCRGVLEVYAAAVRRLGERLFELLSEALGLPVGYLGRDAGCMDGLSLSVAAHYYPACPEPEATMGATKHSDPSFLTVLLQDTSGGLQAVLPRPPEERWVDVPPVAGALVVNVGDLLQLVSNDRLRSVEHRVLPTGAAGPARVSVACFFRHAYASTRPCVPVVVGGGGARAAAVYRSTTAGEFLAHYNGKGLDGRSALDHFRLPAAASSPPPPL

SEQ ID NO: 63746 - protein, 655 aa, Pyrococcus furiosus DSM 3638
MNIKSFINRLKELVEIEREAEIEAMRLEMKRLSGVERERLGRAILSLNGKIVGEELGYFLVKYGRNKEIKTEISVGDLVVISKRDPLKSDLLGTVVEKGKRFIVVALEPVPEWALRDVRIDLYANDITFKRWIENLDRVRKAGKKALEFYLGLDEPSQGEEVSFEPFDKSLNPSQRKAIAKALGSEDFFLIHGPFGTGKTRTLVELIRQEVKRGNKVLATAESNVAVDNLVERLAKDGVKIVRVGHPSRVSRHLHETTLAYLITQHELYGELRELRVIGQSLAEKRDTYTKPTPKFRRGLSDAEIIKLAEKGRGARGLSARLIKEMAEWIKLNRQVQKAFEDARKLEERIARDIIREADVVLTTNSSAALDVVDATDYDVAIIDEATQATIPSILIPLNKVDRFILAGDHKQLPPTILSLEAQELSHTLFEGLIEKYPWKSEMLTIQYRMNERIMEFPSREFYDGRIVADESVKNITLADLGIKVNASGIWRDILDPNNVLVFIDTCMLENRFERQRRGSESRENPLEAKIVSKIVEKLLESGVKAEMMGVITPYDDQRDLISLNVPEEVEVKTVDGYQGREKEVIILSFVRSNKAGEIGFLKDLRRLNVSLTRAKRKLIMIGDSSTLSSHETYRRLIEHVREKGLYVVLTKDSI

SEQ ID NO: 63747 - protein, 376 aa, Oryza sativa (japonica cultivar-group)
MATVSGTDRLRDLHAFDDTKAGVKGLVDAGVTTVPYFFRHHPDPLPVAAPSEAASAIPLIDLAKADVDRGRVVAEVRTAAETVGFFQVVNHGVAGELMDEMLAAVRRFNEEPLEAKVPYYTRDVASKVRFNSNFDLFRSPAANWRDTMFVEMFPEVPSPEEIPPPCRGVLEEYAAAVRRLGERLFELLSEALGLPAGYLGRDAGGTDGLSVAAHYYPACPEPEATMGATKHSDPTFLTVLLQDESGGLQAVLPRPPEERWVDVPPVAGALVVNVGDLLQLVSNERLRSVEHRVLPTGAAGPARVSVACFFRLAYSSTRPCVPVVGGGSGARAAAVYRSTTAGEFLAHYNGKGLDGRSALDHFRIPAAAASPPPPPQ

SEQ ID NO: 63748 - protein, 321 aa, Geobacter metallireducens GS-15
MGTGRNGGRAIVATGLGQCCWDTLAVVDSYPSPDSKAEAAVWAEQAGGPTATALVALARLGIPCRFAGVVGDDDAGSRIRQALDSEGVDGAFLVTRRRGASQRAFIMIERGSGRRTIVWRRPTGDPLDPREVPDAFLAGSSLLLLDGLMADASLHAAGRARSLGIPVMVDAGRMRPGMLDITRQCDYVVAAEQFFLDLGWDRTPEHFRGLAADLGAPVVTVTLGAAGSLTWSGHEPFHVPAFTVDAVDTTGAGDVFHGGYGYGILQGWSVRETVVFASAMAAMKCRQVGAQQGIPRLPDVLEFLTRRTITVLSNPQTEVSP

SEQ ID NO: 63749 - protein, 357 aa, Zea mays
MADMQNYAAPPLLTHATAKRKRVALNQLPTLPNAVLGAHDEGGGGDDKPVKKQHLLPAAKPEPNAAPAPAAAASDDEEDPQLRKPYASDIYSYLRSTESQATRRPATDYIAAVQVDVTPNTRAILVDWLVEVSEEYKLVSDTLYLTVSYIDRFLSAKVLNRQKLQLLGVSAMLIASKHEEISPLNVEDFCYITDNTYTKQEVVKMESDILNVLKFEMGNPTPKTFLRMFTRFSKEDTKKYRSLQLEFLGSYLCELSLLDYSLLRFLPSLVAASVLFVARLTLDPHTHPWSKKMQTLTGYKPSELKDCVAAIHHLQLNRKYSSMMATRDKFKERRFKGVSALLPPVEIPAPYFEKLKE

SEQ ID NO: 63750 - protein, 1005 aa, Actinosynnema pretiosum subsp. auranticum
MVATGTRIPGPKPLPLVGNLLDVLTSDLDTDVDFLDRCHREHGGIVALTFAGQRQVFASSHELVARMCSDPSWGKAVHPALEQVRDFAGDGLFTARGDEPNWGKAHRLLMPAFGPTAMRDHFPAMLDIAEQMLVRWRRFGPDHRIDVADDMTRLTLDTIALCAFGARFNSFYRDRAHPFVDAMVRSLVEAGERAERLPGVQPFLVGRNQRYRDDIATMNRIADGIVAARAALPAGERPDDLLERMLTCADPVTGERLSARNVRYQLATFLIAGHETTSGLLSFAVHRLLAHPEVLRKAKDAVDGVLGDRVPAFEDLARLDYLGQVLRETLRLHPTAPAFALAPDEPAELGGHAIGAGEPVLVMLPTLHRDPAVWRDPDVFDPERFAPERMDEIPACAWMPFGHGARACIGRPFALQEATLVLALVLQRFDLALADPDHRLTIKQTLTLKPDSLVVRARPRADRPGATATVETVVPHQVPATHRHGTPLHVFYGSNGGSGEGLARTIAGDGAARGWATSVAPLDDAVRALPASGPVVIVSSSYNGAPPDNAAHFVRWLTQDGPDLSGVDYLVLGCGNLDWSATYQRVPTLIDEAMAAAGARRLRERGATDARADFFGDWERWYEPLWPLLSAECGVEVGEIGPRFRVVESDAADGLGDLASAVVLENRELVRGPDAGSKRHLELRLPDGTSYRTGDYLSVLPQNHPDLVRRAVARLGTRAERVVTVESSAPTGLVPVGRALRVDELLTRCVDLSAPAGAGVVARLAERCPCPPERAELAATTGATLLELLERFPSCAVDLALALELLPAPRTRLYSISSAAEEQRAEVALTVSVTGVTSGYLSRVRPGDRVAVGIASPPESFRPPADNTVPVVLIAAGTGIAPFRGFLRARAALGGEPGPALLLFGCRGPELDDLYAEEFAALGDWLEVDRAYSRHPDGEVRHVQHRLWQRRDRVRELVDAGARVYLCGDATRVGPAVEEVLGRIGPGAGWLDALRAGGRYATDVF

SEQ ID NO: 63751 - protein, 461 aa, Arabidopsis thaliana
MASSSSQRRCVFVGNIPYDATEEQLREICGEVGPVVSFRLVTDRETGKPKGYGFCEYKDEETALSARRNLQSYEINGRQLRVDFAENDKGTDKTRDQSQGGPGLPSTTTVTESQKQIGGPVDSNMHQPVGLHLATTAASVIAGALGGPQVGSQFTQSNLQVPASDPLALHLAKMSRSQLTEIISSIKLMATQNKEHARQLLVSRPQLLKAVFLAQVMLGIVSPQVLQSPNIVQAPSHMTGSSIQDAQLSGQNLLPPLAQRSQQLSRAPHSQYPVQQSSKQPFSQIPQLVAQPGPSSVNPPPRSQVKVENAPFQRQQVVPASTNIGYSSQNSVPNNAIQPSQVPHQALPNSVMQQGGQTVSLNFGKRINEGPPHQSMNRPSKMMKVEDRRTTSLPGGHVSNSMLPNQAQAPQTHISPDVQSTLLQQVMNLTPEQLRLLTPEQQQEVLKLQQALKQDHMMQPS

SEQ ID NO: 63752 - protein, 337 aa, Pseudomonas fluorescens PfO-1
MNTFSKVLTGTLLALSIHSAFAGEVEHNTQAFLDVLNAGTGKPMEQLTPKEARAVLTGAQSGVKLTLPKADVSEKTIQVDGQPLSLTIVRPAGVKGELPVFMFFHGGGWVLGDFPTHERLVRDLVVGSGAAAVFVNYTPSPEAHYPVAINQAYAATKWVAEHGKEINVDGKRLAVAGNSVGGNMAAVVALMAKDKGTPAIKFQVLLWPVTDANFDTGSYNQYAEGHFLTRNMMKWFWDNYTTDANQRNEIYASPLRATTAQLKGLPPALVQTAGADVLRDEGEAYARKLDEAGVPVTSVRYNGMIHDYGLLNVVSQVPAVRSAMLQASEELKQHLKK

SEQ ID NO: 63753 - protein, 510 aa, Gossypium hirsutum
MPSFDTILLRDLVAAACLFFITRYFIRRLLSNPKRTLPPGPKGWPIVGALPLLGSMPHVELAKLAKKYGPVMYLKMGTCNMVVASTPDAARAFLKTLDLNFSNRPSNAGATHIAYNSQDMVFAEYGPRWKLLRKLSNLHMLGGKALEDWSQVRAVELGHMLRAMCESSRKGEPVVVPEMLTYAMANMIGQVILSRRVFVTKGSESNEFKDMVVELMTSAGLFNIGDFIPSIAWMDLQGIEGEMKKLHNRWDVLLTKMMKEHEETAYERKGKPDFLDIIMDNRENSAGERLSLTNVKALLLNLFTAGTDTSSSIIEWALAEILKNPKILNKAHEEMDKVIGRNRRLEESDIPKLPYLQAICKETFRKHPSTPLNLPRVSTQACEINGYYIPKNTRLSVNIWAIGRDPDVWGNPLDFTPERFLSGRFAKIDPRGNDFELIPFGAGRRICAGTRMGIVLVEYILGTLLHSFDWMLPPGTGELNMDEAFGLALQKAVPLSAMVRPRLAPTAYVS

SEQ ID NO: 63754 - protein, 522 aa, Uromyces viciae-fabae
MPAVMAGPVSFAPPEGKSSKVAIVIAVFAAFGGFLYGYDTGYIAGVKAMPFWLRSAGQRGPDGKYMITTSQDSMVTSILSVGTFVGALLAYPIGDRFGRRIGIMIACAIFSVGVALQTASTKIPMFVVGRVFAGLGVGVASCLVPMYQSECAPKWIRGGIVACYQWAITIGLLVASITVNATKDFDSANSYRIPIGIQFIWAAILTIGLLVLPESPRYLLLKGREDEAWKSLSRLYSAPYDDPDVQAEFSEIMASLEKERSFGKTTLLDCFKTDKRKNLQRTLTGLGVQGWQQASGINFFFYYGTTFFKNAGIENAFLVTVATNVVNVVMTIPGIWAVDKVGRRTMMICGAAMMFTCELILACVGTFTATSNLASQKVLVAFSCIFIGLFAATWGPIPWVVTSEIYPLATRGKQMAMSTASNWAVNFFIGFITPYLVDSGAGQAGLGVKVFWLWAALCFGAMVFSFLLIPETKGLSLEQVDLLYTNSTVLKSNTYRSQLIANNLHEGMTPAEKAYQEKLEHI

SEQ ID NO: 63755 - protein, 989 aa, Oryza sativa (indica cultivar-group)
MHHTRAGAADGAGGGGEDIVEAGAEAPPPQRERLVPHSGPLSKRSGMRKSARFAESVSAPLSAPSGVAAARRAAAAANDDDEEDYVEITLDVRDDSVAVHSVKPAGGGGEDSDVTLLARTLEKRSSSFGHSVIRNASSRIKQVSQELRRLASVNRRGGGGGAGGPRFDRSKSAAAHALKGLKFISRADGGAGWPAVEKRFDDLAKDGLLPRSKFGSASVPSRTPSPSSSSSSSHQLINHSLWLASGMKELEFAGELFDALARRRNISGDSISKAELLEFWDQISDTTLRQPSPNLLRHIITLSASANKLSKVQEQSEEYARLIMEELDPSNLGYIELYNLEMLLLQAPSQSVRIGTTNSRNLSQMLSQNLRPTAEPNPLRRWWRRASYFLEDNWRRVWVLLLWLAICAGLFTYKFIQYRHRAVFHVMGYCVCVAKGGAETLKFNMALILLPVCRNTVTWIRNRAAVARVVPFDDNLNFHKVIAVGITVGAGLHVISHLTCDFPRLLHATDAEYEPMKRFFGDTRPPNYWWFVKGTEGWTGLVMLVLMAVAFTLATPWFRRGRLRLPRPLNRLTGFNAFWYSHHCFVIVYALLIVHGYYLFLTKDWYKKTTWMYLAVPMFLYACERLTRALRSSVRPVKILKVAVYPGNVLSLHFSKPQGFKYKSGQYIFVNCAAVSPFQWHPFSITSAPQDDYVSVHIRTLGDWTRELKNVFSRVCRPPTEGKSGLLRAEYDRDGAMTNPSFPKVLIDGPYGAPAQDYKQYDIVLLVGLGIGATPMISIIKDIINNMRQLDGDLEDGDGNDNSVSSAAAAFKTRRAYFYWVTREQGSFEWFRGVMDEVAETDKKGVIELHNYCTSVYEEGDARSALIAMLQSLNHAKHGVDVVSGTRVKTHFARPNWRNVYKRIALNHRDQRVVASGDLADGDKHDQSFEVECSIGSSDGLGAAVIKVEQEPAGVFYCGAPVLTKELRELAQDFSRKTSTKFDFHKENF

SEQ ID NO: 63756 - protein, 305 aa, Glycine max
MAATSTSLFFSNLHSLNPQPFSSSLSFFRNVHSTLSFPSSSKPSRGVVAMAGSGKFFVGGNWKCNGTKDSISKLVSDLNSATLEPDVDVVVAPPFVYIDQVKNSITDRIEISAQNSWVGKGGAFTGEISVEQLKDLGCKWVILGHSERRHVIGENDEFIGKKTAYALSEGLGVIACIGELLQEREAGQTFDICFQQLKAFADAVPSWDNIVIAYEPVWAIGTGKVATPEQAQEVHAAVRDWLKKNVSAKVASKTRIIYGGSVNASNSAELAKQEDIDGFLVGGASLKGPEFATIINSVTSKKVAA

SEQ ID NO: 63757 - protein, 341 aa, Solanum chacoense
MAELLSNWSSTLEAVPPSHCIPVHERPSDPVEIVDSIPVIDLGKANGEERSAVVKDLLKAFEEYGFFQIINHGVPVDLMDEAMKVYKEFFSLPAEEKAEYAKDAANDTNRGAATLYSSSAKHYDSEEHRYWRDVLEHSCNLDGKDKKTWPSNPPRYREVIGAYGDELRRVSKVILGLLAEGLGLEAGFFDKELGQRMLVNHYPACPDPSLTLGVGGHCDPNLITIIQQEVYGLQILKDDKWIGVQPIRNAFVVNSGLPITVVSNGKLTSVAHRVVTNTTHSRTSIGTFICPHDIVEPAKALVGPENPPQFKSFNWGIDFMPHYLSKKSVYHASLEPFKIDA

SEQ ID NO: 63758 - protein, 216 aa, Arabis pumila
MSSFSAFSEMFGSDYESMISSVGDYSPTLATSCPKKPAGRKKFRETRHPVYRGVRQRNSGKWVSELREPNKKTRIWLGTFQTAEMAARAHDVAAIALRGRSACLNFADSVWRLRIPESACAKDIQKAAAEAALAFQNELMSDTATTDHGLDMEETLVEAIVTAEQIDTFYIDEETMFGMPSLMANMAEGMLLPLPSIQWINNYDVEGDADMPLWSY

SEQ ID NO: 63759 - protein, 345 aa, Streptomyces avermitilis MA-4680
MTNTATTPSYQRYQQLPIIDLSAADRGPQARALLHAQLHSAAHDVGFFQLVGHGVTQAETDELLRAMHAFFALPEADRLAIDNVNSPHFRGYTRTGDERTGGSRDWRDQLDIGAERPVRTPGPGEPAYWWLEGPNQWPAALPELRTAALAWIDKLSAVAQRLLHELLTAIGAPAGFYDPVFGEHAHPHLKLVRYPGSAGDGADQGVGAHKDYGFLTLLLQDQVGGLQVQREDGLFHEVPPLPGAFVVNLGELLEVATNGYLLATNHRVVSPPGATERFSVPFFYNPRLDARVEPLPFPHASTAPGVTDDPANPLFAEYGLNELKGKLRAHPLVAARHHAELLTPA

SEQ ID NO: 63760 - protein, 542 aa, Saccharophagus degradans 2-40
MPGFCFPPIFLQSENTMPNTDIHSQRILILDFGSQYTQLIARRVREVGVYSEIRAWDVSDEEIKEFAPKGIILAGGPESVTAGFSPRAPQLVFELGIPVLGICYGMQTMAEQLGGKVESSNVQEFGYAQVKIENECALIKDIKDHVDDGGAALLDVWMSHGDKVVAMPEQFTLMASTPSCPIAGMAWEEKKFYGVQFHPEVTHTLQGKRIFEHFALELCGCEALWTAANIVEDAIGRVRAQVGDDKVLLGLSGGVDSSVVAALLHKAIGDKLTCVFVDNGLLRKNEGDQVMDMFAKNMGVKVIRADAADLFLGNLAGESDPEKKRKIIGNTFIDIFDQEASKLKDVKWLAQGTIYPDVIESAASKTGKAHVIKSHHNVGGLPEDMQFELVEPLRELFKDEVRKIGLELGLPYDMVYRHPFPGPGLGVRILGEVKKEYAEILREADAIFLEELHAAGWYHKTSQAFAVFVPVKSVGVVGDARRYAWVIALRAVETIDFMTARWAHLPYELLEKVSNRIINEISGVSRVTYDVSSKPPATIEWE

SEQ ID NO: 63761 - protein, 524 aa, Streptomyces avermitilis MA-4680
MFRSEYADVPPVELPIHEAVLGRAAEFGEAPALVDAVDGTTLTYEQLDRFHRRIAAALAEAGVRKGDVLALHSPNTIAFPTAFYAATRAGASVTTVHPLATAEEFAKQLSDCSARWIVTVSPLLDTARRAAELAGGVREIFVCDSAPGHRSLIDMLATAAPEPRVDIDPAEDVAALPYSSGTTGTPKGVMLTHRSIATNLAQLEPAVPTGPGERILAVLPFFHIYGLTALMNAPLRLGATVVVLPRFDLDTFLAAIEKHRITHLYVAPPIVLALAKHPAVAQYDLSSLKYVISAAAPLDADTAAACSRRLGVPPVGQAYGMTELSPGTHVVPLNAVNPPPGTVGKLVAGTEMRILSLDDPDQDLPVGEAGEIAIRGPQVMKGYLGRPEATAAMIDEDGWLHTGDVGRVDADGWLFVVDRVKELIKYKGFQVAPAELEALLLTHPKIADAAVIGVYNDDNNEVPHAHVVRQPSAADLSAGEVMMYVAERVAPYKRIRHVTFLDEVPRAASGKILRRQLRDLREHS

SEQ ID NO: 63762 - protein, 728 aa, Halobacterium sp. NRC-1
MKTLERDLGLGAVFAISVGAMIGSGIFILPALALKMAGPAVIVAYLLAGLLVVPAALSKSEMATAMPEAGGTYIYIERGMGPLLGTVAGVGTWFSLSFKSALALVGGVPYLVLLFDLPVQPVALGLAALLIVVNLLGAKQTGRLQTVIVSLMLGALGWFVAGSAGQVQQANFQGFLTGGWEGLLAATGLVFVSYAGVTKVASVAEEVENPDRNLPLGILGSLAFTTLLYVGIVAVMVGVTDSGAVAGSATPVAVAADATLGTAGVYAVIAAAVLALVSTANAGILSSSRYPFAMSRDQLAPPTFAEIHDRFGTPTTAITLTGAVVLALIAFVPILDIAKLASAFQILVFVLVNLALVAFRTGTTDYDPDFESPLYPWMQGFGVLSGLALLTQMGWVPIAGAAVITLGSVVWYRVYARPRVRREGAATDVVRRRLGRDVLTETEALVDATGAEAGGPEVLVALTREASADRERALLSLAADRARNEDGQVVVVRFDEVPDQAPLDHAADVQSPADVRFEERTEGLSTEFDVDIAYGEVVSHDTKRAILNVAEQRSVDTVVAEHERLRLRSRLLGDPIDWVVRHAPCDVLLVENRGYDAPQNVVLEGDGGPYDPATVAVADAVAGAAGGTVTLQFPLSADHPDKRQETVHAYQDELAGLLSAPVRTADLRADGGDQTAPDLVVRTGAHRRVRGGRGSHTQTAADCTELTVYPHESRQPGLLRRLAERLVF

SEQ ID NO: 63763 - protein, 664 aa, Shewanella sp. MR-4
MSSRKVLANAIRALSMDAVQKANSGHPGAPMGMADIAEVLWNDFLKHNPNNPKWVDRDRFILSNGHGSMLIYSLLHLTGYDLPIDELKQFRQLHSKTPGHPEYGYTPGVETTTGPLGAGISNAVGMAIAEKTLAAQFNREGHEIVDHYTYCFLGDGCLMEGISHEACSLAGTLGLGKLIAFWDDNGISIDGHVEGWFTDDTPKRFESYGWHVIANVDGHDSDAIRAAIEAAKAVTDKPTMICCKTIIGFGSPNKSGSHDCHGAPLGDAEIAAAREFLGWSHAPFEIPADVYAGWDAKEAGNAREAAWNDKFAAYAKAYPELAAEYERRVLKGELPADFEAKAQAFIQECQAKGEGIASRKASQNAIAAFGAVLPELLGGSADLAGSNLTLWAGSKGIQEDPAGNYVYYGVREFGMSGIMNGVSLHGGFINYGATFMMFMEYARNAVRMSALMGIQNIFVYTHDSIGQGEDGPTHQPVEQLANLRMTPNMAVWRPCDAAETAVAWKAAIERRHAPTSLVFSRQNLKAQVRTAEQLANVAKGAYVLQDCAGTPEYILIATGSEVQLAVEAAAALTEQGKQVRVVSMPSNTEFDKQDAAYKESVLPKAVTKRIAIEAAHTDFWYKYVGFEGTVVGMTTFGESAPGNVLLKHFGFTVENVLNAAKSLG

SEQ ID NO: 63764 - protein, 821 aa, Pseudomonas putida GB-1
MASLAPTYGRGAMTNHWSDIANANLVLVMGGNAAEAHPCGFKWVTEAKAHNKARLIVVDPRFTRTASVADYYAPIRTGTDIAFMGGLINYLLSTDKIQHEYVRNYTDVSFIVKENYGFEDGLFSGYDEAKRVYADKSGWGYELGEDSYAKVDPTLQHPRCVFQLMKQHYSRYTPELASMTCGMPQDAMMKVWEEIATCSAPGKTMTILYALGWTQHSIGAQIIRSAAMVQLLLGNVGMPGGGVNALRGHSNIQGLTDLGLLSNSLPGYLTLAGDAEQDYATYIDKRASKPLRPGQLSYWQNYGKFHVSLMKAWYGANATAENNWGYDWLPKLDVPAYDVLRMFEMMGQGKVNGYMCQGFNPIAALPDKNRVTAALGKLKWLVIMDPLATETSEFWRNAGPFNDVDTANIQTEVIRLPTTCFAEEDGSLVNSSRWLQWHWKGADGPGETRTDVQIMSELFLRLRQRYQAEGGAYPDAMMNISWPYKIPDEPSPEELAKEMNGWAVTDLTDTTGATLKAGQQLSGFAQMKDDGSTASGCWIFAGCWTEQGNQMARRDNSDPYGMHQVQNWAWAWPANRRILYNRASSDPQGKPWDPEKKRLVWWNGKAWTGTDVPDFKVDSPPEAGMNPFIMNPEGVARFFAIDKMAEGPFPEHYEPFETPIGINPLHPQNKKATSNPAGRIFDSVWDTLGTHDEFPYAATTYRLTEHFHFWSKHCRLNAIAQPEQFVEIGEVLANEKGIKAGDRVRVSSKRGHIDAVAVVTKRIRPLQVNNQTVHQIGIPLHWGFTGATRHGYLTNTLVPFLGDGNTQTPESKSFLVKVEKL

SEQ ID NO: 63765 - protein, 391 aa, Shewanella sp. MR-4
MAIINMSDLDLQGKRVLIREDLNVPVSNGVVTSDARLRASLPTIELALAKGAAVMVMSHLGRPTEGEYNSEFSMQPVVDYLAKALSCTVRLATDYLDGVEVAVGEVVVFENVRFNKGEKKNDEALSKKMAALCDVYVMDAFGTAHRAEASTNGVGLHAPIACAGPLLAQELEALGKALDNPARPLVAIVGGSKVSTKLTVLESLSGIVDQLVVGGGIANTFIAAAGHNVGKSLYEADLIDEAKRLVANAQSRGGDIPVPTDVVVAGEFSPTAAATLKAVNEVADSDMIFDIGPDSAEALAKIIESAGTIVWNGPVGVFEFDQFGEGTKRIAQAIADSKAFSIAGGGDTLAAVDKYDIADKVSYISTGGGAFLEFLEGKELPAVAMLKQRGA

SEQ ID NO: 63766 - protein, 481 aa, Burkholderia xenovorans LB400
MAIPSYTDTRLLINGEWCDAASGKTLDVINPATGQAIGKVAHAGIADLDRALAAAQRGFEAWRKVPANERATTMRRAAALVRERASDIGRLMTQEQGKPFAEARIEVLAAADIIEWFADEGRRVYGRIVPSRNLAAQQLVLKEPIGPVAAFTPWNFPVNQVVRKLSAALACGCSFLVKAPEETPASPAALLQAFVEAGVPAGTVGLVFGDPAEISGYLIPHPVIRKVTFTGSTPVGKQLAALAGAHMKRATMELGGHAPVIVAEDADVALAVKAAGGAKFRNAGQVCISPTRFLVHNSIREEFAAALVKHAEGLKLGDGLAEGTTLGPLANARRLSAMSKVLDDARKTGAKVETGGERVGSEGNFFAPTVLTNVSLEADVFNNEPFGPIAAIRGFDKLEEAIAEANRLPYGLAGYAFTKSFSNVHLLSQQVEVGMLWINQPATPSPEMPFGGVKDSGYGSEGGPEAMEGYLVTKAVSVMAV

SEQ ID NO: 63767 - protein, 267 aa, Mycobacterium avium subsp. paratuberculosis K-10
MSLPKPDIATTVVITGASSGIGAELARGLARRGFPLLLVARRRERLDDLANEVGGQYSVGVEVLPLDLGDSKARARLAGRLRSESIAGLCNSAGFGTSGVFHELPMERESEEVTLNALALMELTHATLPGMVSRGAGAVLNIASIAGFQPVPYMAVYSATKAFVQTFSEAVHEELHGSGVSVTCLCPGPVPTEWAEIANAERFSIPIAQVSPRDVAEAAIGGMLTGRRTVVPGVVPKVVSTGGRFAPRSLLLPGIRIGNRFRGGPKR

SEQ ID NO: 63768 - protein, 512 aa, Oryza sativa (indica cultivar-group)
MAFFRGLTAVSRIRSRMAQEATTLGGVRWLQMQSPSDLAAMAFFRGLTAVSRIRSRMAQEATTLGGVRWLQMQSPSDLDLKSQLQELIPEQQDRLKKLKSEHGKVQLGNITVDMVLGGMRGMIGMLWETSLLDPEEGIRFRGLSIPECQKVLPTAIKGGEPLPEGLLWLLLTGKVPTKEQVDALSKELVTRSSVPGHVYKAIDALPVTAHPMTQFTTGVMALQVESEFQKAYDKGMPKSKFWEPTYEDCLNLIARLPPVASYVYRRIFKDGKTIAADNALDYAANFSHMLGFDDPKMLELMRLYVTIHTDHEGGNVSAHTGHLVGSALSDPYLSFAAALNGLAGPLHGLANQEVLLWIKSVIGETGSDVTTDQLKEYVWKTLKSGKVVPGFGHGVLRKTDPRYTCQREFALKYLPEDPLFQLVSKLYEVVPPILTELGKVKNPWPNVDAHSGVLLNHFGLSEARYYTVLFGVSRSIGIGSQLIWDRALGLPLERPKSVTMEWLENHCKKAAA

SEQ ID NO: 63769 - protein, 903 aa, Yarrowia lipolytica CLIB122
MKKFTEFVPEGWVPTFHNEPPKNTEKDEVDRFLAEAVEPDLLDIIGNKLNAAVDQDKGYDKNVRYIAQRVGEMTDEEARSILKAFYTVHFDDGNLSSEYKDHITELAKGYPGMGGDPPGPRDPEIPYDDDKDEAPEDYSLEVRFQASLVKYWSPYVEVRAVTDAYDDPNEPCETIRSYFVGFIWMVIGAGVNQFFAFRFPSISLPSNILQLLSYPSGKLLEFILPDWGFTFRGHRISLNPGPWSRKEQMFATFFISGGGTPYITTANIPVQLLPMFYHETWATFGYQTILTLSNQLIGMGLTGMLRRFAIYPAKAMWPMSMPTIALNRALLQPKRKERINGWTISAYLFFFASFCFMFIYFWFPNYIFQALSTFNWMTWIAPNNKNLAFITGSQNMGINPFPTFDWNVITGGAGDPLVVPWSTLLNVYFGVWIGTFAIIGVFFNNVRNTAYLAMNQPGIYDNTGSSYNVSLILNSAGRFVEEKYQAYSPPFWTAGSLVSYGAFFTVYTLGISYCLLQYRRDIWSAMKDLARGVQFWRKDEFRNTHHDNTFVRSMNNYKDAPEWWFIALLLVSFGLAVATVEHWPTNTPVWGIVFVLGLNYVFLIPITMISAYTGSTWSMNVLVEIIIGVALKGRPQALNILKAYGVMIDSEASGMASVWKIGLYTYVPSRAVFRSQIISAVLASFTCLGVLQYQLHLQGICTPAQRFTTKFTCPGLQQFFSASVLFGAIGTERFMTHLYPFLKWCFLLGAALGPFFWFIQTGGPEMLAKWKPQYARKCVQWSRRANLFNPVNACVGIISFAPGNLCYFTGAIYVGALWRFWVRRRYIKWWAKYTYVLSAGFGCGIALSGIIMFFALSYRTGTTKAPEIDWWGNNAPATGFDGQAGPRLDIPAVGYFGPPAPFP

SEQ ID NO: 63770 - protein, 467 aa, Listeria monocytogenes str. 4b F2365
MLYSEDDKRKQESYRIPLFGSEEESTSIPKYVLKKEPMEPRIAYQLVKDQLMDEGNARQNLATFCQTYMEKEAEILMAETLEKNAIDKSEYPQTAELENRCVNILADLWNAPKDMSYLGTSTVGSSEACMLGGLAMKFRWRNHAEKRGLDIQAKRPNLIISSGYQVCWEKFCVYWDVDMRVVPMDKEHLSIDVDKVFDLVDEYTIGIVGILGITYTGKFDDIQLLDEKVEAYNEANEHQLVIHVDGASGAMFTPFVNPELPWDFRLKNVVSINTSGHKYGLVYPGVGWILWKDKEYLPKELIFEVSYLGGSMPTMAINFSRSASQIIGQYYNFLRYGFEGYREIHEKTKKTALYLAKSVEKSGYFEIINDGANLPIVCYKMKEGLDVEWTLYDLADQLLMKGWQVPAYPLPADLSDTIIQRFVCRADLGYNVAEEFAVDFADALHNLEHARVLYHDKERNDSYGFTH

SEQ ID NO: 63771 - protein, 1798 aa, Streptomyces coelicolor A3(2)
MPATRRTARVRRVAAVTVTALAAALLPPLAARADTPPAPPSDAKLAKTAARHDLTREQFYFVLPDRFANGDAGNDRGGLTGTRLTTGYDPTDKGFYQGGDLKGLTERLDYIKGLGTTSIWMAPIFKNQPVQGTGKDASAGYHGYWITDFTQVDPHFGTNKDLKNLISKAHAKGMKVFFDVITNHTADVVDYEEKSYDYLSKGAFPYLTKDGQPFDDADYADGERRFPRVDSGSFPRTPTVPAAKKNLKVPSWLNDPAMYHNRGDSTWAGESATYGDFNGLDDLWTERPEVVGGMEKIYQRWVEDFAIDGFRIDTVKHVDMEFWTQWATALDAYAAKKGRDDFFMFGEVYSADTSVTAPYVTQGRLDSTLDFPFQDAARAYASQGGSARKLAAVFGDDYKYTTDKANAYEQVTFLGNHDMGRIGTFLKQDAPEAGDAELLKKDRLANELMFLSRGNPVIYYGDEQGFTGAGGDKDARQPMFASRTADYLDDDQLGTDRTHAEAAYDTSAPLYRQISALAELRKANPALADGVQTERYAADGAGIYAFSRTDAKTGTEYVVAFNNAGTEKSAAFATGSAGMTFRGLYGTDATVKSGADSKVTVTVPARSAVVLKAAGRLAAPAAEPTISLHAPDPGATGTVELSADVAGGQLNRVVFAAQTGDGKWRTLGTADHAPYKVTHTVDADTPAGTALRYKAVVVDSAGRTASATAASTTGTPPAEEVPTAASRDYAVVHYKRADGNYDDWGLYAWGDLADGEATTWPGTHPFTGRDAYGAFAYVKLKPGASTVGFLVIDKDGNKDVAADRTIDVTETGEVWIEQGEEQLVTERPEYPAQDTTKAVLHYKRADGNYDGWGLHVWGDAANPTDWAKPLQPVRTDPYGAVFEVPLTDGASSLSYIVHKGDEKDLPTDQALDLKADGHEVWLLSGQEDHLLPQPAGSAAAVDLTTSKAVWIDRNTVAWNGSDGAASTQLLASRTGSITAEGGRLTGDDQQWLRLTKSALTDAQKAKFPHLKESTAWSVDPRDRDRVREALRGQVVAAQRTATGALLAATGVQTAGALDDLYADRATRADLGPVFRHGRPTLSVWAPTAQDVKLEIGDRTVRMRRDDATGVWSVTGPKSWKGKAYRYAVKVWAPTAGEVVTNKVTDPYSLALTTDSERSLVVDLDDRSLAPRGWEHYRKPEAVPLQDAQIQELHIRDFSVADRTADADHRGTYLAFTDKKSDGSRHLRELAEAGTSYVHLLPAFDIATIPERKSEQTTPDCDLAALPAGSEKQQECVTKAAAKDAFNWGYDPYHYTVPEGSYATDPDGTERTVEFRKMVKALNEDGLRVVMDVVYNHTAASGQAKTSVLDRIVPGYYQRLLADGSVANSTCCSNTATENAMMGKLVVDSVVTWAKEYKVDGFRFDLMGHHPKANILAVRKALDELTLRKDGVDGKKIVLYGEGWNFGEVADDARFVQATQKNMAGTGIATFSDRARDAVRGGGPFDEDPGVQGFASGLYTDPNSSTANGTEAEQKARLLHYQDLIKVGLTGNLADYSFTDTHGKEVKGSEVDYNGAPAGYAAAPGDALAYADAHDNESLFDALTFKLPKDTSADDRARMQVLAMATATLSQGPALSQAGTDLLRSKSLDRNSYDSGDWFNALHWNCADGNGFGRGLPPAADNQDKWPYAKPLLGAVEVGCPQITGASAAYRDLLRIRSGEQDFSLATAARVQSRLSFPLSGEDETPGVITMRLGDLVVVFNATPERQEQRVGAAAGTGYRLHPVQAAGADAVVKESAYAAKTGTFTVPARTVAVFQRAG

SEQ ID NO: 63772 - protein, 178 aa, Triticum aestivum
MAPDVMASSDTTVAPFQGLKSTDGLPVSRRSSGSLGYVSNGGRIRCMQVWPIEGIKKFETLSYLPPLSTEALLKQVDYLIRSKWVPCLEFNKVGFVFRDHNSSPGYYDGRYWTMCKLPMFGCTDATQVLNEVEEVKKEYPDAYVRVIGFDNLHQVQCVSFIAFRPPGCEESGKAYTTS

SEQ ID NO: 63773 - protein, 277 aa, Triticum aestivum
MADALDMSLDDLISKNKSSSQRGRGRRNPASGSGSGSASGGPAPAGRRFQARAATRAAAAPYHQFNFPPPAPAAFAYAAQQAHAHAHAQVMAMVAPPTGVETGTKLYISNLDYNVSNEDIKELFAEVGDLKRYSINYDKSGRSKGTAEVIFSRKSDALAALKRYNNVQLDGKPMKIEVIGTNIEAPPPPPAIFTLNTPTIGNFIPSYSGGRGRGGDGGRGWPRGRGGFGGRSAAGRGRGRGDVGRGRGRGGRGSQPVSANDLDADLDKYHSEAMQTS

SEQ ID NO: 63774 - protein, 573 aa, Streptomyces avermitilis MA-4680
MTTDRNKTAERDTTHKPLRVTARGRAVLADPRLNRGTAFTDEERRALGLVGLVPPRVLTQDEQADRAYAQFREQPGDLAKNVYLTALHDRNEVLFYRLVGDHLEEMLPIVYTPTVGTAIKRYSYEYRRPRGIYLSVNAPDDIERSLRAAGLGADDVDLIVATDGEGILGIGDWGVGGIDIAVGKLAVYTAAAGVDPRRTLPVMLDVGTNRQELLDSPLYLGNRHPRVDRDTYDAFIDAYVTAATKLFPRALLHWEDFGPANARRIFNHYRDDVFTFNDDIQGTGAVNLAAVLSGAKAGDLPLRDHRIVVLGAGSAGIGVADQLRDALVAEGLSSDEATARFWCVDRYGLLTADQGDKLRDFQVPYARPADEVSDWQRDDDLPGIPLDEVVRRVHPTILIGTSGQGGAFTETVVREMAAHTPRPIILPMSNPTDLAEAKPADLLAWTDGKALVATGSPFDPVELNGTTYRIGQANNALIFPGLGLGAIVARATRVTDRMLRAAADAVANQTDVTDPGAPVLPPVRDLRETSFAVAVAVARAAAEDDVARAGTDDIEAAVRAVTWEPVYPPVQAV

SEQ ID NO: 63775 - protein, 281 aa, Saccharophagus degradans 2-40
MHQDFTVTEKNGIQFISIQNDNCKAEVCLFGGHITEWQPEGHAPVLWMSETSALDGSAAIRGGIPVCWPWFGPVENKGRHGLVRTMNWTLEDAKEESDLTVLKLSCDIGKDKALAWSHPQIIEQTLIFGSRLTQTCKVVNPFNAPVNFAYALHNYFQIGSLNHLSVPELTGQPYYCKINDLENQCDTTEPDYNGPIDRVYQCDGPASITDSIMQRRISVTKHGSANWVLWNPGTLAADIDDIHTDGEKSYLCLEAASTSDIEVAANSSMEFGQTIAVTALD

SEQ ID NO: 63776 - protein, 269 aa, Pyrococcus furiosus DSM 3638
MPLYFIGLGLYDEKDITLKGLEIAKRCDKVYAEFYTSLMAGTTLEKIEEVIGKKIIVLNREDVEMNFEKIVLPEAKEKEVAFLTAGDPMVATTHAELRIRAKRMGVESYVIHAPSIYSAVAITGLHIYKFGKSATVAYPEGNWFPTSYYDVVKENLERGLHTLLFLDIKAEKGKYMTANEAMELLLKVEEMRGENVFTPNTLVVVLGRAGSLNPTIRAGYVKDMIKEDFGKQPHVLIVPGKLHVVEAEYLVEIAGAPKEILEQFAPRKM

SEQ ID NO: 63777 - protein, 196 aa, Pseudomonas putida GB-1
MDLNRRQFFKVAAVGLGGSSLAALGMAPTPAFAEQVRHFKLAHTKEARNTCPYCSVGCGLILYSQGDAGKNVKQNIIHIEGDADHPVNRGTLCPKGAGLLDFIHSPSRLQYPEVRKPGSREWVRVSWDEALDRVADLMKQDRDANFIERNAQGQTVNRWLTTGFLAASAASSEAGYLTHKVVRATGMLGFDNQARV

SEQ ID NO: 63778 - protein, 256 aa, Triticum aestivum
MAPRKFFVGGNWKCNGTGDDVKKIVTFLNEAEVPSEDAVEVVVSPPFVFLQQAKGLLRPDFAVAAQNCWVRKGGAFTGEISAEMLVNLQVPWVILGHSERRALLNESNDFVADKVAYALAQGLKVIACIGETLEQREAGTTMEVVSAQTKAIAEKTSDWTNVVLAYEPVWAIGTGKVASPAQAQEVHDGLRKWLHANVGPAVAESTRIIYGGSVNGANCKELAAQPDLDGFLVGGASLKPEFVDIIKSATVKSSSA

SEQ ID NO: 63779 - protein, 425 aa, Bacillus subtilis subsp. subtilis str. 168
MMNKDITAQSPRSKAVQDALDGKIRGFRGLLPFLGPAFIAAIAYIDPGNFATNISAGSKYGYMLLWVILFSNIMALLIQSLSAKLGIATGKNLPEVAREEFPKPVSIGLWIQGELVIIATDLAEFIGAALGLYLLFGIPMLEASIIAAIGSFAILELQRRGYRSLEAGIAGMLFVVVIAFALQTFFAKPDAVSVMKGLFVPAFHGTDSVLLAAGILGATVMPHAIYLHSALTQRRVVGKTDAERKKIFRFEFIDILIAMLIAGAINASMLIVAAALFFKNGLFVEDLDVAFQQFGHLVSPMSAALFGIGLLVAGLSSSSVGTLSGDVIMQGFINYRIPLYVRRFITIIPPILIIASGVNPTTALVLSQVVLSFGIAFALIPLIMFTSNKRIMGSLINAKWITVVSWLIAVLIVALNVFLIVDTFR

SEQ ID NO: 63780 - protein, 131 aa, Medicago truncatula
MAMNHVRSVRSILSSTNEAIGVAYQRTFATGKAKKGKGGASADGPKESSLSKEVKASTVVGGNILKEGTDPKILPDSEYPDWLWHLLDKRPALSELRRKEIDTLPYEDLKRYVKLDNRARIKENNSLKAKN

SEQ ID NO: 63781 - protein, 201 aa, Triticum aestivum
  misc_feature (178)..(178): Xaa can be any naturally occurring amino acid
MQGPTASFRVCLAVVVAVFLLGSSAAAAHGLRRVVSSSSDEPCNEMTLYYHDILYNGVNNTRNATSAAATKPTALSTTHWKNGTYFGMLVVFDDPLTVGKALPVAGEEPAARAQGFYFYDKQESYTSWFGFSIVFNSTAHKGTMNLVGADLMDDKTRDLSVVGGTGDFFMARGIATLXLDASEGAVYFRLQMDIKLYECYV

SEQ ID NO: 63782 - protein, 573 aa, Geobacillus kaustophilus HTA426
MEKTIHGIAASSGIAIAKAYRLETPHLAAEKRTVADVEAEIARLEAAVAKAKEELEAIKQHALEKLGEDKAAIFAAHLLVLDDPELLNPIKEKIKTEQVNAEYALHETASFFISMFEGMDNEYMKERAADIRDVTKRVLAHLLGVTISNPSLISEEVVIIAEDLTPSDTAQLNRQYVKGFATDIGGRTSHSAIMARSLEIPAVVGTKAITAEVQNGDIVIVDGLDGQVVVNPSPELLARYEEKRARYEEQKAEWAKLVDQPTVTADGVHVELAANIGTPDDVKGALANGAEGIGLYRTEFLYMGRSELPTEDEQFAAYKTVLEQMGGKPVVVRTLDIGGDKELPYLHLPKEMNPFLGFRAIRLCLEMQDMFRTQLRALLRASVHGNLKIMFPMIATLDEFRQAKAILLEEKEALLRQGVPVADGIEVGMMVEIPAAAVMADQFAREVDFFSIGTNDLIQYTMAADRMNERVSYLYQPYNPAILRLISYVIDAAHREGKWVGMCGEMAGDPIAIPILLALGLDEFSMSATSILPARAQLKRLSKEDAVCVKETVLSLGTAEEVVSFVKRTFHMA

SEQ ID NO: 63783 - protein, 505 aa, Oryza sativa
MSLPLTRKDLMIVNMGPQHPSMHGVLRLIVTLDGEDVIDCEPILGYLHRGMEKIAENRTIIQYLPYVTRWDYLATMFTEAITVNAPEFLENIQIPQRASYIRVIMLELSRIASHLLWLGPFMADLGAQTPFFYIFRERELIYDLFEAATGMRMMHNYFRIGGVAADLPYGWIDKCLDFCDYFLRGVIEYQQLITQNPIFLERVEGVGFISGEEAVNWGLSGPMLRASGIQWDLRKVDLYESYNQFDWKVQWQKEGDSLARYLVRIGEMRESIKIIQQAVEKIPGGPYENLEVRRFKKAKNSEWNDFEYRFLENWIHATPSHFPSTPVDAVSPRLRTEPEDTTTDFGFGNDTDAGASSGGDSGFSWWRRRASGGRNPVRSGPHATTAVEDAAGERCSCSSSPRRSFAAARTSSRVPSARDADATGRRRRRSRGPLCRLLLGCLGFLVACPDNTMVAESTPVRWLPLSVSSTARLTWVAAKELDRGEGARRWRRGSSAPETAPERPH

SEQ ID NO: 63784 - protein, 80 aa, Glycine max
FVIKKDGLPDIPAWNPWDNNSKSISYFLDKDYKQMLHIDGSITHKPVNFNPCQECTFQLQLFIVPSNLFNNHLALYRNYL

SEQ ID NO: 63785 - protein, 850 aa, Arabidopsis thaliana
MAAARRLRTLQSQPENKVCVDCSQKNPQWASISYGIFMCLECSGKHRGLGVHISFVRSVTMDSWSEIQIKKMDAGGNERLNNFLAQYGISKETDIISKYNSNAASVYRDRIQALAEGRQWRDPPIVKESVGGGLMNKKPPLSQGGGRDSGNGGWDNWDNDDSFRSTDMRRNQSAGDFRSSGGRGAPAKSKSSEDIYSRSQLEASAANKESFFAKRMAENESKPEGLPPSQGGKYVGFGSSPGPAPRSNQQSGGGDVFSVMSEGFGRLSLVAASAANVVQTGTMEFTSKVKEGGLDQTVSETVNVVASKTTEIGQRTWGIMKGVMAIASQKVEEFTKEEASTWNQQNKTEGNGYYQNSGIGNKTANSSFGGSQSSSSGHNNSYRNSNSWDDWGEENNSKKEAAPKVSTSNDDDDGGWAGWDDNDAKDDDFYYQPASDKKSVGHNGKSDTAWTGGGIAEPVVFSCSVTRESRVVISTIKPPLRSWSMKDDRESMSLSRFMFYRSNRTSSHFHSIIRHPEPGQRKREREREIMGIYGVMTGKKGKSGFGSASTAEDVTQAIDASHLTAIITGGTSGIGLEAARVLAMRGAHVIIAARNPKAANESKEMILQMNPNARVDYLQIDVSSIKSVRSFVDQFLALNVPLNILINNAGVMFCPFKLTEDGIESQFATNHIGHFLLTNLLLDKMKSTARESGVQGRIVNLSSIAHTYTYSEGIKFQGINDPAGYSERRAYGQSKLSNLLHSNALSRRLQEEGVNITINSVHPGLVTTNLFRYSGFSMKVFRAMTFLFWKNIPQGAATTCYVALHPDLEGVTGKYFGDCNIVAPSKFATNNSLADKLWDFSVFLIDSISK

SEQ ID NO: 63786 - protein, 180 aa, Zea mays
MAGRGGGGKGAAGRMMSLQEFVSCMQPLIDLEKAAEISAESETSAKSLERRGCVIANLKCTDAQFGTHDVVALKPNKADAGSASLGQGVVYRLKDSSITVAFDDIPEDGLNSPLRLEKLANEVTYRRMKDALIELSKAVQTGPCANLVPVLFGEKAPMRSKDAMKFSPFNKNLDDSQVTI

SEQ ID NO: 63787 - protein, 348 aa, Glycine max
MSTHGSYSMRSKGSFENEAKATGKESGGGGGGGGGKSGKTMSTNSKENLFIVFLVTLWYSSNIGVILLNKYLLSNYGFKFPIFLTMCHMSACAVLSYVSIVFFKVVPQQMIKSRSQFIKIATLSLVFCASVVGGNISLRYLAVSFNQAVGATTPFFTAVFAYLATLKREAWVTYGALVPVVAGVVIASGGEPGFHLFGFIMCLSATAARAFKSVLQSILLSSEGEKLNSMNLLLYMSPIAVLVLLPAALIMEPNVVDVILTLAKDHKSVWLLLFLNSVTAYAANLTNFLVTKHTSALTLQVLGNAKGAVAVVISILLFRNPVTVLGMGGYTITVMGVAAYGETKRRFR

SEQ ID NO: 63788 - protein, 228 aa, Brassica napus
CSECSPFGKGRSEGNKGMKSLLGGKGANLAEMASIGLSVPPGLTISTEACQQYQVAGKKLPEGLWEEILEGLSFIERDIGASLADPSKPLLLSVRSGAAISMPGMMDTVLNLGLNDQVVVGLAAKSGERFAYDSFRRFLDMFGDVVLGIPHAKFEEKLESMKESKGVKNDTELSATDLKELVEQYKSVYLEVKGQEFPSEPKKALELAIESVFDSWDSPRAIKYRSIN

SEQ ID NO: 63789 - protein, 130 aa, Solanum tuberosum
MVRVSVLNDALKSMYNAEKRGKRQVMIRPSSKVIIKFLIVMQKHGYIGEFEYVDDHRSGKIVVELNGRLNKCGVISPRFDVGVKEIEGWTARLLPSRQFGYIVLTTSAGIMDHEEARRKNVGGKVLGFFY

SEQ ID NO: 63790 - protein, 732 aa, Mycobacterium avium subsp. paratuberculosis K-10
MSSNEPASAAGGGTHQPEVPTVWPGSPYPLGASYDGAGTNFSLFSEIAEKVELCLIDSRGAETRIPLDEVDGYVWHAYLPNINPGQRYGFRVYGPFEPSAGHRCDPSKLLLDPYGKAFHGDFTYGQALFSYDLKAVAAGGDDADPGIPPMVDSLGHTMTSVVSNPFFDWGSDRAPLTPYHETVIYEAHVKGMTQTHPSVPEQLRGTYAGLAHPAIIDHLKSLNVTAIELMPVHQFMHDSRLLDLGLRNYWGYNTFGFFAPHNQYAANRNSSVAEFKSMVRSFHEAGIEVILDVVYNHTAEGNHLGPTINFRGIDNAAYYRLVDTDLRRYKDYTGTGNSLNPRHPHVLQLIMDSLRYWVTEMHVDGFRFDLAATLARELHDVDRLSAFFDLVQQDPIVSQVKLIAEPWDVGEGGYQVGNFPGLWTEWNGKYRDTVRDYWRGEPATLGEFASRLTGSSDLYEATGRRPSASINFVTAHDGFTLNDLVSYNEKHNMANGEDNRDGESHNRSWNCGVEGPTDDPDITELRYRQMRNFWATLMVSQGTPMIAHGDEFGRTQNGNNNVYCQDSELSWMDWSLVDKNSDLLAFARRATTLRTKHPVFRRRRFFEGEPIRSGDEVRDIAWLTPGGREMTHEDWGQSFHKCVAVFLNGDAITAPNARGERVVDDSFLLCFNAGEQPVQFVMPGGDYAKEWTVELDTNEPTGRKEGAEPLVVHTEEELTLPSRSLLILRKTL

SEQ ID NO: 63791 - protein, 180 aa, Drimys granadensis
MFPMMTGFMNYGQQTVRAARYIGQSFMITLSHANRLPVTIQYPYEKSITSERFRGRIHFEFDKCIACEVCVRVCPIDLPVVDWRLETDIRKKRLLNYSIDFGICIFCGNCVEYCPTNCLSMTEEYELSIYDRHELNYNQIALGRLPMSVIGDYTIRTIMNSTQIKITTDKPLDSITITND

SEQ ID NO: 63792 - protein, 210 aa, Oryza sativa (japonica cultivar-group)
MAGRKRKAEAARAAEEEADRALYGAFRGAANSLSQLYALAGAHQRLSFHAGERHALEKLYQWMVRQHEIGLRLTVSDIASHIQHEIEYGGDNALTSPRSQHAFQNLQAPMHIPNTSTQQPPSCSITPSNPSKDSMIFSKALSSPVRQNLQLYHVQQCGDTGCFADGIFCPGNGDSDPAASNDSSVDMHSDSPGFPRPTEALRDSEGGRPS

SEQ ID NO: 63793 - protein, 199 aa, Zea mays
  misc_feature (135)..(135): Xaa can be any naturally occurring amino acid
  misc_feature (143)..(143): Xaa can be any naturally occurring amino acid
  misc_feature (184)..(184): Xaa can be any naturally occurring amino acid
GRETPTHTNPRSSAPHHPAQLYVSLSLPSHATETTATPNSATVPVAARQACLASRTWAPSATDSLKAVGIKGLGGRSISGRKLSGARASGRSMRKTRAAVAADQERHNSGYFELQDIPNTTGTVENSTAHEAPSXYNPLQSKXLHTVPPSFTQRRLLVQVLLLGGGSLLVYLQAAGERTSRAIXKGPHETPQSGPGGKN

SEQ ID NO: 63794 - protein, 508 aa, Arabidopsis thaliana
MEIVIASLALVVVLWCIWRILEWVWLKPKMLESYLRRQGLVGTRYTPLVGDVRRSFSMLKEARSKPMKPTDDLISLVMPYSFHMLNTYGKTFFTWSGPIPAITIMNPQLIKEVYNKFYDFEKTHTFPLTSLLTDGLANADGDKWVKHRKIINPAFHFEKIKNMVPTFYKSCIEVMCEWEKLVSDKGSSCELDVWPWIVNMTGDVISRTAFGSSYKEGQRIFILQAELAHLIILALGKNYIPAYRHFPTKNNRRMKTIVKEIQVILRGIISHREKARDAGEAPSDDLLGILLKSNSEQSKGNGLNMEEIMEECKLFYFAGQETTSVLLAWTMVLLSQHQDWQARAREEVMQVFGHNKPDLQGINQLKVMTMIIYEVLRLYPPVIQMNRATHKEIKLGDMTLPGGIQVHMPVLLIHRDTKLWGDDAAEFKPERFKDGIAKATKNQVCFLPFGWGPRICIGQNFALLEAKMALALILQRFSFELSPSYVHSPYRVFTIHPQCGAHLILHKL

SEQ ID NO: 63795 - protein, 466 aa, Staphylococcus aureus subsp. aureus MRSA252
MTKSVAIIGAGITGLSSAYFLKQQDPNIDVTIFEASNRPGGKIQSYRKDGYMIELGPESYLGRKTIMTELAKDIGLEQDIVTNTTGQSYIFAKNKLYPIPGGSIMGIPTDIKPFVTTKLISPFGKLRAGFDLFKKPTQMQNGDISVGAFFRARLGNEVLENLIEPLMGGIYGTDIDKLSLMSTFPNFKEKEEAFGSLIKGMKDEKNKRLKQRQLYPGAPKGQFKQFKHGLSSFIEALEQDVKNKGVTIRYNTSVDDIITSQKQYKIVYSNQQEDVFDGVLVTTPHQVFLNWFGQDPAFDYFKTMDSTTVATVVLAFDEKDIENTYDGTGFVIARTSDTDITACTWTSKKWPFTTPEGKVLIRAYVGKPGDTVVDDHTDDELVSIVRRDLSQMMTFKGDPEFTIVNRLPKSMPQYHVGHIQQIRQIQAHIKQTYPRLRVTGASFEAVGLPDCITQGKVAAEEVIAEL

SEQ ID NO: 63796 - protein, 433 aa, Photorhabdus luminescens subsp. laumondii TTO1
MSKIVKVIGREIIDSRGNPTVEAEVHLEGGFVGLAAAPSGASTGSREALELRDGDKSRFMGKGVLKAVDAVNGPIAQAVIGQDAKDQANIDKIMIDLDGTENKSQFGANAILAVSLANAKAAAAAKGMPLYEHIAELNGTPGKFSMPLPMMNIINGGEHADNNVDIQEFMIQPIGAKTLKEAVRIGSEVFHNLAKVLKAKGMSTAVGDEGGYAPNLESNAAALAAIKEAVEQAGYVLGKDVTLAMDCAASEFYNPETGNYELKGEGKTFTSQEFTHYLEDLTRKYPIVSIEDGLNESDWEGFAYQTKVLGEKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALGNRAPFYGLKEVKGQA

SEQ ID NO: 63797 - protein, 472 aa, Salinibacter ruber DSM 13855
MANTPIEFGTDGWRAVIADDYTFANLERVAQATANWLHDDYGDTPSIVLGHDTRFLGAEFAERAARVLADAGVSVTLADSIVPTPAVSWATQAAGHDAGVVITASHNPPSYNGYKIKAHFGGPAPPDMIASVEGAVPDHNLDGTSLAPFGTLAADGAVQTDGVRGGYLDALRDALNISAIQNADLTIAHDAMFGAAQGLVEALLGDGVVSLRHDLNPGFHGVAPEPIADRLGELSDTVAQSDAAVGLANDGDGDRIGMVDEDGTFVSSHRILALLVKYLYEERGLTGSIVKTFSTTHLLDKMGARYGLDVETTPIGFKHIAPKMAEGNVLVGGEESGGIAAAGHIPERDGVYIGLLIVEMMVERGMTLSALVDELLEEFGPHYNYRDDIHIREDQKADVLDRLDNQGGLESVNGHAVEEVRTLDGFKHVTDHGWLLIRPSGTEPVLRVYSEAESPEAAEALVKDASAQLGLN

SEQ ID NO: 63798 - protein, 1107 aa, Synechococcus sp. CC9311
MPRRNDLRRILLLGSGPIVIGQACEFDYSGTQACKALRAEGYEVILINSNPASIMTDPEMADRTYVEPLTPDVVTRVIELERPDALLPTMGGQTALNLAVALSKDGTLDRFGVELIGADLKAIQKAEDRQLFKQAMERIGVHVCPSGIASTLEEAESVGASISSYPRIIRPAFTLGGSGGGIAYNPEEFSAICKTGLDASPVSQILIEKSLLGWKEFELEVMRDLADNVVIVCSIENLDPMGVHTGDSITVAPAQTLTDREYQRLRDQSIAIIREIGVATGGSNIQFAINPADGEVVVIEMNPRVSRSSALASKATGFPIAKIAARLAIGYTLDEILNDITGKTPACFEPTIDYVVTKVPRFAFEKFRGSPAVLTTAMKSVGEAMAIGRCFEESFQKALRSLETGLSGWGGDRPEPSCSKTDLERSLRTPSPDRILAVRSAMLSGMTDAHIHELSHIDPWFLAKLRGLIDAESDLLKGKSLEDLDETILFKLKTLGYSDRQIAWFVDSKELNVRERRDQLGVTPVFKTVDTCAAEFASSTPYHYSTYERPLFRLKPDGLLQPMAPSTEVATETRPKLMILGGGPNRIGQGIEFDYCCCHASFSAQDQGFATVMLNSNPETVSTDYDSSDRLYFEPITLEDVLNVIEAERPNGVIVQFGGQTPLKLALSLLNWLSTPQGKATGTQIWGTSPASIDLAEDREQFEAILRKLEIRQPRNGLARSEVEARSIAGNVGYPVVVRPSYVLGGRAMEVVYDEEELNRYMKEAVQVEPDHPVLIDQYLENAVEVDVDALCDHEGTVVIGGLMEHIEPAGIHSGDSACCLPSISLSEDALSLIRRWSEALAITLKVQGLINLQFAVQRAADGQEKVFIIEANPRASRTVPFVAKATGVPLARLATRLMAGETLSQVGLLKEPVPPLQTVKEAVLPFRRFPGSDSLLGPEMRSTGEVMGSASDFGMAFAKAELAAGEALPTTGTVFLSTHDRDKPALVPVARQLIGLGFQLMATSGTAQALRNEGLQVESVLKVHEGRPNIEDLIRSGGVQLVINTPIGRQAAHDDRYLRRAALDYSVPTLTTLAGARAAVEAIEALQTRTIVIHALQDVHASLSGQ

SEQ ID NO: 63799 - protein, 368 aa, Triticum aestivum
MVHQDQGKLVQVVAVDVGLVAPPSRYVLSEENRPTTVEQQAKLVIPIVDVSRLAKPDDVEEAAKLRSALQSWGLFVVTGHGMPKEFLDEILEATRKFFHLPLEEKLKCGNVIDGVKFQNEGYGIDRIDSDEQILDWCDRLWLQLQPEDERRLQFWPQNLRDLLHEYTLESGRVTMDVLKAMAKLLNQEEGFFINMVGERFKSYSRFTYYPPCPRPDLVNGLKPHTDNSVITLLLMDKDVGGLQVLKDGHWVDVPVLGNDLLVVVGEGMEIVSNAIFKAPWHRVVTSADKERLSLAMFYQPEPERIIGPPGVLVHEKRPAMFKKCLVQTLADGYWDAFAAGDRTVDFLNVRINAEADAELEARAVVANN

SEQ ID NO: 63800 - protein, 132 aa, Brassica napus
  misc_feature (130)..(131): Xaa can be any naturally occurring amino acid
MGPRCSKLSLCWWQTHHKSSLNDASDLENGNDDSASFSEFSFDQLRTATSGFSTDSIVSEHGVKAPNVVYKGRLEDERWIAVKRFNRSAWPDTRQFLEEAKAVGQLRSERLANLIGFCCEGDERLLVAEXXP

SEQ ID NO: 63801 - protein, 764 aa, Aspergillus nidulans FGSC A4
MASVYKAVSKRKSRDITKQQDQDDEDVMMEEMLADADDTSDSDEDEENTADAAKKQLAAGMMPKTRVLMLTSRGVTSRHRHLLNDMTSLLPHTHKESKLDSRKKAAGYNLLLNSLADLHSCNVIFFLEAKKNGQDLYLWLSRPPNGPTVKFHVNNLHTMAELNTGFAGNCLKGGRGIVVFDKSFDEQGPVMSQPGNEYRGLIREMLRSVFCVPKRGVKGMKPFIDRVIGIYGVDGKIWIRVYEIRESESGNKKKDGEEVTEKPAHNPKDGPEISLVEIGPRFVLTPIVILEGSFGGPVIYENKEFVSPNQVRREIRISKAARYWLSPSFAIITQMNVQRVKSLDSSLAPELLLAAVMASPSQYSPLWLQGTQKYLPDIIPSQLLMVMELFSVFAYPSGKESPSAMSFQYLVTELLLHIFRSCDTISDIINLAATCRRFRDVINRSNKLQILMDVAEMEFGPVDDIIQIATHNTSQPAHLFRTAPLTASLLKQIAQIGRAAQKWATIYPVKKWKLDYENRRSLTDEEQFRLRRAIYRLWLYHRAFHRREYDRYSRNLLNTVVERAQLLHNWTTSELADIEDIRTVIGDVVQNHICPSNGTIQRKFRKRYPESNYQLTFNIHLNYPISNTQTPYGFHDSSLNPTDHDQYFHLTHYTSFGNYSAKYRSRFRNDIFHEPGSEGWGDEIPHYYVVQDMMKLDPGQILWLRENCPLKEQVETFVLSLGDWFRDNGETFGDTLAWVIKERGEDLEEFRVAIVERELGIACN

SEQ ID NO: 63802 - protein, 356 aa, Arabidopsis thaliana
MKTVLVIINCIFLAIGNCGGPLMMRLYFQNGGERIWFPSFLQTVGCPLIFFPLLLSFLRRRRCLEEQETTPFFLMKPPLFIAAIVVGLLVGFDNYLYSYGLAYIPVSTASLIISAQLGFTALFAFFMVKQKFTPFTINAIVLLTGGAVVLALNSDSDKLANETHKEYVVGFIMTLGAALLYGFILPLVELSYKKSGQRITYTLALEFQMVLCFAATCVCLVGMLAAGDFKVKHALFIFKNRVIAGEARDFKLGESLYYVVIVFTAIIWQAFFVGAIGLIFCASSLVSGIMVSALLPVTVILAVICFQEKFQAGKGVALALSLWGSVSYFYGQVKSEEKTKAQDTQLSQLPVTDYVA

SEQ ID NO: 63803 - protein, 118 aa, Helicobacter pylori J99
MKNRYIQQFEDAQLKDKSMPTFKAGDTLRLGITIKEGEKTRTQYFEGVCIAIRGNGVDKTFCVRKIGANNIGVEKIFPFYSESLASVEVLRVGRVRRAKLYYLRDRRGKAARIKEVRH

SEQ ID NO: 63804 - protein, 795 aa, Alteromonadales bacterium TW-7
MKFSEKWLREWVNPAIDTQALSEQLSMAGLEVDGVEPAAAKFNGVLVGEVVECGQHPDADKLRVTKINVGGDELLDIVCGAPNCREGIKVAVATVGAVLPGDFKIKKAKLRGQPSHGMLCAFDELGISEESEGIMELPSDAPIGADLRDYLSLDDNIIDVDLTPNRGDCLGIKGLAREVGVLNSIDVNVLEIPAVAPTIDDKVSIELVNEDACPRYLGRVIKGINLDAETPLWMVEKLRRSGVRSIDPVVDVTNYVLLELGHPMHAFDLSAIEGGIKVRSANADEELVLLDGNTAKLNESTLVIADNDKALAIAGIFGGEQSGVTEKTTDILLESAFFNPVAIAGQARSYGLHTDASHRYERGVDFALQHDAMQRATALLLEIVGGQAGPVVEAVAADKLPKVTEVRLRRSRLDRVIGHHIDDAKVTDILTRLGLDVKVENDSWSADIPSYRFDIRIEEDLIEEVARVYGYNSIPNVAPTAKLKMTTHNEASIALSKFRNTLVTRGYQEAITYSFVDPKAQAILHPQSDALALPHPISIEMSAMRVSLMPGLLASVAYNQNRQQPRIRLFEHGLKFISDENAENGVYQVPVIGGAITGLAHGEHWVEEKRNVDFYDLKGDVEALLAITNDVSRFEIKAEQSDGLHPGQSAVIYVDGKKVGFFGALHPQAQKSLDINNATFVFEIEMSAIEKRNLPQAESVSKFPSNRRDIAILVADSVKSGDILNAIEKVGGNQLVDLNLFDVYKGKGIEPNYKSLAIALTLQAVDRTLEEKDINLVVDNVVAELAEKFNASLRD

SEQ ID NO: 63805 - protein, 438 aa, Mycobacterium avium subsp. paratuberculosis K-10
MPAAKAGLTPEQISAIDAAHLWHPYSTIGAESVAPVVAVGARGAWLTLIRDGAEVRALDAMSSWWTAIHGHGHPVLDAALSDQLAAMNHVMFGGLTHEPAARLAQLLVSITPAGLDTVFFSDSGSVSVEVAVKMALQYWRSRHRPAKHRLMTWRGGYHGDTFTPMSVCDPEGGMHSLWTDILARQVFAPQVPRDYDPAYSAAFEAQLARHADELAAVIVEPVVQGAGGMRFHDPRYLGDLREACTRRDVLLIFDEIATGFGRTGELFAADHARVSPDIMCVGKALTGGYLSLAATLCSTDIAQVISAGEAGALMHGPTFMANALACAVSMASVEVLLGQDWRSRVAEISAGLAAGLEPARELPGVTDVRVRGAIGVIECDRPVDLAVATPAALDHGVWLRPFRNLIYAMPPYICPPDEIARIASAMVQVAARLGSRRL

SEQ ID NO: 63806 - protein, 393 aa, Drimys granadensis
MTVPATKKDLMIINMGPHHPSMHGVLRLIVTLDGEDVIDCEPILGYLHRGMEKIAENRTIIQYLPYVTRWDYLATMFTEAITVNAPEQLGNIQVPKRASYIRVIMLELSRIASHLLWLGPFMADIGAQTPFFYIFRERELLYDLFEAATGMRMMHNYFRIGGVAADLPHGWIDKCLDFCDYSLTGVVEYQKLITRNPIFLERVEEVGIIGGEEAINWGLSGPMLRASGIQWDLRKVDHYECYDEFDWEVQWQKEGDSLARYLVRISEMTESIKILQQALEGIPGGPYENLEVRRFDRAKDSEWNDFEYRFISKKPSPTFELLKQELYVRVEAPKGELGIFLIGDNSVFPWRWKIRPPGFINLQILPQLVKRMKLADIMTILGSIDIIMGEVDR

SEQ ID NO: 63807 - protein, 349 aa, Zea mays
MAPDLVNGVLNWVGTPAMVASLLLFYPPYYLFKTCYSFLSWLFPEDLAGKVVLITVASSGIGEQLAYQYALNRASLALVARRESSLRHVADRALELGARDVVVLPGDVSAPDDCDRFVRTAISHYDRLDHLVCNAGVASVGAFEEIPDVTSYSSQLDVNFWGSVQTTFAALPHLKRSRGRIVVTASATGWNPVPRMSIYNAANAALINFFETLRTELGNQVGITVVTPGWVESEMSRGKFLKEHGQVEVDQEMRDAQIGLFPVEYAKNCAKAMVQAARQGERYLTVPAWFGAMYLWRLFAPEVVEACYRLLYMHGHGARQADAPSRTMAEAGGKQLLYPTSLRSEEIKE

SEQ ID NO: 63808 - protein, 213 aa, Magnaporthe grisea 70-15
MQSTSPDNANPTIRSIASLPSRGRRSDFSLDNSPESKYDNLLLSRNTASDYGLPDVLAWSSDSDSDYDSTDRASPFPSSSSPSSSLYAAEPIDALEIYTLTASISDPEHPHTLGQLSVINLPDIHVTSNHVLVEVTPTITHCSLATVIGLAVRVRLEQALPPAYRVDVRMKQGSHAQDDQVNRQLADKERVAAALENDSLRGMLDKMMETCTT

SEQ ID NO: 63809 - protein, 430 aa, Listeria monocytogenes str. 4b F2365
MSIITEVYAREVLDSRGNPTVEVEVYTEAGAFGRALVPSGASTGEYEAVELRDGDKARYLGKGVLKAVENVNDIIADKIIGFDVTDQIGIDKAMIELDGTPNKGKLGANAILGVSLAAARAAADELGVHLYEYLGGVNGKVLPVPMMNILNGGEHADNNVDVQEFMVMPVGAPNFKEALRMGAEILHALKAVLKGKGLNTGVGDEGGFAPNLKSNEEALETIMQAIKDAGYKPGEEVKLAMDAASSEFYNRETGKYELKGEGVTRTSEEMVTWYEEMITKYPIISIEDGLDENDWDGFKLLTERIGDRVQLVGDDLFVTNTTKLKEGIEKGIANSILIKVNQIGTLTETLDAIEMAKRAGYTAVISHRSGETEDSTIADIAVATNAGQIKTGAPTRTDRVAKYNQLLRIEDNLADLAEYHGNETFYNLKK

SEQ ID NO: 63810 - protein, 510 aa, Listeria monocytogenes str. 4b F2365
MSKSPVAIIILDGFGKRAETVGNAVAQANKPNFDRYWANFPHGELKAAGLDVGLPEGQMGNSEVGHTNIGAGRIVYQSLTRIDKAIEEGEFQENKALNNAFTHTKENNSDLHLFGLLSDGGVHSHINHLVALLETAKDKGVKNVYIHAFLDGRDVAPQSSLEYLETLQKAISDLNYGAIATVSGRFYAMDRDKRWERVEKAYKAIVNAEGEKFEDPIELVKASYANDKNDEFVVPAIITKDGKPVATVKDNDAVIFFNFRPDRAIQLSNAFTDKEWDHFDRGANHPKNIKFVTMTLYNPSIDAEVAFEPIEMKNVIGEVLSNEGLSQLRIAETEKYPHVTFFMNGGRNEEFPGENRILINSPKVETYDLQPEMSAYEVTDALVEDIKNDKHDAIILNFANPDMVGHSGMLEPTIKAIEAVDENLGRVVDLILEKGGSAIIFADHGNSETMSTPEGKPHTAHTTVPVPVIVTKKGVTLREGGRLADVAPTMLDLLGVKKPAEMTGESLIQK

SEQ ID NO: 63811 - protein, 469 aa, Rhodopirellula baltica SH 1
MTEVKLPELGDGIESGDVLEIFVSVGDVITAGQDIVEMETDKATVPVPSDVGGKVTKISVGEGDTVPIGGVLIEVEAAAGAESAPAPAAPAEPEKKPEPKPEPQAEAPAPEPAAPPAAKPAAPAAPPVAQPVATPAARTPAVADEPDAPVDGGGSIPAGPAIRRFARETGVNLASVTGTGAGGRITRDDVLAVVRSASQKAAAPAAKPAPSAGTAAPRTNVTSGDLPGTPDTDDYGPIRVERMSKIRKTISAQMHLSWSTVPRVTNFDDADITDLERLRQSSKDDYAAQGLKLTTMPFLVKAVATALRHHPSLNAVIDSENQQVIYKDYVNIGIAVDTDNGLVVPVMHNADQMGIPDTARNIAEMAGKVRGGKFGVNDLRGGSFTISNLGAIGGQYSTPIVNVPEVAILLVGRSRKLPVVMPDDSIQPRLMMPLSLSYDHRLVDGGTAARFLNDVIGYLQAPSRLLLAL

SEQ ID NO: 63812 - protein, 910 aa, Rhodopirellula baltica SH 1
MSESKSVAQAEISQNLGELQHSPDVDVDSAETQEWISSLEYVLQSKGPERVKFLIDQLRDRAAEEGVPLSSDTSTPYVNTIPPHEQPAYPGNRELERRIKSIIRWNAMAMVVRANKRPGGVGGHISTFASSATLYEVAFNHFFQGRGEDGYSGDSIYFQGHASPGMYSRAYLEGRLSDENLDNFRRELAPGGGLSSYPHPWLMPGFWEYPTVSMGLGPIMAIYQARFNEYLNDRGIKDTKGQKVWAFLGDGECDEPETLGAIGLASREKLDNLIFVINCNLQRLDGPVRGNSKIIQELESIFHGAGWNVIKVVWGGEWDELLARDTTGLLAKRMNEVVDGQYQKYTSMPGSYIREHFFGKYPELLELVKHLSDEKLEKIRRGGHDPEKVYAAYHRATTLNNGKPTVILAKTVKGYGLGEAGEGRNVAHNQKKMNEAELLEFRTRFGIPISDEKVGEAPFYKPPANSTEIKYLKTRRETLGGPVPSRPTEHPKLEIPALDVFQKFVAKRTDNKEVSTTFAAVQMLISMCRDKSIGKYVVPIVPDESRTFGMEGMFKQFGIYAHAGQLYEPTDSDQVAYYKEAQDGQILEEGITECGSMSSFNAAGTAYSCHGVNMIPFYIYYSMFGFQRIGDSIWAAADMRAKGFLVGGTAGRTTLNGEGLQHQDGHSLLNAIAFPTVRAYDPAFAYEVTVIVHEGLKRMYEEGEECLYYITAENEAYVQPEIPEGCEEGIIKGMYKFNSREVDGAKARVQLFGSGAILNSALKAQEILAEKYNIASDVWSVTSYTLLRRDAHSVERWNRLHPTETPRKSYLEEVLEGVEGPFISASDYVRALGEQLTPWIPGDYYVLGTDGMGRSETREALRRHFEVDAESITIAALGRLAKAGTFEAADVAQAIKDLDYDPDKVDPYFA

SEQ ID NO: 63813 - protein, 310 aa, Saccharophagus degradans 2-40
MTNKLEQLKQFSSVVADTGDIEAIKRYQPLDATTNPSLLFKAAQLPQYAPLLEKALAESSSIDDACDRLAVAIGCEILKIVPGRVSTEVDARLSFDKNASIDKAHRLIDMYEANGIGKERVLIKLASTWEGIRAAEQLQKEGIDCNLTLLFSFSQAAACADAGVFLISPFVGRILDWYKANTDKKEYLPHEDPGVISVSRIYNYYKQHDYKTVVMGASFRNTGELEELAGCDRLTISPDLLEALAQDTGKLERKLSPENSGEPIAKLIENESQYRFSNNEDAMATHKLAEGIRNFAKDQINLINLLKSKA

SEQ ID NO: 63814 - protein, 335 aa, Coccidioides immitis RS
MPKETPFLPEHTKGAEGGKTMSQIFDDKSQYCIPFLLGRLELHRARYASDPNPPPFFLGLNGVQGAGKTVLVTTLRSTLSAPPYNLPTIAFSLDDIYLTHESQLRLAASHPNNPLLQHRGQPSTHDISLGKQVFDSLRKGLPTKIPTYDKSAFKGQGDRLPEDRWEVVNDVENGGRKAKVVIFEGWCLGFRARLPDDIRTAWENAVQQKATGTYDGQLANVKLEDVLAVNEALKGYDAFTDDAEDTHYVYDWRQEQERTLLATKGTGMTPDQVTQFVNGYYPSYELFTPALRNGVFNPAGRALCPGNEHSALSWKGKQLRLIVDRQRRVSKAITI

SEQ ID NO: 63815 - protein, 237 aa, Aspergillus nidulans FGSC A4
MANDEYDVSPRPLTFLFKVVLIGDSGTGKSNLLSRFTRNEFNLDSKSTIGVEFATRSIQVDSKTIKAQIWDTAGQERYRAITSAYYRGAVGALLVYDISKHQTYDNVNRWLKELRDHADSNIVIMLVGNKSDLRHLRAVPTEEAKQFASENNLSFIETSALDASNVELAFQNILTGIAPVGISKRRSLTAILFFVEIYRIVSSKALEGESGGASVGERRQIIDIEKTQDTENKGGCC

SEQ ID NO: 63816 - protein, 357 aa, Geobacter metallireducens GS-15
MEIRIAPLPEGRKKPKYTDESQLGFGKLFTDRMFMVEWKIGQGWVDARIEPYAPFVLDPACSVLHYAQEIFEGLKAYKWADGTITLFRPEMNARRFNHSADRLCMPEVPEELFLDGIEKLVALERDWIPSSEGTSLYIRPTMIGVDPVLGVKPADHYYFYVILSPVGAYYSAGFNPIKIMVEDQYVRSVPGGTGEAKTGGNYACSLKAGLEAKKKGYDQVLWLDGVHRRYIEEVGAMNMLFAYGKTIVTASLTGTILNGVTRDSTLKLAASLGYTIEERLIDVNELMADIRAGKVTEAFGSGTAAVISPVGVLAYKDEVCTVGNGGVGPITQQLYDTLTGIQTGKVPDTFGWTRKIA

SEQ ID NO: 63817 - protein, 453 aa, Salinibacter ruber DSM 13855
MAQSGDRSPTARLGLLDATMVGMGAMIGAGIFVLTGLAAEIAGPAAILVFALNGVVTVLTGISYAELASAIPKSGGGYVFVREVFSGPTSFLMGWMLSFAYMIAGALYALGFSSNFVEFVHLYWAGLPTGPVWHILYALTVVGLFALLNAVSTEASGGAETVVTIIKIIILLVFAGFGAFAVEGSNFEPFFAKDDSSVAILKAMGLTFIAFEGYDLIATVTEEVENPRENIPKAIFISLVATVAIYLIVVWVAIGTLGAEELGRAGETGIAEAATSFMPTIPLLGEGAALIVFGAVFSTVSALNAVVIASSRVVFAMGREDQLPNPLGQISARFGTPLAAVVVSAAVMLGSVVFLPIEQVGRVSSLFFLVSFVVVNWSVIRLRNRRPNMRRPFEMPFYPAIPILAIVLNLVLAYFLLRDDPYTLVLGVGWIAIGGLVYAALQWRRTETEAAGA

SEQ ID NO: 63818 - protein, 949 aa, Oryza sativa
MKRSGDIASLFGNHEAKTMEIPESSSSSNVFIGDETPVPEEEPRQVPTDAFPRAPPVQRNASSVSATMDRRPGRHKLRRVKAHVRAARMDRISGLPDKILHHIMSFLNTRQAVQTCVLSRRWRNLWRTMPCINADFDEFDFIAYQGDDEDYNDEVAFKRFVNQMLELRDPTAMIDTFWLSYIIWDGYNEYKDSNVDANRWISHALQKQARVIEVVVFAFPLELDHSVFTSCYLRKIGFSCVSLHQGFFKQLDTGCPALEELFLHDCIIADEEILSQSLKVLTIDGTEFSMANKASISIPSVTSLTLSIEDSTPMLKDMELLTTASVSVKFNTFIFSYGFDANDLRQCLWSLSGVTNLEFNYEGTELTFENNLQWCPEFIDVVNLTLGQWCLDANFYALIVFLQNSPRLEKLTLNLAKCIADKSPRIVGELMERSFTCEHLKIVEVKCLEDDPQVISVEDFFASNGMASVQFDIKHWGQYKDELPAFIRHHKSYIPEIKRHPVIFHMAIKVPHAHHLFDETPLRAWPPWRGVLAVARRKVKTPAHAAGMDWISDLPDEILHRIMSFLNARQAVQTCVLSRRWRNLWRTVPCINADCKEFDFFGFRRSEVEFKRFVNRLLELRDPIAMMDAFWFRYHKLDTDTTSSADTNRWISHALQKQARVLEAVMYPCHLLDLDHSSFTSRYLRRIGFSGVRLDQGFFKQLEAGCPALEDLFLHHCTIEDDKISSQTLKVLTIDRTYFLIAINATDVQKKSISAPSVTSLTMYSPEGSLHILKDMTSLVTASVSFSEFRVHFDANDFYQYLWSLSGVTNLEFNYQGPKLKIENNLQWCPEFVNVVNLTLGKWCLDANFYALTVFLQNSPKLQKLTLKLAKCTSEIHQRIIGELTERSFTCEHLKIIEVICLENDPQVIRVKDFFASSGITSVQFHIKHWSQLKEDKLPAFTRIPIPSH

SEQ ID NO: 63819 - protein, 233 aa, Lactococcus lactis subsp. lactis Il1403
MPKLVFARHGESEWNLANLFTGWADVDLSENGTKQAIEAGKLIKEAGIEFDIAYTSVLKRAIKTTNLALEYSDQLWVPVVKSWRLNERHYGGLTGLNKADAAAKHGDEQVHIWRRSYDVLPPAMDHDDKYTAHGDRRYAGLEDSLIPDAENLKVTLERALPFWEDQIAPALKEGKNVFVGAHGNSIRALVKQIKKLSDDEIMDVEIPNFPPLVFEFDDNLNVQNEYYLAPKKA

SEQ ID NO: 63820 - protein, 1023 aa, Streptococcus pyogenes M49 591
MPKRKDIQKIMVIGSGPIIIGQAAEFDYAGTQACLALKEEGYKVILVNSNPATIMTDKEIADKVYIEPLTLEFVNRIIRKERPDAILPTLGGQTGLNMAMALSKAGILDDLEIELLGTKLSAIDQAEDRDLFKQLMQELDQPIPESTIVKTVDEAVTFARDIGYPVIVRPAFTLGGTGGGICSSEEELCEITENGLKLSPVTQCLIERSIAGFKEIEYEVMRDSADNALVVCNMENFDPVGIHTGDSIVFAPTQTLSDIENQMLRDASLKIIRALKIEGGCNVQLALDPYSFKYYVIEVNPRVSRSSALASKATGYPIAKLAAKIAVGLTLDEMINPITGTTYAMFEPTLDYVVAKIPRFPFDKFEHGERQLGTQMKATGEVMAIGRNLEESLLKACRSLEIGVCHNEMTSLSNISDEELVTKVIKAQDDRLFYLSEAIRRGYSIEELESLTKIDLFFLDKLLHIVEIEQDLQMHVEHLESLKKAKRYGFSDQKIAEIWQKDESDIRAMRHSHSLYPVYKMVDTCAAEFDAKTPYFYSTYELENESVQSNKESILVLGSGPIRIGQGVEFDYATVHSVKAIQKAGYEAIIMNSNPETVSTDFSVSDKLYFEPLTFEDVMNVIDLEQPKGVIVQFGGQTAINLAQALSEAGVTILGTQVEDLDRAEDRDLFEKALKELGIPQPQGQTATNEEEALQAAKKIGFPVLVRPSYVLGGRAMEIVENKEDLREYIRTAVKASPEHPILVDSYIFGKECEVDAISDGKSVLIPAIMEHIERASVHSGDSMAVYPPQQLSKQIQETIAEYTKRLAIGLNCIGMMNVQFVIKNEQVYVIEVNPRASRTVPFLSKVTGIPMAQIATKLILGQTLKDLGYEDGLYPQSQLVHIKAPVFSFTKLAQVDSLLGPEMKSTGEVMGSDTSLEKALYKAFEANNSHLSEFGQIVFTIADDSKAEALSLARRFKAIGYQIMATQGTAAYFAEQGLSACLVGKIGDAANDIPTLVRHGHVQAIVNTVGIKRTADKDGQMN

SEQ ID NO: 63821 - protein, 422 aa, Geobacillus kaustophilus HTA426
MAEIKVPELAESITEGTIAQWLKKPGDYVEKGESICELETDKVNVEIMAEESGVLQQLLANEGDTVAVGQAIAIIGEGAAAPTAALQAAPQPADETETVAPADSNEQPAPQPVAVAQAPSQRPIASPAARKMAREKGIDLTQVPTVDPLGRVRKQDVASFAAQPAAAPQPAPQAAPTSTPAAVPAAEAGKPVIREKMSRRRQTIAKRLLEVTQTTAMLTTFNEIDMSAVIDLRKRKKDKFFEEHDVRLGFMSFFVKAAVAALKKYPYVNAEIQGDEILLKKYYDIGVAVSTDEGLVVPVVRDCDRKNFAEIERDIAELAAKARSNKLSLADLQGGTFTITNGGVFGSLLSTPLLNGPQVGILGMHSIKLRPVAVDEERIENRPMMYVALSYDHRIIDGKEAVGFLKTVKDLIENPEDLLLES

SEQ ID NO: 63822 - protein, 482 aa, Bacillus cereus E33L
MIRVGGEWMYTETKEKKQSPNKMVRKIAFISTFGGLLFGYDTGVINGALPYMSDSNQLDLNPFTQGLVASSLLLGAAFGALFGGRLSDYNGRRKNILYLALLFFISTLGCTLAPNTTLMVICRFILGLAVGGASVTVPTFLAEMSPAETRGQIVTQNELMIVTGQFLAFTCNAILGNVLGDVGYVWRLMLVIASLPAVVLWFGMLIVPESPRWLASKGKIGDSLRVLKQIREENQANIELEEIKSALAEDSKLEKSSFKDLSTPWVRRILFLGIGVAIVNQINGVNAIMYYGTEILKNTGWGTKAALIGNVANGVISIAAMLVGIWLLGRVRRRPMLIIGLCGTTTSLFLIGFFSFILNGSVMLPYIVLSLTVIFLAFMQGAIGPVTWLTLAEIFPLRMRGLGMGFSVFWMWIVNFLISLSFPVLLSKIGLSATFLLFGILGLVAIAFVNKYLPETKGKSLEELEHYFRSYDDQGLENKQAR

SEQ ID NO: 63823 - protein, 664 aa, Escherichia coli
MSSRKELANAIRALSMDAVQKAKSGHPGAPMGMADIAEVLWRDFLKHNPQNPSWADRDRFVLSNGHGSMLIYSLLHLTGYDLPMEELKNFRQLHSKTPGHPESGVTPLGVETTTGPLGQGIANAVGMAIAEKTLAAQFNRPGHDIVDHYTYAFMGDGCMMEGISHEVCSLAGTLKLGKLIAFYDDNGISIDGHVEGWFTDDTAMRFEAYGWHVIRDIDGHDAASIKRAVEEARAVTDKPSLLMCKTIIGFGSPNKAGTHDSHGAPLGDAEIALTREQLGWKYAPFEIPSEIYAQWDAKEAGQAKESAWNEKFAAYAKAYPQEAAEFTRRMKGEMPSDFDAKAKEFIAKLQANPAKIASRKASQNAIEAFGPLLPEFLGGSADLAPSNLTLWSGSKAINEDAAGNYIHYGVREFGMTAIANGISLHGGFLPYTSTFLMFVEYARNAVRMAALMKQRQVMVYTHDSIGLGEDGPTHQPVEQVASLRVTPNMSTWRPCDQVESAVAWKYGVERQDGPTALILSRQNLAQQERTEEQLANIARGGYVLKDCAGQPELIFIATGSEVELAVAAYEKLTAEGVKARVVSMSSTDAFDKQDAAYRESVLPKAVTARVAVEAGIADYWYKYVGLNGAIVGMTTFGESAPAELLFEEFGFTVDNVVAKAKELL

SEQ ID NO: 63824 - protein, 396 aa, Listeria monocytogenes str. 4b F2365
MAKKVVTDLDLKDKKVLVRVDFNVPMKDGKITNDNRIVAALPTIEYILEQNGKAILFSHLGKVKTEEDKEGKSLRPVAARLSELLGKEVKFVPTTRGPELEKAIDELKDGEVLLFENTRFEDIDGKKESKNDPELGKYWASLGDVFVNDAFGTAHRAHASNVGIASNLESAAGFLMEKEIKFIGGVVDNPARPLVAILGGAKVSDKIGVIENLLTKADKVLVGGGMTFTFMAAQGQEIGKSLLEADKVELAKGLLEKAGNKLVLPVDAVVSKEFSNDAPFHTVSADSIPADEMGLDIGQATIDLFTKELQGAKTVVWNGPMGVFELSNFAKGTIGVCEAIANLTDATTIIGGGDSAAAAMDLGFADKFTHISTGGGASLEYLEGKELPGVASISDK

SEQ ID NO: 63825 - protein, 332 aa, Bacillus cereus E33L
MNPLIFKEDCPLDLIAVGRLCVDLNANETQRPMEATRTFTKYVGGSPANIAIGATRLGLQTGFIGKVSDDQMGRFITRYLQDNNINTDQICIDRTGAVTGLAFTEIKSPEDCSILMYRDNVADLNLDPTEVSEDYIKQSKALLISGTALAKSPSREAVFLALEYARKHDVVVFFDVDYRPYTWQSEAETAVYYNLAAEKSDVIIGTREEFDMMEKLLNYEESNDQVTAERWFSHHAKIVVIKHGGDGSIAYTRDGQSHRGGIFKTKVLKTFGAGDSYASAFIYGLMQGLEIPQAMRLGGASASIVISKHSCSDAMPTRAEISAFMEIAEEIV

SEQ ID NO: 63826 - protein, 547 aa, Magnaporthe grisea 70-15
MMLWRKPPNVAGTSANALFALLLVASGGCLFGHDTGVINGVLAMPSFRDQFNPSTSQSSLIVAILSAGTFLGSLMSAPMADFIGRRKALHIAIGVFCLGVVFQVCSADIPMLLGGRFVAGIGVGLISVLVPLYQSEMAPKWIRGTMVCAYQLFITLGLLAASVINIITSDIPGPAAYRIPLGLQLVWACVLMMGLLILPETPRYLIKRGLDTEAALSLSRLRRLDITHPALIEELAEIKANHEYELALGPDTYKDVFFGSPHLGRRTLTACGLQMLQQLSGVNFIMYYGTWFFKGAMVDNPYLISCIMNIVNFISTLPGLVVVESWGRRRLLIVGAIGMSICQLSVASFTAATKHIAGSNGSSTTQNQVLVTFVAIYIFFFAASWGPVVWVVTAEIFPLKVRAKSMSVSTASNWLLNFGIAYSTPYMVDTGYASLGPLIFFVWGAFCIVGIFFVYFMVYETSKISLEQIDEMYERVTVAWKSRDFEPSWSFQQMRDLGYSDSGIPPDESNELQQTTTTQSETASSGMAPSNGDSKSIPTMGNVDFSY

SEQ ID NO: 63827 - protein, 363 aa, Oryza sativa (japonica cultivar-group)
MAAVTRAARSRALLLLPRASAAAPHFSTTASSGAAAAAAAPVKAAAAGASDASAAAAAGRGGAAGAAAEAVGPAEVWRLRGAYTLEEVDQKTREFRKAMTTPRPVAEDASEFEKFQAMIYSTAMKAPVAAIEFYMDVRHTIEDHIRGFAEPTSDKLLPDLDPLNQHIFTLVLDLNETLVYSDWLRERGWRTFKRPGVDAFIEHMGKFYEVVVYSDQMPMYVDPVLERLDTKGFITGRLSRPATKYQDGKHYRDLSKLNRNPAQVIYISSHALESCLQPENCVQIKPWKLETDDTQLLDLIPFLEYVAMVRPSDIRTVLASYQGRDVAAEFIERSKEHQSFHKENFPSIWRMQEQKQHGRIWRQ

SEQ ID NO: 63828 - protein, 505 aa, Oryza sativa (japonica cultivar-group)
MELLPWLLGFVVKYPEIMASAACFLLLFCRFRRRSKRIPTNWPVVGALPAIVANAGRVHDWVTEFLRAAAMSHVVEGPWGSPGDVLITADPANVAHMFTANFGNYPKGEEFAAMFDVLGGGIFNADGESWSFQRRKAHALLSDARFRAAVAASTSRKLGGGLVPLLDGVAASGAAVDLQDVFMRLTFDLTAMFVFGVDPGCLAADFPTVPFAAAMDDAEEVLFYRHVAPVPWLRLQSYLKIGHYKKMAKAREVLDASIAELIALRRERKAADANATGDADLLTAYLACQDEIGMDGAAFDAFLRDTTLNLMVAGRDTTSSALTWFFWLLSNHPGVEARILAELRAHPPSPTGAELKRLVYLHAALSESLRLYPPVPFEHKAAARPDTLPSGAAVGPTRRVIVSLYSMGRMEAVWGKGCEEFRPERWLTPAGRFRHERSCKFAAFNVGPRTCLGRDLAFAQMKAVVAAVVPRFRVAAAAAPPRPKLSIILHMRDGLKVKVHRRQED

SEQ ID NO: 63829 - protein, 179 aa, Yarrowia lipolytica CLIB122
MGKDTKEAKDGKDKKEKKEKSMKAREGRDNQVYSASGSRVVAGCVCVNNDSSQVLMISSAAHPNRWILPKGGVEKDELSVEGDFSESAVRETWEEAGVTGKISKYLGKYDDMRKPIEYKDSLIPKTEFHFYEMEVENLADVWPENRKRKWAGFEEAKADLTKAKRLELIEALKDSSLKR

SEQ ID NO: 63830 - protein, 261 aa, Hordeum vulgare
MSTAEATREENVYMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAAESKVFYLKMKGDYHRYLAEFKAGAERKEAAENTLVAYKSAQDIALADLPTTHPIRLGLALNFSVFYYEILNSPDRACNLAKQAFDEAIAELDSLGEESYKDSTLIMQLLRDNLTLWTSDNAEEGGDEIKEAASKPEGEGH

SEQ ID NO: 63831 - protein, 1139 aa, Triticum aestivum
MSSSRSNNRPACSRGSSARSKHSERVVAQTPVDARLHAEFEGSQRHFDYSSSVSALNRSGASTSSAVSAYIQNMQRGRYIQPFGCLLAIHPESFALLAYSENAAEILDLTPHAVPTIDQRDALAVGADVRTLFRSQSAVALHKAAVFGEVNLLNPILVHARTSGKPFYAILHRIDVGLVIDLEPVNPADVPVTAAGALKSYKLAAKAISRLQSLPSGNLSLLCDVLVREVSELTGYDRVMAYKFHEDEHGEVIAECRRSDLEPYLGLHYPATDIPQASRFLFMKNKVRMICDCAASPVKLIQDDNLSQPISLCGSTMRAPHGCHAQYMANMGSIASLVMSITINEDDDEDGDTGSDQQPKGRKLWGLVVCHHTSPRFVPFPLRYACEFLLQVFGIQLNKEVELASQAKERHILRTQTLLCDMLLRDAPVGIFTQSPNVMDLVKCDGAALCYQNQIMVLGSTPSEGEIKKIVAWLLECHDGSTGLSTDSLLEAGYPGASALGEVVCGMAAIKISSKGFIFWFRSHTAKEIKWGGAKHEPGDADDNGRRMHPRSSFRAFLEVVKWRSVPWEDVEMDAIHSLQLILRGSLQDEDANDNNARSIVEAPSDDIKKIQGLLELKIVTNEMVRLIETATAPILAVDIVGNINGWNNKVAEITGLPTTEAIGMLLVDLVEGDSVEVVKQMLNSALQGTEEQNLEIKLKTMHQQESKGPVVLMVNACCSRDLSDKVVGVCFVAQDLTGHKMVMDKYTRIQGDYVAIVKNPNELIPPIFMINDLGSCLEWNEAMQKITGIKREDAIDKLVIGELFTLHDYGCRVKDQVTLTKLSILMNTVISGQEPEKLAFGFFNTDGKYMESLLTANKRTDAEGKITGALCFLHVASPELQHALQVQKMSEQAATHSFKELTYIRQELKNPLNGMQFTRKLLEPSDLTEEQRQLFASNVLCQEQLKKILHDNDLEGIEQCYMEMNTVEFNLEEALNTVLMQGMSVSKEKQISLDRDWPVEVSSMYLYGDNLRLQQVLADYLACTLQFTRPAEGPIVLQVIPKKEHIGSGMQIAHLEFRLVHPAPGVPEALIQEMFRHGPGVSREGLGLHISQKLVKTMSGTVQYLREAESSSFIVLVEFPVAQLNSKRSRPSTSKSNF

SEQ ID NO: 63832 - protein, 250 aa, Desulfovibrio vulgaris subsp. vulgaris str. Hildenborough
MARLILLRHGQSAWNLENRFTGWTDVDLSPAGEAEALAAARLIRDEGLDFSVCHTSMLTRAIRTLHLVQQELDRLWTPVRKHWRLNERHYGALQGLDKRETAARHGEDQVFVWRRSYDVPPPVIAPDDPKHPVHDPRYADVPPDVLPCGESLEATVARVLPYWYDAIAPDLMAGRDVLVAAHGNSLRALVMHLDGLDREDVSRLDIPTGLPRLYELDAALRPVSYRYLGDPAEAEERARAVAAQGRLEKN

SEQ ID NO: 63833 - protein, 478 aa, Arabidopsis thaliana
MASTAATAALSIIKSTGGAAVTRSSRASFGHIPSTSVSARRLGFSAVVDSRFSVHVASKVHSVRGKGARGVITMAKKSVGDLNSVDLKGKKVFVRADLNVPLDDNQNITDDTRIRAAIPTIKFLIENGAKVILSTHLGRPKGVTPKFSLAPLVPRLSELLGIEVVKADDCIGPEVETLVASLPEGGVLLLENVRFYKEEEKNEPDFAKKLASLADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLSVGSSLVEEDKLELATTLLAKAKARGVSLLLPTDVVIADKFAPDANSKIVPASAIPDGWMGLDIGPDSVKTFNEALDTTQTVIWNGPMGVFEFEKFAKGTEAVANKLAELSKKGVTTIIGGGDSVAAVEKVGVAGVMSHISTGGGASLELLEGKVLPGVVALDEATPVTV

SEQ ID NO: 63834 - protein, 545 aa, Helicobacter pylori J99
MLTQLKTYPKLLKHYEEIKEVHMRDWFSKDKERASRYFVQLESLSLDYSKNRLNDTTLKLLFELAKDCSLKEKIEAMFKGEKINTTEKRAVLHTALRSLNDAEILLDNMEVLKSVRSVLKRMRAFSDSVRSGKRLGYTNQVITDIVNIGIGGSDLGALMVCTALKRYGHPRLKMHFVSNVDGTQILDVLEKINPASTLFIVASKTFSTQETLTNALTARKWFVERSGDEKHIAKHFVAVSTNKEAVQQFGIDEHNMFEFWDFVGGRYSLWSAIGLSIMIYLGKKNFNALLKGAYLMDEHFRNAPFESNLPVLMGLIGVWYINFFQSKSHLIAPYDQYLRHFPKFIQQLDMESNGKRISKKGEIIPYDTCPVVWGDMGINAQHAFFQLLHQGTHLIPIDFIASLDKKPNAKGHHEILFSNVLAQAQAFMKGKSYEEALGELLSKGLDKDEAKDLAHHRVFFGNRPSNILLLEKISPSNIGALVALYEHKVFVQGVIWDINSFDQWGVELGKELAVPILQELEGHKSNAYFDSSTRHLIELYKNYNQ

SEQ ID NO: 63835 - protein, 264 aa, Pseudomonas fluorescens PfO-1
MNSPKSQGTALVTGASSGIGAVYAERLAARGFDLLLVARDQERLESAASKLRDAHGVQVEVLKADLTQKGEVLKLEQRLRSDSSISLLVNNAGVAVNGLLANADPETLEQLIQLNVTTLTRLAAAAASAFTRAGRGTIINIASVVALFPERFNATYSASKAYVLSLTQSLNTELEGTGVKVQAVLPGVTRTEIWERSGFDASGIPAEMVMEAGEMVDAALSGLDQGELVTIPSLPDAGEWQAFVAARHVMAPNLSHSSAASRYK

SEQ ID NO: 63836 - protein, 539 aa, Geobacillus kaustophilus HTA426
MSEKRALSLYPEHISFYMDIPDKTVCDVLHERAAEFGSQPALTFYDKTITYAELEAAVNRFTSSLQALGVQKGDRVAIMLPNCPQYVIAYYGILQAGAIVTQVNPMLVERELAYLLKDSGAETIVIYEPLYPRLAAVRGETAVKQAITVSFGAPPSVSLAEGDVTFDEFLAAGSGAVRPVSIESTHDVAVLQYTGGTTGRSKGAMLTHRNIFANVLQCAEFFKGTFEFGKERYLTVIPLFHVFAMTSGMNLAIYQGAENILLPRFELKEVLETIRDKQPTVFPGVPTMYVAITNTPGVEQYGISSIKTCNSGSAPMPLELMRDFEAKTGAVILEGYGLSEASPVTHCNPPFAARKPGTVGIGMPLTEYKVVDVATGTQELPPGEVGELIIRGPQVMKGYWNMPEETAAALRDGWLYTGDLASIDEEGYVTIVDRKKDLIIAGGYNIYPREIEEVLYEHPAVKEAAAVGVPDPYRGETVKAIIVLKDGMQASEEEILAHCRKNLAAYKVPRIVEFRAELPKTNVGKILRRALREEASHSQ

SEQ ID NO: 63837 - protein, 207 aa, Mycobacterium avium subsp. paratuberculosis K-10
MTAVQAARRARIERRTKESDIVIELDLDGTGRVDVETGVPFYDHMLTALGSHASFDLTVRTTGDVEIEAHHTIEDTAIALGAALGQALGDKRGIRRFGDAFIPMDETLAHAAVDVSGRPYCVHSGEPDHLQHSTIAGSSVPYHTVINRHVFESLAMNARIALHVRVLYGRDPHHITEAQYKAVARALRQAVEPDPRVSDVPSTKGVL

SEQ ID NO: 63838 - protein, 463 aa, Listeria monocytogenes str. 4b F2365
MTKVNSFFRKKSFHNPATDKHHLNKTLGAFDLTMLGVGAVVGGGIFILPGQVASVIAGPGIIISFIIAGIACCLAALCYSEFASKLPVAGSAYTYSYHVFGEGVAWILGWSLILEYGLAVAAIASGWSSYMKSLLAGFDLHIPTVISSAYDPSAGTYFDLLAFVVVMVIGILLSFGIRESTRVNNIMVLVKIAVVVLFILVGAFYVKPDNWTPFLPFGVQGVITGASTVFFAYIGFDAVSSAAEEVKNPQKNMPIGIISSLAICTLLYILLSAVLTGVVPYTDLVDVSAPVAFALQAINQNWIAGLLSVGAIVGMTTVVLVMSYGGTRLLFAMGRDGLLPKSFSKISKNDTPVRNTMIFATVMGLIASTVPMADLAQLINIGTLFAFAMVSIGIFFLRRNPDLNQKGFRTPFYPVVPALSFLLCVYLMINLSKTTWIAFGIWFVIGILVYTFYGRKHSALRIK

SEQ ID NO: 63839 - protein, 785 aa, Yarrowia lipolytica CLIB122
MVDDVFKRNRSTSASAALTLGPGDDTTTAKDSGKEITFPQRLKSFFKFNNTNSPVANSGNGPDEEIAFPKYDPTPTIHVQGVPGASNTSPPPDDKETKSSFKQRFLRGRSPSTPSTKDTNTPDQHNQHHGSVPTVPDIPSEFAPKLHYPKHLAAHTPEDEAVDPMDSTKPVPVVDEWPVQPAHMSGSASPNSPNFHSPPSSPSPNNNSNNYNYNNNNSSNYGGLGVPGQHPRKNIRRVASEPNVKNAISNSHSHSGGHHQQHLPIIPAGSEDVRLQDLVREEQQHPSDPITDRDRTHSAPLNDGINHGNGSHGQNSRSGSATPQSRSRTNSKSFARTYSSNSIKVCDVEVGPSSFEKIRLLGRGDVGKVYLVKEKKSTKLYAMKVLSKKEMIKRNKIKRAFAEQEILATSNHPFIVTLYHSFQSNDYLYLCMEYCMGGEFFRALQTRERKCVAEADAQFYAAEVTAALEYLHLMGYIYRDLKPENILLHQSGHIMLSDFDLSKQSEQLGAPTIQSSTNVPQLDTKSCIANFRTNSFVGTEEYIAPEVIRGNGHTSAVDWWTLGILIYEMLFGMTPFKGKNRNLTFSNVLKQEVNFPSGSGYQSISSSCKNLIRKLLIKDEHKRMGSKAGASDIKNHPFFKNTQWALLRNQTPPLVPVPSRGADAVNFRTMKDSSSVDFVTDKKQDKSISSVLSVNTDRSSTNSVAGPRSYGREGDYDPFQNFNSVTLHHVGADSEGEDDDGDITITNQDIPHTFQPNPAKSPNMKNSSGFFFGGQKDKLWKTNRT

SEQ ID NO: 63840 - protein, 566 aa, Cryptococcus neoformans var. neoformans JEC21
MRPPHHLPVILHNNNRGLLIIQPSTLDVLQLSGDGPPPKRLLTCPLTNFLKAYLAPAPENSARRLDLHCLGGGMGTQLKLVKLHVLVEPINIPETNEWIRMLMEAAYGSIKPFRNVLILVNPVGGKGKAKDIVQDTVIPILEAAGTTVTVKETTHRLHAEEIASSMDLIYDVIVTASGDGLVYEVVNGLASRSDARKALLTPIAPIPTGSANAVCTNLFGVKDTFNIPLAVLNIIKGCNLPIDLCSVLILPSMTRRFAFLSQAIGLMVDLDIGTENLRWMGDTRFLVGFLKGIANNKGARCRLRLKVVEDDKQNMAKKAKERTQQGTTEGAVTPLINGTRNMSVDGETPVSTNDNIIGEHEPSAVIGEPISSASHTPPKPANANYVPDHGPIPDALPLKHDETWLTIESLPKKSSIKPKKSIQSLKALRKASAQNKWVDGQEILYFYAGMMRWVARDLMQWPVSIPGDGLIDVVVQSVVPRLTMANAIAGAEKGETYWMDCQYYYKVSQFIAENLDTENQPLFTIDGEAFPFESFHVEVHTRVANLLSLNGDFFTSDFLKKPTGKS

SEQ ID NO: 63841 - protein, 834 aa, Pseudomonas sp. G-179
MTAELTRRDVLKAQAAAIAASTAGIAMPAAAQSVPGGVAALEIKWSKAPCRFCGTGCGVMVGVKENHVVATHGDMEAEVNRGLNCVKGYFLSKIMYGKDRLTTPLLRKRNGVFDKEGEFEPVTWEEAFDIMAEKAKKTLKEKGPTALGMFGSGQWTIFEGYAATKLMRAGFRSNNLDPNARHCMASAAYGFMRTFGMDEPMGCYDDFEHADAFVLWGSNMAEMHPILWTRLADRRLGHEHVKVSVLSTFTHRSMDLADIPLVFKPGTDLAILNYIANHIIQTGRVNQEFIDKNTKFMQATTDIGYGLRAEHPLEVKATGAAKAAEMTPIDFEAFKKHVSEYTLEKVAELAGVDKGFLEQLAELYADPKVKVMSLWTMGFNQHVRGVWANQMVYNIHLLTGKISEPGNSPFSLTGQPSACGTAREVGTFAHRLPADMTVTNPEHRKHAEELWNIPHGIIPEKPGYHAVQQDRMLHDGKLNFYWVQVNNNMQAAANNSNEAYIGYRNPDNFIVVSDAYPTVTAMTADLILPAAMWVEKEGAYGNAERRTHVWHQLVNAPGEARSDLWQLVEFSKRFTTDEVWPQDILDQNPEYKGKTLYDVLFQNGNVDKFPVSEISSDYENREAKAFGFYLQKGLFEEYASFGRGHGHDLGPYDLYHQVRGLRWPVVNNQETKWRYREGYDPYVKEGEGVKFYGQNDGRAVILAAPYEPPAESPDDEFGFWLVTGRVLEHWHSGSMTMRVPELYKAFPGARCFMNGDDARRLGINQGGQVKIQSRRGEIISRVDIRGRNRMPHGVIFVPWFDASQLINKVTLDATDPISKQTDFKKCAVKILPVA

SEQ ID NO: 63842 - protein, 389 aa, Oryza sativa
MPATDSSSAAAPLTSFGRSFLSHRRDQIPPPPPDHHSHSHTQHPSSSDLEIDAFHRHAADLLHDLLSDSNSDPSAPDLLSLAWTRRLLDSFLICLEEFRAILFALADSQPLSRPPLDRLLLDFLDRAVKALDLCNALRDGLDLIRQWRKHLAIAAAALATAPAAQRGEAQIRRARKALTDLTILMLDDKDAGGVVGQRNRSFGSASTTRTPFPTATATTAGAAAAGAPGPALAPISGLASAVYAMGAVLFVVTWALVAAIPCQDRGLQAHLTAVPRTFPWAGPLITLFDRILDESKKKDRKHSCGLLKEIHQIERCSRQLMEVTDAAEFPLADDKDSEVQEATQELVQVCGSLKDGLDPLERQVREMFHRVVRTRTEILDYLSRPHNAG

SEQ ID NO: 63843 - protein, 332 aa, Ostreococcus tauri
MNAEKRAEIYTYEAPWMVYACNWSVRQDKRFRLALGSFVEEYSNKVEIITLDEETGEFPKEAKCSFTHPYPCTKIMFIPDKECTKEDLLATTGDYLRIWQVKDEDTVQMKSLLNNNKSSEFCAPLTSFDWNETKLQRVGTSSIDTTCTIWDIERECVDTQLIAHDKEVYDIAWGGPEVFASVSADGSVRVFDLRDKDHSTIIYESQTPDTPLLRLGWNKQDPRYMAAICMDNPVVVLDIRFPTLPVAELQSHRASVNTLAWAPHSSSHMCTAGDDSQALIWDLSSMNQPPEGGLDPILAYSAGAEINQLQWSATQPDWISIAFRNSLQILRV

SEQ ID NO: 63844 - protein, 115 aa, Mycobacterium avium subsp. paratuberculosis K-10
MTLDPQIAARLKRNADGLVTAVVQERGSKDVLMVAWMDDAALARTLETREATYYSRSRGQQWVKGETSGHTQYVHSVRLDCDGDTVLLTVDQVGGACHTGDHSCFDADVLLHPQD

SEQ ID NO: 63845 - protein, 502 aa, Ureaplasma parvum serovar 3 str. ATCC 700970
MKLNKKIGLIIIDGLGIGKEDNTNAVHLANPPTLNYLINNFPTLQISAAQQNIGLLENQAGNSEIGHLTIGAGRIILNDNANINNYMKSVDYESAVLSNIKNEIVHIVGMYSNGLVHSNYEHIHWIIKQIIKNNNQVVLHLISDGRDDYPYGFAQFIEQINALKKQYNIIVKSLSGRYFAMDRDQRWERTQKAFNAMFVKQDKICEKTFLEVAQSIANSYKSDEFVQPVVFNDDEKYNLKPHQKVILANYRSDRMRQLAHLLKPNKKFHYNNPFLVQDVNLITLVPFPDVDAIALFEKQNLNNTLGDVFNKHQIKEARIAETEKYAHISFFFDGGVNKYYSTKTQYLIPSQKVATYDLCPQMSAHLITKTIIDHYFDHDVFIVNYANPDMVGHSGNMQQTIEAILSVDHEIRKLYDFFEKNNGVLMITGDHGNAEMMLDDQKQVITSHSVNDVWFIITDNKVILNSTQKFSLANIAPTILEYLNIAQPIQMTATSMIKKICE

SEQ ID NO: 63846 - protein, 440 aa, Ureaplasma parvum serovar 3 str. ATCC 700970 [sequence omitted]

SEQ ID NO: 63847 - protein, 118 aa, Geobacter metallireducens GS-15
MNTIDMLELEQMKKNIPPFKPGDTVKVHVKIVEGDKSRIQAFQGVVIARQNGGIRESFTVRKISNGIGVERVFPLHSPSLDAIEVITRGHVRRAKLYYLRKLRGKAARIREKKYVAAH

SEQ ID NO: 63848 - protein, 321 aa, Ureaplasma parvum serovar 3 str. ATCC 700970
MNQVNFLNLDKNILIITSGGDAPGMNASLISLIHRLMNNNFNVFIGIEGLLGLYNNLIEPIKDKRVFDVYFNEQGTVIKTSRFIKLDINDKKTQIIKDNLLSHNIQKIIILGGQGSMQAGLVLTKMGFEVFGILHTIDNDFSETQMCIGALSAASFNQKLLKCLNYTAKAHCAFNLVELMGRECSWLVNNSVGKLKPILMLTNQDNKYTVDEVIDLIKDKINSIKEYDPLIIVQELIYDQKWYELLVKTFEQKLHKSLRITILNYLQRGAPVSDFDLQLAKDSANVLVDFIVNQNDIKNTNNMYVVINKFDNKLEVIKFNK

SEQ ID NO: 63849 - protein, 246 aa, Silicibacter sp. TM1040
MARKLAAGNWKMNGTGEHLAELENLAQGDLPEGVDVLICPPATLISRAADRAGDIAIGGQDCHAKTSGAHTGDLSADMLRDAGATYVIIGHSERRADHGEGDADVRAKTEAAQAAGLVAVVCIGETLEEREAGTTLEVVGAQLAGSLPDGVTAENTVVAYEPVWAIGTGKVPTLDQIAEVHDALRADLVARFGAAGKDLPLLYGGSVKPGNAAEIFGVSNVDGALVGGASLKAADFGPIIAALAAS

SEQ ID NO: 63850 - protein, 132 aa, Zea mays
  misc_feature (77)..(77): Xaa can be any naturally occurring amino acid
PVHAAQGWRRSPWQRPPSLAAPAAKRRPAAGVTYVEGMNAYSGLKGLNKVTMLGVRKTADYSFAKVVASLSPAGRKXAGGAFGAQMNAAAEIFRIAATMSGLVLVGVAVGFVLLRVEAAVEEGRVGRSPPAS

SEQ ID NO: 63851 - protein, 204 aa, Brassica napus
MESDRPPHFKVILGSSSIARQSILTDMGYQFTLMSADIDEKSIRKEKPEELVLALAEAKAEAIVQRIPDDVEDKPTLLVTCDQVVVYEDAVREKPSSVVEAREYIRSYSKGHTATVSSVVVTNLNTGFRKGGVDRVEIYFNEISEEIIEKLIEEGMVLRVAGALLIEHPLILPCVKEVVGTTDSVMGLPKPLTEKLMKEVLATT

SEQ ID NO: 63852 - protein, 664 aa, Photorhabdus luminescens subsp. laumondii TTO1
MTTRKTLANAIRFLSMDAVQKAKSGHPGAPMGMADIAEVLWRDYLNHNPTDPHWVDRDRFVLSNGHGSMLIYSLLHLTGYDVSVDDLKNFRQLHSKTPGHPEYGYTPGVETTTGPLGQGIANAVGFAIAERTLAAQFNRPGHEIVDHNTYVFMGDGCMMEGISHEVCSLAGTLKLGKLVAFYDDNGISIDGHVEGWFTDDTASRFEAYGWHVIRGVDGHNADSVKAAIEEARKVTDKPSLLMCKTIIGFGAPTKAGTHDSHGAPLGDAEIAATREALGWNYPAFEIPAEIYSEWDAKEAGNVKQAAWNEKFAAYEKAYPELAAEFKRRTSGELPANWEVESKAFIEQLQKNPANIASRKASQNALEAFGKVLPEFMGGSADLAPSNLTMWSGSNPLNEDQAGNYIHYGVREFGMSAIMNGIALHGGFVPYGATFLMFVEYARNAVRMAALMKIRSIFVYTHDSIGLGEDGPTHQPVEQLASLRVTPNLSTWRPCDQVESAVAWKYAIDRKAGPSALIFSRQNLAQQERTAEQLANIEKGAYILKDCQGQPELILIATGSEIELAVSAYHQLTEEGRQVRVVSMPSTDAFDKQDAAYREAVLPAAVSARVAVEAGIADYWFKYVGMNGAIVGMDTFGESAPADQLFKTFGFTVENVVAKAKALLK

SEQ ID NO: 63853 - protein, 530 aa, Lactococcus lactis subsp. lactis Il1403
MCGFLFMETSDLTIEEFKSNLELIEHRGPDDQQHVRDTLGNDFGFCRLSIMDLSDLGRQPFGLNGKRVMCNGEIYNFLSLRKFLETKGYKFTGDSDCEVLLPLFETTGIETMVKMLDAEFAFVLVDENTAEIFAARDPFGIRPLFYGYNKVTGKISFSSEAKALISTCNDVTPFPPGYYYANGEFHVFNDIAEVSTIVEEPLAEISGHIRRKLERAVKKRLHADAPMGYLLSGGLDSSLVCAIAAKELESPIKTFAIGMETDPIDLKYAREVADFLRTDHTEILMTKEDVLSAVREVIWHLETWDITTIRASIGMYLICKYIHENTELKVLMTGEVSDEMFGYKYTDFAPSAGAFQKEAQKRVHELYMYDVLRADRCLAAHSLEARVPFADLDFAAYVMSINPSRKLNTYGKGKYLLRHAFEGTELLPDEILFREKAAFSDAVGHSMVDYLKEFADEKYSDEDLAKASEKYPKHTPFTKESLMYREIFEEFYPGYEDWILDFWMPNRDWVGAEVTDPSARVLSNYGDSGK

SEQ ID NO: 63854 - protein, 444 aa, Oenococcus oeni PSU-1
MKTDQKQDNQQKSLDEVNGSIKVPKNAGFWRTLLAYTGPGSLIAVGYMDPGNWITSIGGGAQFKYALLSVILLSSLIAMLLQSMAAKLGIVTGKDLAQLTRDRTSKRVGFVLWIITELAIMATDVAEIIGSGIAIELLFGIPLIVGILITSADVLILLLLMRSGFRKIEAIVATLVAVVLFVFSYEVILSQPNIPEVLKGYLPTYKIVTNTPMLYLALGIVGATIMPHDLYLGSSISQTRRVDRSDKNSVKNTIRFTTIDSNIQLTIAFVVNCLLLVLGAALFYGTNSSLGRFVDLFRALNNSQVVGAIASPVLSMLFAIALLASGQSSTITGTLSGQIIMEGFIHLHMPLWIQRLLTRLISVTPVLIFAIIYHGNEAKIEQLLTFSQVFLSIALPFAVVPLVIFTNDEKLMGEFKNHAWVKWTSWLITAVLIVLNIYLILQII

SEQ ID NO: 63855 - protein, 198 aa, Oenococcus oeni PSU-1
MKITNPKLIISAVSKKQYPAGNLSEIAFVGRSNVGKSSLINTLIERNGLAHTSGQPGKTQTLNFYNLDEKLFFVDVPGYGYAKVSKAQREQFGSMVEEYLSSRDQLKGVISLIDARHEPTEDDKLMYNWLEYYQVPILIVATKADKVASGKFNAVESQIKKTLKFNSTTSSLILFSAIKKFGAKEIWNWIKGQAELQE

SEQ ID NO: 63856 - protein, 1432 aa, Shewanella sp. MR-4
MIELRIDNQIVTAEPNDNLLRAASKAGIAIPSLCDPTDATRQLGAAPHADKQDCNLCLVQIENTDASLRCVKACETPAEAGMKVITQSAYLTKQRQAALSTILSDHFADCEAPCQQACPAGVDVQSYLYHIAQGDHSQAIKVIKDTLPLPLSIGRVCPAFCETECRRGLVDDPIAIRQLKRHAADLDLADDEQGGSYQPPRLADTGKKIAIIGAGPAGLSAGYYLSNQGHSVEIFEAMPKAGGWLRYGIPEYRLPKAILDKEIELLCRNGLTIHTDTRLGHEIHLAQLVADFDAVCLAIGAQKAVPMNYKGSELAGCYLGVGFLKEHCLDKQLKLGKKVAVIGGGNTAIDCARTAVREGCDVTLIYRRTRAEMPAEAYEVHEAEVEGVKFHFLTNPIENHSDANGQVEAVTFSKMALGEADASGRRAPVDTGETFTEAFDTVIAAVSQAPDLSFMQDPMGQLSHGELALSRWNTLIGCEQTMSSGVEKLFVMGDARRGPATAVAAIGDGRKAAIAIDKMLKIGLSCDLHAHEFNSVKTIPSALIPNALKQTETSSKAGSTHYPHTPRQPRLKMPELTALQRLLNYSEVELGFPADAAMQEAARCLECACQANTDCKLRDYATDYGVEAKSLATENARHFSVDKSAPFIQFDANRCISCGKCVDVCQQQSGHCAIQFSQDSYQALPQEMTQHMERRAPRVGFSASMADSLCVQCGNCVQVCPTGALVDARDKRQGDSTELKTASTICTYCGVGCRLDLKIDSNANRIRHIEGNKDSVVNQGMLCVKGRFGFDFIHSDKRLTTPLIRKNGELQPSSWPEAIAYVAKRLTEIKQKDGSNALASLASAKATNEDNFVLQKFVRSVLGTNNIDHCARLCHSSTVTGLQQSIGSGAMTNDIPSIKDSDVIFILGSDTTCAHPIIASKIQQAVMQHGARLLVADPKRVGIAEKAELYVAHRPGTDVMLLNAIMAEIIRNDWQDKDYIAERTEGIVALYAELSKEDYSLENAALITGVKAEDIARLARTIGTAQKTAVYYAMGITQHTTGHDNVTAISNLQLLCGNIGVSGAGINPLRGQSNVQGACDMGALPNYFTGYQKVTDIHARMRFEDHWQTPLSEEIGVTATHMMHDIAKGNIKALYVMGENPVLSDPDQAHVLNALSKVEFLVVQDIFLTETAELAHVVLPAAAFVEKRGHFTNTERRVQRLEQALASPGEALPDWQIVQAVANAMGANWDYANEEAIWCEINELTPQYRGIRWDRLSANAEGQISQGIQWPCPDETHPGTPIMHQSQFTRGLGLFTPVSYRLPAEMPCNEYPLTLSTGRLLEQFHTGTLTRKTPGLDLLGAPKVMISVYDAEQLGIHNGDKLRLTTRRGEIEIDAFVTKRAQAGVLFLPFHFVEAAANKLTINALDPVAYIPEYKVCAVRAEKVTTSVSEPA

SEQ ID NO: 63857 - protein, 337 aa, Triticum aestivum
  misc_feature (206)..(206): Xaa can be any naturally occurring amino acid
  misc_feature (274)..(274): Xaa can be any naturally occurring amino acid
  misc_feature (289)..(289): Xaa can be any naturally occurring amino acid
  misc_feature (302)..(302): Xaa can be any naturally occurring amino acid
  misc_feature (321)..(321): Xaa can be any naturally occurring amino acid
  misc_feature (328)..(328): Xaa can be any naturally occurring amino acid
  misc_feature (330)..(330): Xaa can be any naturally occurring amino acid
MEDKRPKPIRCRAAVCRAAGEPLAVEEVVVDPPKAHELRLKIVCTSLCHSDVTFWRMKDFPGVFPRIFGHEAFGVVESTGEHVEGFAAGDAVVPTFLAQCSECADCRSSRSNVCSKYRFAVRPGMPRDDTTRFRDGDGNPIHHLFGVSSFSEYTVVDVTQVVKVDPAVPPATACLLSCGATTGVGAAWKLAKVEPGSSVAIFGLGXVGLAVAEGARICGASKIIGVDLNPDKEELGKKFGVTHFINPKELGEKTVSQVIIEMTDGGADYCFECXGLAALMNDAFQSSRXGWGKTIILRLGDXGRPLNNIFAGDSPTEMLMXSPPEGVXPXKDIADST

SEQ ID NO: 63858 - protein, 406 aa, Parvularcula bermudensis HTCC2503
MADGTRTVVVEDSASDASSDRPFTINFGPQHPAAHGVLRLVLELDGEIVERVDPHIGLLHRGTEKLIEYKTYLQAIPYFDRLDYVAPMNQEHAFVLAAEKLLELDVPRRAKIIRTLYCEIGRQLSHLLNITTQAMDVGALTPPLWGFEEREKLMVFYERACGARLHAAYFRVGGVHQDLPQDLLDDIGEWCETFPQVLDDIEGLITDNRIFKQRNVDIGVVSREEAFAWGFSGVMLRGSGVPWDLRKSQPYEIYDELDFDIAIGKNGDCYDRYLVRIEEMKQSLKIMKQCLALIEPGPIMTEDPRIGPPRRGEMKTSMEALINHFKLYTEGPKVPAGEAYAAVEAPKGEFGVYLVSQGTNKPYRCKIRAPGYAHLQAMDWMNRGHMLADVSAIIGTLDIVFGEVDR

SEQ ID NO: 63859 - protein, 200 aa, Parvularcula bermudensis HTCC2503
MSMDDLIELKDHIAAWGGEAIIAQEVAFGELSVTVAAGKIVDTLKFLRDDPICRFVQLIDLCGVDYPERRKRFEVVYHLLSLHNNTRIRIKVPVGQSDSCPSVRSIFPNADWYEREAFDMYGIVFDGHPDLRRILTDYGFEGYPLRKDFPLTGFTEVRWDDEQSRVVYEPVELAQEFRNFDTLSPWRGSDYVLPGDEKAD

SEQ ID NO: 63860 - protein, 542 aa, Rhizobium tropici
MIKTVPTTPYADQKPGTSGLRKKVPVFQQPNYAENFIQSIFDSLEGYQGKCLVIGGDGRYYNREVIQKAIKMAAANGFGKVMVGKGGILSTPAASNIIRKYKAFGGIILSASHNPGGPTEDFGIKYNISNGGPAPEKITDAIYERSKVIDSYKIADFPDINLDRIAREDVGGMIVSVIDPVEDYAALMEELFDFGAIRNLISLGFRICFDAMSAVTGPYAKEIFEIRLGAPDGSVRNFLPLPDFGGHHPDPNLVYCKELYDDMMSDDAPDFGAASDGDGDRNLIIGKGIYVTPSDSLAILAANANLAPGYSHGIAGIARSMPTSGAADRVAEKRGVGIYETPTGWKFFGNLLDAGMATICGEESSGTGSNHVREKDGLWAVLLWLNILAVRGESVIDIVTQHWATYGRNYYSRHDYEGVDTDAANGLIAALREKLPTLPGTKIGDLTVSAADDFAYHDPVDKSVSQHQGIRILFEGGSRVVFRLSGTGTTGATLRVYIERYEPDPTRHNIETQEALADLITAAQDIADIKGRTGRDAPTVIT

SEQ ID NO: 63861 - protein, 337 aa, Oryza sativa
MVPKVGINGFGRIGRIVFRNATQAGTVDVVAVNDPFIEVHYAAYMLRYDSTHGQFKGTIEINGTEGLIVNGKKIRFYAERDPAAIPWGKEGADYVVESTGVFTTTDKASAHIKGGAKKVIISAPSADAPMFVMGVNNDSYTKDVNVLSNASCTTNCLAPLAKVINDKYGLVEGLMTTVHSYTATQKTVDGPSGKDWRGGRTAAQNIIPSSTGAAKAVGKVIPSLNGKLTGMSMRVPTANVSVVDLTCRIEKGATYEEIKATIKAASENELKGILGYTEDDIVSTDLNGDDHSSIFDAKAGIALNANFIKLVSWYDNEWGYSHRVVDLISYIAKVDGQ

SEQ ID NO: 63862 - protein, 656 aa, Rhizobium tropici
MSEPTTRSLGATLTDSGVEFAVYSRHAEQIDLCLLDAEGRKEIARLPIARDGDEHRLFVRDAGEGTRYGLRAHGSYDPDQGLWFDPSKLLVDPYTREIDRPFRYDPRLGIFGADTQDLMPKAIVSRDIAVKRAKPLFQPGGLIYEIAVKPFTMLHPDVPAKQRGTLGALAHPFVIAHLKRLQVDAIELMPITAWIDERHLPPLGLTNGWGYNPVAFMALDPRLVPGGMKELRETVAALHAEGIAVILDLVFNHTGESDRQGPTLSLRGLDNPTYFRHLPDQPGTLVNDTGTGNTVACDQPVTRKLIIDSLSHFVRNTGIDGFRFDLATVLGRNGKGFDPESMTLRTMLADEVLQDRIMIAEPWDIGPGGYQLGNFPAPFLEWNDRARDDLRRFWRGDAGIGDLATILAGSSSIFGRDGRTQTRCVNFLAAHDGFTLMDLVSYENKHNEANGENNRDGHNENSSWNNGIEGKTDDQAIQSKRRADIEAMLSTLFAARGTIMLTAGDERGRSQQGNNNAYCQDNAITWMDWNLLDEQLIGHTAWLAGLHRRFTAFADMNFFRGDGDVLWFSSARTPMTVPDWEAPGAAVLGMALQTGDRATHRSTRLALVFNRAADERSVTLPVSESGGWSRLTVAGETPAGEQIAIPARSVAFFVEN

SEQ ID NO: 63863 - protein, 325 aa, Oryza sativa
NEVAMITLPVAAHAPSPWLPPSILRLRSTSTTTTIPAAAARSSAPHPLPDELHLVADIRSPHNHIRVADVSRTASGAGHPLAGARLLLLDAPGNIHSLSFPRSPCPLTSTYLDVFATLPPLLPASASSLAVLGFGAGSAARAVLHFFPDISVHGWEIDPAVVSASRDFFGLAELEAEHAARLSIHVGDALEASADAVAVPGGFGGVLVDLFAGGSVLPELQEMDTWRRIGRRMVAPGGRVMVNCGGPCVEAEEEGRGGEAVKDATLRALTAAFGHGMVSVMDMDESWVAMTGPAVSSAPEEAAAWKAKLPPELRRYVDMWRPCLL

SEQ ID NO: 63864 - protein, 521 aa, Ureaplasma parvum serovar 3 str. ATCC 700970
MLKQKKFFISTPIYYSSGNPHIGHAYTTIIADVLARYKRLFGYDVFFLTGMDEHGQKIQQKAFEENISPKALVDRNSIIFLNLWKRLNISFSKFIRTTQMDHEESVQKVFSYLYKQGKIYLGQWTGYYCVSCEENYNPAEIIKSQDNIMLCRMGHKLETKSEESYFYKMSDQAPFLKTYYQNHPNFIIPNERANEMVNNFLNNLEDLSISRTTFDWGIPIAENPKHVIYVWLDALMNYLTATGYLSNNEELFQKYWCDNETEIVHLLSKEIARFHCIYWPIFLNDLQIRFPSTILSHGWIITKEGKMSKSLGNVIDPNVLIDTYGVDALRYYLMADLSLFRDAIFSEDNLIETYNTQLANSYGNMISRTLGMLKKYRNNIVPKYVGCVLKNDEKLENLINKNIELVQENINKYSIDKALNCIQEILVEANKYIEDNKPWELAKNQQEQELDSLLVHLVKVIQVTTTLLSPILIEGSKKAVEQLNFDESFLTLASLASYDIFNYHKVNDSKPIFARIIVEKQ

SEQ ID NO: 63865 - protein, 339 aa, Photorhabdus luminescens subsp. laumondii TTO1
MTIKVAINGFGRIGRSILRALYESGRRAEIAVIAVNELADAEGIAHLLKYDSSHGRFAWDVRLNNDVLQVGDDNIRLFHQSDISMLPWQELGIDIVLDCSGIYGSRADGEAHLASGAKKVLFAHPGGNDLDATVVYGVNQHLLTAEDRIVSNASCTTNCIIPIIKLLDDQFEIESGTVTTIHASMNDQPVIDAYHKDLRRTRAASQSIIPVDTKLAAGITRIFPKFCDRFEAISVRVPTINVTAIDLSVTVKSSVTVNKINELMQKSAATSFRGIVDYTELPLVSTDFNHDPHSAIVDGTQTRVSGQHLIKTLVWCDNEWGFANRMLDTTLAMAAMGFK

SEQ ID NO: 63866 - protein, 387 aa, Photorhabdus luminescens subsp. laumondii TTO1
MSVIKMTDLDLAGKRILIRADLNVPVKDGKVTSDARIRASLPTIEAALKQGAKVMITSHLGRPTEGEYSEEFSLKPVVDYLEEKLSSPVRLEKEYLEGVDVAEGELVVLENVRFNKGEKKDDETLAKKYASLCDIYVMDAFGTAHRAQASTHGVAKFAPVACAGPLLSAELEALGKALDNPARPMVAIVGGSKVSTKLTVLDTLSKIADQLIVGGGIANTFVAAEGHNVGRSLYEDDLLPEAKKLLISCDIPVPTDVRVATEFSETAEAILKSTHDIKDDEQILDLGDESAQRLADILKNAKTILWNGPVGVFEFPNFRQGTEIVARAIADSDAFSIAGGGDTLAAIDLFGIADKISYISTGGGAFLEFVEGKKLPAVVMLEERAKQ

SEQ ID NO: 63867 - protein, 339 aa, Magnetospirillum magnetotacticum MS-1
MAIVVNFEDERSKKAKSFDALVALVKDDLEKVNRAIVDRMHSPVELIPQLAGHIIAAGGKRLRPVLTLASAKLAGHTGERHIKLAACVEFIHTATLLHDDVVDESELRRGQASANALFGNKPSVLVGDFLFSRSFELMVEDGSLSVLAILSHASSVIAEGEVLQLITANDTETSEDSYLEVIRSKTAALFAAACRIGAVVADRPKVEEEALESYGLNLGIAFQLIDDVLDYSAKQAVLGKTVGDDFREGKITLPVILAFRRGDDEERAFWRRCLEELDQADNDIGRAIKLMEKHGSLAATIARARHYGEIARDALGIFPDSAVKQAMIDVIDFCIDRAY

SEQ ID NO: 63868 - protein, 118 aa, Oryza sativa
  misc_feature (20)..(20): Xaa can be any naturally occurring amino acid
  misc_feature (48)..(48): Xaa can be any naturally occurring amino acid
  misc_feature (81)..(81): Xaa can be any naturally occurring amino acid
  misc_feature (101)..(101): Xaa can be any naturally occurring amino acid
  misc_feature (108)..(108): Xaa can be any naturally occurring amino acid
MAKKRKRSSDAEDDVDNPEXFAPIGSERILLGFKEKPDDYEESEADVXLSEGEEDVAVAAAAVPFRTKDKVLVTCSRRINXRYRHLIHNVVSLLPDANNDXKVESKHXKGNALMELVY

SEQ ID NO: 63869 - protein, 477 aa, Lactococcus lactis subsp. lactis Il1403
MENQNQVKRNLKQRHITMIALGGTIGTGLFLTSGATISQAGPWGAVLAYCFIGIMVYFVMTSLGEMATYLPTSGSFSDYGGRYVDPAFGFALGWNYWLNGAITIAVDLTTAGLITQFWFPHLPSWIFSGIATVLIFIINVMAVGAFGETEYWLSTIKVITIVLFLAIGLLTIFGVLGQGNVDVVANLSAGNHGFVGGISGFVGVLLIAGFSFQGTELLGITAGESEDPGKSIPKAMNSIFWRILLFYIFSIIVIAAIINFKDPRLLNPNSTAVMSPFTIVFKNIGFAVAASVMNAVILTSVISSANSVMYASTRILYSLGQEKGAPKFFGRTAKNGIPFYALLATTIICFIAFLTGIFGTQIYLFLVDLSSLTGFLAWLGISISHIRFRRAYIAQGKKLEDLPYKAKWFPFGPIVALLMTAAIAINLDPAMLFSEHWGEGLALYAAIPIFIILYFGYKWKYNTKIIPLEEVDLSREK

SEQ ID NO: 63870 - protein, 176 aa, Sulfitobacter sp. EE-36
MKQVQDYIRTIVDFPHEGIMFRDVTTLFADPRGFRMAIDQMLHPYAGIDIDKVVGLEARGFILGGAIAHQLSVGFVPIRKKGKLPGRTISQDYKLEYGEAIVELHDDAIKPGEKVLVVDDLLATGGTAEAGIKLIQRLGGEIVSCAFIIDLPELGGRKRLEAMGMEVNALCAFEGA

SEQ ID NO: 63871 - protein, 375 aa, Terfezia boudieri
MIWHCLKALTKTPTIKEVLLIGYYEEHIFTSFIHDWRNEFSQFTSIKYLREYQALGTAGGLYHFRDIILKGQPEQFFVINADVCCSFPLSEMLSLMQDRSAEAVILGTKVPADVASNFGCIVTDPETQQVRHYVERPESHISSLINCGVYLFSASIFKSIRSAMSAKAERLASDPYFGENEDDSSEVLRLERDILGPLSDTGSFYAYETKGFWRQIKTAGSAVPANALYLQQAWQSNSQTPGLAAPSANIVAPVFIHPTARVDPTAKLGPNVSIGPRAVIAAGAGVKDSIVLEDAEIKHDACVLWSIIGWNSKVGAWARVEGSPTAAGTHNTTVVKNGAKVQSVSVLAKDCVVRDEVRVQNCVCLPMKELKRVST

SEQ ID NO: 63872 - protein, 1064 aa, Oenococcus oeni PSU-1
MPKRADIKKILVIGSGPIIIGQAAEFDYSGTQASLSLREEGYSVVLVNSNPATIMTDTEIADQVYIEPLTLPFIKRILRKERPDALLATIGGQTALNLAKELAEDGILEELKIELLGTKLKAIEAAEDREKFKQLMEALKEPVPESRIARTLEQAVHFADQIGYPIIVRPAYTLGGTGGEIVENSEQLTEVAKNGLELSPVTQVLIEKSIAGYKEIEFEVMRDGNDNALIVASMENFDPVGIHTVDSIVVSPVQTLSDREYQMLRDAALKIIRALKIEGGVNIQLALDPDSLRYYIIEVNPRVSRSSALASKATGYPIAKMAAKIAIGLTLDEIVNPVTGTTKAEFEPALDYVAVKIPRWPFDKFAEADRELGTQMKATGEVMAIGRNFETALMKAIRSLEIGTFALDDLTYSDLSNQDLLNRLMPATDERLFMVADLLRRGITIGQIHEKSQIDEFFLDKILHLIEIEKELKMHVLDFKILKIAKENGFPDVTIARYWQLEEKELRHLRKKEDLFPVYKMVDTVAGEFSSKTPYYYSTYELENESLKEKRPSVLVVGSGPIRIGQGVEFDYATVHCVKAIQKAGYKAIVINSNPETVSTDFSVSDKLYFEPLTLEDVLNVIDLEKPIGVVVQFGGQTAINLAGRLENNGVKLLGTSLKDINRSEDREDFNQVIKKLDLSQPFGKTATTVTQALSVAEEVGYPLLIRPSYVLGGRAMEIVTNRQDLSDYMKRAVKVSLKHPVLIDSYLTGREAEIDLLSDGQTIIVPGIMEHIERAGVHSGDSMSVYPSQYLDQNVQEQMLDAAFKLAKELHTIGLMNVQFVIHEQQAYVIEVNPRASRTLPFISKATDLPLAQLATRVMLGEKLADLGFKSGLMAPKKLVYVKALVFSFNKLPKVDSSLGPEMKSTGEVMGVDRNLAKALYKAFVAAGFKVHEHGNVLFTIADRDKKEALALAKRFDELGYVLWATAGTSSFLHENHLPVRQLGKISEDQLNPVTAMRQGKLQIVINRLKTDEPLESDGRAIRAAAIENGVPLFTSLDTVAAFLQVLESRSFNVSAINKGDKS

SEQ ID NO: 63873 - protein, 199 aa, Campylobacter lari
MVKIGIGGPVGSGKTALVLNLCQALKDELSLAVITNDIYTNEDANFLIKQGVLEKERIIGVQTGGCPHTAIREDASCNLEAVELLQERFSDLDLIFIESGGDNLSMTFSPELVDFFIFVIDVAQGEKIPRKGGPAICRSDLMIINKIDLAPYVDASLKIMQEDTLKMRGDRPFIMSNLQTKEGLDEIITWIKKYTLLKD

SEQ ID NO: 63874 - protein, 988 aa, Arabidopsis thaliana
MGSVKRKSVEESSDSAPPQKVQREDDSTQIINEELVGCVHDVSFPENYVPLAPSVHNKPPAKDFPFTLDSFQSEAIKCLDNGESVMVSAHTSAGKTVVASYAIAMSLKENQRVIYTSPIKALSNQKYRDFKEEFSDVGLMTGDVTIDPNASCLVMTTEILRSMQYKGSEIMREVAWIIFDEVHYMRDSERGVVWEESIVMAPKNSRFVFLSATVPNAKEFADWVAKVHQQPCHIVYTDYRPTPLQHYVFPAGGNGLYLVVDEKSKFHEDSFQKSLNALVPTNESDKKRDNGKFQKGLVIGKLGEESDIFKLVKMIIQRQYDPVILFSFSKKECEALAMQMSKMVLNSDDEKDAVETIFASAIDMLSDDDKKLPQVSNILPILKRGIGVHHSGLLPILKEVIEILFQEGLIKCLFATETFSIGLNMPAKTVVFTNVRKFDGDKFRWLSSGEYIQMSGRAGRRGIDKRGICILMVDEKMEPAVAKSMLKGSADSLNSAFHLSYNMLLNQLRCEEGDPENLLRNSFFQFQADRAIPDLEKQIKSLEEERDSLVIEEEESLKNYYNLILQYKSLKKDIREIVFTPKYCLPFLLPNRAVCLDCTNDDEEPQSFSIEDQDTWGVIMKFNKVKSLSEDDDSRRPEDANYTVDVLTRCMVSKDGVGKKKVKAVPIKERGEPVVVTVPLSQIKSLSSAIMNIPKDLVPLEARENALKKVSELLSRHPDGIPLDPEVDMKIKSSSYKKTVRRLEALENLFEKHKIAKSPLITEKLKVLQMKEELIAKIKSLKKTVRSSTALAFKDELKARKRVLRRLGYITSDNVVELKGKVACEISSAEELTLTELMFSGIFKDAKVEELVSLLSCFVWRERLPDAAKPREELDLLFIQLQDTARRVAEVQLDCKVEIDVESFVQSFRPDIMEAVYAWAKGSKFYEVMEIARVFEGSLIRAIRRMEEVLQQLIVAAKSIGETQLEAKLEEAVSKIKRDIVFAASLYL

SEQ ID NO: 63875 - protein, 199 aa, Campylobacter lari
MVKIGIGGPVGSGKTALVLNLCQALKDELSLAVITNDIYTNEDANFLIKQGVLEKERIIGVQTGGCPHTAIREDASCNLEAVELLQERFSDLDLIFIESGGDNLSMTFSPELVDFFIFVIDVAQGEKIPRKGGPAICRSDLMIINKIDLAPYVNASLKIMQEDTLKMRGDRPFIMSNLQTKEGLDEITAWIKKYTLLKD

SEQ ID NO: 63876 - protein, 707 aa, Trichodesmium erythraeum IMS101
MYVPLWPGKPYPLGSSWNGKGTNFAIFSENATSVELCLFDKQNKETRLTLTEVSNFIWHGYLPGISPGQKYGFRVHGPYEPSQGHRFNPNKLLIDPYAKAIDGNILYGQEIFAYSWDNPEKDLVCILDDDAHLMPKSVVIDESFDWGDDKLLNIPNHESVIYEINLKGFTKLHPEIPENLRGTYAGLAHPTAIAYLQSLGITAVELMPIHHFLRYPGHLVDKELSNYWGYDSINYFAPYSGYSSSSKAGGQVREFKQMVKALHNGGIEVILDVVYNHTGEGNHLGPTLSFKGIDNAAYYRLVEDDPRYYMDFTGCGNSLNVRHPQILKLIMDSLRYWVTEMHVDGFRFDLASALARELYEVDSLAAFFDIVHQDPVISNVKLIAEPWDVGEGGYQVGNFPLLWSEWNGKYRDTVRDFWRGEKETLAEFAYRFTGSSDLYASNGRLPHASINFVTAHDGFTLNDLVSYNEKHNEANGEDNNDGEKHNRSWNSGEEGETNDPEILSLRNRQRRNFLVTLMLSQGVPMLLGGDEFGRTQKGNNNAYCQDNEISWVNWNLQVENLDLLDFTRELIYFRFQHPVFYRRKWFQGRAIHGSDVSDIGWYNPDGGEMTEEQWNIDFAKAVGIFLNGEEIPASGRRGERIIDDSFMIFFNAHYELIEFTIPPRFQDRNWVIIIDTSKSAFVENGKYYKGKILVPVMEHSIVVLQLL

SEQ ID NO: 63877 - protein, 199 aa, Campylobacter lari
MVKIGIGGPVGSGKTALVLNLCQALKDELSLAVITNDIYTNEDANFLIKQGVLEKERIIGVQTGGCPHTAIREDASCNLEAVELLQERFSDLDLIFIESGGDNLSMTFSPELVDFFIFVIDVAQGEKIPRKGGPAICRSDLMIINKIDLAPYVNASLKIMQEDTLKMRGDRPFIMSNLQTKEGLEEIIIWIKKYTLLKD

SEQ ID NO: 63878 - protein, 440 aa, Davidiella tassiana
MPISKIHSRYVYDSRGNPTVEVDIVTETGLHRAIVPSVASTGSHEACELRDGDKSKWAGKGVTKAVANVNEIIAPALIKENLDVKDQAAVDAFLNKLDGTTNKTKIGANAILGVSMAVAKAAAAEKRVPLYAHISDLSGTKKPFVLPVPFMNVVNGGSHAGGRLAFQEFMIVPSGAPSFTEAMRQGAEVYQKLKSLTKKRYGQSAGNVGDEGGVAPDIQTAEEALDLITDAIEEAGYTGQIKIAMDVASSEFYKADEKKYDLDFKNPDSDKSKWITYEQLADQYNELAAKYPIVSIEDPFAEDDWEAWSYFYKTSGSDFQIVGDDLTVTNPEFIKKAIETKACNALLLKVNQIGTITEAINAAKDSFAAGWGVMVSHRSGETEDVTIADIVVGLRAGQIKTGAPARSERLAKLNQILRIEEELGDKRLYAGDNFRTAINL

SEQ ID NO: 63879 - protein, 157 aa, Caulobacter crescentus CB15
MEDPRSIKNKGGHAVLVSQILKDKGDLVFTASPQETVGAAAALLHTRKVGAMVVVDDKEAVVGIVSERDIVRMVAKEGAAALTKPISGCMSANVVFAQPDETIDALLERMTDRRIRHLPVVQNDRLAGIISIGDLVKYKIQATQAEAEGLKAYIAAG

SEQ ID NO: 63880 - protein, 414 aa, Rhodopirellula baltica SH 1
MTLMAEPTDAANIRPPFQKSVRTSLMSVAKPESVRAVAMTAPGATEMRTYPYPTVDHDSAILKVDMSGICGTDRHIFKGEASELRGKSIFPYVGGHEVIGTIVEIGDNAAKVMDYDKQPLQVGDRVAIAVEVNCGHCFYCRKHYNNTTCLNQIQAYGLHPNADTLPYLRGGFAEYIFIRPGTHLFKVPDEMSTDVAVFVEEMAVAYHSLARAAGPFAPVNEGFGPGNSVAVLGNGPLGILHGIMASIHGAGLRIATDLSDLRLEKAKNLYADVTINAAKVSTDERIEQVKDMTEGVGPDLVIESAGEPEAFIEALRMVRKGGTVIEVGNWVDLGKPVALDVMRHISSKNLHIHSVFHCGTDWRPVLNILHQQSDRYDFPSLITHRFGLDELVDKFGTVTNFDECCKIEVIPHKS

SEQ ID NO: 63881 - protein, 264 aa, Zea mays
MVAAGRNRAERWNLAGATALVTGGSKGIGHAIVEELAGFGARVHTCSRNAAELEECRRRWDEKGLQVTVSACDVSARADRERLVATVGATFGGRLDILVNNAGQSLFKRTAECTGEDYSRIMATNLESCFHLSQFVHPFLRLVSGRGGGSVVHVFSDAGFVGLPALAVYSMSKGALNQLTRSLAAEWAGDGIRVNCVAPGGIRTDISSDKTIDPELAKREMARVPMGRIGEPEEVASMVAFLCMPAASYMTGQVICIDGGRTIA

SEQ ID NO: 63882 - protein, 325 aa, Geobacillus kaustophilus HTA426
MAQMTMVQAITDALRIEMRNDPNVLVFGEDVGVNGGVFRVTEGLQAEFGEERVFDTPLAESGIGGLAIGLALQGFRPVPEIQFFGFVYEAMDAICGQMARIRYRTGGRYHVPITIRSPFGGGVHTPELHSDSLEGLVAQQPGLKVVIPSTPYDAKGLLISAIRDNDPVIFLEHLKLYRSFRQEVPEGEYTIPIGKADIKREGKDITIIAYGAMVHESLKAAAELEKEGISAEVVDLRTVQPLDIETIIGSVEKTGRAIVVQEAQRQAGIAANVVAEINERAILSLEAPVLRVAAPDTVYPFAQAESVWLPNFKDVIETAKKVINF

SEQ ID NO: 63883 - protein, 500 aa, Glycine max
MAMANLARRKGYAVVLSSRSSLCLTRWRGFASGSDENDVVVIGGGPGGYVAAIKAAQLGLKTTCIEKRGTLGGTCLNVGCIPSKALLHSSHMYHEAKHAFANHGVKFSSVEVDLPAMMAQKDKAVSNLTKGIEGLFKKNKVNYVKGYGKLVSPSEVSVDTTEGGNTVVKGKHIIIATGSDVKSLPGITIDEKKVVSSTGALALTEIPKRLIVIGAGYIGLEMGSVWGRLGSEITVVEFASEIVPTMDAEVRKQFQRSLEKQGMKFKLKTKVVGVDTSGDGVKLTLEPAAGGDQTTLEADVVLVSAGRTPFTAELGLDKIGVETDKIGRILVNERFATNVSGVYAIGDVIPGPMLAHKAEEDGVACVEYIAGKVGHVDYDKVPGVVYTMPEVASVGKTEEQVKELGVEYRVGKFPFLANSRAKAIDNAEGLVKILAEKETDKILGVHIMAPNAGELIHEAAIALQYDASSEDIARVCHAHPTMSEAVKEAAMATYDKPIHI

SEQ ID NO: 63884 - protein, 434 aa, Geobacillus kaustophilus HTA426
MAFEFKLPDIGEGIHEGEIVKWFVKPGDEVNEDDVLCEVQNDKAVVEIPSPVKGKVLEILVPEGTVATVGQTLITLDAPGYENMTFKGQEHEEVKKEEKAETVSKKEMVEIAAPSAPAAEAEADPNRRVIAMPSVRKYAREKGVDIRLVQGTGKNGRILKEDIDAFLAGGAKAAAEPTPQAAEEKAAPQAPAAKPVVPEGEFPETREKMSGIRRAIAKAMVHSKHTAPHVTLMDEADVTKLVAHRKKFKAIAAEKGIKLTFLPYVVKALVSALREYPVLNTSIDDATEEIIHKHYYNIGIAADTDRGLLVPVIKHADRKPIFALAKEINELAEKAREGKLMPNEMKGASCTITNIGSAGGQWFTPVINHPEVAILGIGRIAEKPIVRDGEIVAAPVLALSLSFDHRMIDGATAQKALNHIKQLLSDPELLLMEA

SEQ ID NO: 63885 - protein, 470 aa, Geobacillus kaustophilus HTA426
MVVGDFAIETETLVVGAGPGGYVAAIRAAQLGQKVTIVEKGNLGGVCLNVGCIPSKALISASHRYEQAKHSEEMGIKAENVTVDFSKVQEWKASIVKKLTGGVEGLLKGNKVDIVKGEAYFVDANTVRVVNGDSAQTYTFKNAILATGSRPIELPNFKFSGRILDSTGALNLGEIPKSLVVIGGGYIGIELGTAYANFGAKVTILEGAGEILSGFEKQMVSIIKRRLKNKGVEVVTNALAKGAEERADGVTVTYEANGETKTIDADYVLVTVGRRPNTDELGLEQIGIKMTNRGLIEVDQQCRTSVPNIFAIGDIVPGPALAHKASYEGKVAAEAIAGHPSVVDYIAIPAVVFSDPECASVGYFEQQAKEEGIDVITAKFPFAANGRALSLNDTDGFLKLVVRKEDGVVIGAQIIGPNASDMIAELGLAIEAGMTAEDIALTIHAHPTLGEIAMEAAEVALGTPIHIIAK

SEQ ID NO: 63886 - protein, 199 aa, Campylobacter lari
MVKIGIGGPVGSGKTALVLNLCQALKDELSLAVITNDIYTNEDANFLIKQGVLEKERIIGVQTGGCPHTAIREDASCNLEAVELLQERFSDLDLIFIESGGDNLSMTFSPELVDFFIFVIDVAQGEKIPRKGGPAICRSDLMIINKIDLAPYVNASLKIMQEDTLKMRGDRPFIMSNLQTKEGLDEIITWIKKYTLLKG

SEQ ID NO: 63887 - protein, 462 aa, Neurospora crassa
MLPSRGLLRSTPALGLARASFKAPSSRQFGTALRSSFPQGSRRIGGPLGTTATAAASHQLLSSLRQVRYASTGPDAAVAADAAAAAAAAPSSSPVDAVAATPVELTGSDLLNLPEQIGFLKTLGLDYGWGVTSMMQWLTEHVYVYSGLPWWATLAAVAAIVRVAIFKPSLGASQESQKMQDLNKNPKYAAIMAKVKEASFDTTKQNDLVKYRQEMALMTKNAGINYFKVFIPFIQVPIGFGMFRLIRGMAALPVESLETGGTLWFPDLTVADPYFALPIASACLFVASMRKPIPYMAPQQARMMKSMGLVLVPVSIFATAWLPAALQWYFLVSAIGQYFQASIFHLPAFRRWVGLPELVPGGMRGPSPFAKAAAPSSTIQYVAPRTMDTTATPVDSGSILGDIKDSSNFVKEKLEDWKKKNDNTNIHSRAKEYEERRALEEHEAYLARLELKKQKQKGRKNH

SEQ ID NO: 63888 - protein, 314 aa, Rhodopirellula baltica SH 1
MTDTMTRPKITVVGSANVDLTFRTPRLPVPGETFAGHSLHQGMGGKGANQAVVAARLGAEVAFVARVGNDGFATQAIDAYQTDGINTSFVQHSKDQPTGTAAILVDDDAENCIIVVAGANAELNADDVRSAKDVIAFSDVVICQLETPVEAALEAFKLARAANVLTMLTPAPAELVSDELLSLCDVCVPNKTEIAAITGCSVETQADCAAAAEQLRQRGVRQVALTMGGEGVLVLDRSGMSLIPASPVKAVDTTGAGDAFTGALAVSLAEGMSLADAATRAGIVAAISVTRVGTQTSFPSLDEINRWKQAENTA

SEQ ID NO: 63889 - protein, 145 aa, Oryza sativa (japonica cultivar-group)
MDAGDQSPKEVYSVWALPPEPVRARLRGVMAGLRAAHGGPAFEPHATVVGAIRFRRSAAVVEASDHCCGHFGYERSTPYMPHVSLLYGDLTDEEKEVARKKVEEIDKEICGLQFEISELALYRTDTEDKSLESWELVEICHLERK

SEQ ID NO: 63890 - protein, 235 aa, Zea mays
MGSKASFCVTLLLLLAAAWGPADDAAELPDHRAITLKEQVSSTEIPVRLKSGSPLCSACEDFTGKAVSYISEKQTQDKVMGFLHDACSQSFSFEQKCDELMDSYATLLFAKITEIKPEAFCKRYGLCRGTALFSGVTSDSTCVFCHHLLDEVMSKLKDPDAEFEIIQILIKECNKIEGHVQQCKRLVLQYIPLILVNGEKFLEKNDVCALVQACPATHKRTFSSALKEALLLSDA

SEQ ID NO: 63891 - protein, 336 aa, Ureaplasma parvum serovar 3 str. ATCC 700970
MKLNNHNLKEIYSLSLNELKEELFKLGLKSFISKQIYSWIYQKRIFNFDKFSNIAKNNVIILKENFSNNLLKINSYQSNSDGSIKFEFLTDKNLIINCMIIKFKNGFLIKINPFGINFKKEIINLSTNELVLQILLIQQFLDQRKLGNITNVIIKGLQDSLLNMDVVSNFINIINNENGLNIGKRKIAVWTSGINVDLIKWGQLQNQIELIISMNASNSLIYQKIMLKKLNQNWSFLKLIEQIKAYTKITNNRVVLEYLLIDKINDDLNYANELVELLKNILCYVLLIPYNLNNYRTSANLDDFFNILSVNKIRISKRIRKSNDLDISFKQLKIKE

SEQ ID NO: 63892 - protein, 203 aa, Brassica napus
  misc_feature (183)..(183): Xaa can be any naturally occurring amino acid
MAALKGYGLISIDSALHFPRSHQFEGYKRRNLKWVSPKAAVVPNFHLPMRSLEDKNRTNTEDIRSLKVITAIKTPYLPDGRFDLEAYDELVNTQIIKGAEGVIVGGTTGEGQLMSWDEHIMLIGHTVNCFGARIKVIGNTGSNSTREAIHATEQGFAVGMHAALHINPYYGKTSIEGMTAHFXTVLHMGPTIIYNRPWSNESE

SEQ ID NO: 63893 - protein, 575 aa, Serratia marcescens
MISGILVSPGIAFGKALLLKEDDIVINRKKISADQVEQEVSRFLAGRAKGHEQLEAIKTKAGETFGEEKEAIFEGHIMLLEDEELEQEIIALIKDDLASADAAAYTVIEGQAKALEELDDEYLKERAADVRDIGKRLLQNILGMPIVDLGSIQDELILVATDLTPSETAQVNLDKVLGFITDLGGRTSHTSIMARSLELPAIVGTSDVTKQVKNDDYLILDAVNNKIYVNPTADVIDQLIAAQNQYITEKNDLAKLKDLPAITLDGHQVEVCANIGTVRDVAGAERNGAEGVGLYRTEFLFMDRDSLPTEDEQFQAYKAVAEAMGSQAVIVRTMDIGGDKDLPYMNLPKEENPFLGWRAIRIAMDRREILRAQLRAILRASAFGKLRIMFPMIISVEEVRDLRGEIETLKAQLREEGKAFDESIEVGVMVETPAAAVIAHHLAKEVDFFSIGTNDLTQYTLAVDRGNELISHLYNPMSPSVLGLIKQVIDASHAEGKWTGMCGELAGDERATLLLLGMGLDEFSMSAISIPRIKKIIRNTNFEDVKALAAQALAQPTAQDLMNCVNKFIEEKTLC

SEQ ID NO: 63894 - protein, 304 aa, Kluyveromyces lactis
MVAPSQFKQLEKVGNGTYATVYKGLNKTTGVYVALKEVKLDSEEGTPSTAIREISLMKELKHDNIVRLFDVIHTENKLTLVFEFMDNDLKKFMDNRNKGNPHKGLEMDLVKYFQWQLLQGVAFCHENRILHRDLKPQNLLINNRGQLKLGDFGLARAFGIPVNTFSSEVVTLWYRAPDVLMGSRNYCTLIDIWSCGCILAEMIMGKPLFPGSNDEEQLKLIFDTMGTPVEQTWPQVTQLAKYNPLLPPHMPRDLKQLLQNNTEEVLDDNVVDLLHGLLQLNPDARLSAKDALNHPWFAEYNHAN

SEQ ID NO: 63895 - protein, 513 aa, Oryza sativa (japonica cultivar-group)
MAGGAMTDTDGAHKNYPGKMTIFVFLACLVASSGGLIFGYDIGISGGVTSMDSFLIKFFPSVYAKEKEMVETNQYCKFDSELLTLFTSSLYLAALIASLFASVITRKFGRRITMLGGGVIFLVGAILNGAAADVAMLIIGRILLGIGVGFSNQAVPLYLSEMAPARMRGMLNISFQLMITVGILAANLINYFTDKIAGGWGWRVSLGLAAVPAVIMAGGSLFLPDTPNSLLSRGKENEARAMLRRIRGTDDVGPEYDDLVAASEASKAIENPWRTLLERRYRPQLVMSVLIPTLQQLTGINVVMFYAPVLFKTIGFGGTASLMSAVITGLVNMFATFVSIATVDRLGRRKLLLQGGVQMIFAQFILGTLIAVKFGTAGVANISRGYAIVVVLCICVFVSAFAWSWGPLGWLVPSEIFPLEIRSAAQSVVVVFNMAFTFIIAQIFLMMLCHLKFGLFYFFGAMELIMTGFVFFFLPETKGIPIEEMDRIWGKHWYWRRFVGAGAGGKVEITSTV

SEQ ID NO: 63896 - protein, 396 aa, Triticum aestivum
DARRSAVAAAASAVGEIERGNRGVGFGLDTKAVSSLLRDGSTGSDMVDQKLSLIQVASLIESSAKRGTTELNLRGKLVDQIEWLPVSLGKLQDVTELDISENRIMALPSTGGSLRYLTKLDIHSNQLINLPDTFGELSSLIDLDLHANQLKSLPASFGNLTSLANLDLSSNQFKILPDCIGKLMNLRRLIAETNELEELPYTIGSCISLVELRLDFNQLKALPEGIGKLEKLEILTLHYNRIKGLPTTIGSLTRLRELDVSFNEVEGIPESICFATSLVKLNVSRNFADLRALPRSIGNLEMLEELDISSNQIRMLPDSFEFLAKLRVFHADETPLEVPPREVIKLGAQAVVQYVADMVASRGASQKKTDGTSFWAWFRSLFGCCKKDEELGLVPA

SEQ ID NO: 63897 - protein, 993 aa, Trichodesmium erythraeum IMS101
MVEQISHTNYETKTQEIAKQLLKATQEKNRSFLAQLQNQMRWDDKLLDWAMASPGLRVQLFRFIDCLPALRSKPEIAAHLQEYLTTQEVELPETLKKLLNFANPDSVPGQLAATTVAPAVETLAHKYIAGENVKQIIKTLEKLRKDKMCFTVDLLGEAVITETEAQLYLDRYLELMTQLSQAANSWSSIPQIDEAEGEKLPRVQVSVKLTAFYSQFDPLDVKGSQERVSDHVRTLLRHAQKLGVAVHFDMEQYTYKDLTIDILKELLMEEEFRNRNDIGVTIQAYLRDSEKDLQGIIEWAKIRGRPVTVRLVKGAYWDQETIKALQHDWPQPVFNDKPETDANFEKLTYMMLENHEYIYSAIGSHNVRSQARAIAIAETLKVPRRCFEMQVLYGMGDKIATILAEKGYRVRVYCPYGDLLPGMAYLIRRLLENTANSSFLKQSLENRPLEELLAAPSINGKTTIHDVVKPVFPNAADSDYANFQQRQQALNTIGQIRLELGKTYLPIINGEYTNTAQIVDSLNPSNSKEVVGKIGLISVEQAEQAIQAAKAAFPSWKKTPVRERTRILRKAADLMEKRRHELAAWMVLEVGKPLNQGNAEVSEAIDFCRYYADEMERLEQGYNYDVAGETDRYYYQPRGISLVISPWNFPLAIPTGMTVSSLVTGNCTLLKPAAVSSVIASKISEILLEAGFPKGVFQFVPGNGSTVGDFMVKHPSVNSITFTGSMEVGCHIYAQAAVLQPRQKHLKRVIAEMGGKNAIIVDESADLDQAVAGVVYSAFGYSGQKCSACSRVVVLATIYDSFVNRLVEATRSLNIGDAEKPSTQVGPVIDEKAQKRIQEYIVKGKQEAEVAIEMSAPKDGYFVGPVIFKDVSPSATIAQEEIFGPVLAVMKADNFTQALEIANGTNFALTGGLYSRTPSHIEQAKAEFEVGNLYINRGITGAIVSRQPFGGFKLSGVGSKAGGPDYLLQFLEPRTITENIQRQGFAPIEGVDN

SEQ ID NO: 63898 - protein, 350 aa, Clostridium difficile 630
MKSVRFYGIRDTRVEDVDVPKILEKDDVIIKVKVAGICGSDISKYSKTGPHMVGEILGHEFSGEVAQVGKEVRSFKIGDRVAVCPAMPCFECDECKKGLYSRCNNVAIIGNKELGGCFAEYTKVKERNLIKIPDEISYETAAALEPVCIAGHGLFRSEAKVGDTVVVLGTGPIGLFSIQWAKIFGSTKIIAVDVFDEKLDLAKELGADICINAKEKNIVEEIKRLTDGDGADIVIESAGTPLTCGQVLLLAKKGGTVLYAGVPYGDVALTREQFEKIVRSELTVKGTWFGNSFPFPGKEWSAGLYHMQKGDMNVEKLVTHRINLEEAPAYFEKVYKRDIFFGKIMINIDN

SEQ ID NO: 63899 - protein, 463 aa, Escherichia coli B
MLAFLNQVRKPTLDLPLEVRRKMWFKPFMQSYLVVFIGYLTMYLIRKNFNIAQNDMISTYGLSMTQLGMIGLGFSITYGVGKTLVSYYADGKNTKQFLPFMLILSAICMLGFSASMGSGSVSLFLMIAFYALSGFFQSTGGSCSYSTITKWTPRRKRGTFLGFWNISHNLGGAGAAGVALFGANYLFDGHVIGMFIFPSIIALIVGFIGLRYGSDSPESYGLGKAEELFGEEISEEDKETESTDMTKWQIFVEYVLKNKVIWLLCFANIFLYVVRIGIDQWSTVYAFQELKLSKAVAIQGFTLFEAGALVGTLLWGWLSDLANGRRGLVACIALALIIATLSVYQHASNEYIYLASLFALGFLVFGPQLLIGVAAVGFVPKKAIGAADGIKGTFAYLIGDSFAKLGLGMIADGTPVFGLTGWAGTFAALDIAAIGCICLMAIVAVMEERKIRREKKIQQLTVA

SEQ ID NO: 63900 - protein, 439 aa, Escherichia coli B
MLPFLKAPADAPLMTDKHEIDARYRYWRRHILLTIWLGYALFYFTRKSFNAAVPEILANGVLSRSDIGLLATLFYITYGVSKFVSGIVSDRSNARYFMGIGLIATGIINILFGFSTSLWAFAVLWVLNAFFQGWGSPVCARLLTAWYSRTERGGWWALWNTAHNVGGALIPIVMAAAALHYGWRAGMMIAGCMAIVVGIFLCWRLRDRPQALGLPAVGEWRHDALEIAQQQEGAGLTRKEILTKYVLLNPYIWLLSFCYVLVYVVRAAINDWGNLYMSETLGVDLVTANTAVTMFELGGFIGALVAGWGSDKLFNGNRGPMNLIFAAGILLSVGSLWLMPFASYVMQATCFFTIGFFVFGPQMLIGMAAAECSHKEAAGAATGFVGLFAYLGASLAGWPLAKVLDTWHWSGFFVVISIAAGISALLLLPFLNAQTPREA

SEQ ID NO: 63901 - protein, 521 aa, Ureaplasma parvum serovar 3 str. ATCC 700970
MAKIIEEMINKKGLLIDDYELYGNEIAKIKSIKKLNKKDSKLIVITSMNPNPAGEGKTTTAIGLVDALNKHGYKAIGALREPSMGPVFGMKGTGSGGGLSFLKPFDKINLHFSGDFHAITAANNLIVAVIENEIHNRSSMQIDSQKILIKRCLDVNDRSLRNIEYDINHQQTKSGFNITAASDLMALFCLAHDHKDFEDKLAQTIVAYNIVNQPIRICDLELTKAIMAILEDALYANLVRTNEDNPVFVHGGPFANIAHGCNSIIATKNALALGDYVVTECGFGSDLGLEKFMNIKMASLNLKPDLIGLVISLKSIAYHAQTNEKDYVKQGFANVLCHINHIKKYNVSFIVYINVNTNTDSEEDLLTLEKLLDEHQIEHARSYAYSYGSKKSEEITKKTITLTNQINDHELKLIYDIKDHLSYKLKKICENVYGADGYELSYEAKEQLNRYEHLDFYLCIAKTPYSISDDAKLLNNPKNFKIHIERFEINYAAKLIIAITTTIYRMPGLNKEPAAKNFVMK

SEQ ID NO: 63902 - protein, 239 aa, Haloarcula marismortui ATCC 43049
MGPNMDGVVLAAGEGTRMRPLTADKPKGLVEVAGKPLLTHCFETLRSVGGDRLVVVIGYRADDILSHYGDQYRGTPIAYVRQDEQLGLAHALEQARSAVDGTFVVLNGDNVCRANLSDAIARHRETDASATLLVESVSRAEARSTGVVTTDSEGRVTGLVEKPSDPPSTLVTRGFFVFEPAIGHACVLTRPSERGEYELPDAIDLLLSAGHRVEAVELDGWCHNVNEPGDIDAVEDRLA

SEQ ID NO: 63903 - protein, 281 aa, Phalaris coerulescens
MSNTKRFHVSNSPPSRPRNIPRPSPPPSSVLIHGTPQHHYKKERKPILLPPPPPINQTTRCGGAQRSEQPTTRRGDRPLTPTTTTGDSVALHVNPPSRVKEPLNCPEIRQLIVFVSLPAALGAKIPAPDPRAFRGPFAQCCVLVCRLKFTMGGCVGKDRGIVEDKLDFKGGNVHVITTKEDWDQKIAEANKDGKIVVANFSASWCGPCRVIAPVYAEMSKTYPQLMFLTIDVDDLVDFSSTWDIRATPTFFFLKNGQQIDKLVGANKPELEKKVQALGDGS

SEQ ID NO: 63904 - protein, 490 aa, Photorhabdus luminescens subsp. laumondii TTO1
MTNNVNTELLRQQAYINGQWVDADNQATFKVTNPANGEVIAHVSNMGAAETERAIAAAQQALPAWRTMTAKQRSQILQRWFQLMMANQPALAELLSREQGKSQTEAMGEIAYGASFIEWFAEEGKRTYGETIPSPLPGRRIVTIKQPIGVVAAITPWNFPNAMITRKVGPALAAGCTVILKPASETPLSALALAALAEQAGIPAGVFNVVTGIDAKAIGGAMTQSPIVRKLSFTGSTRVGKLLMAQSADTVKKLSLELGGNAPFIVFDDANIDAAVQGALIAKFRNSGQTCVCANRILVQETIYDTFAERLAQAVNQLQVGPASDAKSQQGPLINQAAVDKVEEHISDAISHGARILAGGKPHALGGLFFEPTVLADVNKSMLISQEETFGPIAPLFKFRDEAEAIHLANETEFGLAAYFYSRDIGRIYRVAEALESGMVGINEGLISNEAAPFGGIKQSGLGREGSRYGIEDYLEVKYLCFGGIEDTGV

SEQ ID NO: 63905 - protein, 491 aa, Escherichia coli
MMSRMAEQQLYIHGGYTSATSGRTFETINPANGNVLATVQAAGREDVDRAVKSAQQGQKIWASMTAMERSRILRRAVDILRERNDELAKLETLDTGKAYSETSTVDIVTGADVLEYYAGLIPALEGSQIPLRETSFVYTRREPLGVVAGIGAWNYPIQIALWKSAPALAAGNAMIFKPSEVTPLTALKLAEIYSEAGLPDGVFNVLPGVGAETGQYLTEHPGIAKVSFTGGVRSGKKVMANSAASSLKEVTMELGGKSPLIVFDDADLDLAADIAMMANFFSSGQVCTNGTRVFVPAKCKAAFEQKILARVEPIRAGDVFDPQTNFGPLVSFPHRDNVLRYIAKGKEEGARVLCGGDVLKGDGFDNGAWVAPTVFTDCSDDMTIVREEIFGPVMSILTYESEDEVIRRANDTDYGLAAGIVTADLNRAHRVIHQLEAGICWINTWGESPAEMPVGGYKHSGIGRENGVMTLQSYTQVKSIQVEMAKFQSIF

SEQ ID NO: 63906 - protein, 488 aa, Photorhabdus luminescens subsp. laumondii TTO1
MTVISHWINGKNISSKTYFETTNPATGEVLAEVASGGQEEVDQAVAAAKAAFPKWADLPMKERARLMRRLGELIDENVPEIAAMETKDTGLPIHQTQNVLIPRASHNFNFFAEICQQMNGRTYPVDDKMLNYTLVQPVGVCALISPWNVPFMTATWKVAPCLALGNTAVLKMSELSPLTANRLGELALEAGIPAGVLNVVQGYGATAGDALVKHHDVRAVSFTGGTATGRQIMKNAGLKKYSMELGGKSPVLIFEDADIERALDAALFTIFSINGERCTAGSRIFIQQSIYPEFIKRFAERANRLRVGDPQDPTTQIGALISKPHWEKVSGYIRLGIEEGATLLAGGPDKPIDLPAHLKDGHFLRPTVLADVDNRMRVAQEEIFGPVACLLPFKDEAEGLRLANDVEYGLASYLWTQDVSKVLRLARNIEAGMVFVNTQNVRDLRQPFGGVKASGTGREGGEYSFEVFAEMKNVCISMGDHPIPRWGV

SEQ ID NO: 63907 - protein, 490 aa, Escherichia coli
MSRMAEQQLYIHGGYTSATSGRTFETINPANGNVLATVQAAGREDVDRAVKSAQQGQKIWASMTAMERSRILRRAVDILRERNDELAKLETLDTGKAYSETSTVDIVTGADVLEYYAGLIPALEGSQIPLRETSFVYTRREPLGVVAGIGAWNYPIQIALWKSAPALAAGNAMIFKPSEVTPLTALKLAEIYSEAGLPDGVFNVLPGVGAETGQYLTEHPGIAKVSFTGGVRSGKKVMANSAASSLKEVTMELGGKSPLIVFDDADLDLAADIAMMANFFSSGQVCTNGTRVFVPAKCKAAFEQKILARVEPIRAGDVFDPQTNFGPLVSFPHRDNVLRYIAKGKEEGARVLCGGDVLKGDGFDNGAWVAPTVFTDCSDDMTIVREEIFGPVMSILTYESEDEVIRRANDTDYGLAAGIVTADLNRAHRVIHQLEAGICWINTWGESPAEMPVGGYKHSGIGRENGVMTLQSYTQVKSIQVEMAKFQSIF

SEQ ID NO: 63908 - protein, 446 aa, Lactococcus lactis subsp. lactis Il1403
MKIVVIGTNHAGIATANTLIDRYPGHEIVMIDRNSNMSYLGCGTAIWVGRQIEKPDELFYAKAEDFEKKGVKILTETEVSEIDFTNKMIYAKSKTGEKITESYDKLVLATGSRPIIPNLPGKDLKGIHFLKLFQEGQAIDEEFAKNDVKRIAVIGAGYIGTEIAEAAKRRGKEVLLFDAESTSLASYYDEEFAKGMDENLAQHGIELHFGELAQEFKANEKGHVSQIVTNKSTYDVDLVINCIGFTANSALAGEHLETFKNGAIKVDKHQQSSDPDVSAVGDVATIYSNALQDFTYIALASNAVRSGIVAGHNIGGKSIESVGVQGSNGISIFGYNMTSTGLSVKAAKKIGLEVSFSDFEDKQKAWFLHENNDSVKIRIVYETKNRRIIGAQLASKSEIIAGNINMFSLAIQEKKTIDELALLDLFFLPHFNSPYNYMTVAALNAK

SEQ ID NO: 63909 - protein, 357 aa, Desulfovibrio vulgaris subsp. vulgaris str. Hildenborough
MHMNICLLPGDGIGPEIVAQGTKVLDAVARRFGHTVSTSSALIGGAAIDATGSPLPDATVEACRTSDAVLLGAVGGPKWDDLPSEKRPEKGLLGIRKALGLFANLRPAALFPELAGACLLRADIAAAGLDLVVVRELTGDVYFGQPAGIETRDGLRTGFNTMIYDEDEVRRIARVAFDTARARKRRVCSVDKANVLATSRLWREVVEEVARDYPDVELSHMYVDNAAMQLVRWPAQFDVIVTGNLFGDILSDEAAVITGSIGMLPSASMGSGGPALFEPIHGSAPDIAGQDKANPIATILSVGMMLRLGFGLAAEADAIDAAVRRVLAEGYRTGDIMENGRTLVGTVSMGNLIAERI

SEQ ID NO: 63910 - protein, 223 aa, Zygosaccharomyces bailii
MIGEHKALVQRITNETKIQIAISLNGGHIELPESILDKNPTQENNIATQATTSQVIDIHTGVGFLDHMIHALAKHSGWSLIVECIGDLHIDDHHTTEDCGIALGEAFKQALGQVRGVKRFGCGFAPLDEALSRAVVDLSNRPYAVIDLGLKREKIGDLSCEMIPHFLESFIEAARLTVHIDCLRGFNDHHRSESAFKALAVAIREATAPNGTNDVPSTKGVLM

SEQ ID NO: 63911 - protein, 501 aa, Centaurium erythraea
MEITDFSTFLLAFLLLSYLLVTGRRLISKKSTGKLPPGPKKFPIVGNLPQLALAGTLPHRAMRDLAKTYGPLMHLRLGEVSQLVVSSPEMAKEVLKTLDPMFASRPDLILADIMLYDNAGLTFAKYGDYWRQLKKIFATELLSAKRVKSFRSLREEETLNTIRWISSNEGKPINMTNTLLNLVFGVLSRATFGKKSPEQDKLVYIVNKAAELATGGNISDLFPSIKFFRLISVVNYKLKSMFAESNRLLDMIMKEHKKGNGSGESKDLVDVLLGYQRENAEFSLTDENIKAVLLDIFIGGTDGSFTTLDWAMSELMRAPTVLKRAQEEVRQAFETDGYIDEEKFEDLKYVTSIIKETLRLHPPAPLLVPRSNDETAHILGYEVPAKSKILVNVWAINRDPRYWEDAESFKPERFLGSSVGYKGTDFHFLTFGAGRRMCPGMVYGYANIVHPLVKLLYYFDWNLPSGIKPEELDMTEEHGLSVKRKADLYLIPSVRNSISHL

SEQ ID NO: 63912 - protein, 531 aa, Aspergillus nidulans FGSC A4
MASFANPTQIFADDVIEEKGENARLSAFVGAIAVGDLVKSTLGPKGMDKILQSASTGEILVTNDGATILKAIALDNAAAKVLVNISKVQDDEVGDGTTSVTVLAAELLREAEKLVNRKIHPQTIIEGYRIASRAALDALDKVAVDRSDDMEKFRKDLHSIARTTLSSKVLAQDRDQFAALACDAVLRLRGSTDLSHIQIIKKAGGKLSDSYLDEGFILDKKIGVNQPKRLENAKILVANTAMDTDKVKIFGARVKVESTGKLAELEKAEREKMKAKVERIKAHGINCFVNRQLIYNWPEQLFTEAGIMSIEHADFDGIERLALVTGGEIASTFDHPDQVKLGSCDLIEEVIIGEDTLIKFSGVAAGQACTIVLRGATEQLLDEAERSLHDALAVLSQTVKDPRVTLGGGCAEMVMSKAVEQAAQNTTGKKQLAVDSFAHALKQLPTILADNAGLDSSDLVTRLRTAINNGMTSSGLDLLTPGGGIADMRELGVVESYKLKKAVVSSASEAAELLLRVDNIIRAAPRRRDRM

SEQ ID NO: 63913 - protein, 498 aa, Hypericum androsaemum
MEFLLITQCSLLFVATYLLVNHVILRGRSKNNGSTKLPPGPRPLPIIGNLLALRDKPHKSLAKLARVHGPLVTLKLGQVTTVVVSSPATAREILQKHDATLSNRYIIDAIRAQGHHEAGLAWVPVGPTWRKFRKVCYSHIFTNQKLNSSQHVRQRTIQQLLAEARESCRVGEAMDVGKAAFRAALSSLSISVMSLDLADAASDTAREFKELARCIMNDVGEPNLADYFPVLKRFDPQGVRGRVEISFGRILDLFGSIIADRMEKRGADEDILDTLLTTHDENPELVEINDIKHLLLDLFVAGTETTSSTLEWAMAELLHKPTTMAKAKAELEQIIGKGNSIDQESEVSRLPYLQAVIQETLRLHPAVPLLLPRRAGEEVHVSGFTIPKDAQVLVNVWAMGRDPEVWEDPCSFTPERFLGSSIDVIGTCFELIPFGAGRRICPGLPLAMRMLQMMLGNLLLSFDWKLPDGVTPECMDMEDRFGITLQKAQPLLAIPLSL

SEQ ID NO: 63914 - protein, 905 aa, Trichodesmium erythraeum IMS101
MSYSTQNSQELALKTLFPFQLDEFQKQAIAALNAGKSVVVCAPTGSGKTLIGEYAIYRALSRGQRVFYTTPLKALSNQKLRDFRKLFGPEKVGLVTGDTSVNREASVLVMTTEIFRNMLYGTHIGEVGASLEKVEAVVLDECHYMNDRQRGTVWEESIIYCPPEIQLLALSATVANSDQLTDWILRVHGPTELIYSDFRPVPLKFNFSNSKGLFSLLNSNQKRINPQLKPKSRQPKTDKKDKKEEPALSTVLSQLQERDMLPAIYFIFSRRGCARAVAEIAQLSNLTLVNPEEAAKLQKLVQKFLQRNPDLGKSQQLEPLTRGIAAHHAGMLPVWKGLVEELFQQGLIKVVFATETLAAGINMPARTTVISSLSKRTDDGHRLLKPSEFLQMAGRAGRRGMDIQGYVVTVQTRFEGVKEAAYLATSGADPLVSQFTPSYGMVLNLLQTHTLQEAKDLVERSFGQYLSTLSLLPERKEIELKEKELKALENKLGIYEDNDWINLEQLLASYEKLRGKVKEEKRLLRILQRQAEETRIREMSLSLSFAILGTVLSLKGKHVPTAKKSTAEPIPAVLVAKVPGSGQSSYSLCLGKDNRWYIVGAMDVMTLQADFPRLAAVDYMEVPEEMGSRLGQCRKGDEISLVLAQQIPAVPLPVDPPEVLAQMQKLAICEAEAEAHPLKEWGNPRTLIKGWRRVEMLRAEIEDRQRELEDKLARHWQEFLHLIEILQYFGCLHGVEPTEVGQACAAIRGDNELWLGLVLMSGSFDELDPHHLATACAGLVTEITRPDSWTRYELSVEVKEAMASLRNLRHQLFQVQHRHQVALPVWLERDLIALVEQWALGVEWEELVNNASLDEGDVVRMLRRTLDFLSQIPHVPCLSDALRRNAHRAMQLIDRFPVNEVVEPE

SEQ ID NO: 63915 - protein, 519 aa, Bartonella henselae str. Houston-1
MPDTYYITTPIFYPNGAPHIGHAYSAIASDVLARFQRLDGKNVFFLSGTDEHGLKMQQTAVALGITPKQLTDRNSAVFQKMLAALNCSNNDFIRTTEKRHYQACQEIWKKMKANGDIYLSRYTGWYSVRQEAYYEEKDTEVGEDNIRREKELGSPVEWNEEESYFFKLSRYEKALLEHYEKHPDFIAPPERRNEVISFIKSGLKDISISRASFNWGICVPNDSKHVMYVWVDALTNYLSAIGFFDENSKKRAFWPASVHIIGKDIIRFHAIYWPAFLMSAGIALPKRIFAHGFLLNNGVKMSKSIGNVVDPFEMIDHYGLDQVRYFLLREVPFGQDGSYSHDSFVNRINADLANDLGNLAQRSLSMIAKNCDAKVPLPAAFLVQDEQLLEKSLQTLDTMRKAMSSQEIHLALSAIFSVVADANRYFANEQPWSLRKNNPERFSTVLYITLEILRRIGIMLLPFMPQSAAKLLDSLKISQEDRLLQHISNSKIQEGLDLPPPEPIFPRYILKKDDIHHVD

SEQ ID NO: 63916 - protein, 173 aa, Brassica napus
MAASVDPLVVGRVIGDVLDMFIPTANMSVYFGPKHITNGCEIKPSAAVNPPKVSISGNSNELYTLVMTDPDAPSPSEPNMREWVHWIVVDIPGGTNPSKGKEILPYMEPRPPVGIHRYIFVLFRQNSPVGMMVQQPPSRANFSTRMFAGHLDLGLPVATVYFNAQKEPASRRR

SEQ ID NO: 63917 - protein, 561 aa, Zea mays
MLDRPPRRGFAFIVPSMSMQEPTSAATQLHAAMEASLSLSSLQLAFTAVAAIAALGVAVTVTRYNRRYMGLRLPPGPPGWPVVGNLFQVAFSGKLFIHYIRELRKEYGPILTLRMGERTLVIISSAELAHEALVEKGREFASRPRENTTRNIFSSNKLTVNSAVYGPEWRSLRRNMVSGMLSTSRLREFRHARRRAMDRFVSRMRAEAAASPDGASVWVLRNARFAVFCILLDMTFGLLDLREEHIVRIDAVMKRVLLAVGVRMDDYLPFLRPFFWRHQRRALAVRREQIDTLLPLINRRRAMLRDMQQRQSSSPPPDPSVAAPFSYLDSVLDLRIEGRDDGALTDDELVTLCAELLNGGTDTTATAIEWGMARIVDSPSIQARLHEEVMQQVGDARPVDDKDTDAMPYLQAFVKELLRKHPPTYFSLTHAAVQPGCKLAGYDVPVDANLDIFLPTISEDPKLWDRPTEFDPDRFVSGGETADMTGSAGIRMIPFGAGRRICPGLAMGTTHIALMVARMVQAFEWRAHPSQPQLDFKDKVEFTVVMDRPLLAAVKPRNLAF

SEQ ID NO: 63918 - protein, 121 aa, Brassica napus
KDTDNSLLTKSHFNENEQSGFEKFVRDKYTILPDTRERMLATEVNASWRYSYESVASIPKKELYFSEKFMEVKKVLMDTFFGPPETGVYSPSVQRTLYLMGSAVLRRYHHHICPHGLRFFF

SEQ ID NO: 63919 - protein, 222 aa, Pichia stipitis
MARTATIKRDTNETKIQIALSLDGGFLAVEESIFKKRKIDDDDEHAKQATSSQVINVQSGIGFLDHMLHALAKHAGWSLIVECIGDLHIDDHHTAEDVGITLGIAFKQALGQVKGVKRFGSGFAPLDEALSRAVVDLSNRPFAVVELGLKREKIGDLSCEMIPHVLESFAQGAHITTHVDCLRGFNDHHRAESAFKALAVAIREAISSNGTNDVPSTKGVLF

SEQ ID NO: 63920 - protein, 587 aa, Streptococcus pyogenes MGAS315
MAVEIIMPKLGVDMQEGEIIEWKKQEGDTVNEGDILLEIMSDKTNMELEAEDSGVLLKITRQAGETVPVTEVIGYIGAEGESVEVSSPAASDVNVARTTEDLEAAGLEVPKAPAQAASAAPKAALADDEYDIIVVGGGPAGYYAAIRGAQLGGKIAIVEKSEFGGTCLNVGCIPTKTYLKNAEILDGIKIAAGRGINLASTNYTIDMDKTVDFKNTVVKTLTGGVQGLLKANKVTIFNGLGQVNPDKTVTIGSQTIKGRNVILATGSKVSRINIPGIDSKLVLTSDDILDLREMPKSLAVMGGGVVGIELGLVWASYGVDVTVIEMADRIIPAMDKEVSLELQKILSKKGMKIKTSVGVSEIVEANNQLTLKLNNGEEVVAEKALLSIGRVPQMNGLENLNLEMDRNRIKVNDYQETSIPGIYAPGDVNGTKMLAHAAYRMGEVAAENAIHGNTTRKANLKYTPAAVYTHPEVAMVGLTEEQAREQYGDVLIGKNSFTGNGRAIASNEAHGFVKVIADAKYHEILGVHIIGPAAAEMINEAATIMESELTVDELLLSIHGHPTFSEVMYEAFADVLGEAIHNPPKRK

SEQ ID NO: 63921 - protein, 449 aa, Centaurium erythraea
MDVIFPLLVAFITWAIASSLTFRRFGRLPPGPFPVPVIGNIHQLGKHPNQSLAKLSKIYGPLMSLKLGTQTAIVASSSTVVREILQKHDQVFSSRTIPSALHAHDHHKFSMALLPASSRWRHLRKITKEQMFSVQRLDESQGLRQDKLKELRDYLHSCCVTGQAVNIGEAAFTTTLNLMSCTLFSVNFASFDSKFSDELKRDICAFVQVIAAPNLADFSPVLRHVDPQGLLKRTKTYMQKVFDSFEDIITKRLQERGTSQQDSLRRHDLLEALLDEMEKNDSAFTINDMKHLILDLFIAGADSTSSTTEWGMAELLHNPEKMEKAKAELNEVIGQKNLVEESDISRLPYLQAVVKEVFRLHPPGPLLVPHKADADVEIDGYVVPKNANVLVNVWALGRDSSSWADPEAFMPERFLDNEIDVKGQHFELIPFGAGRRMCPGLPLSYRMLH

SEQ ID NO: 63922 - protein, 226 aa, Zygosaccharomyces rouxii
MIPEQGEHKAFVQRNTNETKIQIAISLNGGHIEIPESIIGKKRVESDGVRTQATSSQTIDIHTGVGFLDHMIHALAKHSGWSLIVECIGDLHIDDHHTTEDCGIALGDAFKQALGQVRGVKRFGFGFAPLDEALSRAVVDLSNRPYSVIELGLKREKIGDLSCEMIPHFLESFTEAARLTVHVDCLRGFNDHHRSESAFKALAVALREATSPNGTNDVPSTKGVLM

SEQ ID NO: 63923 - protein, 326 aa, Oryza sativa (japonica cultivar-group)
DALADSVGNVVIGGIMEHIEQAGIHSGDSACSLPTRTVSAKCLDIIRSWTTKLAKRLNVCGLMNCQYAITTSGEVFLLEANPRASRTVPFVSKAIGHPLAKYASLVMSGVTLPELGYTQEVVPKHVSVKEAVLPFEKFQGCDILLGPEMRSTGEVMGIDYEFSGAFAKAQIAAGQKLPLNGTVFLSLNDLTKRHLAEIGRGFRELGFNIIATSGTAKVLQLEGIPVEPVLKIHEGRPNARDMLKNGQIQVMVITSSGDALDSKDGLQLRRLALAYKVPIITTVDGARATIDAIKSLKNKSIETLALQDYFQTTDASQNLQAAQSAS

SEQ ID NO: 63924 - protein, 218 aa, Actinidia deliciosa
ETGRHVRMLTHEIRSTLDRHTILKTTLVELGRTLALEECALWMPTRTGLELQLSYTLRHQKPVGFTVPIQLPVINQVFSTNRAAKISPNCPVARLRPLAGKYMPGEVVAVRVPLLHLSNFQINDWPELSTKRYALMVLMLPSDSARQWHVHELELVEVVADQVAVALSHAAILEESMRARDLLMEQNVALDLARREAETAIRARNDFLAVMNHEMRTP

SEQ ID NO: 63925 - protein, 993 aa, Oryza sativa
  misc_feature (275)..(275): Xaa can be any naturally occurring amino acid
MSGQSNSPDMIFQVYTPRKRKFLNSVHYSESNRAVSHGSGLVTSAKDSHQGEESFLNGPAGLSSILSNSQGFAPQDILSGTTELSGIRCTTSSCKPNETILHTISTNNGTSNCQDTTQSFSLLMECTNHTTPSKPMHPHITFQLMHTKIESSNSCAKYADSTDQSQTAVAHKLLFSCEKGDQSIVAMVHPSQSSLEKIQQKQGISSYEAKHDVQGSTKADDSSSILSPHSLDDEIMSVVGLLSPSAYESLCDGTIQLSSTVKVSVIAFFKSGEKXNHDITWPKIIEIKGRVKLDAFEKFVQELRRCQTRSLMVISLCWKFGTSKAGLLGMKEVAENFEASHKVGFADVCDGSNLYVCPRSDAVITILAKCGFFKGMSAADTNQDSLIGCIVWRRNPLSKIVDHSRSETIGKGSPCVPHVGARHPTSLPFSDGHQATSCSNNPGMDSRTNTGNIQNDIDQMQEIQSNSVKTHPVATGLLSQCGHAKSTGERDPTEKVVPHSLFKLASKLTPQPPFKAPSLIGCQLSQVSPFELASHEVPEIQQHVQSIIDSHSGSFGVWHPTSHSQGLSLKSLHVQQRTTHYDLAAQKNHMAEAFSGSITQEYASNAVESSKQQETNPFLLQPDTYGAHRANDIDDLPKVDFANLHRVELKFDVHPINRETTITSDVLICPRLSDKKSNSPFQQSSQPSFQVEGIKNHEKVEVKENVTDMISREITNQVSHRKAEIENFKSKDDIDAEDMPECHFQGLDNEKLHQSGSSKHTSPSLKNSTGSKAPSQVFPPITQKSYTPLEVEDISSGHDPNMPSGCLNIPRDQVSFPRHPPPAQGDQRLAARHPPVLADQGYVPRLPPPVLEDQGLAPRCPPPALAGQGFVPRHPPPVLPNQGFFPRRCPPFAGQDLYPWRPPFHANQGPFPRHAPPHPCPPFTPGHVRPPSNFAPPGPWRPVLHPGQEHHHHHYGHPGRSNGPSGSGNKPGYHNPSYGNGPGGCRPQHQAQG

SEQ ID NO: 63926 - protein, 394 aa, Methanosarcina mazei Go1
MFSINSECVISKKSEDIPPFYVMEVLESAQALEAQGRHIIHLEVGEPDFPTAPHICEAACAAIGRGLTKYTHSQGLLALREAIVESYYQKFGVDLDPGQVIVTSGTSPALLMVFMALLEKRDEVIMSNPHYSCYPNFVKHLGGTPVFVYTNETNGFALEPETVRQRLSPNTKAILINSPSNPGGHVMSPENLQGLAAIADERGIPIVSDEIYQGLIYSGEEHSILEYTKNAFVLNGFSKLYAMTGWRLGYIICPPGCVRALQKIHQNFFICANSFVQEAGIAALKGPQEHVTEMVQTYNVRRQYMLKRLIGMGLDVRKEPMGAFYVLADARKYCSDSLELSRRILNEAGVAVTPGIDFGNGAEGYLRFSYANSLENITEGMDRLEAFLEKELEG

SEQ ID NO: 63927 - protein, 316 aa, Buchnera aphidicola str. Bp (Baizongia pistaciae)
MNQLECLKKYTDIVVDSGDLVSINKFKLGDVTTNPSLIRQVMSLQKYQYIIYDSIRYAKKKGGSHKFKLENAIDKVSVILGSEILKNISGKISTEIDSRLSFNTNLCIERAKKLISMYEEHDIHRDRVLIKLAATWESVSAAKELKKENIQSNLTLLFSFAQAKICAEAGVFLISPFVGRIYDWYKSKSLIKSAMIDDDPGVNAVRKIYQYYKEYGYHTIIMGASFRNVDQVLALSGCDRLTISPNLLHKLQLSDDLVIRKLIPPKHKKLQPVCMSKSEFCWFHNEDAMAVEKLSEGIRQFGKDQQELENIINNNF

SEQ ID NO: 63928 - protein, 666 aa, Buchnera aphidicola str. Bp (Baizongia pistaciae)
MCLRRKLANAIRALSIDAVQEAQSGHPGMPMGMADIAEVLWREFFKHNPKNPLWNNRDRFILSNGHGSMLLYSILHLTGYKLSIDDLKKFRQLGSNTPGHPEIGSTPGVEMTTGPLGQGLGAAVGMAIAERTLASTFNKPNYDIVDHYTWVFVGDGCLMEGISHEVCSLAGTFGLGKLIVFYDSNGISIDGKVEEWFTDDTENRFKAYNWHVVSNVDGHDYRSISSAIKDAILVKNKPSLIICKTIIGYGSPNKSGLETSHGAPLGENEVLLTKQKLGWTYPPFVIPQDVYDHWNFNLQGVILENEWNKKFQGYYNKYPDLANEYLRRISKNVPDKFVDNFNKFIKELYLCPKNIATRVASQNVLEFLGKSLPELIGGSADLAPSNLTMWSKSKSIKQDISGNYVHYGVREFGMTAISNGIAHYGGFIPYVATFLAFMDYARSAVRMSALMKTQNIFIYSHDSIGLGEDGPTHQPIEQLSALRFIPNVNVWRPCDQLETAIAWKNAIERKDGPTALILSRQILCQIDRSQEQINDIYRGGYIVNTTVRSPKVIIVATGSEVKIALDVSNILFKKGILVRVVSMPSTNVFDQQDNDYKEFIFPRCLVHRVAIEAGISDFWYKYVGLTGCIIGIDTFGESGSSDQLFSKFGFNSDIISEKIISYLKSS

SEQ ID NO: 63929 - protein, 815 aa, Parvularcula bermudensis HTCC2503
MVDGQRTGWSAAMDRIARGFRDAIERHGPDSVAFYLSGQLLTEDYYVANKLMKGFIGSANVDTNSRLCMASAVAGHKRAFGSDTVPGTYEDLEACDLLVLVGSNLAWCHPVLYQRVLAAKEARPDLKIVVIDPRRTATCDLAEQHLAIAPGSDVALFSGLLRFLANSPARNDGYIAQYTSGMRDALEAAAAYDINRVARETRLPKDDLIRFYESVSRNERTVTLFSMGVNQAADGTDRVNAIINTHLVTGRIGKLGGGPFSITGQPNAMGGREVGGLSNQLACHMDFDDASVDRVRRFWRAPRMATRPGLKAVEMMDAVAAGRIKAIWIMATNPVVSMPNADAVKAALKACPLVVVSDIVPDTDTAQCADILLPATGWGEKDGTVTNSERRISRQRAFLPAPGLARHDWWAMSDLARRLGYEEAFGYENTASIFREYAALTAFENEGGRDLDLGGLAGLTDDEYDELSPVRWPVRRDGSRTERFFRRGGYFTPDRRARFVAPRTDEPKEEAPGLCLNTGRIRDHWHTMTRTGRAARLNKHIAEPFAEIHPDDAAAHGILDASLVRVKNDDGEAVVRALLTDRQQRGSVFVPMHWTGQAASQARVDTLVPPLVDPVSGQPALKSGRVTIEPYPAVWYGFAAGHVTPPTGETYWARAMTETGRRLELAGTSHPHDWSVFARELLSADEEDSETVEHMDAAGAHYRCAVFRGGRLRSVLLVGPTPVAAARDWLGDQIGKVASLNTRTSILAGVPGAGAPDPGPIVCSCLGVGANVIRRAMRDGASSLTQIGDRTGAGTNCGSCRPEIRKLMEIAHATT

SEQ ID NO: 63930 - protein, 294 aa, Buchnera aphidicola str. Bp (Baizongia pistaciae)
MLRGSIVALITPMNEYGHVCETSLEKLINYHINNGTKAIVSVGTTGESSTLSQEEHINVVMLTLEITNKRLPIIAGTGANATSEAILLTKKFENTGISACLTVTPYYNRPTQKGLYQHFKAISENTKIPQILYNVPIRTGCDLIPETIIKLSKFKNIIGIKEATGDLSRVQKIKNSVHKNFFIISGDDTTFLDFIQLGGHGVISVTANIAAKIMSNICHLALNKNFKLARFMNNKLIPLHQGLFHEPNPIPIKWLAKKIGLIASDTLRLPMTPVSNKTRLILEKALYFSKITAK

SEQ ID NO: 63931 - protein, 815 aa, Parvularcula bermudensis HTCC2503
MARNRLVIIGNGMAPGRVLDHLFERAPGAYDVTIFNAEPRVNYDRIMLSPVLSGEKAFEDIIIHDDAWYEQNGVTLHRGKRVTEIDRQRKTVTAADGTQAEYDKLLIATGSTPFIIPVPGHDLDGVLGYRDLDDVEKMLAAAEQGGRAVVIGGGLLGLEAAVGLKKRGMDVTVLHLAPTLMERQLDEPAGHLLQAAIERRGIEVLTKANTKEILGTERVEGVRLDNGRVIEADLVCMAAGIRPSTELAKDAGLEIGRGIVVGDDLRTSDPDIFAVGECVEHRGICYGLVAPLYEMAKVIAAQLCEDCEAEYLGSEVSTKLKVTGVDLFSAGDFQTGEGREEVVFRDAAKGIYKRLVLEGDRIVGAVFYGDTKDSAWFFQHIKDRTDVSEYRDTLIFGPAFAGSGAPDPMAAVAALPGDAEICGCNGVCKSKIEGAITGEGLTTIDEVRAHTKASASCGSCTGLVEQLLALTLGDEFDPDAVKPVCGCTDLSHDEVRRLIVAGELKSIPSVMQQLEWKTSCGCAKCRPAINYYLVCAWPGEYVDDGQSRFINERVHANIQKDGTYSVVPRMWGGMTSPSELRAIADVADKFAIPTVKVTGGQRIDLLGVQKEDLPAVWADLNAAGLVSGHAYAKGLRTVKTCVGTDWCRFGTQDSTGLGVKLERFLWGSWAPHKVKLAVSGCPRNCAEATCKDIGVVCVDSGYEIHYAGAAGMHVKGTELLCTVPTEKDAIQYIGALMQMYREQGWYLDRIYKWAAKVGTDYVRDTLDDPAERQAYYDRFVYSQQFMQDDPWAARVAGKDAHEFEPITISRELEAV

SEQ ID NO: 63932 - protein, 323 aa, Debaryomyces hansenii CBS767
MANALEQLKSTGTVIVTDTGEFESIAKYTPQDATTNPSLILAASKKAEYAKLIDIAIDYAQDKGSNPKEKASIALDRLLVEFGKEILKIVPGRVSTEVDARLSFNKDATIKKAIEIIKLYESVGISKDRILIKIASTWEGIQAARELESKHGIHCNLTLLFSFVQAVACAEAKVTLISPFVGRILDWFKASTGKEYDGETDPGVISVRKIFNYYKKYGYDTIVMGASFRNTGEIKALAGCDFLTIAPKLLEELYNSNEDVPKKLDSSSANATDEEKVSYIDNEAEFRYLFNEDAMATEKLSEGIRNFAKDCVTLLDQLEARFK

SEQ ID NO: 63933 - protein, 98 aa, Haloarcula marismortui ATCC 43049
MSDDTGDVIDELFAVIEDRKANLPEDSYTASLFTHEKGENAVLEKLGEETTELILAAKDDDTEELAHESADIVYHLLVLLSMKEMDIDDLRAELAKRR

SEQ ID NO: 63934 - protein, 460 aa, Magnetospirillum magnetotacticum MS-1
MSKETGSRRGWEPPYITPHRHDNSKFGRRAARDNCWEQIDGVDVEYLMSRYGSPLFIASERRLRENVRRVRGAFERHYRPVVHGWSYKTNYTSAICRILHQEGSWAEVVSAFEYEKARSLGVPGNRIIFNGPNKPRAILERAIAEGARLHVDHLDELELIERIAREKGEVVPVTLRLNFNTGYTDPWSRFGFNLESGQAHSAASRIKRSAHLRLTGLHSHIGTFILETRAYAEQVRLMCNFMKTVEADGECVIDAIDIGGGLPSRNALQGIYLPPEQAVPAVEEYGAAVCSALEECLADRVGPHPTLFIESGRAVVDDAVSLASTVVGTKRLPDGRAAAVLDAGINSMLTALWYHHPVKLTKPKAGDSADTVLYGPMCMNIDVMRHTVQLPPLSVGDCLVFNPVGAYNNTQWLQFIEYRPAVVLIHSDGEHSVIREAETIEDMNRHDRLPTHLQSPVDLP

SEQ ID NO: 63935 - protein, 838 aa, Xanthomonas campestris pv. campestris str. 8004
MSSPSIAPVTPDLVRLRATARDKDDAIAQAAQLLVAAGCVAPGYDASMRRREGLANTFLGHGLAIPHGVGEDRHLVRRDGIAVLQLPEGVEWNPGQTTRLVVGIAAQSDTHITLLRRLTRLIQDPAQLEALFTTDDPAVIVAALTGDRAPDTSAAPATDLAERFEWTIAYPSGLHARPATRWAETARGFSARAQVRAGDQAADAKSLVGLLQLGLRAGDSITVSAKGSDAPALLKRLRAVMDSLTAQEKADAERAAQRRAAPVIGWTPPQAQPAIVGIGASPGVAIGIVHRLRAAQTEVADQPIGLGDGGVLLHDALTRTRQQLAAIQDDTQRRLGASDAAIFKAQAELLNDTDLITRTCQLMVEGHGVAWSWHQAVEQIASGLAALGNPVLAGRAADLRDVGRRVLAQLDPAAAGAGLTDLPEQPCILLAGDLSPSDTANLDTDCVLGLATAQGGPTSHTAILSRTLGLPALVAAGGQLLDIEDGVTAIIDGSSGRLYINPSEQDLDAARTHIAEQQAIREREAAQRALPAETTDGHHIDIGANVNLPEQVAMALTQGAEGVGLMRTEFLFLERGSTPTEDEQYQTYLAMARALDGRPLIVRALDIGGDKQVAHLELPHEENPFLGVRGARLLLRRPDLLEPQLRALYRAAKDGARLSIMFPMITSVPELISLREICARIRAELDAPELPIGIMIEVPAAAAQADVLARHADFFSIGTNDLTQYVLAIDRQNPELAAEADSLHPAVLRMIRSTIDGARKHDRWVGVCGGLAGDPFGASLLAGLGVQELSMTPNDIPAVKARLRGRALSALQQLAEQALQCETAEQVRALEAQREGQA

SEQ ID NO: 63936 - protein, 698 aa, Oryza sativa
MATAVAATAMRRGQHLPLSLSLCYNLAAVALLVGVFLHAPPRAGAQPLPWQLCNATAGNYTEGSTYQANVRALASALPGNASSSPALFAEGAAGTAPDVVYAIALCRGDTNASSCAACVATAFDTAQQLCAFNKRATLFNDPCILRYSDLDILANVTDNSGRFVAWNYNNVSAAKAAAYDAASGRLVNATADYAAADPVRRFGTGEVGSDDATYPRIFSLAQCTPDMSEADCRSCLGDIIRKATPKYFVGKPGGRVFGVRCNFRFEAYEFFSGRPLLQLSGPPPPPANMTPPVTSEGRTSHRTGRILAITLPIAGAALAFIALTCFCFRRKRTPANKASSLPFSTNPDDIQSIDSLLLDLSTLRAATDNFADRNKLGEGGFGAVYKGVLSEGQEIAVKRLSQSSRQGIEELKTELVLVAKLRHKNLVSLVGVCLEGDEKLLVYEYMPNKSLDTILFDYEKSKDLDWGKRLKIVSGVARGLQYLHEDSQLRVVHRDLKASNVLLDFDHNPKISDFGLAKLFEWDQTQDVTSHIAGTYGYMAPEYAMRGQYSVKSDAFSFGVMILEIVTGRRNSSFSNSEQSIDLLSLVWEHWTTGTIEELLDPAMRGRSADDLLKLINIGLLCVQDNPADRPTMSAVSVMLSSETFSIQAPSRPTFCIQETDSAADTDLYSSALRSTGDSKTRAVASPNEVSLTELEPR

SEQ ID NO: 63937 - protein, 465 aa, Medicago truncatula
MVIINQARRIEGKIVRLGKYELGKTLGEGNFGKVKLARDTDCGQFFAVKILEKNKIVDLNNTDQIKREISTLKLLKHPNVVRLYEVLASKTKIYMVLEYVNGGELFDKISSKGKLTEAHGRKMFQQLIDGVSYCHNKGVFHRDLKLENVLVDAKGNIKITDFNLSALPQHCRADGLLHTTCGSPNYVAPEILANRGYDGAKSDIWSCGVILYVILTGYLPFDDRNLAVLYQKIFKADVQIPRWLSPGAQNIIKKILDPNPKTRVTMDMIKEDEWFKEGYNPANLEDEEEEEDVFIDDEAFSIHEVSLDGDQSPKSPALINAFQLIGMSSCLDLSGFFEQEDVSERKIRFTSNHSPKDLTEKIEDIVIEMGFKVHKKNGKLKVIQEDKAHKSLDSLSVAAEVFEVGPSLYVVELRKSYGDASVYRQLCKRLSNDLGIAEVAEVSSERHGLGIAEAAELVSSESLDI

SEQ ID NO: 63938 - protein, 231 aa, Glycine max
MYTLNHSSYLYHVSPELSSSLDSSSPASEGSRGVAFSDEEVRLAVRHPKKRAGRKKFRETRHPVYRGVRRRNTDKWVSEVREPNKKTRIWLGTFPTPEMAARAHDVAAMALRGRYACLNFADSTWRLPIPATANAKDIQKAAAEAAEAFRPSQTLENTNTKQECVKVVTTTTITEQKRGMFYTEEEEQVLDMPELLRNMVLMSPTHCIGYEYEDADLDAQDAEVSLWSFSI

SEQ ID NO: 63939 - protein, 100 aa, Glycine max
  misc_feature (69)..(69): Xaa can be any naturally occurring amino acid
  misc_feature (78)..(78): Xaa can be any naturally occurring amino acid
DTVEVDAITHRMTCKTGVVNIPYGGTKGGIGCYPAELTISELDRLTRDFTLTNHDQIGSHTDVPAPDMXTGPQTMSWXILYQFSKFLRYFSAVVYWKTFI

SEQ ID NO: 63940 - protein, 411 aa, Sorghum bicolor
MFLADRRGPCRRRDGDAIGHREQEAASLPLVLLLVVLQALPRRPAPAVPAQAACRAASATPRREVEEEEGARPAVDEDGSVGQVRAREKAMVINLEFIRAIVTADEVLLLEPLAQEVIPFIDKLRRHFPLKSVEVDVGATQVGNVDGKHAKTGAECGLPFEFQVLELALEAVCLSFHSSLSDLNKHAIFVLDELTENVSTRNLERVRSLKRNLTSLLAGVHKVRDEVEHLLDHNENRAQLHLSRKQIKSPQDEALLVSSALNCNFPSKTNLDIRNSVINQGTGIAVVAPLDDTVGDLEMLLESYFMQLDGIRNRITMVRGYIVDTEDYINIQLDNLRNGLIQLHLILIIVSFGISTNTLIAASFAINMPNNGDYKKFVGDFWQFVGGTSSFCLLVIVVLLGYAWRNRLLGS

SEQ ID NO: 63941 - protein, 541 aa, Sulfitobacter sp. EE-36
MGWMTNEDGLDKCAANYVPLTPLSHLKRAAHVFADVTAVIYGAHRVSYAQYHARCSQLASALVAAGVEPGQVVATILPNIPAQAEAHFGVPACGAVLNTINTRLDVGTVGYILDHGEARVLLVDTQFVDLAEAACATLDGPPPLLIEVPDPAAGFPATGRHTTYDDFIATGDPAFNWIMPQDEWESLALNYTSGTTGRPKGVVYHHRGAYLMTMGTVVSWRMVMRPVFMQIVPLFHCNGWNHTWMMPLLGGTLVCCRDITAAAIYDAIADEGVTHFGGAPIVLNMMVNATEAERRAFDHQVEVFTAGAPPAPATLSKIEALGFNVTQVYGLTETYGHVTECLWDPAWDSAQGAERAAIKARQGVAMPMMEEITVMDSEMAQVPLDAATQGEIMIRGNSVMKGYFKNPAATRAAFAGGYFHSGDLAVQHPNGHMQIADRAKDIIISGGENISSVEVEGVLMGHPDVNLAAVVAQPDEKWGEVPCAFVELKPGRSGDEAALIAFARDTLAGFKAPKRVVFQELPKTSTGKIQKFELRAQAARL

SEQ ID NO: 63942 - protein, 341 aa, Alkalilimnicola ehrlichei MLHE-1
MNAQKTLVERQRRQPGEPASDERFRALGQAVLELEADAVRTLTERVDATFVRACRHMLACRGRVVVTGMGKSGHIAGKIAATLASTGTPAFFVHPGEASHGDLGMITRDDVVLALSNSGETNEITTILPLIRRLHVPLIALTGNPDSTLARAADDHLDVSVAQEACPLGLAPTASTTASLAMGDALAIALLEARGFTADDFARSHPGGRLGRRLLLLVEDVMHTGTRIPRVGEDTPLAEALLEITRKGLGMTAIVDGDDRILGVFTDGDLRRCLDQGLDIHRLRVGEVMTRGGRTVRPDALAAEALELMESHRINALLVTDDGQRLLGALNMHDLLRAGVV

SEQ ID NO: 63943 - protein, 132 aa, Brassica napus
MAVSFQTKYPLRPITNVSRTNRPSLLHVRVTCSATTTTTTKTQPIREKKLVVEKRFVSPPLSNDPTLKSTWTHRLWVAAGCTTLVASLAKSVIGGVGSHLWLEPALAGYAGYVLADLGSGVYHWAIDNYGDE

SEQ ID NO: 63944 - protein, 571 aa, Arabidopsis thaliana
MTLLSSLGRASRSAPLASKLLLLGTLSGGSIVAYADANEEANKKEEHKKKKVVVLGTGWAGISFLKDLDITSYDVQVVSPQNYFAFTPLLPSVTCGTVEARSIVESVRNITKKKNGEIELWEADCFKIDHVNQKVHCRPVFKDDPEASQEFSLGYDYLIVAVGAQVNTFGTPGVIENCHFLKEVEDAQRIRRGVIDCFEKAILPGLTEEQRRRKLHFVIVGGGPTGVEFAAELHDFIIEDITKIYPSVKELVKITLIQSGDHILNTFDERISSFAEQKFTRDGIDVQTGMRVMSVTDKDITVKVKSSGELVSIPHGLILWSTGVGTRPVISDFMEQVGQGGRRAVATNEWLQVTGCENVYAVGDCASIAQRKILGDIANIFKAADVDNSGTLTMEELEGVVDDIIVRYPQVELYLKSKHMRHINDLLADSEGNARKEVDIEAFKLALSEADSQMKTLPATAQVAAQQGAYLAKCFNRMEQCKELPEGPKRFRTGGHHQFRPFQYKHFGQFAPLGGDQAAAELPGDWVSAGKSAQWLWYSVYASKQVSWRTRALVVSDWTRRYIFGRDSSRI

SEQ ID NO: 63945 - protein, 468 aa, Triticum aestivum
MAAIISRRGAARALALAMARRGMCSAPAPAAALSSEELIRMEQDCSAHNYHPIPMVFSKGEGSHILDPEGNKYIDFLSAYSAVNQGHCHPKVLRALIEQAERLTLSSRAFYNDKFPVFAQYLTSMFGYDMMLPMNTGAEGVETAIKLARKWGYEKKNIPKNEALIVSCCGCFHGRTLGVISMSCDNDATRGFGPLVPGHLKVDFGDIDGLEKIFKEHGDRICGFLFEPIQGEAGVIIPPDGYLKAVRDLCSRHNILMIDDEIQTGIARTGKMLACDWEGVRPDMVILGKALGAGVVPVSAVLADKDIMLCIKPGEHGSTFGGNPLASAVAIASLKVVKDEGLVERAAELGQEFRDQLRKVQQKFPDIIREIRGRGLLNAVDLSSKALYPASAYDICIKLKERGILAKPTHDTIIRLAPPISISPEELTEASKALSDVLEHDLPQLQKQIKKPESEAKTPVCDRCGRDL

SEQ ID NO: 63946 - protein, 433 aa, Nostoc punctiforme PCC 73102
MSIHEVFMPALSSTMTEGKIVSWVKSPGDKVEKGETVVVVESDKADMDVETFYEGFLAHIIVEAGETAPVGSAIAFIAETEAEIEQAKSLANSGGVAATTTSAPEPIPATASVVTPALASQNGSNHKEGRLVASPRARKLAKELKVDLTTLQGSGPYGRIVAEDVEALSNKGKQPATAPVAPPATVPTSAPIASPAPRTPAPAPVVAAVPGQIVPLTTFQNAVVRNMVATISVPVFRVGYTITTDGLDKLYKQIKSKGVTMTALLAKAVAVTLQKHPLLNASYSDQGIVYHSDINISVAVAMDDGGLITPVLQNADAVDIYSLSRTWKSLVERARAKQLQPQEYNSGTFTLSNLGMFGVDKFDAILPPGQGSILAIGASRPQVVATPDGLFGVRQQMQVNITSDHRIIYGAHAAAFLQDLAKLIETNPQSLTL

SEQ ID NO: 63947 - protein, 371 aa, Pyrococcus furiosus
LAKGLEDVYIDQTNICYIDGKEGKLYYRGYSVEELAELSTFEEVVYLLWWGKLPSLSELENFKKELAKSRGLPKEVIEIMEALPKNTHPMGALRTIISYLGNIDDSGDIPVTPEEVYRIGISVTAKIPTIVANWYRIKNGLEYVPPKEKLSHAANFLYMLHGEEPPKEWEKAMDVALILYAEHEINASTLAVMTVGSTLSDYYSAILAGIGALKGPIHGGAVEEAIKQFMEIGSPEKVEEWFFKALQQKRKIMGAGHRVYKTYDPRARIFKKYASKLGDKKLFEIAERLERLVEEYLSKKGISINVDYWSGLVFYGMKIPIELYTTIFAMGRIAGWTAHLAEYVSHNRIIRPRLQYVGEIGKKYLPIELRR

SEQ ID NO: 63948 - protein, 228 aa, Triticum aestivum
MGEEANCDAVMEDGNGNDNGKAKENGHATAVVAMPDVKAKAEDAVVAPGDPRLQGISDAIRVVPHFPKQGIMFNDITTLLLRPGVFKDALDMFVERYRGMGIAAVAGIEARGFIFGPAIALAIGAKFIPLRKPKKLPGEVISETYVLEYGTDCLEMHVGAIEPRERVLIVDDLVATGGTLCAAINLLERAGADVVECACLIGLPKFKDFYKLNGKPVYVLVESLEYEK

SEQ ID NO: 63949 - protein, 209 aa, Rhizopus oryzae
MRFSLLALLGTIVATSVSALKEPPTQLQVGVKKRIPASECTRKSHSGDELSMHYTGTLFDTGEKFDSSLDRNEPFVFTLGAGQVIQGWDQGLLGMCVGEKRRLVIPPHLGYGERGAGGVIPGGATLVFEVELLEIKPGKYNQKAMPVQQQQESPISFTSPSFLVSTGIIVALFLIVFKMAKKQDIAEANEKAAAATAEASTEKKEEKKE

SEQ ID NO: 63950 - protein, 223 aa, Brassica napus
  misc_feature (184)..(184): Xaa can be any naturally occurring amino acid
AYTRTVVKSSSSLVMMMDKRLDSMNQVVEEIMSIHRSLPPRPDIDDVEAATSLIQNVENDDQSRLDAVDREIKSSGVPQELFDVLQEMRRGLVRFQSKEQKREAAKVLDLESAHVLFGELIQRASRCVASPPSSDTNPSRPPLPPVVSPASLYSSDQTPVKSKEMFTRDDTFVTKVKSSLYSDXFLAPRKPQVLDSRLQAKNLSGHDGEKLSLIKLATLIEVS

SEQ ID NO: 63951 - protein, 901 aa, Oryza sativa (japonica cultivar-group)
MRRGFADGTSRDQVEDGNGTNRSIAASSGTATRRNAGSPVALSSSDKVRYRYMMAIHALQLDVKLEAPNRLGEVAARMSVPAIAVYTSPPGAVYTSSSSSELEASSRGSAPCATAAPPSPASSHRHQAIAGGLSCLFSSPTAAPRAAAAQDELGALWHDRSGEATAVGGGGGGGGYSYPQPSSPFKWRDMLHHSPVPLFHSPASSPASRSPSASWLAGRERERLFSSFVRNALGSCVDYAPVAALPLGVSAAVGVGAGELAFELDEHLSEAEPSCEPYARDLLAGAQARHRIFHDELVVKAFFEAERAHRGQTRASGDPYLQHCVETAVLLAKIGANATVVSAGLLHDTIDDSFMDYDQIFRMFGAGVADLVEGVSKLSHLSKLARDNNTASRTVEADRLHTMFLAMADARAVLIKLADRLHNMKTIEALPLVKQQRFAKETMEIFVPLANRLGIASWKDQLENICFKHLNPEEHKELSSKLVISFDEALLTSTLDKLDKGLRDEGISYHSLSGRHKSLYSIYSKMIKKNLTMDDVHDIHGLRLVVDTEQDCYQALDIVHKLWPRVAGRFKDYILHPKLNGYRSLHTVIMCEGIHPFEVQIRTKEMHLQAEYGFAAHWRYKEGGCKHSFVLQMVEWARWVLTWQCEAMSKERSSGLGRSDAIRPPCPFPSHSEDCPYSYTRQCNHDGPIFVIMLEHDKMSVQELPANSTVVDLMERVGANSPRCSPYSFPLKEELRPRVNHKPISDPNRKLCMGDVVELTPALPHKSLTEYREEIQRMYERGGFALATTRDVFVGQKLCAQLVDEPRIVGSGGDSSPGKACGQEAVLNEEKAEENSQLSCRNHESNQTCYQNGDRDLEGTSQSGWIAGLEPWRDATRRSEIEGMAGRWSSIFRVVFGSGVD

SEQ ID NO: 63952 - protein, 291 aa, Methanosarcina barkeri str. Fusaro
MFEGAMPALITPFTKDDRIDREGLQRNIEFVEEGGVAGIVPCGTTGESATLSALEHEEVIDIAVECSKVPVIAGTGSNNTGEALQFTKHAADAGVDGVLLISPYYNKPNPAGLLTHFKKIAEAVDVPMVMYNIPSRTGQDMPLEVIVELAKVENIVGIKEASGNIGKVSQILENTIDEDFVVISGEDNLTLPILSVGGQGVISVAANIVPDRMSRMVNAALAGDYETARKIHFEIAPLIRALFLETNPIPVKKAAELAGLASGNLRLPLAPLSETNTQKVADELRKLGVIE

SEQ ID NO: 63953 - protein, 355 aa, Triticum aestivum
PRVRPRVRMSALLATPTRAQPFLLLLHRLRPNQLHPLRTARGLASFVASSPRAPPTRRGTRAMASQQKFPPQQQDCQPGKEHAMDPRPETLIKNYKSANKLQGKVALVTGGDSGIGRAVCLCFALEGATVNFTYVKGHEDKDAEETLQALRDIKSRTGAGEPKALPGDLGYEENCRRGGGGGGERARRARGHPRQQRGGAVRPALHHRDHRAGPGARVPHQHLLLLPHGQVRGEAHAARVQHHQHHLRERVQGQRDAAGLHGHQGRHRGLHPRAVYAAGGEGDPCQRRRAGAHLDAAHPGLLPGGEGEAVRVRGAHEARRAAQRGRAQLRLPGQRAGLLLHLRPDPPPQRWHHRQ

SEQ ID NO: 63954 - protein, 458 aa, Lactobacillus sakei subsp. sakei 23K
MDKKQREDSQKHEKFIHYADGSSLEEINNTVAIPKNAGFWKTLMAFMGPGALVAVGYMDPGNWITSIAGGAQFAYTLISVILVSNLIAMLLQAMAARLGIVTGMDLAQMTRAKTGKKMGIFLWIVTELAIMATDIAEIIGSAIALELIFNIPLLWGVLITAFDVLLLLLLMKLGFRKIEAIVATLVAVILFVFLYEVILAQPNMGDVVRGFVPSPRIMTDKKMLFLALGIVGATVMPHNLYLHSSIAQARQYDRDDVAEKRKAIKFTVIDSNIQLTIAFVVNCLLLILGAAMFYGTNSDLGRFVDLFNALQNKEIVGSIASPMLSLLFAVALLASGQNSTITGTLSGQIVMEGFVRMKIPLWARRVITRGLSILPVIIFTVYYHGNEAQVENLLIYSQVFLSIALPVSMIPLTLFTSDEKIMGPFVNRPWVKYTAWFVTIVLTLLNIYLILQTVGLAA

SEQ ID NO: 63955 - protein, 367 aa, Glycine max
MATSENNSSARPQREAKKRAAAAISQIHGNAAKKKRVVLGDVTNVSSSDVAVSVSKKPVQTHKNVKLEKPAAPVATPEKVEERHDPQLCGPYVSDIYEYLRGMEVDPSKRPLMDYVQKIQRDVNANMRGVLVDWLVEVAEEYKLVSDTLYFSVAYIDRFLSLNILSRQRLQLLGVASMLIASKYEEIKPPEVEDFCYITDNTYSKEEVVNMEAEILKALKFELGGPTVKTFLRRFSRVGQEGVDTSDLQFEFLSCYLAELSLLDYNCIKFLPSLVAASVVFLARFMFSTKTHPWNSALHQLTRYKPADLKECVLNLHDLYLSRRGASLQAVREKYKQHKFKCVATTPSPPEIPLSFFEFEGQILRQL

SEQ ID NO: 63956 - protein, 601 aa, Medicago truncatula
MPTISVGRDRLFAALGKTYTQEEFEDLCFSFGIELDDVTTEKAIVRKEKHLEKEADEDEEIIYKIEIPANRYDLLCLEGLAQALRVFCGFQEIPTYILSDISKDAMLKMHVKPETSLIRPHVVCAVLRGLTFDKVRYNSFIDLQDKLHQNICRRRTLVAIGTHDLDKLEGPFTYEALPPSSINFTPLKQERSFRADELMEFYKSDLKLKKFLHIIEDSPVYPVIYDSKRTVLSLPPIINGAHSAITLDTKNVFIECTATDLTKAKIVLNTMVTAFAEYCENKFVIEPVEVISSDGKSHIYPDLSVYNMEVSLSYITGLIGVSLEAEEVTKFLNRMQLHAKQSTSDNKQCNFIVSVPPTRSDVLHPCDVMEDVAIAYGFNAIKDQAIVDNKGSKRLAASLTLLPLNELSDLIRKEVAMIGFTEVLTFILCSKKENFSMLNRKDDKSKAVIIGNPRSSDFEAVRTSLMPGILKTVAHNKDHPKPIKIFEVGDIAILDDNDVGAKNLRQLAALYCGANAGFEIIHGLVDKVMEKNGITFVSPGDKSGYYIERSDEPEFLAGRQARIIYKGKQVGTFGIVHPEVLNSFDIPDPCSFVELNIESFL

SEQ ID NO: 63957 - protein, 394 aa, Sorghum bicolor
MDYFSSCWGPRSRAGHRGKGSDAAGRQDGLLWYKDAGQLVTGEFSMAVVQANQLLEDQSQVESGPLSLADPGPQGTFVGVHDGHGGPETARFINDHLFNHLRKFATEHKCVSADVIRKAFQATEEGWLSLVSKEWSMKPQIASVGSCCLVGVICAGTLYVANLGDSRAVLGRLVKATGEAVAMQLSSEHNACHEEVRQELQSSHPDDPHIVVLKHNVWRVKGLIQISRSIGDVYLKKPEYNREPLHSKFRLRETFQRPILSADPQITEHRIQPNDQFVIFASDGLWEHLSTQEAVDLVHSSPRNGIARRLVKAAMQEAAKKREMRYSDLKKIDRGVRRHFHDDTTVVVLFLDSNAMSKASWSKSPSVSIRGGGVTLPAKSLAPFSALAQLNSTY

SEQ ID NO: 63958 - protein, 336 aa, Medicago truncatula
MLNMAMVVTATTLVILLLCSQSSVAILLNKLQLPSPVTGPESLAFDKNGEGPYVGSSDGRIFKYNGPDVGFKEYAYTSPNRNKTVCDGLSDFSAVQATCGRPLGLGFNHQTGDLYVADAYLGLVKVSPDGGNVTQLVGPAQANSTMFADGLDVDPDTGIVYFTVASTNFQLKDYQTLVTSGDSSGSLLRYDPSTNQTTVLLSNLSMPSGVAVSKDGSFVLVGEYLSNRIQRVWLKGPRANSSELFMLLTGRPNNIKRNSAGQFWISVHSVLGLGLPISPRRTALPRGVRVSENRIILQIASLVAEYGIEPASEVQEYNGKLYAGSLLASYASIFIG

SEQ ID NO: 63959 - protein, 1009 aa, Arabidopsis thaliana
MASPHKPWRAEYAKSSRSSCKTCKSVINKENFRLGKLVQSTHFDGIMPMWNHASCILKKTKQIKSVDDVEGIESLRWEDQQKIRKYVESGAGSNTSTSTGTSTSSTANNAKLEYGIEVSQTSRAGCRKCSEKILKGEVRIFSKPEGPGNKGLMWHHAKCFLEMSSSTELESLSGWRSIPDSDQEALLPLVKKALPAAKTGKSLKDPDLQYFSLIFPLIYFGPTGTETAEARQTNSRAGTKRKNDSVDNEKSKLAKSSFDMSTSGALQPCSKEKEMEAQTKELWDLKDDLKKYVTSAELREMLEVNEQSTRGSELDLRDKCADGMMFGPLALCPMCSGHLSFSGGLYRCHGYISEWSKCSHSTLDPDRIKGKWKIPDETENQFLLKWNKSQKSVKPKRILRPVLSGETSQGQGSKDATDSSRSERLADLKVSIAGNTKERQPWKKRIEEAGAEFHANVKKGTSCLVVCGLTDIRDAEMRKARRMKVAIVREDYLVDCFKKQRKLPFDKYKIEDTSESLVTVKVKGRSAVHEASGLQEHCHILEDGNSIYNTTLSMSDLSTGINSYYILQIIQEDKGSDCYVFRKWGRVGNEKIGGNKVEEMSKSDAVHEFKRLFLEKTGNTWESWEQKTNFQKQPGKFLPLDIDYGVNKQVAKKEPFQTSSNLAPSLIELMKMLFDVETYRSAMMEFEINMSEMPLGKLSKHNIQKGFEALTEIQRLLTESDPQPTMKESLLVDASNRFFTMIPSIHPHIIRDEDDFKSKVKMLEALQDIEIASRIVGFDVDSTESLDDKYKKLHCDISPLPHDSEDYRLIEKYLNTTHAPTHTEWSLELEEVFALEREGEFDKYAPHREKLGNKMLLWHGSRLTNFVGILNQGLRIAPPEAPATGYMFGKGIYFADLVSKSAQYCYTCKKNPVGLMLLSEVALGEIHELTKAKYMDKPPRGKHSTKGLGKKVPQDSEFAKWRGDVTVPCGKPVSSKVKASELMYNEYIVYDTAQVKLQFLLKVRFKHKR

SEQ ID NO: 63960 - protein, 331 aa, Medicago truncatula
MVVSVILLAIFLLCSPSSVAVLLNKLQLPPPLTGPESLAFDRNGGGPYVTSSDGRIFKYVGSNEGFKEYAYTAPNRNRTICDGLADFSVVQAICGRPLGLGFNHQTNDLYVADAYFGLVKVGPNGGNATQLVGPTQANSTMFADGLDVDPDTGIVYFTIASTNYKLKDFQTVLASGSGDNSGSLLRYDPSTNQTTVLLRNLTIPSGVAVSKEGSFVLVSEYLANRIQRVWLKGPRANSSELFMLLAGRPDNIKRNSGGQFWISVSSFLGTPRSPGCSTLPSGVRVNENGLVLQIVSLVEEYGPEAASEVQEYNGTLYGGSLLASYATSFTS

SEQ ID NO: 63961 - protein, 227 aa, Coccomyxa sp. PA
MSAKDTADLSPLLEANRKWADECAAKDSTYFSKVAGSQAPEYLYIGCADSRVSPAQLFNMAPGEVFVQRNVGNLVSNKDLNCMSCLEYTVDHLKIKHILVCGHYNCGACKAGLVWHPKTAGVTNLWISDVREVRDKNAAKLHGLSADDAWDKMVELNVEAQVFNVCASPIVQAAWARGQPLSVHGIVYTPGTGLVKELIKPITGMEDAGALLRADLKQHCFFSESLA

SEQ ID NO: 63962 - protein, 267 aa, Triticum aestivum
  misc_feature (196)..(196): Xaa can be any naturally occurring amino acid
  misc_feature (252)..(252): Xaa can be any naturally occurring amino acid
NKFVQKSRLVPVRNSRDIVDPRVRELVANPSIIFMDEPTSGLDARAAAIVMRAVRNTVNTGRTVVCTIHQPSIDIFEAFDELFLMKRGGEEIYVGPLGHNSSKLIEYFEGIEGVSKIKDGYNPATWMLEVTSIVQEEMLSVDFCEIYRRSELYQRNKELIEELSTPHPDSSDLDFPSLYSRSFFTQCLACLWKQKXSYWKNPSYTAMRFLFTIIIALLFGTNVWGLGQKTKRRQDLFMALGSMYAAVLLLEXQNSGTVQPVVPVERT

SEQ ID NO: 63963 - protein, 471 aa, Pseudomonas aeruginosa UCBPP-PA14
MSSVGEQKVQDGSLKRELGERHIRLMALGACIGVGLFLGSAKAIQMAGPAIMISYILGGLAILVIMRALGEMAVHNPVAGSFSQYAKDYLGPLAGFITGWNYWFLWLVTCVAEITAVAVYMGIWFPDVPRWIWALAALASMGTINLIAVRAFGEFEFWFALIKIVTILAMVVVGIGMIAFGFGNDGIATGISNLWAHGGFMPNGIQGVLMSLQMVMFAYLGVEMIGLTAGEARNPTKTIPSAINSVFWRILLFYVGSLFVIMSLYPWNEIGTQGSPFVMTFERMGIKTAAGIINFVVITAALSSCNGGIFSTGRMLYSLAQHRQAPAFFGKASRSGVPRRALILSILALLLGVLLNYLVPEKVFVWVTSIATFGAIWTWAMILLAQLRFRKTLSPAECDKLQYRMWLYPLSSYLALAFLVMVVVLMAFFEDTRIALYIGPPFILLLTVLYYAFNLAPKEPAGTGSVSRAAS

SEQ ID NO: 63964 - protein, 480 aa, Zea mays
  misc_feature (57)..(57): Xaa can be any naturally occurring amino acid
  misc_feature (337)..(337): Xaa can be any naturally occurring amino acid
  misc_feature (460)..(460): Xaa can be any naturally occurring amino acid
MAVSHNVGSKHGVAPLEVSVEAGNGGAAEWLDDDGRPRRTGTFWTASAHIHRFVTGXPGVLSLAIAQLGWVAGPAAMLLFAFVTYYTATLLAECYRTGDPDTGKRNYTYMDAVRSNLGGAKVAFCGAIQYANLVGVAIGYTIASSISMQAVSRAGCFHKRGHAVPCKSSSNPYMILFGAVQILFSQIPDFDQIWWLSIVAAVMSFTYSAIGLSLGIAQTVANGGFKGSLTGISIGADVTSTQKVWHSLQAFGDIAFAYSFSNILIEIQDTIKAPPPSESKVMQKATRLSVATTTIFYMLCGCMGYAAFGDKAPDNLLTGFGFFEPFWLIDVANVAIXVHLVGAYQVFCQPIFAFVERRAAAAWPDSAFVSQELRVGPLAVSVFRLTWRSAFVCVTTVVAMLLPFFGNVVGFLGAVSFWPLTVYFPVEMYIKQRRVPRGSTKWICLQTLSVACLLVSVPAXALRAIADVIEALKVYHPFSS

SEQ ID NO: 63965 - protein, 163 aa, Bartonella henselae str. Houston-1
MLGLIQAAKSLLLLEFMSAFFLAMRQFFSPKPTINYPYEKGVVSQRFRGEHALRRYPNGEERCIACKLCEAICPAQAITIEAGPRRNDGTRRTVRYDIDMVKCIYCGFCQEACPVEAIVEGPNFEFATETREELYYDKEKLLMNGDRWEREIARNILMDAPYR

SEQ ID NO: 63966 - protein, 312 aa, Vibrio vulnificus YJ016
MATKTADYIWFNGKMVPWAEANVHVLTHAMHYGTSVFEGVRCYNTPKGPIVFRHQEHAQRLKDSAKIYRFPIPYSVEEIMEATRETLRQNKLDNAYIRPLAFVGNVGLGVCPPTDTEMDLIIAAFPWGSYLGEEALENGVDAMVSSWNRAAPNTIPTAAKAGGNYLSSLLVGGEARRHGYAEGIALSVDGYLSEGAGENIFVIKNGVITTPPATAAILPGITRDSIMTLAREMGYEVREANIAREALYLADEVFMTGTAAEVVPVRSVDQIQVGAGKRGPITKAVQEAYFGLFNGTTEDKWGWLDYVYPEKK

SEQ ID NO: 63967 - protein, 396 aa, Bartonella henselae str. Houston-1
MAEVNVRNFNINFGPQHPAAHGVLRMVLELDGEVVERVDPHIGLLHRGTEKLMETKTYLQAGPYLDRLDYVAPMNQEHAFVLAIEKLLGVEVPKRGQLIRVLFSEIGRILNHLLNVTTQAMDVGALTPPLWGFEQRERLMIFYERACGARLHANYFRPGGVHQDLPESLVEDIGNFIDPFLIALGKLDALITPNRIFKQRNVDIGVVSIDEAWARGFSGVMIRGAGVPWDLRKSQPYECYDEMEFDIPVGKNSDCYDRYLIRMEEMRQSAKIMRQCVDRLLSTEKNEPVSSLDRKIVPPKRCEMKSSMEALIHHFKLYTEGFRTPPGEVYVAVEAPKGEFGVYLVSDGTNKPYRVKLRAPGFAHLQAMDFLTRGHMLADATAILGSIDIVFGEVDR

SEQ ID NO: 63968 - protein, 236 aa, Triticum aestivum
MDSTADLKGKRPLLQPDDVSAAAAAAAVPDEAEAKPSSSSEEVKEAEPGTEKQEEKPALVLVAEDGVEVCISEPAARMSQMLSHMMEDGCADGRIPTANIHSDILEMVVEYCEKHGPFYDPEASERDRYPFPPFPVELTPTVSSIKPVTYVDPDPHGLKDWDSDFISLDNSTLFEIILAANYLNIEDLLDLGTSAVADKMRGKKPEEIREIFEIENDYTPEQEAEVRKENAWAFEN

SEQ ID NO: 63969 - protein, 141 aa, Oceanobacter sp. RED65
MAVERTLSIVKPDAVGKNVIGEIYSRFEKAGLQIVAAKMIKMDEEMAGGFYAEHKERPFFKDLVGFMTSGPVMVQVLEGEGAVLKNRELMGATNPQEADAGTIRADFAESIDANAVHGSDSTESAAREVSYFFNEEEICPR

SEQ ID NO: 63970 - protein, 308 aa, Pasteurella multocida subsp. multocida str. Pm70
MGKIWVLGDAVVDLIPEGENTYLRCAGGAPANVAVGIARLGATTGFIGRVGDDPLGRFMLNKLQQENVCTQYMHLDPKQRTSTVIVDLKEGERSFTFMVNPSADQFLELSDLPHFNPNDWLHCCSIALINEPSRSSTFAAIHRIKAEGGFFSFDPNLRESLWNSPAEMKTVVNQVVALADVLKFSEEELLFLTDSDTLSDATAKLTQHYPDKLIIVTLGKLGATYYLQGKSQLVSSKKALIPVDTTGAGDAFVSGLLFGISQVKNWQNPTALVEIIKQANACGALATTAKGAMSALPNKQQLDAFLAE

SEQ ID NO: 63971 - protein, 326 aa, Medicago truncatula
MSKSMVVTVILLAIFLLCSPSSVAILLNKLQLPPPVIGPEALAFDRNGGGPYVTSSDGRIFKYVGPSEGFKEYAYTSPNRNRTICDGFSDFSNIQAICGRPLGLGFNHQTGDLYAADGYYGLVKVGPNGGKATQLVGPAQSNSTVFANGLDVDSNTGIVYFTIASTKFQPKDFPTALLTGGIGDNSGSLLSYDPSNNQTTVFLRNLTFASGVAVSGDGSFVLVSEYFANRIRRVWLKGPKANSSDLFMLLAGRPDNIKRNSRGQFWIAVNTVTLSSGVRVTENGIVLQIVSLVEEYGLEAASEVQEYNGTLYGGSLLASYAIIFTP

SEQ ID NO: 63972 - protein, 392 aa, Fusobacterium nucleatum subsp. nucleatum ATCC 25586
MAKRDYYEVLGIDKSASENDIKKAYRKAAMKYHPDKFANASDAEKKDAEEKFKEINEAYQILSDSQKKQQYDQFGHAAFEQGGAGFGGGFNAGGFDFGDIFGDIFGGGGFGGFEGFSGFGGSSRRSYVEPGNDLRYNLEITLEEAAKGVEKTIKYKRTGKCENCHGTGGEDDKMKTCPTCNGQGTIRTQQRTILGVMQSQSVCPDCHGTGKVPEKKCKHCHGTGTAKETVEKKVNVPAGIDDGQKLKYAGLGEASQNGGPNGDLYVVIRIKSHDIFVRDGENLYCEVPISYSTAVLGGEVEIPTLNGKKMIKVPEGTESGKLLKVKGEGIKSLRGYGQGDIIVKITIETPKKLTDKQKELLQKFEESLNEKNYEQKSSFMKKVKKFFKDIID

SEQ ID NO: 63973 - protein, 290 aa, Medicago truncatula
MLNINNSMVMVVTATLAIFLLCSPSSVAILLNKLQLPPPVTGPESLAFDRNGGGPYVTSSDGRIFKYVGPSEGFKEYAYTSLNRNKTVCDGLAEFSALQPTCGRPLGLGFNHQTNDLYVADAYFGLVKVGPNGGNATQLVGPTQANSTVSADGLDVDPNTGIIYFTIASTKFQLNRDGSFVLVGEYLANRIRRVWLKGPKANSSDLFMLLAGRPDNIKRNSRGQFWIAVNSVIGCSTLSSGVRVTENGIVLQTVSLVEEYGAEVASEVQEYNGTLYGGSLLASYAIIFTS

SEQ ID NO: 63974 - protein, 240 aa, Sorghum bicolor
MDGCAMSLAAAAANCRCSRVVYVGNIPFHASEKEVHDACELIGPVRSLRLAADPGTGKRRGYAFVEYPDDETARSACRNLHGHALRGRELRVGLAGRAGRRGVGARGEHEPVGLEDAVHAASLVAGTPPPDSVTRFLAARSARELREIVGQLEGHGPDALRLLQEQVPGLAAAVDLARHLIDMVAADAATEEARNKKRTGVEGSGSDDGDHRAKLRKVDLEEGGGFKDHGAVSAARVMCF

SEQ ID NO: 63975 - protein, 480 aa, Candidatus Pelagibacter ubique HTCC1002
MYEKFGQFIDGSWSPSSNKETYEVINPATEEVLGHASKATPEDVDRALKSAEKGLAVWKKITPWERSYILRRIADKLREKKDVLAKWMTLENGKPLAEGVGETNGAADIFEWNAEETKRIFGQTIESRFEDTRVHVYYQPVGVVAALSPWNFPLILAARKISTALAAGCSVIIKPDTITPGVVMELVDICRECGVPPGAVNLLSGDPPAIASQLIQSDIIKKISITGSLRVGKLILKQAADKVQRATMELSGHSPFIVFDDADVKKAADMAIAAKFRNNGQVCISPNRFYIHENKKEEFINLFIEKTKKLKIGNGMDPDTQLGPLTTQKRLNETEELVEKTKQEGAKVLLGGKRPAGFNKGFYYEPTIFDDVKDDFTIMKQEPFGPLVPMLSFKSFDEVIERANDNDLGLCSYVCTNSMETAHLASEKLETGSVAVNTGVVAIAEAPFGGIKQSGYGREGGSMAIKDYLNVKYTHMGIKG

SEQ ID NO: 63976 - protein, 1002 aa, Rhodopseudomonas palustris CGA009
MPSDPPLAEFTAAYAPDDAALAAELLTTATLTPDREAQIDAIATDLITAIRGSEHGLRGVEAMLREFALSTKEGLALMVLAEALLRVPDAATADAFIEDKLGQGDFAHHRIKSDAVLVNASAWALGLSARLVHAGETPQGTLAALTRRIGAPAVRAATRQAMRLIGNHFVLGETIDAALARAQPYAREGSRYSYDMLGEGARTAADAERYYQSYADAITAIGRRAGNAALPARPGISVKLSALHPRFEAISRDRVMRELTPRLLELAQLAKSHDLAFTVDAEEADRLELSLEVFAACFADPSLKGWDGYGLAVQAYQKRAATVIDHVAELARAFDRRMMLRLVKGAYWDTEIKRTQERGLADYPVFTRKAMTDLNYLHCARKLLALRPLLFPQFASHNALTVATILAEAGDGDGYEFQRLHGMGEALYGRLLADHPQAVCRIYAPVGGHRDLLAYLVRRLLENGANSSFVAQAGDDSVPITELLARPATLIGHPENARNSAIPLPRDLYQPQRINSRGIEFGDRSALAALLGDIEGARRPLPTVASTSPEQAAATVTAARKGFESWSRTSGDHRAAILQRAGDLLEQRRGELIALLQDEGGKTLDDGVAEVREAVDYCRYYASEGRRLFGEPQALPGPTGERNTLALRGRGVFVAISPWNFPLAIFLGQITAGLMAGNAVVAKPAEQTPVIAEVAVRLLHEAGVPPAALHLVQGDGRIGAALVEQRDIAGVVFTGSTEVARAINRTLAAKDGPIVPLIAETGGINAMIVDATALPEQVADDVIASAFRSAGQRCSALRLLCVQDDVADRVIAMIAGAARELTIGDPRDPATHVGPVIDAEAKTRLDTHIATMKRQAQLHFAGTAPASGNFVAPHIFELNRASELTEEVFGPILHVVRYKAAQFDDLLDDIATTGYALTLGVQSRIDDTIARVIARLPTGNVYVNRNIIGAVVGVQPFGGSGLSGTGPKAGGPHYLPRFALEQTVSINTAAAGGNAALLTGSE

SEQ ID NO: 63977 - protein, 370 aa, Arabidopsis thaliana
MRSEITRETKLLFDLPQDVIEEIFSKVPVTCLRRIRSTCKRLYALLKDRGFIRKHFAKSARQYHALMLKNFRFYSVSFNPNGTEMDVASLFNGERSLIDPYSSSEAIISQAFHCDGLLLCTTKENRLVVLNPFSGQTKWLQPQNRCKIDEAYVLGYDNSDFSNSWRRNLGVTPHGGLGLKIYDFSSNSWKKLDVITPEGCLKSYGVSLKGNAYWVYMSKRRGVNDYSLLSFDFSTESFQHLCVPFHQEADCFGTMALSVVREEHLSLLYQSCETLKVEIWMTKEIDTTFVSWKKFLTVDLEPHLPHLLMFSCRMSFFIDEEKKVAVCCDRDNKVHVVGEDEYRVSSGFYFLDFEGITCCLTVFGYVPRLV

SEQ ID NO: 63978 - protein, 543 aa, Arabidopsis thaliana
MDFLDNEMLDIEIHDIGSLHHLLHVDCCFRFAFFKLIGLEDKLKLASSLSIFRSIEFIPGEGDDSVLIENDEDDVTGPSRLWNKTILHDIMTSCIIMHNMIIEDERDIDAPIEERVEVPIEEVEMTVLWLEMPLEEILSRLPLKSTRAVRSTCKKWDSLFKNRSFISKAAAAREGESQMVVLMDHNLHLVSFFFGSDTSVEIKGKRICLNDDSDSEQVKISQVFHCEGLLLCILKDDNFSLVVWNPYWGQTRWIKPRCSFEIPQGCDMYRYAIGYDNKRRNHKILRFIDYEFHYPRDNVVLWYEIYDFESDLWTTLDVTTPHWLINCGNRGVTLKGNTYWCAKKRNSDLFLNADHIICFDFTSERFGPLLLLPFSDLDGVVTLACVREEKLAALVCHEDVVEVWITIKIEANEVLWSKFLTVNVDLGDEIPSSLTYGSFFIDEEKKVAMIFDKTLDRGDTVHIMGEAGYGGQVDLGEPVNKRRCPLVCSYVPSLVQIKKPAGFQRKQQSKLEKRQYVRNISKLRALKTQSSWTLSMSLECHQQ

SEQ ID NO: 63979 - protein, 224 aa, Methanosarcina mazei Go1
MTKEYVKGDLPEKAAILQRDGETYAIAPHIPGGIVYPETLRKLADIAEKYGAAALKVTSAQRIAVVGLKEEDLDSAWGELGMKPGAAIGLCVRSVKICPGTTFCKRGKQDSVGLGLKLDEKYHGMQLPSKFKMGVSGCQNSCSETIIKDVGIVGTAKGFNVSVGGNAGPRPRLGEVVAKDLSEEQVLDLVERIINFYKGYGKSKRIGAMIDEIGIEKFKEGVGL

SEQ ID NO: 63980 - protein, 578 aa, Oceanobacter sp. RED65
MDASFWDGKRAPGVIDQIDLDKYDSVVEVIEHAFKEYADRPAFTSIGHTVTYRQIDEWSAAFANYLQNHTSLKKGDTIAIQMPNTLQYPVVMYGALRAGLRVTNTNPLYTEREMLHQFNDSEAKALVCMDVFAKSVQNIKDQTGLETIIVTSLADMLPGLKRVLINFAAKYVKKMVPSYDLPGAIRLRNALSLGAGKSFKPDHMENPQDTIILQYTGGTTGVAKGAELTNRNLVANMLQSKSMLQQVNENGEKLKGNGQAIAVAPLPLYHIYAFTVHLMALFEQGDHSVLIANPRDTETFIKFISPFKLNAFVGLNTLFVSLMASPNFKKLDFSELKLTLSGGTALMDDTAKRWKELTGSGISEAYGLTECSPAVTMNPGGGLERMGTVGQAVPATALKCIDDEGNEVAIGERGELCVKGPQVMKGYWKRPDASKSAFTEDGEWFRTGDVAIIDEDGFVKIVDRIKDMILVSGFNVFPNEIEAVVSEHPDVDNCAVIGVPDDKSGEAVKLYIMTENSNLTGDDMKAWLKDKLTGYKMPRHIEFRDELPMTPVGKILRRELKDEEEAKRAKKPESEKVA

SEQ ID NO: 63981 - protein, 498 aa, Medicago truncatula
MGILSYLCYSLFYLSIFFIIRLLFQSRKFKNLPPGPTSLPIIGNLHHLKRPLNRTFKALTEKYGNVISLWFGSRLVVVVSSLSEFQECFTKNDVVLANRPRFLSGKYIFYNYTTLGSTSYGEHWRNLRRITSLDVLSNHRINNFAPIRRDETQRLIKKLAEDSSTKFAEVELTFRFFDMTFNNIMRMISGKRYYGDDCDISEVQEASQFRDMVSELLQLSGANNKTDFMPLLKFLDFENLEKRVKRIGEKNDVFLSGLLQEQRSKKERTNTMIDHLLNMQESQPEYYTDTIIKGLCLAMLLAGTDSSAVTLEWTMSNILNYPEVLKKVRDEVDTHVGQDRLVDESDLPKLTYLRNVIYETLRLYTPAPLLLPHSTADECIMGGYKVPRDTIVLINAWAIHRDPETWSEATTFKPERFDKKGELEKMIAFGMGRRACPGEGLALRAISMTLALLVQCFDWKRINDEKIDMSERDGFTMTKLLPLKAMCKTRPVVNKVFK

SEQ ID NO: 63982 - protein, 501 aa, Medicago truncatula
ALFYYSLLSLSFIITIKILLKITSRRLKNLPPGPPTIPIIGNLHHLKHPLHRTFTTLSQTYGDIFSLWFGSRLVVVVSSPSLAHECFTKNDIILANRPRFLTGKYIFYNYTTLGSASYGDHWRNLRRITTIDVLSNNRLNSFLGVRRDETNRLIQKLLKDVVSEGFGFTKVELRPRLTEMTFNAMMRMISGKRYYGDDGDVSDVEEAKQFREIISEMMSLLGANNKGDFLPLLRVVDLDNLEKRCKRIAKRSNAFLEGLIEEHRRGNIHSDGGTMIDHLLKLSESQPEYYSDHLIKGLIQGMLLAGTDTSAVTIEWVMSELLNHPEVLKKAKEELDTQIGKNKLVDEQDLSKLPYLQNIISETLRLHPPAPLLLPHYSSEDCTIGEFNVPKDTIILTNVWGIHRDPKHWNDALSFKPERFEKEEEVNKVMAFGLGRRACPGLSLAQRTVGFTVGLLIQCFEWERESEEKLDMMEGKGITMPMKIPLRAMCKALPIANDVTK

SEQ ID NO: 63983 - protein, 427 aa, Saccharomyces cerevisiae
MHHNSQSLSSGHIRSPEDENVAPIGNLKHRTGSLSHISSAHPRVALSRVTNIVATNSSNNSISKPKVAPIKERLDSAAIIEEERLDANSVAQRKEADHNDLLTDREQEEPVEDDGESEEDEEEDQEPLLLQHYASDTLVWEHAFRTYYRTTLDPNDDDVYDVVMVAELSNEIFEYMRKLEDLYKPNPYYMDKQPELRWSFRSTLIDWIVQVHEKFQLLPETLYLCINIIDRYLCKEVVPVNKFQLVGAASLFIAAKYEEINCPTIKDFVYMSENCYSRNDLLDAERTILNGLEFELGWPGPMSFLRRISKADDYEHDTRTLAKYLLESTIMDHRLVSAQPSWLAAGAYFLSKIILGQNQWSLAHVYYSNYTQEQILPLATIILENCRYASKRHNAIWRKYSSRRYLHSSQIVAKWIALAEHRVERSN

SEQ ID NO: 63984 - protein, 331 aa, Spinacia oleracea
MAASLQASTTFLQPTKVASRNTLQLRSTQNVCKAFGVESASSGGRLSLSLQSDLKELANKCVDATKLAGLALATSALIASGANAEGGKRLTYDEIQSKTYLEVKGTGTANQCPTVEGGVDSFAFKPGKYTAKKFCLEPTKFAVKAEGISKNSGPDFQNTKLMTRLTYTLDEIEGPFEVSSDGTVKFEEKDGIDYAAVTVQLPGGERVPFLFTIKQLVASGKPESFSGDFLVPSYRGSSFLDPKGRGGSTGYDNAVALPAGGRGDEEELQKENNKNVASSKGTITLSVTSSKPETGEVIGVFQSLQPSDTDLGAKVPKDVKIEGVWYAQLEQ

SEQ ID NO: 63985 - protein, 387 aa, Pasteurella multocida subsp. multocida str. Pm70
MSVIKMTDLDLSGKRVFIRADLNVPVKDGKVTSDARIRATIPTLKLALEKGAKVMVTSHLGRPTEGEFDEANSLKPVVDYLNANLDVPVRLVRDYLDGVDVNQGEIVVLENVRINKGEKKNDPELGKKYAALCDVFVMDAFGTAHRAQASTYGVAEYAPVACAGPLLAAELDALGKALKEPARPMVAIVGGSKVSTKLEVLNSLSKIADQIIVGGGIANTFIAAAGHNVGKSLYEEDLIPVAKNLAASTDIPVPVDVRVGLEFSETAAATEKAVNEVKDDESIFDIGDKSAEQLAEIIKNAKTILWNGPVGVFEFPNFRKGTEIISHAIANSEGFSIAGGGDTLAAIDLFGIKDKISYISTGGGAFLEFVEGKVLPAVEILEKRANG

SEQ ID NO: 63986 - protein, 288 aa, Xanthomonas campestris pv. campestris str. 8004
MTNTSIPADLGDWIIAQAIAGHPPEHTLQPLLEAGWSEQDAIDAVEALVRAHVQAHAQAHGLPVPVPVRVPAPLQADASSLLDLGDRQVQVLVSLMLPRVVVLGGLLADDECDALIALARPQLARSRTVDNRDGSEIVHAARTSHSMALQPGQDALCQRIEARIAQLLEWPVEHGEGLQVLRYATGAQYAPHYDYFEPDAPGTPVLLQHGGQRVASLVMYLNTPERGGATRFPDVHLDVAAVKGNAVFFSYDRPHPMTRTLHAGAPVLAGEKWVATKWLRERPLHAPT

SEQ ID NO: 63987 - protein, 2745 aa, Magnaporthe grisea 70-15
MASLQFVVSSLETIAKDSHRNKQLSESVQTALAAIKESDPQLPDPEVIFAPLQLATKSGSVPLITNALDSIGKLTSSSYFSQLSSQEGSAERAPLIERAIDTICDCFQGETTHADVQLQIVKSLLAAVLNDKIIVHGAGLLKAVRQVYNVFLLSRSPVNQQVAQGTLTQMAGTVFERVKTRLHMKESRLNLSRLAQSSSKLTLEVQESINGSSAPSADYDDRDSDAGGETPVERRDEDAKLTIKDLEKMKNFDDSGLGDGPTMVSQVKPAKRVARSISENTQGDASLDDSPEALDAEDEVYIRDAYLVFRSFCNLSTKVLSQDQLYDLRGQAMRSKLISLHLIHTLLHSNIAVFVSPLCTITNTKNNEPTSFLEAIKYYLCLSITRNGASSVDKVFDVTCEVFWLILKFMRASFKKEIEVVLNEIYLALLARKTAPLSQKLYFVGILNRLCADPRALVEVYLNYDCDRNVDNIFQTLIEDLSRFATAPVAITPAQEQLFEERHSKGNQATDWQTKGAMPPPLSATQIAPQNEIESDIPKEYAIKRMSLDSLVEALRSLVNWSQSGRPDGNAGTVNESERRSSLEDARDSIDPSYSEGLSRGDTPALPSTPVIDDDPEHLEKEKARKTAMTNAIKVFNFKPKKGIALLLKEGFIASDRPEDIAKFLIQEERLDKAQIGEYLGEGEPKNIEIMHAFVDTMDFTKRRFVDALRQFLQSFRLPGEAQKIDRFMLKFANRYVMGNPNAFANADTAYVLAYSVILLNTDLHSSKIARRMSKEDFIKNNRGINDNADLPEEYLISIYDEIASNEIVLTSERQAAAAAGTVPPQATGIAAGIGQAFSSRDYQREAYVQQSEEISLRSEQLFKNLFKSQRRNAEMAGIKFIPATSFKHVGPMFDVTWMSFFSALSSQLQKALNLEVIKLCLEGMKLAIKIACFFDLPTPREAFISAVKNTANLNNPQEVFAKNLEALRVLLELGYTEGNYLRQSWKDILMCVSQLERLQLMAGGVDANSVPDVSKARFQPPARDNPSDARKSAATKRQRQRSNTATHGLNTDIAYEILSDEMIKSMDRIFTNTANLNGDAIGHFARALTEVSWDEIKVSGSNDQPRMYSLQKIVEISYYNMTRVRFEWTTIWDVLGDHFNNVGCHINEAIVFFALDSLRQLSMRFMEIEELPGFKFQKDFLKPFEHVMSNSSNIRVKDMVLRCLIQMIQARGENIRSGWRTMFGVFTVAARDPSESIVSMAYENVSHVYKTRFGVVISQGAFTDLIVCLTEFSKNMKFQKKSLQAMETLKSIIPRMLKAPECPLSRKYTSNNQLKEASTIESPIKSPGQSRTSIEEAFWFPVLFAFHDVLMTGEDLEVRSNALNYFFEALLRYGGDFPPEFWDTLWRQQLYPIFMVLRSRPEMSNVLNHEELSVWLSTTMIQALRNMITLFTHYFDALEYMLDRFLELLALCICQENDTIARIGSNCLQQLILQNVTKFTPEHWAKIVGAFCELFERTTAYQLFSATTINSTASLSLSPPPSGLDFGGPLSPGLDSPKLDEKSLKINGGEENGYLSDGESTVDTSAEAGEDPLKTPTAHPSQTVVAAATDNVPSPVLEDYKPSSHLQQQPVVVTAARRRFFNRIISRCVLQLLMIETVNELFSNEAVYAQIPSSELLRLMGLLKKSFLFARRFNNDKELRMRLWREGFMKQPPNLLKQESGSAATYIAILFRMFADQAPGRRESKSDVENALVPLCKDIIRGYISLEEESQHRNILAWRPVVVDVLEGYAALPESAFRNHAKAFYPLVVDLVAKELSGELRSALLLVLRRVGEYELGIEGMATSSSYNHRGHNRSDSVVTMSTEGGGGGHSPSVEVESGDASSRFMGREKSRNKRRPRWPFLINSTRPATSTVGTENHQLSYYLLVVLHNPTNDECGVLGGTLEPIATLPTAVSIAPCLLKATQWAADMSLFGFNPFGLGSREPAAPQTLESRTLEAVADHIKSGKVKRITVMTGAGISTAAGIPDFRSPGTGLYSNLERLKLPEPEAVFDISFFRDRPEPFYVLAKELYPGKFQPTISHAFIALLSKKGLLQMNFTQNIDCLERQAGVPGEKVIEAHGSFATQSCIECKELFPDDEMLLHVEKEIVPRCASCNGLVKPNIVFFGEPLPRTFSEKCHLVAESDLAIIIGTSLTVYPFAGLPELVPRGSPRLLLNKVRVGQIGTRSDDVVELGSCDAGVRKLADLLGWRDELEDLWRSVVGDAEADRQIAAKDDEQGGYSDDSSDSDPDEDMRKLAEVVNRMNLGLETSAVDDSSSKPGDDGVPKATMKSPDETASSDNLKPEDPSMGDKHKMEQSNSTQVRSVESQQKKGTGASNQVEEAVSTHGSAGEAKTKNTRPDTSQQAQPPVNALAAPVQSSSGGKVEEALTVSTQQDFSQTREPPAVWVLQVKKLNLEGWDRGIGHYLLQRLSELPRDAPKPHVVTSSGGNAGLAAVHAARNVGLPCTVVVPLLIKPLMIEKLKAAGAHEVVRHGATWQETDDYVRHEFMAKSEVPTIYIPPFNHPDVWTGHSTMVHEMAKQMPTGTLPDAIICSVGGGGLLNGICQGVDDVAAAADPSRAKPIILAVETEGADSLNASVKAGELVELPGITSLATSLGAKKVTVKTLEYAQQDHVRSHVLTDAEAAMGCWKLADDERLLVELACGVSVSLCYGGRLEKALGRKVKADDSVVIVLCGGSNITVEMLREYREMFGGHAAVAEHQTSSSI

SEQ ID NO: 63988 - protein, 712 aa, Oryza sativa
MGQLSAILIVFHVSLLKISLNPKSWLIKLRQWKSCYNRYDVGVPNIGIEDPCQNAVQIPEDNDSQVNVFARSPEKDEKQCPGSNQAPSQSTDKKDGTLQPNSGVNRTVIWKMDNGRTMIITGSEFTPEDAARIPKRERFSADDDDDNDDDNDDNDDATLDSFRERELKFKAYHVPKDCQLNAVIAKTKKEQGTTVQPIRQPMTIDNSGHNPSALPPTPAPVEANHGRSNVTKDVHKSLLVPVSAAKVHNQEPAPRDQASRFCRNCRKPGHRFSDCPLPRAAKAVRRDSQVTSTAHDTNRHLNVQPPPQRIIVKGTVKGRIVPPAIVSSLQHQRQQGKQCQENNSSLQLQRGGTLLRQHPRQVLSAPGRATVVRSSNAPRIAPIWRPIDKSPLGNPTGKKILPVTADKTVAPPPSKINKQSNVPEVEGVLTQSGTSPDYKVGNRITDISQKMVEELKESVKEEQAEKKEEAAKEKPDEPQEIVLKVDMHCEGCAKKVEKSLLRFEGQKAFHTVSNYDFCRRAADPSKVCERVQRKTKRRVELIFPLPPPPEEEKKEEAPAPPPEEKKEEPPKTITVILKVQMHCDACAQILQKRISRTEGVESVETDLLNGLVVVKGVMDPAVLIESIQRKTRRPAVIVEEVKPREEEKKAEEEEKKPDEDKADGIEEIKKYDFWPPVQYYVEYVYPYPLPPPPTALVSEEFSDENPNACTVA

SEQ ID NO: 63989 - protein, 238 aa, Zea mays
MTVPDAESRFHVLAVDDSLVDRKLIEMLLKTSSYQVTTVDSGSKALELLGLRDASSPSPSSPDHQEIDVNLIITDYCMPGMTGYDLLKRVKGSSSLKDIPVVIMSSENVPARISRCLQDGAEEFFLKPVKLADMKKLKSHLLKRKQPKEAQAQAQQGQAVELEPEQQLDPRAQPAHDAEETAAEPPPAASNGTADGGNKRKAAAMEEEGMLAVMTVAAPESSTKPRLSTTSNSLAVET

SEQ ID NO: 63990 - protein, 192 aa, Oryza sativa (japonica cultivar-group)
MGSGSGSFLKVVVKNLDVLAGPIVSLAYPLYASVRAIETKSAVDDQQWLTYWVLYSFITLFELTFSPVLEWLPLWSYAKLFFNCWLVLPYFNGAAHVYEHFVRPMVVNQQIVNIWYIPRKDESDRPDDVISAAQRYIEQNGSRAFESLVNKFKASNTRRSILEEVEAERRAKAELEAEARDENPFFNQNYRY

SEQ ID NO: 63991 - protein, 367 aa, Xanthomonas oryzae pv. oryzae KACC10331
MHPPRLLSRLVASLAASLGVGAAQAQSPASPPSPIVLSEFIADPAPTPQAHASTLLETRDGRLLAAWFGGAHEGAADVGIWLAQRGPQQWQTPRHLADGAHAGVDGAAVPAWNPVLFQSATGPLQLYYKLGPNPRQWWGLRLLSTDDGAHWSPPQRLPDGILGPIKNKPVQLPNGRILAPSSSEDRGWRAHLEWSDDDGAHWQRGMPLNDASVIGAIQPSLLLYPDGRLQALGRSQQNKLFSTFSNDGGLHWQPMHLLDVENPNSGTDAVMLRDGRALLVYNPAIAGKDWWEGRGTLAVAVSNDGTHWQRMLTLENSEKDEFSYPAVIQTRDGLVHISYTWKRQRIKHVVLDPTRINASAAASRPSP

SEQ ID NO: 63992 - protein, 316 aa, Salmonella enterica subsp. enterica serovar Typhi Ty2
MNQLDGIKQFTTVVADSGDIESIRHYQPQDATTNPSLLLKAAGLEQYGHLIEDAIAWGKKHGGTQEQQVAAASDKLAVNFGAEILKSIPGRVSTEVDVRLSFDKEKSIEKARHLVDLYQQQDVDKSRILIKLAATWEGIRAAEQLEKEGINCNLTLLFSFAQARACAEAGVYLISPFVGRIYDWYQARSPLEPYVVEEDPGVKSVRNIYDYFKQHRYETIVMGASFRRTEQILALTGCDRLTISPNLLKELKEKEEPVIRKLVPSSQMFHRPTPMTEAEFRWEHNQDAMAVEKLSEGIRLFAVDQRKLEDLLAAKL

SEQ ID NO: 63993 - protein, 468 aa, Candidatus Pelagibacter ubique HTCC1002
MTAANVLKFIKEKEVEFVDLRFTDPRGKLQHLTMDQTIVDEEMLNEGVFFDGSSIAGWKAINESDMILIPDTSRMIMDPFTSHNTLILFCDILDAVKRSPYERDPRGTAKKAEAYLKKSGIGDKAFFGPEPEFFVFDDVRINNDPNNTGFKIDSKEGPYNSGTEYANGNMGHRPPVKGGYFPVPPVDSEQDMRGEYLKSLKEVGIKVEKHHHEVAPSQHELGMYFGTLVDQADNVQLYKYVVQMVTHSFGKTATFMPKPIAGDNGSGMHIHQSIWKDDKPVFSGDAYAGLSETALHYIGGILKHAKAINAFSNATTNSYKRLIPGFEAPVLLAYSARNRSASCRIPISLSKNGARCEIRFPDASGNPYLTFAAMLMAGLDGIKNKIHPGESFDKDLYELPPEEVKNIPTVCGSLREAMESLDKDREFLTEGGVFTDDQIDAYIALKFEEIHRFEHAPHPVEFEMYYSS

SEQ ID NO: 63994 - protein, 499 aa, Medicago truncatula
MTTFYLSLIISLFFLIITLKVFFNTSRKFKNLPPGPQCLPIIGNLHQLKQPLHHTFHTLSQKYGQIFSLWFGSRLVVVVSSLTIAQECFTKNDIVLANRPHFLTGKYIGYNNTTVAQSPYGDHWRNLRRILSIEILSSHRLNSFLEIRRDEIMRLIQKLAQKSYNGFTEVELRPMFSEMTFNTIMRMVSGKRYYGNDCDVSDVEEARLFRGIIKEVVSLGGANNVGDFLGFLRWFDFDGLEKRLKKISKRTDAFLQGLIDEHRFGKRNSNTMIDHLLTQQQSQPEYYTDQIIKGLMVVMLLAGTDTSSVTIEWAMSNLLNHPEIMKKAKNELDTHIGHDRQVDEHDISKLPYLQSIVYETLRLHAAAPLLVPHLSSEDFSLGGYNIPQNTILMVNAWVIHRDPNLWSDPTCFKPERFEKEGEVNKLLSFGLGRRACPGENLSQRTEGLTLGLLIQCFEWKRIGEEKIDMVEAKGITAGKKTSLNAMCKVRHPLKINDVF

SEQ ID NO: 63995 - protein, 435 aa, Bordetella bronchiseptica RB50
MPGGRACARLQGFVALQSCGAPAARGLFPPLFLSPFRIPIMRKFSRIERLPPYVFNITGELKMAARRRGEDIIDMSMGNPDGATPQHIVDKLVEASTRPDTHGYSVSKGIPRLRKAICDWYMRRYAVEFDPDSEAIVTIGSKEGLAHLMLATLDRGDTVLVPNPSYPIHIYGAVIAGANIRSVRMTPGIDFFEELERAVRESIPKPKMMILGFPSNPTAQCVDLSFFERVVALAKEHDILVVHDLAYADVCFDGYVAPSIMQVPGARDVAVEFFTMSKSYNMAGWRIGYMVGNRELVGALARIKSYHDYGTFTPIQVASIAALDGPQDCVNEIVAQYQRRRDVLARGLHEAGWNVEIPKASMYIWAQIPEPYRAMGSLEFAKRVLSDAKVAVSPGIGFGEYGDEYVRFALIENEQRTRQAVRGIKDMFRKDGLLK

SEQ ID NO: 63996 - protein, 1075 aa, Salmonella enterica subsp. enterica serovar Paratyphi A str.
MPKRTDIKSILILGAGPIVIGQACEFDYSGAQACKALREEGYRVILVNSNPATIMTDPEMADATYIEPIHWEVVRKIIEKERPDAVLPTMGGQTALNCALELERQGVLEEFGVTMIGATADAIDKAEDRRRFDIAMKKIGLDTARSGIAHTMEEALAVAADVGFPCIIRPSFTMGGTGGGIAYNREEFEEICERGLDLSPTNELLIDESLIGWKEYEMEVVRDKNDNCIIVCSIENFDAMGIHTGDSITVAPAQTLTDKEYQIMRNASMAVLREIGVETGGSNVQFAVNPKNGRLIVIEMNPRVSRSSALASKATGFPIAKVAAKLAVGYTLDELMNDITGGRTPASFEPSIDYVVTKIPRFNFEKFAGANDRLTTQMKSVGEVMAIGRTQQESLQKALRGLEVGATGFDPKVSLDDPEALTKIRRELKDAGADRIWYIADAFRAGLSVDGVFNLTNIDRWFLVQIEELVRLEEKVAEVGITGLNADFLRQLKRKGFADARLAKLAGVREAEIRKLRDQYDLHPVYKRVDTCAAEFATDTAYMYSTYEDECEANPSVDRGKIMVLGGGPNRIGQGIEFDYCCVHASLALREDGYETIMVNCNPETVSTDYDTSDRLYFEPVTLEDVLEIVRIEKPKGVIVQYGGQTPLKLARALEAAGVPVIGTSPDAIDRAEDRERFQHAVDRLKLKQPANATVTAIEQAVEKAKEIGYPLVVRPSYVLGGRAMEIVYDEADLRRYFQTAVSVSNDAPVLLDRFLDDAVEVDVDAICDGEMVLIGGIMEHIEQAGVHSGDSACSLPAYTLSQEIQDVMRQQVQKLAFELQVRGLMNVQFAVKDNEVYLIEVNPRAARTVPFVSKATGVPLAKVAARVMAGKSLTEQGVTQEIIPPYYSVKEVVLPFNKFPGVDPLLGPEMRSTGEVMGVGRTFAEAFAKAQLGSNSTMKKQGRALLSVREGDKERVVDLAAKLLKQGFELDATHGTAIVLGEAGINPRLVNKVHEGRPHIQDRIKNGEYTYIINTTAGRRAIEDSRVIRRSALQYKVHYDTTLNGGFATTMALNADATEKVTSVQEMHAQIKKS

SEQ ID NO: 63997 - protein, 410 aa, Arabidopsis thaliana
MERAAILPSVNQNYLLCPSRAFSTRLHSSTRNLSPPSFASIKLQHSSSSVSSNGGISLTRCNAVSSNSSSTLVTELADIDWDTVGFGLKPADYMYVMKCNIDGEFSKGELQRFGNIEISPSAGVLNYGQGLFEGLKAYRKKDGNNILLFRPEENAKRMRNGAERMCMPAPTVEQFVEAVTETVLANKRWVPPPGKGSLYVRPLLMGTGAVLGLAPAPEYTFIIYVSPVGNYFKEGVAPINLIVENEFHRATPGGTGGVKTIGNYAAAQSIAKAKGYSDVLYLDCIYKRYLEEVSSCNIFIVKDNVISTPEIKGTILPGITRKSMIDVARTQGFQVEERNVTVDELLEADEVFCTGTAVVVSPVGSVTYKGKRVSYGEGTFGTVSKQLYTVLTSLQMGLIEDNMKWTVNLS

SEQ ID NO: 63998 - protein, 294 aa, Daucus carota
MDQYEKVEKIGEGTYGVVYKARDRVTNETIALKKIRLEQEDEGVPSTAIREISLLKEMQHENIVRLQDVVHSEKRLYLVFEYLDLDLKKHMDSCPEFAKDPRLIKMFLYQILRGIAYCHSHRVLHRDLKPQNLLIDRRTNALKLADFGLARAFGIPVRTFTHEVVTLWYRAPEILLGSRHYSTPVDVWSVGCIFAEMVNQQPLFPGDSEIDELFKIFRIVGTPNEDTWPGVTALPDFKSAFPKWPSKELGNVVPNLDVAGLNLLKKMLCLDPSRRITARSALEHEYFKDIGIVP

SEQ ID NO: 63999 - protein, 431 aa, Thermus thermophilus
MDDHAEKFLWGVATSAYQIEGATQEDGRGPSIWDAFARRPGAIRDGSTGEPACDHYRRYEEDIALMQSLGVRAYRFSVAWPRILPEGRGRINPKGLAFYDRLVDRLLASGITPFLTLYHWDLPLALEERGGWRSRETAFAFAEYAEAVARALADRVPFFATLNEPWCSAFLGHWTGEHAPGLRNLEAALRAAHHLLLGHGLAVEALRAAGARRVGIVLNFAPAYGEDPEAVDVADRYHNRYFLDPILGKGYPESPFRDPPPVPILSRDLELVARPLDFLGVNYYAPVRVAPGTGTLPVRYLPPEGPATAMGWEVYPEGLHHLLKRLGREVPWPLYVTENGAAYPDLWTGEAVVEDPERVAYLEAHVEAALRAREEGVDLRGYFVWSLMDNFEWAFGYTRRFGLYYVDFPSQRRIPKRSALWYRERIARAQT

SEQ ID NO: 64000 - protein, 337 aa, Zea mays
MAFASSSFRLAALFLVLLAFVSLARHATGEASPSRRLMELYKPPPSDLLRYHDGAVLSGDIPVSVLWYGRFTPAQKAIVTDFLLSLSAAPTSPAPSVSQWWGTIDRLYLSKAADAAAVGKSGAHGGGGGRKGARVVLAGQVSDEGCSLGKSLTLAQLPALAAAARPAKGGLALLLTAQDVLVEGFCMSRCGHHGSYGARPRVAAAAYAWVGNPGTQCPGQCAWPFHQPPYGPQAPPLVPPNGDAGMDGAMISVASMVAGAVTNPFGDGFYQGDRAAPLEAATACAGVYGNGAYPGYAGQLLVDAATGASYNANGARGRKYLLPALYDPDTAACTTLV

SEQ ID NO: 64001 - protein, 431 aa, Thermus filiformis
MAENAEKFLWGVATSAYQIEGATQEDGRGPSIWDTFARRPGAIRDGSTGEPACDHYHRYEEDIALMQSLGVGVYRFSVAWPRILPEGRGRINPKGLAFYDRLVDRLLAAGITPFLTLYHWDLPQALEDRGGWRSRETAFAFAEYAEAVARALADRVPFFATLNEPWCSAFLGHWTGEHAPGLRNLEAALRAAHHLLLGHGLAVEALRAAGAKRVGIVLNFAPVYGEDPEAVDVADRYHNRYFLDPILGRGYPESPFQDPPPTPNLSRDLELVARPLDFLGVNYYAPVRVAPGTGPLPVRYLPPEGPVTAMGWEVYPEGLYHLLKRLGREVPWPLYITENGAAYPDLWTGEAVVEDPERVAYLEAHVEAALRAREEGVDLRGYFVWSLMDNFEWAFGYTRRFGLYYVDFPSQRRIPKRSALWYRERIARAQL

SEQ ID NO: 64002 - protein, 433 aa, Pasteurella multocida subsp. multocida str. Pm70
MAKIVKVIGREIIDSRGNPTVEAEVHLEGGFVGLAAAPSGASTGSREALELRDGDKARFLGKGVLKAVAAVNNEIAQALVGKDATNQAEIDQIMIDLDGTENKSKFGANAILAVSLANAKAAAAAKGMPLFAWIAELNGTPGQYSMPLPMMNIINGGEHADNNVDIQEFMIQPVGAKTLKEALRIGAEVFHNLAKVLKGKGLSTAVGDEGGFAPNLESNAAALACIKEAVEKAGYVLGKDVTLAMDCASSEFYNKENGMYEMKGEGKSFTSQEFTHYLEELCKEYPIVSIEDGQDESDWEGFAYQTKVLGDKVQLVGDDLFVTNTKILKEGIEKGIANSILIKFNQIGSLTETLAAIKMAKDAGYTAVISHRSGETEDATIADLAVGTAAGQIKTGSMSRSDRIAKYNQLIRIEEALGDKAPFLGLKAVKGQA

SEQ ID NO: 64003 - protein, 464 aa, Magnaporthe grisea 70-15
MFAPILRRRALQKTSSLRYVTPALTRWYASYPPHTVVKMPALSPTMTAGNIGAWHKKPGDGIAPGDVLVEIETDKAQMDFEFQEEGVLAKVLKETGEKDIAVGNPIAVLVEEGTDVKAFENFTLADAGGEAPASSPPKEEKNVEESSKAASTPTPTPAPEPENTKSAGRLQNALDREPNAEPAAKRLANEKGIKLDGVKGSGKNGKITAEDVKKLGSSGPAAAAAAGPAGALYEDIPISNMRKTIANRLKESVSENPHYFVSSSLSVSKLLKLRQALNSSSEGKYKLRVNDFLIKAIAVASKKVPQVNSSWRDGVIRQFNTVDVSVAVSTPSGLITPIVKAVETKGLESISASVKELAKRARDNKLKSDEYQGGTISISNMGMNTAVERFTAVINPPQAAIVAIGTTKKVAVPVENEDGTTGVEWDDQIVITGSFDHKVVDGAVGAEWMKELKTVVENPLQLLL

SEQ ID NO: 64004 - protein, 436 aa, Thermus sp. IB-21
MTENAEKFLWGVATSAYQIEGATQEDGRGPSIWDAFARRPGTIRDGSTGEPACDHYHRYEEDIALMQSLGVGAYRFSVAWPRILPEGRGRINPKGLAFYDRLVDRLLAAGITPFLTLYHWDLPQALEDRGGWRSRETAFAFAEYAEAVARALADRVPFFATLNEPWCSAFLGHWTGEHAPGLRNLEAALRAAHHLLLGHGLAVEALRAAGTKRVGIVLNFAPVYGEDPEAVDVADRYHNRYFLDPILGRGYPESPFQDSPPVPILSRDLELVARPLDFLGVNYYAPVRVAPGTGPLPVRYLPPEGPVTAMGWEVYPEGLYHLLKRLGREVPWPLYITENGAAYPDLWTGEAVVEDPERVAYLEAHVEAALRAREEGVDLRGYFVWSLMDNFEWAFGYTRRFGLYYVDFPSQRRIPKRSALWYRERIARAQTGGSAR

SEQ ID NO: 64005 - protein, 283 aa, Solanum tuberosum
MEKHAKSVRQLEPWGELAGKVVMVTGASSGIGRDFCSDLSKAGCRIIAAARRIDRLQSLCDEINSNSSNSSQDLRAVAIELDVSANGSAIEAAVQKAWDVFGRIDGLVNNAGIRGSVHSPLDLSEEEWEKTYKTNLRGAWLVTKFVCKHMRAANQEGSVINISSIAGLNPGQLPGCLAYASSKEALNSITKVLALELGPYKIRVNSISPGLFKSEITEGLIQKDWLQNIELRTIPLRTHGTSNPALTSVVRYLIHDSSEYVSGNMFIVDAGATLPGVPIFSSL

SEQ ID NO: 64006 - protein, 501 aa, Oryza sativa (indica cultivar-group)
MELLLLCTPCVILLLSSLYLLRLFVDARRNLPPGPRPQPLIGNILDLGSQPHRSLARLAGRYGPLMTLRLGTVTTVVASSPGAARDILQRHDAAFSARSVPDAARACGHDGFSMGMLPPSSALWRALRRVCAAELFAPRSLDAHQRLRRDKVRQLVSHVARLARDGAAVDVGRAAFTASLNLLSSTIFSADLADFGDARAESSVGDLRDLISEFTIVVGVPNVSDFFPAVAPLDPQRLRRRVARVFERLQAVFDGHIERRLRDRAAGEPPNNDFLDALLDYRSPEDGRGFDRPTLQFLFTDLFSAGSDTSAVTVEWAMAQLLQNPPAMAKAREELARVIGSKQEIEESDISQLKYLEAVVKETLRLHPPAPFLLPHQAETTTQVGGYTVPKGTRVLVNVWAIGRDSKVWSDPDKFMPERFLQSEVDLRGRDFELIPFGSGRRICPGLPLAVRMVHLMLASLLHRFEWRLLPEVEKNGVDMAEKFGMILELATPLRAVAIPV

SEQ ID NO: 64007 - protein, 135 aa, Encephalartos sp.
ARTKQTARKSTGGKAPRKQLATKAARKSAPATGGVKKPHRFRPGTVALREIRRYQKSTELLIRKLPFQRLVREIAQDFKTDLRFQSSAVAALQEAAEAYLVGLFEDTNLCAIHAKRVTIMPKDIQLARRIRGERA

SEQ ID NO: 64008 - protein, 500 aa, Oryza sativa (indica cultivar-group)
MELLLLYAPCVILLVSSLYLLRLFSDARRNLPPGPRPLPLVGNLLELGAKPHRSLARLAERHGPLMTLRLGAVTTIVASSPDAARDILQRHDAAFSTRPVPDIVRACGHDRFAMPWLPPSSPQCRALRKVCSAELFAPRRLDAQQRLRREKARRLVSHVARMAREGAAVDVRRVVFTTLLNMLSCTLFSADLADLDEGRAGSAGELADTVAEFAGTVGVPNVVDYFPAVAAFDPQRLRRRLSRVFTRLFAEFDEQIERRMRERDAGEPPKNDFLDVLLDYRTTEDGRQFDRQTLRSRFTDLFSAGSDTSAVTVEWAMAQLLQSPSSMMKAREELTRVIGSKPEIDESDIDSLEYLQAVVKETFRLHPPAPLLLSHRAETDTEIGGYTVPKGATVMVNIWAIGRDSKVWFEPDKFIPERFLQKEVDFRGRDFELIPFGSGRRICPGLPLAVRMVHLMLASLLHRFEWRLPPEVERNGVNMEEKFGIVMTLATPLQAIATPI

SEQ ID NO: 64009 - protein, 308 aa, Helianthus annuus
MAILSRYSSSNTLFCIEEQVHEDEDELTHQDSSAIHPLDLQDLCWEHEELVSLFTKEEEQQKQTPWPSSCTLSFRKEAVDWILKVKGCHGFTPLTAILAINYLDRFLSSLHFQKANTPWMIHLVAVTCLSLAAKIQETHVPLLLDLQLEESKFLFEAKNIQKTELLVMSTLKWRMNLVTPISFLDHIVRRLGLSNHLHWDFFKKCEAMILYLVADSRFVCYKPSVLATATMLCVVEEIDPTNSIGYKSQLLDLLKTTKDHINECYKLVMDLSYDNHNKGKRDENERTIYPVSPAGFIGFMCHESSNDS

SEQ ID NO: 64010 - protein, 731 aa, Oryza sativa
MGRSKREVAPPPQALPASFPSGMWLATPPMQASFAPGGWQGTAAAPGGWQGMAPPQPPQAPLFAYGANTSAPHLAQMKQGSDRSSMDDSLSDLQESGMDSRPPGGFLSYFQDPSSLQNHQPSIPLNYYATQQAAPWAPSPAEYRSPVTKSGPGEQHPINIDSGGEETPTVRTEKRLTWTHEEDIRLVSAWLNNLNDSINGNFKKNDCYWGDVTTAYNSTTPRNRMRQEKQIKDRFHKIKKNVGRFCCAYKEVKSIYVSGQNELQLMEKVHATYEADYKEGQFTFLHCWKALRDQPKWHAYLEELEKPNKTKSDNEVEVRELTSTPNSPEDIIRPEGTKAAKARRNGKDKRKRKAKVYLSDMDDEIDKPKEVQNMADKGRDELLETQRRVSSENLESKRLAHLAAMEHKEAKCTAAIRMLAYGSPADSLDEYLKIGKSTSLQCLDMFARGVIEVFGPEFLQRPTCEDVERLLQVGESRGFPGMLGSIDCMHWRWEKCPTAWSGQFTRGDYGVPTIILEAVASYDLRIWHAFFGVAGSNNDINVLNQSPLFLDVLKGDAPQVKFSVNGNEYSTGYYLANGIYPEWAAFVKSIHLPQTEKHKLYAQYQEGARKDVECAFGVLQSRFNIVRRPARSWKRKSVGRIMKACVILHNMIVEDEREGVIIPIDLNENLGASIVLPPEVTTGDSPCFFDVLRRKAEIRARAPHSQDMVNFGAFCYGSERYAPALYSIASF

SEQ ID NO: 64011 - protein, 127 aa, Rhodopseudomonas palustris CGA009
MTVRPGRWWSAGRAAKGFAMSIEQFIDNEVKANDVVLFMKGTPQFPQCGFSGQVVQILDHIGVPYKGHNVLENAELRDGIKVYSNWPTIPQLYVKGEFVGGCDIVREMFQAGELQKLFTDKGIKAAA

SEQ ID NO: 64012 - protein, 423 aa, Oceanobacter sp. RED65
MLTSSNGRQKLAVIGNGMAAAKLLQELVLSSLDQYDITVFGNEPYAAYNRIMLSPLLAGEKQLNDIITLPRDWYTENNIDLYTGSEYHISKIERGRKRLTCSNGEIFQYDKLVIATGSHPFILPIQGIELDGVLSFRDIADVNKMLKATESYKRAVVIGAGLLGLEAAMGLMQRGMDVTVVHNSDIPLNRQLDEQAGRLLKDSLIDRGLHFKMDANSHHIEGCGNRVQRIVFDDDSFIETDLVVMAIGIRPNIELAQQSGLQCGRGILVSDTLQTYDPSIYALGECIEHRGETFGLIAPLYEQAKVLANHLSEHGVAHFQTLPTATKLKVTGISLFSMGQFIEQQHHEVQTYFDPQSQVYKKLVIENEQLIGAVLYGDVTDGSFYSELIEQERDISEFRDYIMFGQALCHQSLQENAPEEAVA

SEQ ID NO: 64013 - protein, 892 aa, Oceanobacter sp. RED65
MNQAINTTCAYCGVGCGIKADVNKTTREISIIGSDQHPANYGRLCSKGTALGNTLEEKGRLLSPLVKGQKTSWSSAIDHVANGFQSIIEQHGPDAVAFYVSGQLLTEDYYVANKLMKGFMGSGNIDTNSRLCMSSSVVGHKRAFGTDTVPGCYEDFEKAKLITLVGSNTAWCHPVLFQRIKRYKANNPDVKVVVIDPRKTATCDIADLHIPLALGTDSWLFNGLLHYLADNDYLNQEFIYQHCNGFDAALESAASSSADLKHLSKILSVELTTLKTFFKWFANTEQAVTLYSQGVNQSSSGSDKVNTIINCHLATGRIGRPGMGPFSMTGQPNAMGGREVGGLANTLAAHLEFNDSDIEIVKTFWDAPNMAHKPGRMAVDMFEAIERGEIKAVWIMATNPVVSLPNADQIKRALNQAELVIVSDCIEKTDTTAYADVCLPALGWSEKDGTVTNSERRISRQRALLEPLGEAKPDWWIICQVAQAMGFKESFDYPDAASIFREHAQLSGYKNTPEERLRDFDISRLSSISSDDYDNLNPFQWPINDSYPQGRERFFAQGDFFTPDRKANFLAIEPNLPKEKTSKQYPLKLNTGRIRDQWHTMTRTALAAQLNQHINEPFLQMHPTDAQQQNVHTGQIVQVTSQWGQMLAKLEVTDNVKQGDVFAPMHWTEQLSSRGRINTVVNPHVDPFSKQPESKHTPVNVHAFDLSMYGLLLTRQDLSVVDCAYQVSIRGAHSQQYQLAHHQWPSDPEQQLLDWLNIRSQQDLEKRGWQWIHFADARRRNHRLAILNEHGRLEALAMIQSSAIDCSTTWLQQQFAKESLSGRDRQALLSGHAPAGEDVGNIVCACFSVGSKTIEGAIKQGCRSVSAVGERLKAGTNCGSCIPEIKQLIAKA

SEQ ID NO: 64014 - protein, 276 aa, Listeria innocua Clip11262
MKKITPKAMCAWIPKREDETHKGDYGRVLIVAGNKQFGGAAIMAAEACVKSGAGLTTVASDSVNRPALQTRIPECMFIDYENITSLSEQINHFDTILIGPGLGLDAYAEEIFRLVLQNSTEHQQLIIDGDGITIYAKGENPHPAAKLTFTPHAGEWERLKALAPEAETPTDVALHIDATIVLKGHRTKVYSGESAWQNMYGTPAMATGGMGDTLAGTICGLMAQTEKPLTGTLAAVFLHSYIGEILAKKRYVVLPTEIAEELPTYLKIFSETDEHA

SEQ ID NO: 64015 - protein, 756 aa, Oryza sativa (japonica cultivar-group)
MPPRRAALLLLALAVYVPLGTASSTTIASYLLGLWSRAHRHSLPAPAPAPAPAPAPETHRPGIRHPVPRHHRKRPHVAPPLPPPSSSERQDCSGISCTAPLTSTPIGSPCGCVYPMQIQLDLVVAPYQLFPRIDELEIEIAAGTFLKQSQVRIMGAGSSLQDPEKTTVTVDLVPLGQKFDRTSALLTSNRFLQKKVPINSSIFGDYNVIYVHYPGLPSLVPSVPGSLGPISSSQYPFSANVHNRRHQKINSKSVAIIALSAVVLVLMSFGICIIWKYKGFEKSRGTGRVSNSSATRKTGMRSSFSSMTSSTASFVSTIATCPPTVKTFSISELEKATENFSFNKIIGEGGYGRVYRGTIDDEVDVAVKLLTRKHQNRDREFIAEVEMLSRLHHRNLVKLIGICIERSTRCLVFELVPNGSVESHLHGSDKIYGPLDFDTRMKIALGAARGLAYLHEDANPHVIHRDFKASNVLLENDFTPKVADFGLAKEASEGMDHISTQVMGTFGYVAPEYAMTGHLLVKSDVYSYGVVLLELLSGRKPVDMTQPPGSENLVTWARPLLTDRDGLQQLVDPSMPAASYGFEKLAKAAAIASMCVHVEASHRPFMGEVVQALKLIYNGNNDDTCTSGSFGGGGGEEYEDEEASSPWNNRSWSHDFAATPPPASRRLAFPRAPARPTTMDYSSDPADGAAGTSSASARRQRSTSSLVLDKIESLAAYDWSGPLRASRGRNFYRLRGSMSEHGGHPSEDCSMEGYWM

SEQ ID NO: 64016 - protein, 410 aa, Pinus taeda
MASNIMQRCNVFMSERVKLHAAMLALQFGYAGFHIVSRAALNMGVSKVVFPVYRNILALMLIGPCAYFLEKKERPALTLSFLIQFFLLALCGITGQSRILSLRIVLHIPTFASAIQNSVPAITFIMAAALRLEKVHISRRDGLAKIIGTVACVSGATIITLYKGPPITHIWRPNLEVTASYFKAFQGNDLSAKSENWTLGCIYLLGNCLAWSGWIVLQAPVLKRYPARLSVTSFTCFFGVIQFLIIAAFFETDLEHWKIHSGGELFTILYAGFVASGIAFSVQIWCIDRGGPVFVAVYQPVQTIAVAIMASIILGEQFYLGGIFGAILIIIGLYLVLWGKSEEKRLGLLQAKSSMVPENQPDNMDQSATLIINSSNGIKPNTSSSLTQPLLLDTSYKTVNIPSPSDEPQP

SEQ ID NO: 64017 - protein, 284 aa, Zea mays
TTTSQGGYYTSVLNQEDANVFRSDVVEDLDNEVAELPGLNEINSQPIKRGRSKNFSEEEDLMLVSAYLNVSKDPITGRDQKEGTFWERVWKYFNKNRKFKSDRNWSSLKHRWLAIQKEVNIFQGYYDAIERKNQSGKTSDDKLAEAKAEFRETQHERAFSVFHVWMILRHEPKWPFKESKLKDPQETNNASSDAPINIDRPPGRKAEKEKAQARKHGVCDVDGDPFFEELKKTRESREENDKDRKALDEKFYELEKIKVEAERDRQDKEIMQTDTSTMDDESKQ

SEQ ID NO: 64018 - protein, 610 aa, Streptococcus pyogenes MGAS315
MNSQDLKKRQEKIRNFSIIAHIDHGKSTLADRILEKTETVSSREMQAQLLDSMDLERERGITIKLNAIELNYTARDGETYIFHLIDTPGHVDFTYEVSRSLAACEGAILVVDAAQGIEAQTLANVYLALDNDLEILPVINKIDLPAADPERVCHEVEDVIGLDASEAVLASAKAGIGIEEILEQIVEKVPAPTGDVDAPLQALIFDSVYDAYRGVILQVRIVNGIVKPGDKIQMMSNGKTFDVTEVGIFTPKAVGRDFLATGDVGYVAASIKTVADTRVGDTVTLANNPAKEALHGYKQMNPMVFAGIYPIESNKYNDLREALEKLQLNDASLQFEPETSQALGFGFRCGFLGLLHMDVIQERLEREFNIDLIMTAPSVVYHVHTTDEDMIEVSNPSEFPDPTRVAFIEEPYVKAQIMVPQEFVGAVMELSQRKRGDFVTMDYIDDNRVNVIYQIPLAEIVFDFFDKLKSSTRGYASFDYDMSEYRRSQLVKMDILLNGDKVDALSFIVHKEFAYERGKIIVEKLKKIIPRQQFEVPIQAAIGQKIVARSDIKALRKNVLAKCYGGDVSRKRKLLEKQKAGKKRMKAIGSVEVPQEAFLSVLSMDDDAKK

SEQ ID NO: 64019 - protein, 304 aa, Arabidopsis thaliana
MAATLPLSPINHQLCRFGNNSLTTHRFCSPGFLISSPCFIGLTGMGSATQLRARRSLISSAVATNSLLHDVGATVAVLGGAYALVLSFESLTKRNVIQQSLSRKLVHILSGLLFVLAWPIFSGSTEARYFAAFVPLVNGLRLVINGLSISPNSMLIKSVTREGRAEELLKGPLFYVLALLFSAVFFWRESPIGMISLAMMCGGDGIADIMGRKFGSTKIPYNPRKSWAGSISMFIFGFFISIALLYYYSSLGYLHINWETTLQRVAIVSMVATVVESLPITDQLDDNVSVPLATILTAYLSFGY

SEQ ID NO: 64020 - protein, 479 aa, Thermoanaerobacter tengcongensis MB4
MVESSGAKGVLRKKLPEHAMELAQEEKYRLKRELGWFELMLFVLGATIGAGIFVLPGVAAAKFAGPAIMISYALGGIVTIAVALAYTEFASMVPVAGSAYTYSYVALGEIFAWIVGWDLIFEFTMIASTVAVGWGGYFNSFLETVFGITLPQAISHDITHGGIVNLPAILGLLIVAWIALTGIRASGIANALFTTAKVFAILFVLTVGVFHIKLENWTTPFAPYGLAGIMTGAALTFFAYTGFDGITSLLEEVKRPERDIPIALIGGISLCALFYVAMSAVITGMVHWTKLDVPNPAAFVLMQVGIPWGGALISISVLFGLIATMLGNSLSASRILFAMGRDGLLPEWFAFVHPTRRVPRNAAYVIYTAAIIFAGFLSISELAELANIGGLTAFTLVTISVMVMRYTDPERKRIFKVPAIWVIGPIGIIGSLALIASLPVVTFIRFTVWLIIGLIIYFSYGYKHSKEGTGYYIGKENQK

SEQ ID NO: 64021 - protein, 437 aa, Thermoanaerobacter tengcongensis MB4
MVEERNKEELKRVLGTWDLVAFAIMTMVPIAPMGIYGVIAVVSHGHVPLAYTLAAIAMYFTAWGYAQFALRYPEAGSVYAYVRESVGFHAGFLAGWSILLDYILVPALVIMVSALWLEALTSISMIWWALLFIVLATFMNVLGIQLTSRAAWILFVFELFVLIVFIAVAIYKIASTPGLSFNLAPFYNPSDFSLHAVLAGTSIAVLSFLGFDIMTTLAEETVEARKNVSRAVRIVIPLVALMFVLQTYLGAVVHPGYKFADPDVAFFEITKEVGGNWLQMLAVLGTVLAWGIGDTMAAQAGISRVLFSMGRQGHLPKIFARIHPQYKTPYVATIFVALITGPLIYLLTLKDITSLVNFGALTSFIAMHLSLGYIFLAKEKRPLAVIMPAIGFIITAAVWWGLDKLAKELGFAWLILGFIYLAIITRGFRVKTTLPID

SEQ ID NO: 64022 - protein, 258 aa, Oryza sativa (japonica cultivar-group)
MDAVAGASVSSSSARLRPCPRPRRIGNVAPATVRRRSRRRAVTCAAAADADVVGLFDAAKLTVDRFVESGMVVGLGSGPASGLAIQYLGTRLRRGSLTGILGIPSSTISASEAVKAGIQVSSYEEGTQIDFAFTDADIIEEDTMTAVIGRRKTESGEPSFMVEKGIVKSADKLAFIIGHEKYVKGIEGSIPVLVKSVWRRPSIGTAGPLGGDFPLVTKEGHHVLDVIFTTPIPDLGKVAESLEKIAGVVDHGIVSSIP

SEQ ID NO: 64023 - protein, 472 aa, Colwellia psychrerythraea 34H
MKNLSHFYINGQWVSPEKPNDFIVENPSNERQIGTISLGTNVDVDKAVTAARNAFNQYGFSSREERIALLEKLLSAYMNRYDEMAQAISQEMGAPIDFATAAQADCGRGHIQTALDALKNYEFQHTSGNATITHEPIGVCGFITPWNWPINQIVCKVAPALATGCTVVLKPSEIAPLSAHVFAKIIDDAGFPAGVFNLVNGDGMGVGSAISSHQDIDMVSFTGSTRAGSLISKSAADTVKRVALELGGKSPNIIFDDVDLESIVTKGVVGCMENTGQSCNAPTRMLVQESVYDDAVKIATQVANNIKIDRADKPGNHIGPLVSKAHFDKVQSMIKEAIESGATLSAGGLGKPEGFELGHFTKPTIFSNVNNKMNIAQEEVFGPVLVIIPFKDEQEAITLANDSPYGLAAYINTPDETKASRVARQMRAGMVRINWASHHYTSPFGGYKQSGNGREWGTYGFDDYLEIKATSR

SEQ ID NO: 64024 - protein, 422 aa, Thermus thermophilus HB27
MTTIVGVRAREVLDSRGFPTVEAEVELEGGARGRAMVPSGASTGTHEALELRDGGKRYLGKGVRRAVENVNERIAPELVGMDALDQEGVDRAMLELDGTPNKANLGANAVLAVSLAVARAAAEALGLPLYRYLGGVQGVTLPVPLMNVINGGKHADNRVDFQEFMLVPAGAGSFAEALRIGAEVFHTLKAVLKEKGYSTNVGDEGGFAPDLRSNEEAVELLLLAIERAGYTPGQEVSLALDPATSELYRDGKYHLEGEGKVLSSEEMVAFWEAWVEKYPIRSIEDGLAEDDWEGWRLLTERLGGKVQLVGDDLFVTNPERLRAGIERGVANAILVKVNQIGTLSETLEAIRLAQRSGYRAVISHRSGETEDSFIADLAVAVNAGQIKTGSLSRSDRLAKYNQLLRIEEELGRAARFLGYAAF

SEQ ID NO: 64025 - protein, 493 aa, Kluyveromyces lactis NRRL Y-1140
MDYRNSKRSSISFGSYQRQLNLLDNVGNNGVNFYQRPNQGHSQQLQHGQQQQQQQQLGLGSGNSNYTLDKLKTVTTCQYQSSAPLFALSWNQNDQCALGTYKEDSYNRIEIINGSNDYSTWECTNVANVVYPISRIQWMPQNNTRLATCSDSLRIWSLDGSLQEQINLSLYKYGKHPSSASQKDTVTLGQLPPVTSFHWSPISPNLLLSCSIDTTCTVWDLSNSTNYVKTQLIAHDSEVFDVKFLAQSTQLFASCGGDGSVRVFDLRSLAHSTIVYDHGNETSRGSSGGGAAAADGPNKNATTKVTANTGSTAGSASGTANTSASGTSGTSGTSTLIPHGNSQDTVDQMDPEPHSNALVRLEPNPFDPNVIVTVAQDSNAIIVLDMRYPGTPLLTLEGHIGPVNQVQWHPKKSGVLVSCGDDCQVLYWDTSALLGQTSSNTARWNNQNVVHTVDTPQMAYTTETEANNLVLNPSGTHVGTVNGKTFTAINLNT

SEQ ID NO: 64026 - protein, 188 aa, Brassica napus
  misc_feature (56)..(56): Xaa can be any naturally occurring amino acid
  misc_feature (98)..(98): Xaa can be any naturally occurring amino acid
VTGGDQVAAAMEIYGPRTTYVLAVKGFPGTHEFLLLDEGKWQHVKETTEINEGKMXSPGNLRATFDNSEYSKLIDYYVKEKYTLRYTGGMVPDVNQIXVKEKGIFTNVTSPTAKAKLRLLFEVAPLGLLVENAGGFSSDGHNSVLDKTIVNLDDRTQVAYGSKNEIIRFEETLYGTSRLKNVPIGVTA

SEQ ID NO: 64027 - protein, 333 aa, Arabidopsis thaliana
MCERVLTKRKKSFRCLLASPELYKVRSLLGNTESCLYVCSRFQDRHTNTTWFTLCRKPDQTLTNGTIKKSSGLVAVGSNIYNIAGSSYLESSSSVSILDCRSHTWREAPSLREGLCSVSSSVLDRKIYVAGSCLDGDSYTYKNSFEVFDTETQFWDPDTITCSKTEGDFYGCGTACIDGEFHVVPVGQKREAVAYNSKEGRWDMVGQQMDHYKFSASCEIQNVLYSCTHGVFRWYDTNAMMWRDLKGLVGLPMFGSGANVKLADYGGKLTVLWEEELPSRGPDSGYKKMIRCAEIALERRKSCEIWGIVEWFGDVLTEPVGYVVLEKVLDVTL

SEQ ID NO: 64028 - protein, 368 aa, Ralstonia solanacearum GMI1000
MKTKAAIAWKSGAPLTIEDVDLQGPRAGEVLVEIKATGICHTDYYTLSGADPEGIFPAILGHEGAGVVLDVGAGVTSLKAGDHVIPLYTPECRQCKFCLSRKTNLCQAIRATQGKGLMPDGTSRFSIDGKPIFHYMGTSTFANHIVVPEIALAKIRPDAPFDKVCYIGCGVTTGVGAVVYTAKVEAGANVVVFGLGGIGLNVIQGAKMVGADKIIGVDLNPAREAMARKFGMTHFVNPKEVGNVVDHIIQLTDGGADYSFECIGNTQVMRQALECCHKGWGKSIIIGVAEAGAEISTRPFQLVTGREWKGSAFGGARGRTDVPKIVDWYMEGKLNIDDLITHTLPLERINEGFDLMKRGESIRSVVLY

SEQ ID NO: 64029 - protein, 560 aa, Arabidopsis thaliana
MGSSGDVNWKLADHPKLPKGKTIGLIVLDGWGESDPDQYNCIHKAPTPAMDSLKDGKPDTWRLIKAHGTAVGLPSEDDMGNSEVGHNALGAGRIYAQGAKLVDLALASGKIYEDEGFKYISQSFEKGTVHLIGLLSDGGVHSRLDQVQLLLKGFAERGAKRIRVHILTDGRDVLDGSSVGFVETLEADLAALRSKGVDAQVASGGGRMYVTMDRYENDWSVVKRGWDAQVLGEAPHKFKSALEAVKTLRAEPGANDQYLPPFVIVDDSGKAVGPIVDGDAVVTFNFRADLMVMHAKALEYKDFDKFDRVRVPDIRYAGMLQYDGELKLPSHYLVSPPLIDRTSGEYLAHNGVRTFACSETVKFGHVTFFWNGNRSGYFNEKLEEYVEIPSDSGISFNVQPKMKALEIAEKARNAILSGKFDQVRVNLPNGDMVGHTGDIEATVVACEAADRAVRTILDAIEQVGGIYVVTADHGNAEDMVKRDKSGKPALDKEGNLQILTSHTLKPVPIAIGGPGLSAGVRFRQDIETPGLANVAATVMNLHGFVAPSDYETSLIEVVEK

SEQ ID NO: 64030 - protein, 263 aa, Zea mays
YLIWLSEGRAMKLRTKRPEWKSLMPLQLSRLSRKSAMRFFLFPKVQSAGQSPDDTPVYLNVYDLTPMNGYIYWAGLGIFHSGVEVHGVEYAFGAHDFPTSGVFEVEPRQCPGFRFRKSIFLGTTCLDPIQVRQFMELQSVNYNGDTYHLITKNCNHFCKDMCYKLTGNKIPKWVNRLARIGVICNCLLPESLKISPVGHGPNSQSEDSEKRRLRNPFSCFSSISSHRQLPSSFPFPPPSPVKEGLPRCRCSSRKPSTASLRCR

SEQ ID NO: 64031 - protein, 391 aa, Zymomonas mobilis subsp. mobilis ZM4
MTSVVADSLTETKTDSQKPIATRKDGRIDLLGLSREDIRAALKSKGLDEKQAKLRTKQLWHWMYNRGAVAFDGMTDIAKTMRPWLAEHFAISRPEVVTMQISTDGTRKWLLKTDDGYDYEMVFIPDADRGTLCISSQIGCTLNCRFCNTGTMRLVRNLTVGEIVGQIMLARDSLDEWPSKPEGRLLTNVVMMGMGEPLYNFDNVRDALKLVMDGDGIALSRRRITLSTSGVVPMMARAGEEIGVNLAVSLHAVTKVVRDEIVPINKKYGIDELLAACAAYPGVNNARRITFEYVMLKDKNDSEEDAHELVRLLQYYRLPAKVNLIPFNPWPNSPYECSTPERIARFSEIVFNAGISAPVRRTRGQDIMAACGQLKSAAERQSKRDSMITLS

SEQ ID NO: 64032 - protein, 269 aa, Bradyrhizobium japonicum USDA 110
MINLNLTGATRLNIIVGDPIAQVKSPAGVTQAFIDRGYDGILVPVQINGARLKTFLAAATDVRNLDGIIVTVPHKFACYEFCATSTDRARLLGSVNIMRRRREGGWHGDHVDGLGFVGAVRANGYDPTGKCALLVGAGGAGSAIAMALVEAGVRSLAIHDNEAARRDQLIAKLATLGKAGIGPGSADPSGFELVANATPLGMKAGDPLPLDASKLKASTFVGCVITSPAVSPLVEAARRLGCKTSTGTEMYNALQSSMVDFLLAHDGSR

SEQ ID NO: 64033 - protein, 420 aa, Methanosarcina mazei Go1
MVSKNLPFTKEDILKIMEKYPTPFHIYDEKAIRENARRMKSAFKDIPGFKEFFAVKALPNPFILKILKEEGFGADCSSLPELILAEKAGMTGDDIMFSSNDTPAEEFIKAKELGGFINLDDISHIPYLEKSAGLPEIVCFRYNPGPLKEGNAIIGKPEEAKYGFTREQMFEGYRILRDKGVKRFGMHTMVASNELNSDYFVETARILFELIVEISKELGIQFEFVNLGGGIGIPYRPEQEPVSLEAVAKGVKEAYDATITANGLAPLKIYLECGRVITGPYGYLISQVRHLKSTYKDYVGLDSCMANLMRPGMYGAYHHITVFGKEKKAPAHKYDVTGSLCENNDKFAIDRMLPEVEIGDILAIHDAGAHGHAMGFNYNGKLRSAELLLREDGSVVQIRRAETIEDYFATLNFEQLKNFR

SEQ ID NO: 64034 - protein, 330 aa, Colwellia psychrerythraea 34H
MKNSQDTQVINLVADIGGTNIRLAITDKDNNINEIKTYQCKDFPHLSNVIYHYLKENGLLNSQVNACLAIACPVDTDSISMTNLPWKFSQKQLKEELKLHSLTLINDYTAIAMAIPLLSDKQKVKIGHGEAENKQPIAVCGPGTGLGVANLVNINNHWYCLGGEGGHTDFAPVDELDVKIFQQLKTTKKRLSYEQLLSGYGLEQIYQALVIINNQEATNAEQSKLSAKEISTQAIAGTCPICQQALSQFCKILGSFSGNLALTTGSFGGVYIAGGIVPRFIDYLKNSEFRARFETKGRMSHLNEQIPTYIITESQPGLLGAAAYLNQVFP

SEQ ID NO: 64035 - protein, 372 aa, Zea mays
RGALRRTFSCLGDPDPPPRDRSSRMHGPYPTAAAAAASSSDDMAANGMKVALHRQVSGGSMKQNAELRRQASLESPRTGRATSRFLFGRQSSMDPNRRRGRSQSPVRAPEDLGVPDNLDATMQLLFFACQGDALGIEGLLRSGVDVNSINLDGRTALHIAACEGHRDVVRVLISWKANIDARDRWGSTAVADAKFYGHSRVYDLLKFHGAKVPRTKRTPMMVSAPAEIPEYELNPGEVQFRRGCDVTPGVYHIAKWNGTKVSVKILDRDGCSDQEAANSFRHELTVLEKVRHPNVVQFVGAVTQSIPMMIVSELHEEKDLSVCIQKKGKLKPQKVLRYGLDIARGMTYLHQCKPDPIIHCDLKPKCQTYLPG

SEQ ID NO: 64036 - protein, 395 aa, Yersinia pestis biovar Microtus str. 91001
MNAMSLLSVEVSNFTFVGLFKNDNVNIVSIHRVLLLLEELMSQLPEKMSAVVCHGPQDYRLEHVPTPVPKAKELVIKVKGCGICAGDCKCKNGAKMFWGETPWVKPPVVPGHEFYGHIVALGEGTESKYKLGERVIAEQIVPCWDCRYCNSGSYWMCETHNIYGFQKDVAEGGMAEYMRFSENAIVHKIPESLSHEDAVLIEPMACAIHTVARGDIQLDDVVVLAGAGPLGLCMVQVARLKTPKKLIVIDTIEERLALAKAFGADVVINPLKEDADKIVKSLTGGYGCDVYIEATGAPIGVTQGLQMIRKLGRFVEFSVFGQETTVDWSIIGDRKELDIRGAHLAPYSYEIATDLFERGLVTSKGIVTHSYSLDDWEKAFELADSTNSIKVILVP

SEQ ID NO: 64037 - protein, 227 aa, Aspergillus oryzae
MAASTGTGWAQLRQQARSLETQTESLFHSYSQYASMTKLPPDPSEEEIRLESQLKELLEKRQSLVSQLARLLDSEATLTSSALKQNNLARHREVLQDHRRELQRLTSAIAESRDRANLLTNVRSDIDAYRASNPAAAEADYMLEERGRIDQSHNVIDGVLSQAYAINENFGLQRETLASINRRIVGAASQVPGMNALIGKIGSKRRRDALILGAFIGFCFLMLLFFR

SEQ ID NO: 64038 - protein, 487 aa, Oryza sativa (indica cultivar-group)
MARSGDCCPVCAAPIASLIREYNVLVDTTGEKQYTIGKFTTGVPPFSDRENAGSHSWSLHPEGQQGRQPTGNIWENCSNRKSCILEDDTGDYQYQGQIQGLQSAASTYYLLMMHGKDVHAVPADSWYNFSKISQYKQLTLEQAEEKMSRRRSTATGYGRWMMKAATNGAAAFSSDVTQLDDANEGETDQVHLKKGNKNGDENKSDKGSGEERAHVPMTKGREEEGSKDRDFDLDDEIEKGDDWEHEEIFTDDDEAVDVDPEEGGDLADPEIPAPPEIKQDDNEKHGGVGLSKSGKELKKLLRRAAGQNESDDDDEDTDEDESPSPVLAPKQQDQLKSEPQEDNHSKPTVLGHPYSTPHVSKSNQKRRQRGDDSKTCATPKKPKIEPDTKKIVVKEETSCSLEPTSEPFASARSDTNVSPITVEEIRVVLRLYAPIAMRDFSKDFMPRFSPRLRSPEDREVFLANLRKISHLQKINGQKYIILLEEYK

SEQ ID NO: 64039 - protein, 503 aa, Pseudomonas putida KT2440
MRYPMKDSSDTHPNHLPDSCYGLFIDNQWVTAEYGETLDIINPANGKILTNIPNATAADVDRAVQAAQRAFVTWRTTSPAERANALLKIADLLEADADRFAVLETLDVGKPIRESRSVDIPLAIDHFRYFAGVIRSQSDEAVMLDEQTLSIALSEPLGVVGQVIPWNFPLLMAAWKIAPAIAAGNTVVIKPSELTPVTILELAKIFAKVLPAGVVNIVTGLGTTVGQALLDHPDLRKLAFTGSTRVGELVANAAAKKIIPATLELGGKSANIVFPDANWDKAVEGAVLAILWNQGQVCESGARLFVHESIYERFLAELKHKFEAVRVGDPLNPDTMMGAQVSKTQMERILGYVDIAKEEGAEVLIGGGRLTGADYDAGFFIQPTILVGVRNDMRVAYEEIFGPVLCVIPFKDEAEVIAMANDSEYGLAGAVWTQDINRALRVARAVETGRMWVNTYHEIPAHAPFGGYKKSGLGRETHKSMLEAYSQKKNIYVSLNEAPLGLF

SEQ ID NO: 64040 - protein, 104 aa, Coccidioides immitis RS
MSAAKQKAQTIIADNAVVVFSKSYCPYCKATKSLLSSEGAKYFTMELDQVDDGAAIQAALEEITNQRTVPNIFIDHKHIGGNSDLQARKSELPALLKAAGALQA

SEQ ID NO: 64041 - protein, 147 aa, Glycine max
MLVPLAPYPPPPPPAPYTPPPNGAQSQLVCSGCRNLLLYPVGATSVCCAVCNAVTTVPPPGTEMAQLVCGGCHTFLMYIRGATSVQCSCCHTVNLALEANLVAHVNCGNCKMLLRYQYGARSVKCAVCSFVTSVGASTSTTEQKFST

SEQ ID NO: 64042 - protein, 196 aa, Cryptococcus neoformans var. neoformans B-3501A
MPEGKKDDGQGKKDDNPIKKDDKPLPNVYLKISINGKEVGKVVIKLYDDVVPKTCANFRSLCTGNKPDQTPLPPSFTYRSTPFHRIIPSFMIQSGDFERQDGTGGVSIYGEKFPDENFEKKHDKVGLVSMANCGAHSNGSQFFITTVEKCEWLDGKHVVFGEVVEGMDVVKEVESKGNKEGKPPKDKIIISACGAV

SEQ ID NO: 64043 - protein, 130 aa, Coprinopsis cinerea okayama7#130
MVRISVLNDCLNNIVNAERRGKRQVLIRPSSKVVVKFLSVMQRHGYIGEFEIIDDHRAGKIVVQLNGRLNKTGVISPRFNVQVTQIESWVNLLLPARGFGIIILTTSSGILDHEEARRKNVGGKLLGYVY

SEQ ID NO: 64044 - protein, 562 aa, Gibberella zeae PH-1
MSRDNILTAAAVERMIADGQTIVVFEESILKLDGWMERHPGGRLAVLHMVGRDATDEMKAYHSESTLRTMKAYRIGRKQGPWTNRTPPIRGGIFRKDAPEEVELSDSACSDTEESLANSSILDDAASSASSATDDVVVGGGDDILKTEGLRHRSATIKSEPNNKRSAILRVANAGVAREIQTDLENYPPPEDTKVQTDIRRKYQLLHDRIRDEGLYQCPYIEYGKELARYTTLFALFGTLFYNQWYITSAIFLGLFWHQIMFSAHDAGHLAITSNFVTDTLIGMFIADFCCGLSIGWWKSSHNVHHLVTNAPEHDPDIQNVPLFATCPSFFKSLHSTYYDFTFIWDAAADFLVPFQKYTYYPVMGIARFNLYLLSWLHVLSKKSSQLGKSRAWWIRPTEITFMCCYWFLFGYCLLWRGLPDWTTRVIFVLVSHIITMPLHVQITLSHWGMSTVDLGETESFAQRQLRTTMDVDCPAWMDFVHGGLQFQAVHHLFPRVPRHNLRKAQQMIREFCADTGVPYSILNFTDGNRKVLGRLQDVSDQLDIMIKCQQHMARTGESGLH

SEQ ID NO: 64045 - protein, 258 aa, Arabidopsis thaliana
MMNLRVLFLALLLLASPLLQVARCQSDAEDHSSLVDDVVGENTDDAVEEDDHDLDMNLSSFPGVETVCVFPKNSAKLVPAGEETELLVGLKNEGKTRVGVMGIRASVHLPYDHKLLVQNLTMLRLNNASIPTSLQATFPYIFAVSQYLQPGAFDLVGYIIYDVEGKPYQSVFYNGTIEVVESGGLLSGESVFLLTLGIGLLLLLGLWAYSQVQRLTKKTKKVSKVEVGTRSTDASLDEWLEGTTLAKTSSGKTKNKKN

SEQ ID NO: 64046 - protein, 155 aa, Methanosarcina acetivorans C2A
MMKVKDVMNPDVVFCKPDDTVREAAKLLKENNISGAPVLEDGQLVGVVSEADLLELLVIPEKGNLWLPSPFEVIEVPIRELLSWEETKKMLSDVGSTKVEEMMTKEVHTISSEASVEEASELMVRHRINRLPVMENDRVVGIVTRGDIIEGLAKL

SEQ ID NO: 64047 - protein, 503 aa, Triticum aestivum
RASPPSESRAPLRAPQRSATRQHQARQGPRRMCNGGRGPPYWTAGVTSAPARQTPLFSGRPSGGLSDPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAWRKIIWVLEDYYKNKSIEHILILSGDQLYRMDYMELVQKHVDDNADITLSCAPVGESRASEYGLVKFDSSGRVVQFSEKPKGDDLEAMKVDTSFLNFAIDDPAKYPYIAGMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 64048 - protein, 524 aa, Ustilago maydis 521
MSAPIFAQEATQERAENARLSSFVGAVALGDLVKTTLGPKGMNKILQSVGSNDIVVTNDGATILKSIHLDNAAAKILVNISKVQDDEVGDGTTSVCVLAAELLREAEKLIEMRIHPQTIVEGYRIASAAALKALEDTAEDHGTDAATFREDLLNIARTTLSSKVLSADKDYFANLAVDAVLRLKGSTNLEHIQIIKKAGGKLTDSYLDEGFILNKKIGTNCPKSLSNAKILIANTSMDTDKIKVFGARVRVEGTGKLAELERAEREKMKAKVDKIKAHGITCFVNRQLIYNYPESLLAEAGIMSIEHADFEGVERLALVTGGEIASTFDRPDLVKLGSCGKIQEVMIGEDKLIKFSGVAAGEACTVVLRGATSQMLDEAERSLHDALSVLSQTVGETRVLLGGGCAEMSMSKVVDEAARCTSGKKAIATESFAKALRQLPTILADNAGLDSSELVAQLRAAHQQGNKTAGLDLDVGKVADMKQKGVRESYKLKRQVVVSATEAAEMILRVDDILKCAPRRREAH

SEQ ID NO: 64049 - protein, 671 aa, Gibberella zeae PH-1
MCGISAFITHPGHSRSPVLNGDAKQVVEELETSLDLIAHRGPDARGRWFSDNHHVGLGHVRLSIIDLSPSGNQPFHDEQGGIHAVVNGELYDYERYKAQLADEFKFVGNSDCEIVIALYKHYGLSFISHLRGEFAFVLWDENRQQLIAARDRYGIKSLYYTVHQNKLLVATEIKSFLAFGLEPEWCVRSLRDQSWRVDSTTFFEGVYKVRPGHYLICRPNEREEQHPYWDLEYPDKFAKDLRSEDEITEGVRERLLEAVRIRLKADVPVAVYLSGGIDSSSVAGMVSHLIKQGTKLGNETSLLPSSMKCYTVQFDEGSGADESAIARRTADFLGVDIHLVKMDEEALVSRFEDTTWYSEVPLPDLNGMGRLALAEAVHAQGIKAVITGEGSDEHFGGYDAFRADSLSEPDHSWPAMMTDTERQEAHALASKEAQYGIFGDFTPKVPISTKRMFYSNHVASSIARVGSLPFSDWTKVYGNSIPETTMIEGFDGRVRDNILKRWHPVHTAQYMFVKTFMPHFILRYNGDNIDMVHQVESRCPFLDHHLTEYVNNVPPSLKMRYNAKDKSWREKHILREAVKPFVTDEVYNMSKKAYMGPRKFWPGGPLHKKISELVTKANVENLGFVDWQATQDAMDGAFNKQEGLALRRIITVAQFVVLGQRFGVKRASGRR

SEQ ID NO: 64050 - protein, 143 aa, Thermus thermophilus HB27
MTVRQVLVHKGGGVHAIHPEATVLDALRKLAEHDIGALLVMEGERLLGIFTERDYARKLVLLGRFSKDTKVREVMTTDVPTVAPEASLEEAMRLMTERRTRHLPVVEGERVVGVVSIGDLVKAIITHQGMLIAELSRYVSENR

SEQ ID NO: 64051 - protein, 344 aa, Kluyveromyces lactis NRRL Y-1140
MSNPLQVIDISEPQEKTVPALLKAATEQGFLFVDGHDFTQEEVNQLFDLSKQFFTNTEHEEKKKYAIKSNNIGYTDFSNEQLDPRKARDFKEGYNFGYANFKTGEYNLSEDYFYKRSDKNDPSENPVPSLFKQNEALTVPTMQKLHKTATEILRLIAIALGIEDEDFFTARHSPDEPSGSVFRMLRYPLIRDDGLTDEETKYDPTIRAGAHTDYGALTLLFQREDQQGLELQMDKDSDDSWAKVPYVASKHEGKAPPLVVNFGDLLSYWTNGVLRSTVHRVKFSPGETRTSDRYSIVFFVHPANKTTLDPVPSDLVKKAGNGQNPPAITALDHLKERLADTYSW

SEQ ID NO: 64052 - protein, 87 aa, Oryza sativa
MALSLMASRATTVCPLQGLKSTAGMPVARRSGNSSLCNVSNGGRIRCMQAWPIEDIKKFETLCYLSPITVEDLLKHIEYLLRSKWVP

SEQ ID NO: 64053 - protein, 714 aa, Kluyveromyces lactis NRRL Y-1140
MSQLITVATCNLNQWALDFEGNRDRIFESIKIAKERGAKLRVGPELEITGYGCLDHFLEDDVFLHSWEMYGQIIKRPETHGILLDIGMPVMHRNVRYNCRILSLDGKILFIRPKIWLANDGNYREMRFFTPWMKAAHTEEYLLPPMIQKLTGQYRIPFGDAVISTLDTCIGAETCEELFTPQSPHIAMSLDGVEIFTNSSGSHHELRKLDKRLDLIMSATRRCGGVYLYANQRGCDGDRLYYDGCALICVNGSIVAQGSQFCLKDVEVVTATVDLEQVRSYRSTVMSRGLQASLTETKFKRIDVEVELATLDDRFDSTLVPEKPRKAFYHIPSEEIALGPACWLWDYLRRCNGTGYFLPLSGGIDSCATAVIVHSMCRLVVKEAAEGNQQVIKDVRRLARMNDEWIPKTPQELANKIFNTCFMGTENSSKETRSRAKKLAEHIGAYHVDLNMDSLVSSMVTLFEVTTGKRPIFKIFGGSQTENLALQNIQARLRMVLAYLFAQLLPWVRSIPNAGGLLVLGSANVDECLRGYLTKYDCSSADINPIGGISKTDLKKFIAYASKEFDLPILEEFLNATPTAELEPITKNYVQSDEIDMGMTYEELSVFGYLRKVEKCGPFSMYLKLLHEWTPKLTPAQVAEKVKKFFFFYAINRHKQTVLTPSYHAEQYSPDDNRFDLRPFLINPRFPWAFKKIDDAVAQSEGTLSGALDVMTVE

SEQ ID NO: 64054 - protein, 168 aa, Avena agadiriana
VMASSATSVAPFQGLKSTAGLPVSRRSNAGLGSVSNGGRIRCMQVWPIEGIKKFETLSYLPPLSEEALLKQIDFLIRSKWVPCLEFSKVGFIFREYGSTPGYYDGRYWTMWKLPMFGCTDASQVIKEVEEVKKEYPDAYVRIIGFDNIRQVQCVSFIAFKPPGCEESG

SEQ ID NO: 64055 - protein, 637 aa, Cryptococcus neoformans var. neoformans B-3501A
MSPTAIIDNHKVDLADLKSKVVDGHVELEETPRPPVADNFMYDFKYNHALPTTDALGVSIPDDVDAQNAAEEIVAKLSKVLSEGDAKGFTGLFLEYGVWRDKLAFTWDYRTFNFTENIARAAADLLPSTHCTNFKLLKPAPAIQKPYPDLSFLQFVLSFDTPLVQASAVINAVFTQEGWRLWTVHSVAESLLKFPELDPADGHMTGPVSWEKQREMDDEEIVPDVLIVGGGQNGLALAARLKALGVPNLIVERNAQIGEIWRKRYEYLSLHFPHWADHFPYFPFPKYWPTYTPAQKLGIFMEWYASAMELPVWTKSTVVKAEQDADGKWTVEVNKNGETRVLNPKHVVMATSLCGVPMTPVIPGMDKWKGTARHSTSHDSSREWVGKKVLVVGTSSSGFDTAYDCARRNIDVTLLQRSPTYIMSLTHSVPRNIGSFEPKNGVAPNIEEQDRLFNSMPVGPGEELARRNRAVLEELDKEMLDGLRAKGLKTYKGQRGTGQATLGSTRNGGFYFEAGACEQIIKGKIKVEQGYVESFTEDKVILSGGREREFDLVVFATGFSNTIDSVRQTLGDKIADQCGPIWGVDEEGEMKSAWKECGVPNLWLVIGYLPLTRYHSKLVALRIKALLEGVSPAPYKA

SEQ ID NO: 64056 - protein, 338 aa, Ralstonia solanacearum GMI1000
MYSAHDVRVENVPDATIVEPTDAIVRVTQACICGSDLWPYRAMEPSETGQSMGHEAIGVVEAIGSGVNKIKVGDVVIMPFAYSDGRCEFCHEGLQTACVHGGFFGYGGFNGAQAEALRIPQADGTLYALPGGVDSALMASLLTLSDVMGTGHHAARVARVRPGTSAAVIGDGAVGLCGVIAAKRLGAERIILMGRHPDRIALAQAFGATDIVSERGEEAIERVRALTGGHGVHSVLECVGTDQSMQTAANIARPGGAVGRVGVPHYNAIPADTTFFKNVIVGGGPAPVRAYIDDLLPDVLDGKIQPGRVFDRVIGLDEVPDGYRAMDERQAIKVMINL

SEQ ID NO: 64057 - protein, 396 aa, uncultured Acidobacteria bacterium
MSGLQRQIRRKSLKDRQLGERRDDIMRPIAAARKTPMTAPRPDLAELEIAELAATLEAAGAPRFHATQIYRWIHRRAATSVEGMTDLSKALRTRLDHEFTLSTPRIVGDETSADGTRKLVLELADRRRIESVFIPDTPAMTFCVSTQVGCAMACGFCLTGKMGLVRHLTAGEIAGQVRVLASATGLLDQSFNIVLMGMGEPLHNYDNTMKALRMLHAEAGLAVSPRRVTLSTVGIVPGLERLAKESLMPNLAVSLHATTDEQRTALVPPNRKYPLAAILDACRAFPLKKRNRITFEYVLLEGVNDTPEDAKRLVRLLSGIKSKVNLIPLNPAPGIPFSRPPDARVDRFADVLARAHLTVSVRKSRGRDIRAACGQLIVEGGASKTAAQQMALLLKP

SEQ ID NO: 64058 - protein, 444 aa, Burkholderia sp. 383
MTTVFHRAPRATLPVAVAGDGIEIIDSTGKRYIDACGGAAVSCLGHSNQRVIDAIKRQAQQLAYAHTSFFTTDVAEELADRLVAAAPAGLEHVYFVSGGSEAVEAALKLARQYFVEKGEPQRRHFIARRQSYHGNTLGALAIGGNAWRREPFLPLLIEAHHVSPCFAYRDQQAGETDEAYAQRLADELEQKIVELGADNVAAFVAETVVGATAGAVPPVRTYLKKIRAVCDKYGVLLILDEIMSGMGRTGYLYACDEDGVAPDLLTIAKGLGAGYQPIGATLVSDRIYRTIVDGSGFFQHGHTYLGHATACAAALEVQRVIAEEKLLDNVKARGEQLRASLRDHYGAHPHIGDVRGRGLFVGVELVRDRDSKATFDPALKLHAAVKREAMQRGLMVYPMGGTIDGVHGDHILVAPPFICTAQQIDTIVERLSGAIGAALASAGA

SEQ ID NO: 64059 - protein, 363 aa, Salmonella enterica subsp. enterica serovar Paratyphi A str.
MSKNYHIAVLPGDGIGPEVMAQALKVMDAVRSRFDMRITTSRYDVGGIAIDNHGHPLPKATVEGCEQADAILFGSVGGPKWENLPPESQPERGALLPLRKHFKLFSNLRPAKLYQGLEAFCPLRADIAANGFDILCVRELTGGIYFGQPKGREGSGQYEKAFDTEVYHRFEIERIARIAFESARKRRRKVTSIDKANVLQSSILWREIVNDVAKTYPDVELAHMYIDNATMQLIKDPSQFDVLLCSNLFGDILSDECAMITGSMGMLPSASLNEQGFGLYEPAGGSAPDIAGKNIANPIAQILSLALLLRYSLDANDAATAIEQAINRALEEGVRTGDLARGAAAVSTDEMGDIIARYVAEGV

SEQ ID NO: 64060 - protein, 1320 aa, Salmonella typhimurium
MGTTTMGVKLDDATRERIKMAASRIDRTPHWLIKQAIFSYLDKLENSDTLPELPALFVGAANESEEPVAPQDEPHQPFLEFAEQILPQSVSRAAITAAWRRPETDAVSMLMEQARLSPPVAEQAHKLAYQLAEKLRNQKSASGRAGMVQGLLQEFSLSSQEGVALMCLAEALLRIPDKATRDALIRDKISNGNWQSHIGRSPSLFVNAATWGLLFTGRLVSTHNEANLSRSLNRIIGKSGEPLIRKGVDMAMRLMGEQFVTGETIAQALANARKLEEKGFRYSYDMLGEAALTAADAQAYMVSYQQAIHAIGKASNGRGIYEGPGISIKLSALHPRYSRAQYDRVMEELYPRLKSLTLLARQYDIGLNIDAEEADRLEISLDLLEKLCFEPELAGWNGIGFVIQAYQKRCPLVIDYLVDLASRSRRRLMIRLVKGAYWDSEIKRAQMEGLEGYPVYTRKVYTDVSYLACAKKLLAVPNLIYPQFATHNAHTLAAIYHLAGQNYYPGQYEFQCLHGMGEPLYEQVTGKVADGKLNRPCRIYAPVGTHETLLAYLVRRLLENGANTSFVNRIADATLPLDELVADPVEAVEKLAQQEGQAGIPHPKIPLPRDLYGEGRINSAGLDLANEHRLASLSSALLSNAMQKWQAKPVLEQPVADGEMTPVINPAEPKDIVGWGREATESEVEQALQNAVNQAPVWFATPPQERAAILQRAAVLMEDQMQQLIGLLVREAGKTFSNAIAEVREAVDFLHYYAGQVRDDFDNETHRPLGPVVCISPWNFPLAIFTGQIAAALAAGNSVLAKPAEQTSLIAAQGIAILLEAGVPPGVVQLLPGRGETVGAQLTADARVRGVMFTGSTEVATLLQRNIATRLDAQGRPIPLIAETGGMNAMIVDSSALTEQVVVDVLASAFDSAGQRCSALRVLCLQDDIAEHTLKMLRGAMAECRMGNPGRLTTDIGPVIDSEAKANIERHIQTMRAKGRPVFQAARENSDDAQEWQTGTFVMPTLIELENFAELEKEVFGPVLHVVRYNRNQLAELIEQINASGYGLTLGVHTRIDETIAQVTGSAHVGNLYVNRNMVGAVVGVQPFGGEGLSGTGPKAGGPLYLYRLLAHRPPNALNTTLTRQDARYPVDAQLKTTLLAPLTALTQWAADRPALQTLCRQFADLAQAGTQRLLPGPTGERNTWTLLPRERVLCLADDEQDALTQLAAVLAVGSQALWSDDAFHRDLAKRLPAAVAARVQFAKAETLMAQPFDAVIFHGDSDKLRTVCEAVAAREGAIVSVQGFARGESNILLERLYIERSLSVNTAAAGGNASLMTIG

SEQ ID NO: 64061 - protein, 95 aa, Zea mays
CSSGSSCFLMIKRVSSAPSLSRWTIQYKQLGHTIYRRSHVLAFASADRRRQAEAINGALAVIGLTAGLLVEAQTGKDILGQLAGYLTAISSLFGQ

SEQ ID NO: 64062 - protein, 403 aa, Oryza sativa
  misc_feature (70)..(70): Xaa can be any naturally occurring amino acid
TRHRSAVPSGASTGIYEALERRDGDGAAYGGKGVLNAVRNINEVIAPKLVGVDVRNQSDVDAIMLDIDGXRPNKSKLGANAILGVSLSVCRAGAGAKEVPLYKHIQELGGAEELVMPVPAFNVINGGSHAGDNLAMQEFMLLPVGASSFSEALRMGSEVYHALKGIIKAKYGQDACNVGDEGGFAPNVQDNREGLVLLMDAIEKAGYSGKIKIGMDVAASEFLTKDGSYDLNFKNQPNDGAHVLSAQRLCDLYKEFVKDFPIVSIEDPFDQDDWSSWASLQSSVNIQIVGDDLLVTNPKRIAEAIGKKACNALLLKVNQIGTVTESIQAALDSKAAGWGVMVSHRSGETEDNFIADLAVGLASGQIKTGAPCRSERLAKYNQLLRIEMELGNVRYAGEAFRSP

SEQ ID NO: 64063 - protein, 563 aa, Xylella fastidiosa Ann-1
MCSIFGIFNLQPSDNLQILRHQALECSQRQRHRGPDWSGVYVDVGAILVHERLAIVDPAGGAQPLFSEDGTLALAVNGEIYNHAVLKGTLQQPYAFQTHSDCEVINALYREETPTSFLNRLNGIFAFALWDKTTGRGLIARDPMGVVPLYWGHDQDGRLRVASEMKALVEHCPDVAQFPPGHWYDTTTGTLVKYYERPWKNYSAVEGVQVSLQELREAFERAVHRQLMTDVPYGVLLSGGLDSSLVAAVAARYARHRIETNDQSEAWWPRLHSFAIGLKDSPDLSAANVAAEALNTVHHRFEYTFQEGLDVLPEVIRHIETYDVTTIRASTPMFLLARRIKAMGVKMVLSGEGSDEIFGGYLYFHKAPNAREFHEELVRKLNALYYYDCLRANKAMMAWGVEPRVPFLDREFLDVAMRMDAQHKMVDKTSNGPQRMEKGILRAAFDGYLPPSILWRQKEQFSDGVGYGWIDGLKAHAETQVSDHALATAETRFQVNPPQTKEAYYYRSIFERFFPSPAAAETVPGGKSIACSSPAAIAWDASFATMADPSGRAVSGVHQQALL

SEQ ID NO: 64064 - protein, 153 aa, Streptococcus pyogenes
PMAYVLWNHFMNINTKTSRNWSNRDRFILSAGHGSAMLYSLLHLAGYDLSVEDLKNFRQWGSKTPGHPEVNHTDGVEATTGPLGQGIANAVGMAMAEAHLAAKFNKPGFDIVDHYTFALNGDGDLMEGVSQEAASMAGHLKLGKLVLLYDSND

SEQ ID NO: 64065 - protein, 293 aa, Zea mays
  misc_feature (104)..(104): Xaa can be any naturally occurring amino acid
  misc_feature (207)..(207): Xaa can be any naturally occurring amino acid
PTRADMPSVQAEVGGGWRPKQQQYPLEIREVWADNVEREFKLIRAAIERFPYVSMDTEFPGVIHHPPPSVHHSALTPPQRYALLKSNVDALHLIQVGLAFAPSXPGSPPALAFQVNLREFDPRLHRHAPDSVRLLAASGLDLPAHRARGVSARAFAALLMSSGLVCNPDVAWVTFASAYDLAYLVKVLMGRKLPRALPEFLRYVRVXFGNAVYDVKHMARVACASHGEVALLGGLERVAAALRVRRAAGRSHQAASDSVLTWDTFREMARLYFPKEGSLEMCAGVLYGLELPN

SEQ ID NO: 64066 - protein, 478 aa, Pseudomonas syringae pv. phaseolicola 1448A
MSQKFDVVVIGAGPGGYVAAIKAAQLGLKTACIEKYQDKEGKLALGGTCLNVGCIPSKALLDSSWKFYEAKNGFSVHGISTSEVNIDVPAMIGRKSTIVKGLTGGVASLFKANGVTTLQGHGKLLAGKKVELTAADGTVEIIEADHVILASGSRPIDIPPAPVDQKVIVDSTGALEFQQVPQRLGVIGAGVIGLELGSVWARLGAQVTVLEALDKFIPAADEAVSKEALKTFTKQGLDIKLGARVTGSKVEGEEVVVSYTDAAGEQSITFDRLIVAVGRRPVTTDLLASDSGVDLDERGFIYVDDYCTTSVPGVYAIGDVVRGLMLAHKASEEGIMVVERIKGHKAQMNYNLIPSVIYTHPEIAWVGKTEQTLKAEGVEVNVGTFPFAASGRAMAANDTGGFVKIIADAKTDRVLGVHVIGPSAAELVQQGAIAMEFGSSAEDIGMMVFSHPTLSEALHEAALAVNGGAIHIQNRKKR

SEQ ID NO: 64067 - protein, 337 aa, Oryza sativa
MAASSAAAGAGGEPQKQLLSIIRDFAAEKSHGGFSRDPLAASELLAERRVTDLKRRLDDLRAASDAAVAELEAAKRAREGAEQELRGGQVQVAIAAASIQALEATISHLQEEISKAGSDLDALKGKGDIERDEFISQMDQLNTKIRQFQQTVSVEFKRQKCSELPSGEGQHVRDRSEIKESEGILKDLIDKVNNADAELHVLEEEYKKDLLHHDEVRRELADTQAKRALMEAVMGETKQLQELGEYPFLGFVQKFSNSLHLVLFPVQIHQAFCKRRFFNGKQAGSRNGESARFACGGVAEAVRVPRLWSQQHGWVGGGGGGQLKMALAGWLLYIDKA

SEQ ID NO: 64068 - protein, 303 aa, Colwellia psychrerythraea 34H
MLNFLPAKLIGFISFSLYILNTIFWLLPILVFSLFKALIPLTFSKKIFSYLLDLMASNWVATNSIIQKLFTKTNIVVTGLEALKINDWYLVLANHQSWVDIVVLQRALHGNIPFLKFFLKKELIYVPLLGLAWWALDFPFMKRYSQAFLKKNPHLRGKDLATTRKACAKFKHKPVSVMNFIEGTRFTQKKHDKQGSPFQHMLKPKSGGISFVLDAMGEHLTKIVDVTIYYPDGIPNFSDFIYGEVEKVHIDIQTFDIASELGHINFSDRNDRIAFQKWLTQFWHDKDARLENMRQQYNAQRDD

SEQ ID NO: 64069 - protein, 376 aa, Thermus thermophilus HB27
MSRVPEPSVFLVVDEAKRKARERGVGLIDLSIGSTDLPPPEAPLKALAEALNDPTTYGYCLKSCTLPFLEEAARWYEGRYGVGLDPRREALALIGSQEGLAHLLLALTEPEDLLLLPEVAYPSYFGAARVASLRTFLIPLREDGLADLKAVPEGVWREAKVLLLNYPNNPTGAVADWGYFEEALGLARKHGLWLVHDNPYVDQVYEGEAPSPLALPGAKERVVELFSLSKSYNLAGFRLGFALGSEEALARLERVKGVIDFNQYAGILRMGVEALKTPKEVVRGYARVYRERALGMAEALKGALSLLPPRATMYLWGRLPEGVDDLEFGLRLVERGVALAPGRGFGPGGKGFVRIALVRPLEELLEAAKRIREALD

SEQ ID NO: 64070 - protein, 168 aa, Avena strigosa
VMASSATSVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKKYPDAYVRIIGFVNIRQVQCVSFIAFKPPGCEESG

SEQ ID NO: 64071 - protein, 286 aa, Mycobacterium smegmatis str. MC2 155
MGAARVCVVGSINADLTFTVANLPRPGQTVLASSLASAPGGKGGNQAVAAARAGAATSLVAAVGDDAAAESLRAHLRANGVDEDAVVSLAGPSGSAAIVVDAAGENHIVVAPGANALLDVDAPAARAAIGSADVVLLQLEISPTTAIAAAQQARDAGALVMLNASPVGTAAHHLLALSHLTDVVVVNETEAAEWHWPVRHLVITRGARGASYVSDDERFDVPALRVRAVDTTGAGDVFAGVLAAGWPAGHEHALQRACAAGALATLVRGAGDCAPSAADIDAVLTP

SEQ ID NO: 64072 - protein, 553 aa, Exiguobacterium sibiricum 255-15
MKLLIIGSVAAGTSVGAKARRNSEDLQITIYDRDQDISYSGCGIPYFVGGEIADIDELTPRDAAFFKKRYNIDIHTRHEVESIDHATKTATIVNLATGDRLTDTYDTLVLATGASSIVPPLQGVDHDNVFTVRNVRNADAIRSYIDAHNPKTATIVGGGFIGLEMAEQLSYRGIQVTLVERLPQVMPPLDRDMAERVADHLRDKGVSLLLGESVTALNGTERVTDIALESGKSIATELVILSVGVKPNTELAKQIGVGLGQTGAIAVNRKMQTNVADIYAVGDVAESFSVITGEAIYRPLGSTANKMGRIAGMVITGEEAEHRGILGTGIFKAFDLTVAQTGLTEKEAREAGYDIEVLHNIKPDRPEYMGGKEMTIKAIADRATGRVLGAQIVGPQGVDKRIDVLATAITFKAKAEDLFHLDLAYAPPFATTKDPVLYTGMALDNAIKKTARLMTPNELIEQVAGGKSFQIIDTRSKAQFEKNHVDGAIHIPLGELRTRAKELDPTLPTIVYCNKGVTGNAAQNVLKNLGFTDVCNLSGGNKNYQHCKKCLTE

SEQ ID NO: 64073 - protein, 168 aa, Avena clauda
VMASSATSVAPFQELKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 64074 - protein, 428 aa, Xanthobacter autotrophicus Py2
MSENAALQARRTKAIPRGIATAYPVFAQKAEGSEVWDADGTRYIDFAGGIAVLNTGHRHPRVLAAVRAQLDAYTHTAFQIVPYEPYVALCERLNAIAPFTGAAKSILFSTGAEAVENAVKIAKAATGRTGVISFSGGFHGRTALTMALTGKVLPYKKKFGISPPGIFHLPFPCADHGVSVADTLKALDYLFRADIGPQDVAAIIIEPVQGEGGFLPAPTELLVALRQTCDAHGIVLIADEVQTGFARTGRMFGIEHSGVEPDLVTVAKSLAGGFPLSGVIGREAIMDAAEPGGLGGTYAGNPIACAAALAVLDVIAEEKLVERANAIGARIKDALTRMALRNDAVAIGSIRGPGAMVAFDVVKKRGTVEPDADAARRVTQAALADGLILITCGVYGNTIRLLNPLTIPDALLDEGLGKLERALVAGAA

SEQ ID NO: 64075 - protein, 349 aa, Kluyveromyces lactis NRRL Y-1140
MFIGIRQHVPRTVFRSMVPVLFAFTLYVLLTVFDLDYKTLSQRSFSSSAGSNNSNSWSSSSSSSYSASSDAFNYQVAIAYQPKDRNEPIYAKLKESLQSPTGEDSYFVAPRSSSELYAGVADGIGGWANHGYDSTAISRELCLAMKSITLNSSKDIAPKELLQMAFSSLLNEEKVEVGGTTAIVAHLKDDGTLNVSNLGDSWCGVFRDCKLTFETKFQTVGFNAPYQLAIIPKHIIEAAEKKNGSFIMNKPTDADDYSFKLQKNDIVVLATDGVTDNIAVEDMELFLKDKIESSQSLQDITQEFVDKVVTISKDPTFPSVFSQEYSKLAGQYYSGGKEDDITVVVIKVE

SEQ ID NO: 64076 - protein, 168 aa, Avena clauda
VMASSATTVAPFQGLKSTAGLPVSRRSASSLGNVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 64077 - protein, 413 aa, Zea mays
MSLPHPVPRETVASAVASLTMWMKKRTAQTRPNLLADERDDLVVLQLSLRRIPASSSARPRLLPLPHPVIGHDGASVCVISDDRPKSRSASASDLLHASKSLHRLPVSDVIPLSTLRTDYRPYESRRRLAASHDLFIADRAILPLLPRVLGKAFYATKKAPIGVDFSRVGWPEQVRKVLGSAFLYLRSGTCSGIKVGRLDMEEEVIVDNVMVAVEEAVEKVPKKWANVRALHLKAVDSVALPIYQVVPELGMKIEVPEIIGSGEVIDAAEAETCGKKIDKKGDAGARGREVFANVSAKRKRNKKGQVEDDVAMQEEVQVEIEKKKRKSIVISANDSQMAGKKGEKKGKRGLENKVNEASFDNKKVKMGKTEQRKKKSMNGDGEVGTEEMQGDKKIKVEKSDVKIKKLRTRIRV

SEQ ID NO: 64078 - protein, 168 aa, Avena sterilis subsp. ludoviciana
VMASSATSVAPFQGLKSTAGLPVSRRSNAGLGSVSNGGRIRCMQVWPIEGIKKFETLSYLPPLTEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 64079 - protein, 103 aa, Zea mays
ILLEPRGGKGKALKLIQSRVRPLLEEAEVSFKLMLTERQNHARELVCAEELGHWDALAVMSGDGLMHEVVNGLMERPDWESAIQKPLCSLPGGSGNALAASLN

SEQ ID NO: 64080 - protein, 495 aa, Thermoanaerobacter tengcongensis MB4
MRIFEVHKKSGVSDSHIAIKFKGRVYTYGEVDALIDKYASYFQSIGVKKGDRVALSFPNCPEYIFSFMGASKAGAIVVPLNMMLTLEEIGYIIMESGTSVLVVHPAIAQKVDKSQLARLNLKNVVIMDENTVNEILKMKSPAPVDIESGEVCAFLYTSGTTGKPKGAMLTHDNFVSDVKMLYDVSRVIDLGPNDNFLTVLPLFHSFSWTVNVLLGLYLGSTITLKETFMPKDTLETLIQEDITVFCGVPSMFAVLMRMAEKGQFKALRLAISGGAPLAAEVQRGFEEKFNFPLVEGYGLSEAAPVALLNPLDPKALRKPGSIGFPLPGVEAKIVDENDNELPVGEIGELVLKGPNVMVGYHNMPEETAKTLRNGWLHTGDLAKKDEDGYFYIVDRLKDMIITGGFNVYPREIEEVLLTHPAVLEAAVVGVGDPLKGEEIKAFIVLKEGAEADRRELQSFLKDKIASYKIPKYFEFVKELPKTPTGKVNKKLLKQM

SEQ ID NO: 64081 - protein, 618 aa, Candida albicans SC5314
MEKEIFQFDQKKKKNYSKAESTQFNPTQLNQTNQTNCYTTIMQLLFVSLSFYIGVVLANLARFDENSLSQVCSGMYSKQDWGGSFKPHIGLTLNQFDTLKYDPKNNNKDENANDKDISVSYIIFEYKDLVNIGADLGDGRYKFICDDYAINELKVCDEKQKGKFIVNKNVTNSTILTAQLTHLGHANINYPVNVTGYYCVSTFTQYENTVYNGQVNFQNAFGQLSASEIPKLPAYGILAICYAIALALFGFQFFKKRKENQILPLQRYLLAMLGFLTFDTVVVWSYYDLVNRIESPSSGFARFYMIFLALLNAAKITFSFFLLLCISLGYGVVKLKLDKKVMFGCKVLAGFNFIASFVYLFFNYYGGSSNALVSTDSIDTAASGSFLGLLPIIPIAIILSIYYVTILASIRKTTESLHKQRQIIKLNLYQNLFKIIFGSVILTFLGLTLSSFVYLSMSSTEMFEQHWKGSFFIYDFWPSVVFFIVFMAVAWLWRPTETSYMLAISSQVANDDENGEYQQGMELDTFSLMSHSDDDDDDEGGNGEHNPQRQVERDSFELPTTTNNKNKNIQPENPPQYDQLSTHEPHEAPSSTLFELGEDDEISDHEGDNRLKDEKHKE

SEQ ID NO: 64082 - protein, 181 aa, Brassica napus
MASSMLSSAAVVTSPAQATMVAPFTGLKSSSAFPVTRKANNDITSIASNGGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 64083 - protein, 517 aa, Candida albicans SC5314
MTTFWSQTINHQNGGVATATATATAATTTPTAGGTGAGTTTSTKGMITPTPFNIDINNDLNDFDGKFIETFKPDLELQKKYRSFIQREGALSFLRTEITQSMSKRDICVLILNLGYPKKAVEDYPILTLKELAYILLKLMLTDSAQLEPKVEIDENDNKNDGTNNSDIDSDIDSNSDMDSQSESGELDDAMDVDDSLSENEDEYDQDMSTTTLKRTINMTPFKYKLPDLISDLSRAKKIMVVTGAGISTSLGIPDFRSFKGLYNQLSKLNLSDPQKVFDLQTFMREPGLFYTIAHLVLPPDGKFSLLHAFLKLLQDKHKLLRNYTQNIDNLEQRAGLKSEKLVQCHGSFAKAKCVSCQGIFAGEKIYNHIRRKQVPRCAICWKNTKQAPIHFGAIKPTITFFGEDLPERFHTLMDKDLQQIDLFLVIGTSLKVEPVASIIERVPYKVPKILINKDPIPNRGFNLQLLGLCDDVVSYLCKCLKWDIPHADFNNNDEFKLSKLKNGDWEIVKKSTSTKK

SEQ ID NO: 64084 - protein, 292 aa, Moorella thermoacetica ATCC 39073
MQWGRILTAMVTPFTADGKLDLDGARRLAAYLVDHGSDGLVVAGTTGESPTLTHEEKIALFREVKKAVGDRAAVIAGTGTNSTAASIELSREAEALGVDGLMLVVPYYNRPSQEGLYQHFKAIAAATTLPIILYNIPSRTGRNMDAATTLRLAEIKNIKAVKEASGDLDQATAILRQAPADFLVYSGDDSLTLPLMAVGGYGIISVVAHVAGEKMQAMVRAFTAGDVQGAAALHRELFPLFKALFITSNPVPVKEALQMLGLPAGPVRLPLVGATREEKEKIAAALKETGLL

SEQ ID NO: 64085 - protein, 1022 aa, Burkholderia pseudomallei K96243
MLQLSRRQFLKLSATTLAGSSLALMGFSPAEALAEVRQYKLARTVETRNTCPYCSVGCGILMYGLGDGAKNATSSIVHIEGDPDHPVNRGTLCPKGASLIDFIHSPSRLTQPEYRAAGSDKWQPISWSDALDRIAKLMKADRDANFVETTDDGMKVNRWLTTGMLAASAGSNEVGYLTHKTVRSMGMLAFDNQARVHGPTVAGLAPTFGRGAMTNHWVDIKNADVILVMGGNAAEAHPCGFKWVTEAKAHRNARLVVVDPRFTRTASVADYYAPIRTGTDIAFLGGVIHYLLTNDKIQHEYVKHYTDFSFIVREDFAFDDGIYSGYDADKHAYPDKSTWDYERGDDGFVKVDETLAHPRCVYNLLKQHYARYTPEMVEKICGTPKDKFLKVCEMLATTAVPGRAGTVLYALGWTHHSVGAQMIRTGAMVQLLLGNIGIAGGGMNALRGHSNIQGLTDLGLMSNLLPGYMTLPMQAEQDFDAYIQKRAQQPLRPNQLSYWKNYRAFHVSFMKAWWGDAASAENNWGYDYLPKLDKQYDLLQTIELMHAGKMNGYICQGFNPLAAAPSKRKTSEALAKLKWLVIMDPLATETSEFWKNHGEFNDVDSSKIQTEVFRLPTSCFAEERGSLVNSGRVLQWHWQGAEPPGQAKSDLEIMSGIFLRMRDMYRKDGGKYPDPIVNLSWPYANPESPTPEELAMEFNGRALADLPDPKDPTKTLVKKGEQLAGFAQLKDDGTTASGCWIFCGAWTQAGNQMARRDNADPTGIGQTLNWAWAWPANRRILYNRASCDVNGKPFDPSRKLIGWNGKTWTGADVPDYKLDEPPETGMGPFIMNPEGVARFFARAGMNEGPFPEHYEPFETPLAANPLHPGNPRALNNPAARVFPDDRASFGKVDQFPHVATTYRLTEHFHYWTKHARLNAIVQPQQFVEIGEDLAKEIGVAHGEQVKVSSNRGHIVAVALVTKRIKPLMVDGRKVQTVGVPLHWGFKGLTKPGYLANTLTPSVGDGNSQTPEFKSFLVKVEKA

SEQ ID NO: 64086 - protein, 416 aa, Methanosarcina acetivorans C2A
MLRVMTSRNFLTIDDFDIRGKTILLRVDMNSPMDTQGHILDDMRIKSHIATLKDLESAKVVLLAHQSRPGKKDFTTMKPHAHLLSRYLGKQVTYVDDIFGTFAKTHIASMEDGDVIMLENVRFYSEESLERTPAEQANTYMVKKLAPFVDIFLNDAFAVAHRSHLSVVGFTEVLPSGAGRVMEKELVSLDRGVKGGERPSIFVLGGAKVDDSLRVTENVLTSGGADRVLLTGVVANVALAASGVNIGKVNMDFIKSQGYENQIEKARGLLAKFKDRIGLPKDVALNDNRERVEVHISELNSDSLPINDIGLETIVDYTNEIQNSKTVVLNGPAGVSEIEDFALGTHEIIKAAIKSDFSIIGGGHISVEVAHLGLEHRFSHISTGGGACIDYLAGEKLPGVESLKAAYIKYQEAKKL

SEQ ID NO: 64087 - protein, 313 aa, Ustilago maydis 521
MTKGETIKCKAAVAWEAGKPMSIEEVEVEPPRAGEVRVQVTHTGLCHTDAYTLSGSDPEGAFPAILGHEGAGIVESVGEGVDHVKEGDSVILLYTAECRQCKFCKSGKTNLCQAVRATQGQGVMPDKTKRFSCRGKQLFHFMGCSTFSQYTVVSQYSLVAIDPKAPRDKTCLLGCGVTTGWGAATHTAKVEKGSTVAVFGIGCVGLAVITGAVDAGAGRIIAIDTNDQKESWAKKFGATEFINPTKLGDKDIVSHLVDITDGGLDYTFDCTGNVKVMRSALEACHKGWGNRYAPLPTGYRSQVARLRFRRCQG

SEQ ID NO: 64088 - protein, 491 aa, Escherichia coli
MTEPHVAVLSQVQQFLDRQHGLYIDGRPGPAQSEKRLAIFDPATGQEIASTADANEADVDNAVMSAWRAFVSRRWAGRLPAERERILLRFADLVEQHSEELAQLETLEQGKSIAISRAFEVGCTLNWMRYTAGLTTKIAGKTLDLSIPLPQGARYQAWTRKEPVGVVAGIVPWNFPLMIGMWKVMPALAAGCSIVIKPSETTPLTMLRVAELASEAGIPDGVFNVVTGSGAVCGAALTSHPHVAKISFTGSTATGKGIARTAADHLTRVTLELGGKNPAIVLKDADPQWVIEGLMTGSFLNQGQVCAASSRIYIEAPLFDTLVSGFEQAVKSLQVGPGMSPVAQINPLVSRAHCDKVCSFLDDAQAQQAELIRGSNGPAGEGYYVAPTLVVNPDAKLRLTREEVFGPVVNLVRVADGEEALQLANDTEYGLTASVWTQNLSQALEYSDRLQAGTVWVNSHTLIDANLPFGGMKQSGTGRDFGPPLAGRAGC

SEQ ID NO: 64089 - protein, 168 aa, Avena maroccana
VMASSATSVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIREVEEVKKEYPDAYVRIIGFDNIRQVQCVSFIAFKPPGCEESG

SEQ ID NO: 64090 - protein, 314 aa, Mycobacterium smegmatis str. MC2 155
MPIDPIAQKMLDDAKASGRPNAHLLPVPTARENFENTFAALQKPDVHRVTDVAIETRDGAVIPGRLYVPAEGDDLPLTVYYHGGGWLLGSVDSHDAATRLLAKASGSAVLSVGYRLAPESRFPTAVNDAIDAVEWARAFGATLGVDTSRLAVAGDSAGGNLAAAVALHYRDAGEPVIRHQLLVYPVTTTDLTKGMDPEYDGVMLERDELQWHQDNYLPGPDAASDPRVNVLGADLHGLPEATVILAECDPIRPQGELYLQALKDAGVPVESHLTPGQVHGFFGLDEIFPAATAAMTFAGQRLASALAVAGQSTR

SEQ ID NO: 64091 - protein, 141 aa, Nepenthes distillatoria
  misc_feature (48)..(48): Xaa can be any naturally occurring amino acid
  misc_feature (96)..(96): Xaa can be any naturally occurring amino acid
CLDKAAVVSDKEIKCEDFSNPWRLCTVTQVEELKILIRMFPIWATGIXFSAIYAQMSTMFVEQGEVMDRTIGSFTIPAASLSMFDTISVIFWVPVXDKILVPLARKFTGKQRGFSELQRMGIGLFISILSMAAAALVEMKR

SEQ ID NO: 64092 - protein, 546 aa, Coccidioides immitis RS
MTPEWVATSPICQLPRILIGQWTPCPWLVLENFLLVGVKTSFGLDNPALVPRDTASVIRKKVTPRYIEPRTTYGRTQGIVLTADSGNGCREGISSKASKGLFAAAALDFCLQYRGAMIGSAAVSLISDTFGRRNALLAGGILAACGAALQGGAISIAMLIAGRFIAGLAIGLLSATVPVYCSEVAPFRIRGLLAGMQQWMIGWGFVVAQWVGYGCSLITGSFSWRFPLSFQAVPAVFLVAATAFLPESPRWLIEQEKLAEGHGVLRRLRASHDDPRSLEAEFLQIQRGIARDRRSVVKSWPELLRCPGWRRRLLLGATIQASTQCSGINVINYYGPHIYAALGFETSRSLMIIGVSGALAQAWNTLCLLVLDRIGRRTLLIPSLIGMGATLCVEATLFEFFNPETSRNANALRAQVAMYFVFSLFFTSLGVISWIYPSEIFPTAIRARGTSVSTFVNWSLNLVFAQCSPIALSRLKYRYFYCFMAFNWVGAVIVWIFFPETLGKTLEGVEEVFEGQQNNDDTALEAHSCTEKGNRIMSERKRIDSL

SEQ ID NO: 64093 - protein, 260 aa, Medicago truncatula
MAKNGDTIEIINVNKPMPVQSKFPLSFFETTVASTVALGFILGLLGVYLTMPDSDYSFLKLPRTLHDLQLLRDNLESYTSDYTAQVLVGYCVVYIFMQTFMIPGTVFMSLLAGALFGVFKGVALVVFTATAGASSCFFLSKIIGRPLLFSLWPDKLKFFQTQVAKRRKSLLNYMLFLRLTPTLPNTFINFASPIVDVPYHIFFLGTVIGLIPAAYVTVRAGLALGELQSVGDLYDFNSIATLFFIGIISVTPTLMGKSDS

SEQ ID NO: 64094 - protein, 922 aa, Candidatus Pelagibacter ubique HTCC1002
MSSEKRKIAYIDGKPYEIGPNHTSVLNFVKSYLGEKKVPTLCDDPNLAPYGACRVCSVEVALVKDGPTKVVASCHTPVGENQYIFTNNENLTALRKNIVELVLTDHPMECGTCEVNNNCELQDVANDLGISDHRYNSPKQHKGITKDTSHDYMRMNLDNCINCGRCVRACDEIQGSFVLTMSGRGFESKITTDNDALFGDSSCVSCGACAHTCPTDAISDVYQSKSVAVDKKVRTTCSYCGVGCNLEASIKDNKVVAISTPKESEVNAGHTCIKGRYAFGFYDHPDRLKTPLIKRNGKFEEASWDEAYDFIKKELNRITKESGPDAVAGISSARCTNEENYVFQKMIRAAIGTNNIDCCARICHSPTAWGMQQTFGTGAATNSTEDIYHADLFMVIGANPTNAHPVTGAKIKQQVMKGKKLIVLDPITTELAKLADYHIKLRPGTNVAVLNMMLHFILKANLYDKDFVRDRTEGFANFIKEIERQDMDHLAKVAGVDKQLVKEAAIAYATAKNSMEFHGLGVTEQEQGSKTVMLIADLAMITGNIGRKGVGVNPLRGQNNVQGAADMGCQPHQGAGYFEVADEKVQNFYTEKYGVVHPTKAGLKIPEMFDGAINKEVKAVWIIGEDIVQTDPNSAHVVQAMNSLELLVVQEIFMSETAKLATVVLPGTTFLEKNGTFTNTERRIQRVNRAVPPLPGTKTDGTIVTDMMQKLGFDQPEYDADQVLAEIADVVPFFKGVTRERLGKMGLQWPVQEDGTDTQILHQETFKLGKGRLKNFDWKESTEIETNKKEYPLILTTSRVLQHYNAATMTRRTSNINIVSEDLLLVHPNDANKRELNTGDIGRLYSGRGEVALKVEVTDKVKEGIVFTTFHFPEHMVNMVTGHGKDEETMCAEYKVSAVEVQKISNQFKTEIKPKENQAEVN

SEQ ID NO: 64095 - protein, 164 aa, Synechococcus sp. RS9917
MVAKVLAVVTCVVIAASLIQLIQQVLISLINPGGTSWLGDGLIKVLGDLLTVLIALEVLQNVTSYLRRHVVQLELVLVTALTAVARKVIVLPAGSEDKPQLLMGLGIASISLAGAYWLVMRAAIRHLPATDPSKTASATAFQAQDPSAPHDGGDGAAEPAHPPR

SEQ ID NO: 64096 - protein, 285 aa, Xylella fastidiosa Ann-1
MTTNDTWFTEHFQATGSAIGFRVTGKLDEVQSPFQKIEIYNSTDWGKLMVIDGALMLTSRDNFLYHEMISHPALFTHTAPKCVVIIGGGDCGTLREVLKHPDIEQVTQCDIDEQVTRMAEKHFPELCTSNNDPRATLLFSDGVAYMADCPTNSVDVIIVDSTDPVGPAKGLFNRTFYESCFRALKNDGLLIQQSESPLALLELIKEMRHEMSKAGFKAFKTLPFPQPCYPTGWWSVTLSSKQPNANFAFRQTDAQTKPFDTLYYNAHLHHGVLVPPPFIAHALGE

SEQ ID NO: 64097 - protein, 149 aa, Triticum aestivum
VLMAQKIAKEKGYSDVLYLDAVEKKYLEEVSSCNIFVVKGNVISTPAIKGTILPGITRKSIIDVALSKGFQVEERLVSVDELLDADEVFCTGTAVVVSPVGSITYQGKRIEYAGKQGVGAVSRQLYTSLTSLQMGQVGGPHGSGPCNCN

SEQ ID NO: 64098 - protein, 165 aa, Triticum aestivum
  misc_feature (91)..(91): Xaa can be any naturally occurring amino acid
MERILKSARESGSLNLSNRSLSEVPGEVYNNLDTGSLDDKWWEGVDLQKLILAHNNLEVLREDLRNLSSLVVLNISHNQLSSLPAAIGDLXPLLKSLDASFNQIKLIPEEVGLATALAKVDFSNNCLTDLPASLGRCLNLSELKASNNNISRLPDELAGCCKLRI

SEQ ID NO: 64099 - protein, 869 aa, Oryza sativa (japonica cultivar-group)
MASRRHVLIAALIMVGVLEFANADKYKPTESILVNCGSDKEGQDIDGRKWLSDKDSKWLIDGEKSSIMANADFQDPSLPSPVPYMTARVFTKETMYNFSVGEERHWVRLHFYPASYHDLPAENFFFSVSTSTGITLLKNFSVYITAKALSQAYIIREFTLPPSTTGSLSLIFTPTAMNNASYAFVNGIEIISMPNIFSQAAASVDIAGNEVSTTDSSLQTIYRLNVGGSYVAPTNDSGLSRDWYDDTPYIYGAAVGVTYQANDTVQIKYPKNDPDAEYAAPASVYLTSRSMGPDPKVNKNYKLTWVFEVDGNFTYIVRLHFCELLLSKPNQRVFDILINNKTAQSGADVIGWGGQFVPVYKDYATIMPGGAGDKVLWVQLMPNVGSGSEFFDSLLNGLEIFKMSDSSGNLAGPNPDPSKLLEEAESSAQGKFKSKPSNLKATVIGGAAGGAAAFGIVAAICIVVYQSKKRKVLNNSASHSSGWLPVYGGNSHTSTSKSSGGRSAALINPNITAMCRHFSFGEIKSATKNFDESLVIGVGGFGKVYRGVVDGDTKVAIKRSNPSSEQGVLEFQTEIEMLSKLRHKHLVSLIGCCEDEGEMILVYDYMAHGTLREHLYKGGKPALSWKQRLEITIGAARGLHYLHTGAKYTIIHRDVKTTNILVDEKWVAKVSDFGLSKTGPTAMNQTHVSTMVKGSFGYLDPEYFRRQQLTEKSDVYSFGVVLFEVLCARPALNPSLPREQVSLADHAMSCQRKGTLHDIIDPLLNGKIAPDCLKKFAETAEKCLADHGVDRPSMGDVLWNLEFALQMQETFENGGKTEGADSTSDSTTTSVADSMAANAAALSLISEDMDEEDIANSVVFSQLVRPTGR

SEQ ID NO: 64100 - protein, 203 aa, Triticum aestivum
SLSLGQGLLRTNPVAKTSVDSGLSPAGLRQAARAALELRRLGACEDDCWIWPSITQRAYQAAEIIAAANSINRSKIVPEYSFLDARGLGAYEGKRLEALPEVYASDNISPDIKPPPTYDGTPNESVADVFVRVTQLMSILETQYSGDTVVIVSPDSDNLSILQAGLIGLDLRRHDSLFFQPGEVRAVDPASIPEYKQPASKCF

SEQ ID NO: 64101 - protein, 312 aa, Oryza sativa (japonica cultivar-group)
MGHYSEQRPGFEVTKDWNGADQVMIRSPRGASVLVSLHGGQVVSWRNDRGEELLFTSSKAIFKPPKAMRGGIPICFPQFGNCGTLEQHGFARNRLWAIDDEAPPLNHNDNNGKVSVDLLLKPSEDDLKCWPHCFEFRLRVSLSTDGDLSLVSRVRNVNGKPFSFSFAYHTYLSVSDISEVRIEGLETLDYLDNLSQRERFTEQGDAITFESEVDRVYVGSPSVIAVLDHEKKRTFIVRKEGLPDVVVWNPWDKKSKTMADFGDEEYKQMLCVDAAAVERAITLKPGEEWTGKLELSAVASTNCSDHLDYPCS

SEQ ID NO: 64102 - protein, 500 aa, Azoarcus sp. BH72
MTLYPDQLISPATRAFLARPKRMLIGAEWSAAVSGETLAVLDPATGQAFATVPAGGAADIDRAVAAARRAFESGEWPKMRPVDRERLLLKFADLIEANAQELAEIEALDNGKPVMMARHVDVALVVDFLRYMAGWATKIEGSTMDVSVPLMRDRELFGFTRREPVGVVGAIIPWNFPLLMAAWKVGPALTSGCTMVLKPAEETPLTALRFAELALEAGYPAGVLNVVTGHGDTAGAALASHKGIEKVAFTGSTEIGKLVGKAAIDNMTRVSLELGGKSPVIVLDDADPAMAAAGAAQAIFFNQGQVCTAGSRLFIHKSRFEKVVEGLSGIAASMKLGPGIDPSTQIGPLVSAVQQQRVLGYIESGLAEGARAATGGGAGGEAGYFVKPTVLVNAHDAMKVVREEIFGPVVVAMPYEDLDEVAHRANDTPYGLAASIWSNDLTRVHRLIPKIKAGTVWVNCHNILDNAMPFGGYKQSGIGREMGRAVLDMYTESKSVIMAL

SEQ ID NO: 64103 - protein, 360 aa, Triticum aestivum
  misc_feature (260)..(260): Xaa can be any naturally occurring amino acid
  misc_feature (330)..(330): Xaa can be any naturally occurring amino acid
MPKRPAPQQQKNLLYITHARRPHLSRLRPLAPPAMSAAVGGAEFHGFGGAAQLPRSRMLGRPVRVAPPGATPAGSGPSAASIRAVSTPLKKDAKEVKRSKVEIIKEKSNFLRYPLNEELVSEAPNVNETAVQLIKFHGSYQQSDREVRGQKNYSFMLRTKNPSGKVPNQTYLAMDTLADEFGIGTLRLTTRQTFQLHGVLKKNLKHVISTVIKNMGSTLGACGDLNRNVLAPAAPFGGKGIPFAQETAENMAALLAPQSXGAYYDLWVDGEKIMSAEEPPEVTKARNDNSHGTNFPDSPGPILGPSILPGKFKLRATLAGKTPGGNLTKXMGVVVVQNNAGNPFGFNPQCWEVHWKEPPK

SEQ ID NO: 64104 - protein, 339 aa, Mesorhizobium loti MAFF303099
MSTETNIRIVLAARPQGRPKPSDFRIESVGIAEPGEGELLLQILYLSLDPYMRGRMNATKSYAKPVEIDGVMEGGTVARVVKSRHAGFAEGDIVLSHSGWQGFALSDGVGLRKLDPAAAPVTTALGVLGMPGFTAYAGLLTIGQPKAGETVVVAAASGAVGSAVGQIARIKGARAVGIAGGADKCAFVRRELGFDAVVDHRADNFAEQLKAACPDGIDVYFENVGGPVWDAVFPLLNEFARVPVCGLIAQYNTVAASADDRLPTLMQQVLHRSLTIRGFIQREFVDQRPAFYRDMAGWIASGQVRYREDIVDGLENAPQAFMGLLEGKNFGKLIVRVAQ

SEQ ID NO: 64105 - protein, 382 aa, Bordetella parapertussis 12822
MESVERVNLLGLDGAALSELVGQWGGKPFRARQLQRWVHQRGADSFDAMTDLARDFRAQLARDCVIEALPVNTEQRSSDGTRKWLFDVGQGNAIETVFIPEDDRGTLCISSQAGCVVNCRFCSTGHQGFNRNLRASEIIGQLWWAKRVLEAAADTARLPGGKAGEDTRVISNVVMMGMGEPLLNYDQVLPALRLMLDDNAYGLSRRRVTVSTSGVVPMMDRLSQDCPLALAVSLHAPNDALRDELVPLNRKYPLNALLAACERYLAHAPRDFITFEYCMLDGINDTDQHARELIQLARQVRCKLNLIPFNPFPASGLKRSPSARVRVFAQRLMDAGIVTTVRKTRGDDIDAACGQLAGEVRDRTRITERNATRTIPIQQVHA

SEQ ID NO: 64106 - protein, 441 aa, Lactobacillus plantarum WCFS1
MNEQIKTDALNSAHHLMVGGVDTLTLAKKYQTPLYVYDTGAIRAEIAAFKQVFEENHVDYQISYASKAFATVAMYQLIAQEHIHCDVVSGGELYTAQQADFPMAAVSFHGNNKSLAELTMALDAGVGTIVVDNFGELRQLTTLTTQRQQPTTIMLRIAPGISAHTHDYISTGQADSKFGFDLDSGQADQAIKAAQAAPYLKLVGIHCHIGSQIFEVNGFEMIVDKLVSEFARWQRELDFYPQIMNVGGGFGVKYTAEDHPLQPTDFVDAIIKETRAQTAAQQVPMLEIWIEPGRSLVATAGMTLYTIGDEKDIPGIRKYLSVDGGMGDNIRPALYQAKYEAVLAKNPALPAEQVASIAGKYCESGDMLIWNQQLPATAPGDVLAVLDTGAYGYSMASNYNRNPRPAVVFCEQGHSQLVVQRESYADLTRLDLPLSVPEKTK

SEQ ID NO: 64107 - protein, 475 aa, Moorella thermoacetica ATCC 39073
MSKTPGEVLEMARKNNIQMVDLKFIDLPGTWQHFSVPLDEFDEGAFTSGVGFDGSSIRGFKTINESDMILVPDPDTAFIDPFCDVPTLSLVCNVYDPMTGQNYNRDPRFVAKKAEAYLKETGIADTSYWGPEAEFFILDHVRFDQSQYAGYYFLDSDEGFWNSGVEMNGHPNLGYRPRYKEGYFPVPPTDTLQNLRTEMVLLLKQMGIAVEAHHHEVATAGQGEIDMKYAPLTRMADQLMMFKYVVKNVAIKHNKTATFMPKPVFQDNGSGMHVHQSLWKGNEPLFYDANGYAGLSELALYYIGGLLKHAPVLTAFCSPTTNSFKRLVPGFEAPVNLVYSQRNRSAAIRIPMYSSSPAAKRIEYRPPDPSCNPYLAFAALLMAGLDGIKNKIHPGEPLDKDIYDLPPEEAARVKSLPDSLEEAIAALEKDHEFLLQGGVFDEDLINAWIEYKQKREINQIKLRPHPYEFVLYYDV

SEQ ID NO: 64108 - protein, 411 aa, Arabidopsis thaliana
MSSSSSCLFFTFILLLSLFSSYASPSNSTSETVPLRPQREIQKMKLIRKQLQKINKPAIKTIHSSDGDTIDCVPSHHQPAFDHPLLQGQRPMDPPEMPIGYSQENESHENFQLWSLYGESCPEGTIPIRRTTEQDMLRANSVRRFGRKIRRVRRDSSSNGHEHAVGYVSGSQYYGAKASINVWTPRVISQYEFSLSQIWIIAGSFAGDLNTIEAGWQARISPELYGDTNPRFFTYWTSDAYQATGCYNLLCSGFVQTNNRIAIGAAISPVSSYKGGQFDISLLIWKDPKHGHWWLQFGSGTLVGYWPVSLFTHLREHGNMVQFGGEIVNTRPGGSHTSTQMGSGHFAGEGFGKASYFRNLQMVDWDNTLIPISNLKVLADHPNCYDIRGGVNRVWGNFFYYGGPGKNSKCP

SEQ ID NO: 64109 - protein, 567 aa, Kluyveromyces lactis NRRL Y-1140
MSNQMTDSTSAGSGTEHSVDTNTALKAGSPNDLKVSHEEDLNDLEKTAEETLQQKPAKEYIFVSLCCVMVAFGGFVFGWDTGTISGFVNQTDFLRRFGQEKADGSHYLSNVRTGLIVSIFNIGCAVGGIVLSNIGDRWGRRIGLITVIIIYVIGIIIQIASVDKWYQYFIGRIISGLGVGGITVLSPMLISETAPKHLRGTLVSCYQLMITFGIFLGYCTNYGTKNYSNSVQWRVPLGLCFAWAIFMVLGMMFVPESARFLVETDQIEEARKSLAKTNKVSIDDPVVKYELLKIQSSIELEKAAGNASWGELITGKPSMFRRTLMGIMIQSLQQLTGDNYFFYYGTTIFQSVGMDDSFETSIVLGIVNFASTFFALYTVDHFGRRNCLLYGCVGMVACYVVYASVGVTRLWPDGPDHPDISSKGAGNCMIVFACFYIFCFATTWAPIAYVVISESYPLRVKGKAMAIASASNWIWGFLIGFFTPFITSAIHFYYGYVFMGCMVFAFFYVYFFVPETKGLTLEEVNEMYSEGVLPWKSSSWVPSSRRGAEYDVDALQHDDKPWYKAML

SEQ ID NO: 64110 - protein, 449 aa, Lactobacillus plantarum WCFS1
MISQNHRLDQQLIEREDHYMATAARINYYDLVIDHAHGALLTDVDGNQYIDLLASASAINVGHTHPRVVKAIQEQAAKLIHYTPAYFHHQPEQRLAERLAKSAPGTDNEVVFGNSGSDANDAIIKFARAYTNRQYIVAYTDAYHGSTYGSMSLSGVSLNMVRKMGPLLPGIVHVPYPDCYRTLPHETEHELALRYFEAFKAPFDSYLPAEETACVIIEPIQGDGGIRKAPAEYVQLVYDFCHQHGILFAVDEVNQGMGRTGKMWSIQNFPGIRPDLMSVGKSLASGLPLSAVIGRREVMESLAAPAHTFTTAANPVCCAAALATIDVLADEQLVARSANYGRYAKEQFLALQQRHPKIGQVRMYGLNGGIELVTDRQSQQPDPDFASDVIYAAFERGVVMITLKGNILRFQPPLVITKTQLDTALTVLDEAMAAAEQGLVKRPQGKIGW

SEQ ID NO: 64111 - protein, 228 aa, Nepenthes mapuluensis
  misc_feature (1)..(2): Xaa can be any naturally occurring amino acid
  misc_feature (6)..(7): Xaa can be any naturally occurring amino acid
  misc_feature (9)..(9): Xaa can be any naturally occurring amino acid
  misc_feature (18)..(18): Xaa can be any naturally occurring amino acid
  misc_feature (32)..(32): Xaa can be any naturally occurring amino acid
  misc_feature (48)..(48): Xaa can be any naturally occurring amino acid
  misc_feature (59)..(59): Xaa can be any naturally occurring amino acid
XXGWAXXFXIPAISMGIXITSFFSGTALYRLXKPGGSPLTRMCQVLVXSFRKSRLALPXDSSLLYETSDKNSVIEGSRKLEHTNELKCLDKAAVVSDKEIKCEDFSNPWRLCTVTQIEELKILIRMFPIWATGIIFSAIYAQMSTMFVEQGEVMDRTIGSFTIPAASLSMFDTISVIFWVPVYDKILVPLARKFTGKQRGFSELQRMGIGLFISILSMAAAALVEMKR

SEQ ID NO: 64112 - protein, 499 aa, Lactobacillus plantarum WCFS1
MQRLLKRLTLKEDPSIYEDKDSHLARVLTVKDFLALGVGTIVSTSIFTLPGVVAANHAGPAVVFSFIVAAVVAGLVAFAYAEMAAAMPFAGSAYSWINVMFGEFFGWIAGWALLAEYFIALAFVGSGLSANLRGLLSPLGLTLPKALSNTFGTDGGVVDLIAVLVIALVSLLLSRGISKASRVENVLVVLKVLAVLTFIVVGATAIHVQNYVPFIPKYHLNADGSAFGGWQGIYAGVSMIFLAYIGFDSIAANSAEAKNPGKTMPRGILGSLVIAVVLFVAVALVLVGMFKYSSYANNAEPVGWALRQAGHPIVASVIQAIAVLGMFTALIGMTLAGSRLIYSFGRDGMLPKWLGKLHRNQPNNALLVLTIVAIIIGAFCPFAFLAQLISAGTLIAFMFVSLGIYALRRREGVDIAVPAFKMPFYPVLPAIAFLGALFVFMGLDIQAKLYAGVWFIVGLVIYFSYGMRHSYLAEKRLSETDTAAKSASKVADSTVEERD

SEQ ID NO: 64113 - protein, 224 aa, Nepenthes madagascariensis
  misc_feature (13)..(13): Xaa can be any naturally occurring amino acid
  misc_feature (32)..(32): Xaa can be any naturally occurring amino acid
  misc_feature (51)..(51): Xaa can be any naturally occurring amino acid
  misc_feature (62)..(62): Xaa can be any naturally occurring amino acid
  misc_feature (107)..(107): Xaa can be any naturally occurring amino acid
  misc_feature (131)..(131): Xaa can be any naturally occurring amino acid
  misc_feature (136)..(136): Xaa can be any naturally occurring amino acid
  misc_feature (157)..(157): Xaa can be any naturally occurring amino acid
  misc_feature (213)..(213): Xaa can be any naturally occurring amino acid
NLGWALGFGIPAXSMGIAIASFFSGTALYRLXKPGGSPLTRMCQVLVASFXKSKLTLPEDSXLLYETSDKNSVIEGSRKLEHTDELRCLDKAAVLSDKEIKCEDFSXPWRLCTVTQVEELKILIRMFPIWXTGIVXSAIYAQMSTMFVEQGEVMDRXIGSFTIPAASISTFDTISVIFWVPVYDKILVPLARKFTGKQRGFSELQRMGIGLFXSILSMAAAALV

SEQ ID NO: 64114 - protein, 235 aa, Nepenthes khasiana
  misc_feature (7)..(7): Xaa can be any naturally occurring amino acid
  misc_feature (9)..(9): Xaa can be any naturally occurring amino acid
  misc_feature (32)..(32): Xaa can be any naturally occurring amino acid
  misc_feature (37)..(37): Xaa can be any naturally occurring amino acid
  misc_feature (39)..(39): Xaa can be any naturally occurring amino acid
  misc_feature (44)..(44): Xaa can be any naturally occurring amino acid
  misc_feature (69)..(69): Xaa can be any naturally occurring amino acid
LIVWVQXNXGWALGFGIPAISMGIAIASFFSXTALYXLXKPGGXPLTRMCQVLVPSFRKSKLALPEDSXLLYETSDKNSAIEGSRKLEHTDELRCLDKAAVLSDKEIKCDDFSNPWRLCTVTQVEELKILIRMFPIWATGIVFSAIYAQMSTMFVEQGEVMDRTVGSFTIPAASLSTCDTISVIFWVPVYDKILVPLARKFTGKQRGFSELQRMGIGLFISILSMAAAALVEMKR

SEQ ID NO: 64115 - protein, 676 aa, Trifolium pratense
MEKMALTSQNTLLFSSTSLPKNSSSPLFFSKHRNKLFGLSLSSSKPTLRIASRNNNINPIKCSVSEVTEPITEEKRKLMRRADIRNIAIVAHVDHGKTTLVDAMLKQTKVFRDNQTVQERIMDSNDLERERGITILSKNTSVTYKDAKINIIDTPGHSDFGGEVERILNMVEGILLVVDSVEGPMPQTRFVLKKALEFGHAVVVVVNKIDRSSARPEFVVNSTFELFIELNATDEQCDFQVIYASGIKGKAGLSPENLAEDLGPLFETIMRCIPGPRIDKDGSLQMLVTSTEYEGHKGRIAIGRLEAGVLEKGMEVKVCTSEDSCRYARVSELYVYEKFFRVPADRVEAGDICAVCGISDIQIGETIADKLTGKALPSIKVEEPTVKMAFAINTSPFVGREGKYVTSRNLRDRLYRELERNLAMKVEDGETADTFIVSGRGTLHITILIENMRREGYEFMVGPPKVINKKVNDKVLEPYEIATVEVPEEHMGAVVELLGKRRGQMFDMQGVGSEGTTLVKYKIPTRGLLGLRNAILTASRGTAILNTVFDCYGPWAGDMSTRDLGSLVAFEGGTSTSYAIASSQERGQMFIAPGTEVYKGQIIGIHQRPGDLALNVCKKKAATNIRSNKEQSVILDTPLDYSLDDCIEYIQEDELVEITPQSIRMSKNPKLAKKGR

SEQ ID NO: 64116 - protein, 223 aa, Nepenthes pilosa
  misc_feature (223)..(223): Xaa can be any naturally occurring amino acid
LGWALGFGIPAISMGIAIASFFSGTALYRLQKPGGSPLTRMCQVLVASFRKSKLALPEDSNLLYETSDGNSVIEGSRKLEHTNELKCLDKAAVVSDKEIKCEDFSNPWRLCTVTQIEELKILIRMFPIWATGIIFSAIYAQMSTMFVEQGEVMDRTIGSFTIPAASLSMFDTISVIFWVPVYDKILVPLARKFTGKQRGFSELQRMGIGLFIAILSMAAAALX

SEQ ID NO: 64117 - protein, 642 aa, Methanothermobacter thermautotrophicus str. Delta H
MEREAEISAMMNEIRRLSPRQRERARRAVNGLNGKITGRELGFHLVKYGRRDPIDTQISVGDLVLISRGNPLRSDLTGTVAMKGKRFLVVALEHVPGWALKNVRIDLYANDVTFQRMIDNLKSPTRNVLRVLGFLCGTEKPSDGVDVVDFQAVDPELNESQRDAIRMALGSEDFFLIHGPFGTGKTRTLHELIRQEVMRGSRVLVTAESNAAVDNLLEGIAGHVKCVRLGHPQRVSRENLRETLAYKIENHPEYSKVREYQEKIDELIEERERHQKPTPQIRRGLSDTQILINATKRRGARGISPNVMISMARWIETNQRIDDLHSKLQEAEMRIADRILRESQVVLSTNSSAALEYIDGLRFDVAIVDEASQATIPSILIPLARAPRFILAGDHRQLPPTILSRDASELERTLFEELIKRHPGRSRMLNCQYRMHPAIMEFPNREFYDGRIRAHPSLEDISIRDIIEDVPDSDICQKLADPDPVLFIDTSGLDGCERRLKGSTSIQNPLEADLAVIISRSLMRMGVKPEEIGIITPYDDQVDLISSMIDVEVNSVDGFQGREKDVIIISMVRSNRNGSIGFLKDLRRLNVSLTRARRKLIIIGDSRTLSAHPSYRRLTEFCRKRGFLDEAGLDDVRKWGAS

SEQ ID NO: 64118 - protein, 503 aa, Burkholderia sp. 383
MTHNSERPADPAGGADSRHADPDAMFASHEAGYAKQLKPRHVQMIAMGGAIGTGLFLGAGGRLQHAGPALALVYLVCGVFAFLIMRALGELVMHRPTSGSFVSYAREFMGERASFVAGWMYYLNWATTGIVDITAVAIYMKYWAVFTDVPQWVFALGALGIVSVMNMIGVKVFGEMEFWFSIVKVGTLAVFLAVGAVFLASGHPVAGQMPGLHLVADHGGIFPHGILPAVLIVQGVVFAYASIELVGVAAGETADARKVLPKAINSVMWRIALFYVGSVVLLTMLLPWTAYSAHESPFVTFFSKLGVPYVGTVMNVVVLTAALSSLNSGLYSTGRVLRSLAMGGSAPRFVSRMNARGAPYGGILITVAINAIGVPLNYIVPAQAFEIVLNMASLGIITTWGFIVMCQILFRRAVDRGELKAVSFRMPGAPFTSWLTLAFLVGVLVLMAFDYPGGTWTIATIPVVVLALVVGWKLAKRGAAREQVADARASAATHAVADPARGA

SEQ ID NO: 64119 - protein, 234 aa, Nepenthes insignis
  misc_feature (12)..(12): Xaa can be any naturally occurring amino acid
  misc_feature (15)..(15): Xaa can be any naturally occurring amino acid
  misc_feature (219)..(220): Xaa can be any naturally occurring amino acid
IVWVQENLGWAXGFXIPAISMGIAIASFFSGTALYRLQKPGGSPLTRMCQVLVASFRKSKLALPEDSNLLYETSDENSVIEGSRKLEHTNELKCLDKAAVVSDKEIKCEDFSNPWRLCTVTQIEELKILIRMFPIWATGIVFSAIYAQMSTMFVEQGEVMDRTIGSFTIPAASLSMFDTISVIFWVPVYDKILVPLARKFTGKQRGFSELQRMGIGLFXXILSMAAAALVEMKR

SEQ ID NO: 64120 - protein, 237 aa, Synechococcus sp. RS9917
MPPLPPSFIDQLRFNAAGLIPAIAQDWLDGAVLMQAWMNREALERSLASGEVHYWSRSRQELWHKGATSGHRQTLRGIRYDCDADVLLLTIEQVGDVACHTGARSCFYDDGPLPSAGGADAAPPPADVCTELMRVIEGRRDHPEAGSYTNTLLEGGDNRILKKIGEESAEFVMACKDDNGAEIAGEAADLIFHLQVALAHHGVSWRQVQQVLADRRGAPRRDAAGQSESAADATTAG

SEQ ID NO: 64121 - protein, 217 aa, Cryptococcus neoformans var. neoformans B-3501A
MSCSHEAHDHDHGHDGHSHDVPLESSPLDSLYTQIDLPNVMALNAEGGGEAGRKVTKSWDMKEDDTIWLESEIDDELIIKIPFTSSVSLRSITLKSGPGGHTPSEMHLFRDNPGLDFSDASSSSPTQSFDVVPRKEGVEYQVKAAKFNGLTSLTIFFPGNTADDDEETTKVYYIGLRGSWKPLPNRPGVIIYESSANPADHKVPGVNAGGATHRPGY

SEQ ID NO: 64122 - protein, 484 aa, Burkholderia sp. 383
MSTVLKPIPASDVRYEALRIDGQRVWRDAVIDVRNPYDGSLVGTVPKATLDDVRRAFAVARAYRPTLTRHDRSAILRRAADIVRARTAEIAGLITAESGLCVKDSTYEAGRVADVLTFGAGEVLKDDGQIFSCDLTPHGKKRRVYTQRDPLLGVISAITPFNHPMNQVAHKIVPSVATNNRMVVKPSEKVPLSCYLFADILYEAGLPPQMLQVLTGDPKEIADELITNPAIDLITFTGGVSIGKSIASRMGYRRAVLELGGNDPIIVMDDADLDEASTLAVSGSYKNSGQRCTAIKRMLVHESVADRFTELVVEKTRAWSYGNPADPSVDMGTVIDEAAAKFCEQQVNDAIARGARLLVGNVRNGALYSPTVIDRVTPDMPLVKYETFGPVSPIMRFSDIDEAIRMSNSTDYALSSSVCTNRFDHITRFITELEVGSVNVREVPGYRLELTPFGGVKDSGLGYKEGVQEAMKSFTNVKTYSLPW

SEQ ID NO: 64123 - protein, 124 aa, Zymomonas mobilis subsp. mobilis ZM4
MNLIQTLEAEQIAKLQEQKSIPDFRAGDTLKVGVRVVEGERIRIQFYEGVCIARSNKAIGSSFTVRKISFGEGVERVFPLYSPNVDSIEVVRRGVVRRAKLYYLRGRRGKAARIAERRDVRPSK

SEQ ID NO: 64124 - protein, 133 aa, Synechococcus sp. RS9917
MVQPRRNALPLPGLTLAVLLFLCWSLLGGSPAQALRPTDPVPANLENGSQVFSAQCAACHMGGGNVIRASRTLCQSDLQAHLAAYRSDHLEAIEDQVEHGKNAMPAFASKLSERDIADVAAFVEEQAERGWGR

SEQ ID NO: 64125 - protein, 472 aa, Bacillus cereus ATCC 10987
MNHLRGGSEVANKELKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGVIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAIGVVLSYIAPKNLFVYVYSASVLPGMVPWFVILISQINFRKEKGAEMKDHPFKMPFAPVTNYLTIAFLIMVLIGMWFNDDTRISLIVGIIFLAIVTISFYAFGIGKRTPLDVQNDQEISSK

SEQ ID NO: 64126 - protein, 445 aa, Thermoanaerobacter tengcongensis MB4
MLHGTMRINSKGHLEIGGCDTVALAKKFGTPLYVIDEELLRQNCRAFYNGFKRDYPGNEVIYASKAFMTMAICKIIEEENLGLDVVSGGELYTALKAGFPPEKIYFHGNNKSREELIMALENDIGKIIVDNWHELNMLNELARKMNKVPNIYIRVSPGIEAHTHQYVKTGQIDSKFGFPLFNGDAMRAIEYALTLKNVNLVGLHSHIGSQIFDSYSYKAEIEIMMNFIKLIKEFLGWEVEELDLGGGFGIAYTEEDDPQPIEKIAHEMMQSVKEYSVSLNVKMPKIIVEPGRSIIGNAGTTLYTVGAIKEIPGIRKYVAVDGGMSDNIRTALYGAKYEAIVANKARLPRVEKVSIAGKLCESGDMLIWDILLPEIEEGDILAVLSTGAYNYSMASNYNRLPRPAAVLVSNGQADVIVERETYEDLVRKDVIPERLLSVKRKIVNY

SEQ ID NO: 64127 - protein, 246 aa, Zea mays
MAFASRIGNALRRTLAPTCSPLLQPVRCMSSSKLFVGGLSFATDETTLKDAFSEFGNVLEARIIIDRESGRSRGFGFITFTSTEEASAAMTSMDGKELQGRNIRVNHANERAGGIRGGGGFGAGGGYGGGGGYPTGGYGGGGYSSGGGGGYSSGGGGGYSSGGYAANGYGVGSGSGYGGTYSNASGGGYSGSDGYGNGAASGGYANNLSSGYNSNGRYNTIGSSDGNTGGYNSSPNPYGVGNYNTG

SEQ ID NO: 64128 - protein, 339 aa, Brassica napus
MADKKIKIGINGFGRIGRLVARVILQRSDVELVAVNDPFITTEYMTYMFKYDSVHGQWKHNELKVKDEKTLLFGEKPVTVFGIRNPEDIPWGEAGADFVVESTGVFTDKDKAAAHLKGGAKKVVISAPSKDAPMFVVGVNEHEYKSDLNIVSNASCTTNCLAPLAKVINDRFGIVEGLMTTVHSITATQKTVDGPSMKDWRGGRAASFNIIPSSTGAAKAVGKVLPQLNGKLTGMSFRVPTVDVSVVDLTVRLEKAATYDEIEKAIKEESEDKLKGILGYTEDDVVSTDFVGDNRSSIFDAKAGIALSDNFVKLVSWYDNEWGYSTRVVDLIIHMSKAA

SEQ ID NO: 64129 - protein, 220 aa, Magnetospirillum magnetotacticum MS-1
EGEYSNAGGRMFPGTEREFAVQESVFTRHGVDRVLTFAFDLARSRPKRHLTSATKSNGISITMPFWDERVRAVAESYPDVRWDQYHIDILTAHFVLNPDRFDVVVASNLFGDILSDLGPACTGTIGIAPSGNINPERRYPSVFEPVHGSAPDIAGQGVANPIGQIWSGAMMLEHLGEREAAAEIVAGIERVLTEKALRTRDLGGTADTQTCGRAVEQALG

SEQ ID NO: 64130 - protein, 323 aa, Prosthecochloris aestuarii DSM 271
MSSAQSIISSAKTILRQEAAAIENIAGLLRESFADAVFSMYNCKGKVIVSGMGKSGIIGQKIAATLASTGTTALFMHPADAAHGDLGVVNSGDIVICLSKSGLTEELNFILPALHHRGVTIIAIVGNPRSFLAEKANIVLDVSVCQEACPFDLAPTTSTTAMLAMGDALAISLMREKQFTPNDFALTHPKGSLGKQLTMKVADLMTSGKAVPLVTEEASVTDMILEMTSKRFGVSGVTNRDGKLSGIFTDGDLRRLIQRGVDFSSLSALDVMSPSPKTVSANALAKTSLEMLETYRITQLMVCDNDERPVGIIHIHDLVTQGL

SEQ ID NO: 64131 - protein, 164 aa, Triticum aestivum
MAVLVARQGRELQRYSASTRGRIVVGCIPYRVRGGGGEGEGELEVLVISSQKGHGMMFPKGGWELDESMDDAARREALEEAGVRGEMGKVLGCWHYQSRRYQTTYEGIMYPLRVTDELQQWPEMASRKRTWATVQQVMEGCQHCWMREALEELVARHAKPQSAL

SEQ ID NO: 64132 - protein, 149 aa, Rhizobium leguminosarum bv. viciae 3841
MTDIYSGPVFEMARTQFNRIADRLDLPDGQRNRLLYPKRAITISCPIHLDNGEVAVFQGYRVQHHLTLGPTKGGTRFAPNVDIGEVAALAVWMSWKCALAGLPYGGAKGGITVDPRQLSIRELEALSRRYMQGMILALRMPGQPCCQDW

SEQ ID NO: 64133 - protein, 272 aa, Salmonella typhimurium LT2
MTKRINKDTQVCMSLAARPSNFGTRFHNYLYEALDLNYLYKAFSPTDLTQAISGVRGLGIRGCAISMPFKEACIPLVDELDASAQAIHSVNTIVNTNGHLKAYNTDYIAIARLLANYKVSPDLVFALRGSGGMAKAVACALKDAGFTRGYIVAIDEASGKQLAELYGYEWRPDTDGIEADLLINATPIGMAGGNDADKLSYSEQEVDKASVIFDVVALPPVTPLIRYARERGKTVITGSEVFAIQAVEQFVLYTGIRPDDALFQKAAAWSRL

SEQ ID NO: 64134 - protein, 287 aa, Mesorhizobium loti MAFF303099
MQAGARKYPEPPFPEQHHPKPGDEWAIDPAPLYDAPFYLGSKKLEDKVALITGGDSGIGRSVAVLFAREGADIAIVYLAEDRDAKATKSAVEAEGRRCILVKADVSERDQCRNAVAQTVKAFGRIDVLVNNAAFQIHSSEFAELTEEHFDTTLKTNLYGYFHMAQEAVPHMKPGSAIINTGSVTGIDGSKALVDYSMTKGGIHAFTRALSGNLLGKGIRVNAVAPGPVWTPLNPSDKEAGDVSKFGADTPMKRPAQPEELAPAYVFLASPHCSSYITGEILPVVGGY

SEQ ID NO: 64135 - protein, 264 aa, Prosthecochloris aestuarii DSM 271
MIKDNHAYKDRFSVQAAEYRRFRPTYPLELFGYLSSLTREHTAAWDCATGNGQSAVALASHYSKVIATDASSSQIQQAIRHENVDYHTAPAHNNDIDDSSIDLVTVAQAVHWFSHRQFYDEVSRVLKPDGVIAVWAYHLPLVNPETDKLVECLYATVLRPFWEDEIRHIETGYRDLPFPFIKLQTPQFSMKANWNLREFAGYLETWSATAAYRQKNGRSPVEDMMQPLQKAWENPESKKSLSWPLILMAGRLKEENMPSSSRKK

SEQ ID NO: 64136 - protein, 377 aa, Oryza sativa (japonica cultivar-group)
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTTAEREIVRDIKEKLAYVALDYEQELEAAKSSSSVEKSYELPDGQVITIGAERFRCPEVLFQPSFIGMEAPGIHETTYNSIMKCDVDIRKDLYGNIVLSGGSTMFPGIADRMSKEITALAPSSMKIKVVAPPERKYSVWIGGSILASLSTFQQMWISKGEYDESGPAIVHRKCF

SEQ ID NO: 64137 - protein, 235 aa, Nepenthes villosa
  misc_feature (39)..(39): Xaa can be any naturally occurring amino acid
LIVWVQENLGWALGFGIPAISMGIAIASFFSGTALYRLXKPGGSPLTRMCQVLVASFRKSKLALPEDSNLLYETSDENSVIEGSRKLEHTNELKCLDKAAVVSDKEIKREDFSNPWRLCTVTQIEELKILIRMFPIWATGIVFSAIYAQMSTMFVEQGEVMDRTIGSFTIPAASLSMFDTISVIFWVPVYDKILVPLARKFTGKQRGFSELQRMGIGLFISILSMAAAALVEMKR

SEQ ID NO: 64138 - protein, 526 aa, Moorella thermoacetica ATCC 39073
MTNSIADIASADCIFVIGSNTTENHPVIALKVKEAVRRGARLIVADPRRIELVNFSYLWLRQKPGTDLALLNGLLHVIIKEELYDKEFIAQRTEGFEALKLAVEEYTPAKVSEVTGVPAGDIIEAARTYARGPSSTILYAMGITQHITGTANVMALANLAMACGQVGKEGSGVNPLRGQSNVQGACDMGGLPNVLPGYQPVTDPGVRHKFSEAWGVPDLPGEPGLTLMEMMAAAQEGKLKGMYILGENPVLTDPDVSHVKEALKNLEFLVVQDIFLTETARMADVVLPGASFAEKEGTFTSTERRVQLLHKAIEPPGEARPDWLILNDLLLLMGYPRKYSSPGEIMQEIAGLTPSYAGITYERLEDKGLQWPVLSLEHPGTPVLHREKFSRGYGQFQVVHYRPPAEEPDEEYPFLFTTGRNLYHYHTVISRKSRGLEEMCPAPVVEINDNDAARLGIREGEMIEIVSRRGKVRVKALVTDRIPRGQVFMNFHFHEAAANLLTIAALDPVAKIPEYKTCAVAIKVKK

SEQ ID NO: 64139 - protein, 411 aa, Thermus thermophilus HB27
MTPRHLILGLQHTVAMFGATVLVPLLTGLNPSVALFTAGVGTLVFHLVTGRMVPVFLGSSFAFIAPILAAKEAGFSLSAIGGGIAAAGLVYVLFALLVLLIGSERVRQVFPPVVTGPVIVVIGLTLAPVAVEMAGKDWLLAVFTFLGAVASAVFFRGLFQMVPVLVGVGAGYLLALLLGRVDLSPVREAPWFALPAFTPATLEWGAVLLIAPVALVTVMEHIGDILTNGRVVGKDFFVKPGLHRTLLGDGLATSLAGLLGGPANTTYSENTGVLAVTRVYDPLVLRIAAGFAILLAFIPKLSALLQTLPQGVLGGISMLLFGMIASIGIRTLAEAEIDFTQSRNLIVVSAILVLGLGGAVANLGTVQVAGTAVPLKVSGMALAALVGVVFNLLLPPRLEPRTLLEEEERLP

SEQ ID NO: 64140 - protein, 235 aa, Nepenthes clipeata
  misc_feature (7)..(7): Xaa can be any naturally occurring amino acid
  misc_feature (39)..(39): Xaa can be any naturally occurring amino acid
  misc_feature (138)..(138): Xaa can be any naturally occurring amino acid
LIVWVQXNLGWALGFGIPAISMGIAIASFFSGTALYRLXKPGGSPLTRMCQVLVASFRKSKLALPEDSNLLYETSDENSVIEGSRKLEHTNELKCLDKAAVVSDKEIKREDFSNPWRLCTVTQIEELKILIRMFPIWXTGIVFSAIYAQMSTMFVEQGEVMDRTIGSFTIPAASLSMFDTISVIFWVPVYDKILVPLARKFTGKQRGFSELQRMGIGLFISILSMAAAALVEMKR

SEQ ID NO: 64141 - protein, 438 aa, Pseudomonas putida KT2440
MNQSLAAFKRWRIQIFAITWLAYAAFYFTRKAFSVAKLGIAEDPGFMLDKAAMANLDAIYLAAYAVGQFTWGMLADRFGPRVVVLGGLLISAAAAVVMGSYATFPIFATCMLVQGLAQSTGWAGLCKNIGSFFPASQRGRVLGLWSSCYAFGGLVASPFAGWWAYTLVGTWHAAFFSSAVVVALVAVLFFFLQRNKPEDVGLPAVEPEPQSMAPADNLCSVWAPLREILRNRTVLTLGLAYFLLKPARYAILLWGPVIVFEQMPSVGKVGAAIIPTAFELAGLLGPIMIGLASDKLFGARRMPACVISLVLLTVTLAAFMAAMNTGSVLLVVALLFVMGLTLYGPDSMISGAAAIDFGTAKAGATAAGFVNGCGSVGAVLGGLLPGYFDGVTVFIVFAGCALFSALVLLPHWNSRPASSAQGTDVAPNTSMAIKPLRT

SEQ ID NO: 64142 - protein, 435 aa, Xanthomonas campestris pv. vesicatoria str. 85-10
MSEFRQATDAFASNPVESKQEIRNYTMNFGPQHPAAHGVLRLILEMDGETVVRADPHIGLLHRGTEKLAESKPFNQSVPYMDRLDYVSMMCNEHAYVRAIESLMGIEAPERAQYIRTMFDEITRIKNHLMWVGSNALDLGAMAVMLYAFREREELMDVYEAVSGARMHAAYYRPGGVYRDLPDRMPQYKESRWHKGGALKKRNAGREGTMLDFLEEFTNTFPARVDEYETLLTDNRIWKQRTVDVGIISPDLARAWGMTGPMLRGSGIEWDLRKKQPYAKYDAVDFDIPVGTNGDCYDRYLVRVAEMRESNRIIKQCVKWLKANPGPVMVTNFKVAPPSREGMKDDMEALIHHFKLFSEGYCVPAGETYSAVEAPKGEFGCYLMSDGANKPFRVHLRAPGFAHLSSMDAVVRGYLLADVVAMIGTYDLVFGEVDR

SEQ ID NO: 64143 - protein, 235 aa, Nepenthes gymnamphora
  misc_feature (7)..(7): Xaa can be any naturally occurring amino acid
  misc_feature (39)..(39): Xaa can be any naturally occurring amino acid
  misc_feature (138)..(138): Xaa can be any naturally occurring amino acid
LIVWVQXNLGWALGFGIPAISMGIAIASFFSGTALYRLXKPGGSPLTRMCQVLVASFRKSKLALPEDSNLLYETSDENSVIEGSRKLEHTNELKCLDKAAVVSDKEIKCEDFSNPWRLCTVTQIEELKILIRMFPIWXTGIVFSAIYAQMSTMFVEQGEVMDRTIGSFTIPAASLSMFDTISVIFWVPVYDKILVPLARKFTGKQRGFSELQRMGIGLFISILSMAAAALVEMKR

SEQ ID NO: 64144 - protein, 591 aa, Oryza sativa
ETNRVTTTPLSSSQAMAAATPASGGGGGGYSCETAEQTREWMEAISAFLHLHRPLLEAHVVNFFKDRLWEMVDAEWMECLRREPVESLLMLPSGCVQEHWPSSLRDFVLTAKSLVLPREQKSPRSLLPDLHVASINTVLAQGMNSKKKHEIETLAGLVHAITKSCGAKTVIDVGSGQGYLAQALSFEYQLPVVAIDASSHHASVTNTRAERIKKYYTAKCVGKQQLRVPRTVTCHVLSSDTLAAVTLEACQDDHAEHIPESKNFNESSPQIEKPNDSIPPLVLAGLHACGDLSVNMLRLFVSCEQVKALISIGCCYNLLSEECHEDTNTCPGFPMSKAAKLSNLVLRKSTRDLGCQSAERWRSLTKDIALQNFDIHAFRAAFQMFLEKHFPEVSRSSPSIGRQGKALRRQRLRKVMESPMAMAETDALSYSTQKEQIMTKDDPLPTGPNNFKEVHVDFLPELSTGFVDSAVSGAAVVPDDIYLDKSQKFTLFKDFTVSGLGRLGCDFVENVSLLEIWKDVQPFTEFIGPFWCLRVALGPLVETYILLDRLLFLQEQGSVIEASLFPLFNPTMSPRNMAIIAWKLSANPSKV

SEQ ID NO: 64145 - protein, 528 aa, Artemisia annua
MILVTDFKDKIYYTMINYWSWWWEVDNESDNVARTILTILVPILVLLWYKWTVSYTKKPRSRLPPGPYGLPVIGYLPFLSSNLHERFTEMSHKYGPIFSLYLGSKLNVVVNSIDLAKVVARDLDQTFANRNPPVTAITVTYGLLDIAWSNNNTHWRNTRKLLVSQVLSNANLDACQGFRTDEVRKTVGHVYAKIGEIVDINEISFETELNVVTNMLWGRNESGSLLEGFREVELKMLELLGAPNISDFIPMLSWFDLQGRKREMQKQHERLDRILDNVIKARMEGVLHDDGKKDFLQIMLELKDQKDGPTSLNMVQIKALLFDILTASTDTTSTMVEWVMAEILHNPDVMRRVQEELTIVIGMNNIVEESHLQKLVYLDAVVKETFRVHPPLPLLIQRCPNESFTVGGYTIPKGSIVYINVMAIHHDPKNWINPLEFKPERFLNGKWDYNGYNLKYLPFGSGRRICPGIPLGEKMLMYILASLLHSFEWSLPKEEELELSEEFGFVTKKRRPLIAIPSQRLPEASLYS

SEQ ID NO: 64146 - protein, 235 aa, Nepenthes sumatrana
  misc_feature (39)..(39): Xaa can be any naturally occurring amino acid
  misc_feature (138)..(138): Xaa can be any naturally occurring amino acid
LIVWAQENLGWALGFGIPAISMGIAIASFFSGTALYRLXKPGGSPLTRMCQVLVASFRKSKLALPEDSNLLYETSDGNSVIEGSRKLEHTNELKCLDKAAVVSDKEIKCEDFSNPWRLCTVTQIEELKILIRMFPIWXTGIVFSAIYAQMSTMFVEQGEVMDRTIGSFTIPAASLSMFDTISVIFWVPVYDKILVPLARKFTGKQRGFSELQRMGIGLFISILSMAAAALVEMKR

SEQ ID NO: 64147 - protein, 473 aa, Artemisia annua
  misc_feature (68)..(68): Xaa can be any naturally occurring amino acid
MELYTTSLLFIVSFSTIIFLLFRRNSAFWRSINTPPGSTGLPLIGETFQIISAYKTENPEPFIDARVXKYGSVFTTHVFGERTVFSADVEINKFILQNEGRLFESSYPGSIANLVGKHSLLLMRGGLHRRMHSLTMSFANSTIIKDHLLADIDRLVRLNLDSWTGRILLMDEAKKITFELTLKQLLSIEPCEWSENLRKEYMLVIEGFFCIPLPFFSLTYRRAIQARKRVTEALHLVVRERRIEREKGVKKNDMLAALFDSDGDEENFYDDEIVDFLVSLLVAGYDTTSTTMTLAVKYLTDTPSALAQLKEEHDAIRAKKGASVALEWDDYKSMPFTQCVVNETLRLSNIISGVFRRAITDVKIKDYTIPKGAKVFTSLRAVHLDQDNFEDARVFNPWRWQKTSDSASFMPFGGGPRRCPGHELARVALSVFLHHLITHFSWKPAEEDKVVFFPTTRTQKRYPIIVEQRNVVG

SEQ ID NO: 64148 - protein, 448 aa, Zea mays
MALVQFNGALVPQLGEKPRLLSSSPAIAKATYSDARFLTPKTGSRGRGKHLLSPSYSLHSQTSSEQLNHVPSSRFRQKRGSRFIVRAEADFYSVLGVSRNASKSEIKSAYRKLARSYHPDVNKDPGAEQKFKDISNAYEVLSDDEKRSIYDKYGEAGLKGAGMGTGDYSNPFDLFESLFEGFGGMGGMGGGRAARNRPMQGDDESYNLVLNFKEAVFGVEKEIEITRLEGCNTCDGSGAKPGTKATTCKTCGGQGQVVSSTRTPLGIFQQVSTCNTCGGTGEFSTPCNTCGGDGRVRRTKRISLKVPAGVDSGSRLRVRSEGNAGRRGGPPGDLYVFIDVLSDPVLKRDGTNILYTCKVSYIDAILGTTVKVPTVDGTVDLKIPSGTQPGTTLVMSKKGVPLLGKSNARGDQLVRVQVEIPKRLSSDEKKLIEELANLNKAQTANSRR

SEQ ID NO: 64149 - protein, 738 aa, Legionella pneumophila subsp. pneumophila str. Philadelphia 1
MQQEDQAQIPQNSRSFSRNTARCFDTFMDTVDFLGRIGWPVIDLAFRIWIAQQLLVSAILLTNHWDTAVYLAKNEYPVPWLSPEWEALLGILAQFVGGISLLLGLFTRCGAAFIVGFAVMTQVYYQPIDLNLLWIALMLGYVLRGPGPLSLDNLFEHGFSRSPLPFAMLIVTFVDRTREFFSSLYLFSLRMWLMISLLLINQHIQLISSDALPLLMPWLPLNSASIVFNNVSLFMAIFLGLGLATRVVAIFGLIVVLLSFTPGVTGFYLYWMMVMAILFISGPGILSLDHLIFHALKKHYPQLSGKPAFSLDGLPRVVIIGAGFGGIACAKALRHMPVKITLIDRHNYHLFQPFLYQIATGSLSPADIAISIRSIFLEQFNAEILLGNVTDINKEERFVIADNFTIPYDYLVIATGATHSYFGKDSWAPYAPGLKTINDGTSVRSRIIKSFELAEIAESDEERKQFLNFVIVGAGPTGVELAGAIAELARFGIVKEFRHFDPASANIILVQAAPRILPTFSEQISQKAQRYLESMGVKVLVNSMVEQIDSDGVIINKERIYSKSVFWAAGVAASPASKWLQLEADPAGRVKVNDDLTVAGYSNIFAIGDTAASNAWNGKPVPGIAPAAKQGGAYVAKVISKRIYNNNSRYKPFKYIHYGSLATVGRKAAVAEFDRFKISGELAWWFWGGVHVFFLVGSRNRLSVILNWLWSYYTFRANNLLITDDSLNKKNKSGTSEV

SEQ ID NO: 64150 - protein, 433 aa, Ralstonia solanacearum GMI1000
MSSPSRSVSLFERAQKTIPGGVNSPVRAFRSVGGTPRFIAKAAGPYLWDADGTRLIDYVGSWGPMIVGHAHPEVVRAVQQVAADSFSFGAPTEAEVVMAETLCELVPSIEQVRLVSSGTEATMSALRLARGFTGRDLIVKFEGCYHGHADSLLVKAGSGLLTFADTTQNAPSSAGVPEDVVKHTMVLPYNDADALREAFARHGKEIAAVIVEPVAGNMNLVRATAAFLQAMRALCTEHGAVLIFDEVMTGFRVALGCAQALYGITPDLTCLGKVIGGGMPAAAFGGRRDIMGFLAPLGSVYQAGTLSGNPLAVAAGVTTLRLIAADGFHDRLAAQTRKLVDGLAGIARDAGVPFAADSVGGMFGLYFREGVPTSFAEVTQSDVGRFNAFFHAMLAEGVYLAPSAFEAGFVSSMHDDAVLEATFEAARRAFKAV

SEQ ID NO: 64151 - protein, 490 aa, Oryza sativa
  misc_feature (448)..(448): Xaa can be any naturally occurring amino acid
MAAANLLSRALLPALNPNPSSHSNRVSPSAVSLRCRHGLTASVRASLSTAAPSPPPRPAAAAADGRAPKRCFRRGADGHLYCEGVRVEDAMGAAERTPFYLYSKPQVVRNFTAYRDALEGLRSIVGYAVKANNNLRVLQLLRELGCGAVLVSGNELRLALRAGFDPTRCIFNGNGKTLEDLVLAAESGVFVNIDSEFDLENIVTAARVAGKKVPVLLRINPDVDPQVHPYVATGNKTSKFGIRNEKLQWFLDSIKSYSNDITLVGVHCHLGSTITKVDIFRDAAGLMVNYVDEIRAQGFELEYLNIGGGLGIDYHHTDAVLPTPMDLINTVRELVLSRDLTLIIEPGRSLIANTCCFVNRVTGVKSNGTKNFIVVDGSMAELIRPSLYGAYQHIELVSPSPDAEVATFDIVGPVCESADFLGKDRELPTPDKGAGLVVHDAGAYCMSXASTYNLKLRPPEYWVEDDGSIAKIRRGESFDDYMKFFDNLSA

SEQ ID NO: 64152 - protein, 521 aa, Zymomonas mobilis subsp. mobilis ZM4
MSQSFYITTAISYPNGKPHIGHAYEAIASDALARYHRLAGDDVYFQTGTDEHGLKMAQTARNRDIEPIALADEMSSHFKTMDDVYNISYDRFIRTTEAEHYKASQALWKTLADAGHIYLGRYEGWYSIRDEAFYKEEELVTDSKGEKLSPQGTPVEWNVEESWFFRLSAFQDKLLAYYEAHPDFIQPEARRNEVISFVKSGLADLSISRTSFDWGIPVPDSPGHVMYVWIDALTNYLTGAGYPDNKERFDRYWPADIHVIGKDIIRFHAVYWPAFLMAADIALPKKVFGHGFLLNRGEKMSKSVGNVVDPIDMAKLYGVDQIRYFLLREVTFGQDGSYSHEAIVNRINADLANDFGNLAQRSLSIIAKNGAKVPSPEDTRAEDQALMEKIAGIPHQVATAMNNVAPNQALDAIWRGVGEANLYISEQAPWTVRKTDPVRADTILYWTIEAVRQLAILCRWAMPASCDALLDLLGQGADQRDFRALSAPLVPGLPLPKPVGVFPRFVENDKNNSEKAAKDKA

SEQ ID NO: 64153 - protein, 301 aa, Brassica napus
  misc_feature (240)..(240): Xaa can be any naturally occurring amino acid
  misc_feature (246)..(246): Xaa can be any naturally occurring amino acid
  misc_feature (249)..(249): Xaa can be any naturally occurring amino acid
  misc_feature (282)..(282): Xaa can be any naturally occurring amino acid
  misc_feature (288)..(288): Xaa can be any naturally occurring amino acid
MCNPTKDSVPSQSGLVSKEKRAYFQRYWTWADVARALTVTIVHFWCLLAPFNYTWEALRFGLILVTLTNLLITFSYHRNLAHRSFKLPKWLEYPIAYAAVFALQGDPLDWVSIHRFHHQFTDSDRDPHSPKEGFLFSHVMWIIDTLYIKYKCGGRNNVMDLKQQWFYRFLRKTIGFHVLMFWTVLYLYGGLPYLTCGGGVGGVLGYHVTWLVNSACHIGGSRSWKTKDTSRNVWWLSIFXMGDSWXNNXHAFQSSARQGLEWWQIDITWYLIRLFEVLGLAXDVKLPXEYQKQKLALACSS

SEQ ID NO: 64154 - protein, 460 aa, Prosthecochloris aestuarii DSM 271
MQVKFGTDGWRAIIAEEFTFANLKRVTLAAAEYFLNQPDSLRGICLGYDTRFMSADFARYSAEIFSSKGLRVFLSDSFVPTPAVSLYTKEKKLAGGVVITASHNPPVYNGFKIKDSYGGSAHPQSIAIIEENLEHVDAEEPIVPNEHLIELTDIKEFYLQNLSRNIDLKSIHDTQMTIAHNAMFGAGQQIISGLFDESTVSNYHCSLNPGFMGINPEPVAQNVMDFVDFVKEVKTDVAIINDGDADRVGMLDENGSFIDSHKIFAIVLKYLVEDRGEKGEIAKTFALTDVIDSICRKHDLPLHILPVGFKHVSKLMTTSNILMGGEESGGIGITSYLPERDGIYIGLLVLEIMAKKKMTLGELVKELFDEYGYFYYERHDLHVSQEKKQAIMRRAAGGDITAIGPYPVTRFNDLDGYKYHFKGGWLLIRPSGTEPVLRIYCEADSREKAQKALAFAEKIA

SEQ ID NO: 64155 - protein, 301 aa, Azoarcus sp. BH72
MVYRVGAPRFHELSVAQARHSFQKLQYAFRPDVPAVASVTEVPMARADGSALLARYYRPLQAGPHEALPLLLYFHGGGWCVGDVESYDVLCRELANAAGCAVLSVDYRLAPEHPFPAAVHDARFAVEWAREQAGLLDIDPARIALAGDSAGGNLSIVTALAMRDEGAVPARCLALVYPSTEIASGRPSRERYAEGYFLDRESLQWFFERYLPEGGSEDWRASPMRADSLVGLPPMLLVSAECDPLVDDCTAFAARVRAEGGTVDEVCVPGMVHGFLTLGKYFPEAGQTVRLLAETLKARLA

SEQ ID NO: 64156 - protein, 618 aa, Zea mays
MGGSHSREDVDLTSSDEEEEFEDDYDARSPIAEAAASAGQRDDDLLRTATPSSLEAIDAKLRSLDLKYQRPTAAKLYLHVGGASPSARWVPAERRATYAFVDQSSDDASSPRWFLEVGPGPRVSAPVDSALQLKTIPAQRRADFAASGSVWALRLPTDAELRRFRVEYERCLFENTYGVEATDEGRKEVFGADFAAWARPAEADDTVWADAEESLTPPAAAPGKDLLKEFEEEAGDGDSIQSLALGALDNSFLVGGAGIQVVKNFRHGLHGKGASVKISGGRGGSGSAYSTPKKALLMRGETNMLLMSPGEALHSNGVHHVDVETGKVVAEWRFEKDGADITMRDIANDSKGAQLEPSGSTFLGLDDNRLCRWDMRDARGRVQTIGSSSDSPVLNWSQGHQFSRGTNFQCFASTGDGSIVVGSVDGKIRLYSKSSMRMAKTAFPGLGSPITHVDVTYDGKWILGTTDTYLILICTIFKDKDGKEKTGFSGRMGNRIAAPRLLKLTPLDSVLAGTDNKFHGGQFSWVTENGKQEKHLVATVGKFSVIWNFQQVKDSNHECYRDQQGLKSCYCYKVVLKDESIVDSRFMHEKFATSDSPEAPLVVATPMKVSSFSIANRR

SEQ ID NO: 64157 - protein, 667 aa, Bacillus licheniformis ATCC 14580
MKTIELKSVATIRTLSIDAIEKAKSGHPGMPMGTAPMAYALWTKMMNVSPENPNWFNRDRFVLSAGHGSMLLYSMLHLSGYDVSIEDLKNFRQWGSKTPGHPEFGHTPGVDATTGPLGQGIGMAVGMALAERHLAETYNRDDYRVVDHYTYSICGDGDLMEGISSEAASLAGHLNLGRLIVLYDSNDISLDGELNRSFSENVKQRFEAMNWEVLYVEDGNNIAEITAAIEKAKQNEKQPTLIEVKTTIGFGSPNRAGTSGVHGAPLGSEEAKLTKEAYEWTYEEDFYVPSEVYEHFNETVKEAGKKKEAEWNELFSAYKKAHPELAEELELAIKGELPEGWDQKVPVYEKGSSLASRASSGEVLNGIAQQVPFFFGGSADLAGSNKTTIKNGGDVSAKDYAGRNIWFGVREFAMGAALNGMALHGGLRVFGGTFFVFSDYLRPAIRLAALMGLPVTYVFTHDSIAVGEDGPTHEPIEQLASLRALPNLSVIRPADGNETAAAWKLALQSKDQPTALVLTRQNLPTIDQSAETAYEGVKKGAYVVSKSQNEKPEAILLASGSEVGLALDAQSELQKEGIDVSVVSVPSWDRFDKQPAEYKNAVLPTDVTKRLAIEMGSPLGWERYTGTDGDILGIDQFGASAPGETIMKEYGFTPANVVDRVKKLLNR

SEQ ID NO: 64158 - protein, 251 aa, Xanthomonas campestris pv. vesicatoria str. 85-10
MRRKIVAGNWKLHGSRAFATELVAKVAAHMPLEGVEVVILPPLPYLGDLIEDFEAHHLSFGAQDVSSNEKGAYTGEVSASMLVDVGAGYGLVGHSERRQYHHESSELVARKFAAAIHAGLIPVLCVGESLEQREAGQTEAILRAQLDPVLALVGSAGFAGAVLAYEPIWAIGTGRTATPEQAQAVHAFLRGEVAKADARIADSLPILYGGSVKPDNAGELFAQPDVDGGLVGGASLVAEDFLAIARAAAAC

SEQ ID NO: 64159 - protein, 471 aa, Exiguobacterium sibiricum 255-15
MIEQNVINGVWYDTEETIPVFNPATKELLGHVPSSTADDAQRAVDAASTAFVDWSERTADDRADKIDAWYRLIQEHRDELADIMTREQGKPFIEARGEIDYGNQYVRWYAEEARRIYGETIPASVPGKRLFVEKEPVGVVAAITPWNFPAAMITRKLAPALAAGCTVVLKPSEETPYTALRLVELAIEAGIPAGAINVLTGDAATISGVWQADSRVRKITFTGSTAVGKLIMRQAADTMKKLSLELGGHAPFIVTENADLDKAVQGAIRSKFRNGGQACVATNRFYVQASVLDTFTEKFVAEVKRLKVGNGLDADSTIGPLINAKAVAKVKAHIDDAVAKGATILTGGTIDDSVGYFVEPTVLGNVTEDMICMQEETFGPLAPISVFETLDEVIERANNTPYGLAAYAFSEKIDEALRLGKKLEYGIVGLNDGAPSAAQAPFGGYKESGLGREGGVYGIEDYLEVKYLSLG

SEQ ID NO: 64160 - protein, 449 aa, Oryza sativa
NPSRERLRVGWGWGRARLSGGAMKLTVKTLKGTQFEIRVQPNDTVSLGDDNSIQNQYLKPWVQQGFRYLFLVCYVFYNYSKNGSATYITVPGFFCLYTMEQIMAVKKIIEEIQGKDSYPWGQQLLIHNGKVLKDESTLEENKVSEVGFLVVMLSKSKASGSSGALSSLTSSTPLTRQETPADASRAAPQPLVAPTRTPQPERPPAEAPSNAYGQAASNLLSGSNLDTTINQLMEMGGGSWDRDKVQRALRAAYNNPERAVEYLYSGIPITAEVAVPAGGQGANTTEPSSTREASLSGIPNASPLNLFPQQGDANDGGGAGGGTLEFLRHNQQFQALREMVHTNPQILQPMLQELSKKNPQLLRLIQENHDEFLQLINEPFDGADGDFLDQPDQDEMPHSINVTPEEQEAIGRLEGMGFDRARVIEAFFACDRNEQLAANYLLEHAADED

SEQ ID NO: 64161 - protein, 170 aa, Mycobacterium smegmatis str. MC2 155
MATPIVVMGVSGSGKSTVGAALAQRLRVPFADADDFHPPANIEKMSAGHALDDDDRYPWLEAIGKWLAEHPAGGVMSCSALKRTYRDQLRQHCPDIEFLHLEGSMETIGRRQASRPGHFMPASLLESQFKTLEPLAPDECGVAIDVDQSIDDIIESYVSATQSHTPEEDR

SEQ ID NO: 64162 - protein, 473 aa, Burkholderia sp. 383
MQPSNQSDLKCGLKQRHMTMIALGGVIGAGLFVGSGVVIQQTGPAAILSFLITGGLVVLVMRMLGEMACAMPAVGSFYEYARLAFGNWRGPGKMAGFLTGWMYWYFWVIVVALEAVAGAKLIQFWLPDTPAWIISLALLVVLTLTNLISVGSYGEFEFWFSSIKVGAIIVFLFLGGLYVLGLWPASMHTTSVLPTLLGHGGFMPLGIGPVMSGAVAATGFYFGAEIVTIAAAEAKEPAKAVAKATNSVITRVLVFYVGSVALVVALVPWNSHQMATPYVSALEVMGLPAAANVMNAIVLTAVLSALNSGLYAASRMLFALTRHGDAPAALAKVNKRGVPVRAILLGTVFGYVSVVMSYVSPDTVFAFLVNSYGTVALFVYVLIAFSQLRLRKRLDPVAASKLRVKMWAYPYLTWVAIIGMVGILVAMAFIPDQRKPLWLGVASLGVLVVAYGLTRRSRREHLDDSELLAYPPR

SEQ ID NO: 64163 - protein, 235 aa, Nepenthes lavicola
  misc_feature (39)..(39): Xaa can be any naturally occurring amino acid
LIVWVQENLGWALGFGIPAISMGIAIASFFSGTALYRLXKPGGSPLTRMCQVLVASFRKSKLALPEDSNLLYETSDENSVIEGSRKLEHTNELKCLDKAAVVSDKEIKYEDFSNPWRLCTVTQIEELKILIRMFPIWATGIVFSAIYAQMSTMFVEQGEVMDRTIGSFTIPAASLSMFDTISVIFWVPVYDKILVPLARKFTGKQRGFSELQRMGIGLFISILSMAAAALVEMKR

SEQ ID NO: 64164 - protein, 230 aa, Coxiella burnetii RSA 493
MPLPEGANVIVVYRNSKKKAIEVSELIKSQYKVKSAAIKADVSLLKDIAELISSAEKFFGSIDILVNNAGVGSRAAFTDVTEEQFNQAINVNLKGPFFLTQAVAKHMIAHSKTGSIINISSISSFKAELNISAYECAKAGESMLTKSAALALAPHHIRVNTISPGLTATDMTQPINDPLARPLSERAQPIPLGRVGQPKDHAGAAIFLASDESSWITGSNIIVDGGESIK

SEQ ID NO: 64165 - protein, 255 aa, Exiguobacterium sibiricum 255-15
MYLPSFQLDQKTVLVTGAGRGIGRALAIGMAEAGADVLLVARTESDLQETAKQIEQLGRRAFVLTCDVTDRTQVQATVDRAYTYVDRIDVLVNNAGMNIRSKALDVTEDEWETIQQTNLKSAFLFSQEIGRRMQDTGGSILNIASVAGHVALRTGVVYATTKAALIQMTKVLALEWGPKNIRVNAIGPWYFKTPLTEPLLADPAYLQDIVDVTPLGRVGELTELVGPAVFLASDAGTYVTGQTLFVDGGMTIKGF

SEQ ID NO: 64166 - protein, 312 aa, Xanthomonas campestris pv. vesicatoria str. 85-10
MSARIPTLDITRFDTDRDAFVAELGAAYRQWGFAGIRNHGIAQADIDAAYDVFKAFFALPEATKRRYHVEGSGGARGYTAFGVETAKDSKHFDLKEFWHIGREIPDDSPYRAVMPPNLWPSEVPGFRERGYQLYQQLDQLGSRVLSALALHIGLPQDYFVDKTNNGNSILRPIHYPPITSDDIPNVRAGAHGDINFITLLVGASAAGLEVRSHDGEWVPFTADADTIVVNIGDMLQRLTNHVYPSTIHRVVNPPGEQARQPRYSVPFFLHPNPDFLIDVLPSCISADNPSRYPEPITAHGFLEERLREIKLK

SEQ ID NO: 64167 - protein, 235 aa, Nepenthes adnata
  misc_feature (138)..(138): Xaa can be any naturally occurring amino acid
  misc_feature (220)..(220): Xaa can be any naturally occurring amino acid
LIVWVQENLGWALGFGIPAISMGIAIASFFSGTALYRLQKPGGSPLTRMCQVLVASFRKSKLALPEDSNLLYETSDQNSVIEGSRKLEHTNELKCLDKAAVVSDKEIKCEDFSNPWRLCTVTQIEELKILIRMFPIWXTGIVFSAIYAQISTMFVEQGEVMDRTIGSFTIPAASLSMFDTISVIFWVPVYDKILVPLARKFTGKQRGFSELQRMGIGLFXSILSMAAAALVEMKR

SEQ ID NO: 64168 - protein, 74 aa, Oryza sativa
  misc_feature (10)..(10): Xaa can be any naturally occurring amino acid
  misc_feature (22)..(22): Xaa can be any naturally occurring amino acid
  misc_feature (63)..(63): Xaa can be any naturally occurring amino acid
MCNHPVLIHXCKRGKHRTGCVXGCLRKLQRWCLTSIFDEYQRFAAAKARVSDLRFMELFDISXSLKHLPASFSC

SEQ ID NO: 64169 - protein, 344 aa, Synechococcus sp. RS9917
MAPTTFLAGDLGGTKTLLSLFSTVEGQLQALHGHRYASAEWPSLDAMLVHFLEEMPADLARPATSCIAVAGPVQQGQAKLTNLPWLVQETSLCAATGLERLELVNDFAVLIHGLPHFSANQQVMLQEGQASQGPVAILGAGTGLGMARGLPGPEGWIALPSEGGHREFAPRTEAEWELSRWLMADLELDRLSVERIVSGTGLGHVMHWLLQRQGNEDHPLQAQARAWRTIGADQPGHEDLPAHTGRAAAAGDPLAQDALTLWLGAYGSAAGDLALQELCRGGLWVGGGTAEKNLEGLRSERFLEPLRRKGRFRSFLESLPIRAVIDPNAGLFSAACRARDLQGD

SEQ ID NO: 64170 - protein, 453 aa, Streptomyces coelicolor A3(2)
MDKQQEFVIRTLEERDIRFVRLWFTDVLGFLKSVAVAPAELEQAFDEGIGFDGSAIEGFARVYESDMIAKPDPSTFQVLPWRAEAPGTARMFCDILMPDGSPSFADPRYVLKRALARTSDLGFTFYTHPEIEFFLLKDKPVDGSVPTPADNSGYFDHTPQNIGMDFRRQAITMLESMGISVEFSHHEGAPGQQEIDLRYADALSTADNVMTFRLVMKQVALEQGLQATFMPKPFSEYPGSGMHTHLSLFEGDRNAFYESGAEYQLSKVGRSFIAGLLRHAAEISAVTNQWVNSYKRIWGGTERTAGAGGEAPSYICWGHNNRSALVRVPMYKPGKTGSARVEVRSIDSGANPYLTYAVLLAAGLKGIEEGYELPPGAEDDVWALSDAERRALGIEPLPQNLGEALALMERSDLVAETLGEHVFDFFLRNKRQEWEEYRSQVTAFELRKSLPVL

SEQ ID NO: 64171 - protein, 137 aa, Prosthecochloris aestuarii DSM 271
MSENQDLQKSFLETVKFDDKGLVPAIVQDFETGKVLMMAWMNRQSLEMTLEKKKACYWSRSRQKLWLKGESSGNMQNVHDILIDCDGDTLLLKVSQTGGACHMGYQSCFYRKTKDDLSMEICDTLMFNPEDVYGKQS

SEQ ID NO: 64172 - protein, 309 aa, Salmonella typhimurium LT2
MKTAGNLIVLGSINADHILNLESFPTPGETVTGSHYQVAFGGKGANQAVAAGRSGANIAFIACTGDDDIGDSIRKQLVSDRIDIAPVSVIKGESTGVALIFVNGEGENVIGIHAGANAALSPALVDAQRERIAQADALLMQLESPLESVLAAAKIAHQHHTTVALNPAPARELPDELLALVDIITPNETEAEKLTGVRVENDDDAAKAAQVLHDKGIRTVLITLGSRGVWASVDGEGRRVPGFSVEAVDTIAAGDTFNGAFITAILEETPLPEAIRFAHAAAAIAVTRKGAQPSVPWREEIEAFLHQQG

SEQ ID NO: 64173 - protein, 500 aa, Bordetella parapertussis 12822
MYPSLPDRLLPGLPAPLGATSDGLGVNFAVFSANAARIELCLFDARGRKELARLPMPECTDEVWHGYLPDAQPGLVYGYRAHGPYNPRAGHRFNPHKLLLDPYATALTGALRWSDALFGYRMQHPRADLSMDRRDSAAGVPKAVVTEPAFHWGATRRPAAAWAHTVIYEAHVRGVSMLRSDLREPIRGTCAALADPRFIDHLHRLGVTALELMPVHAFLQDRTLVERGLRNYWGYNTLAYFAPEPAYLADGQPHDLRRAIRRLHAAGIEVILDVVYNHTCEGNELGPTLSWRGLDNASYYRLVPGDERRYIDDTGTGNTLNLSHPRVLQMVMDSLRYWAVHYRVDGFRFDLGVTLGREGTGFDAGSGFFDALLQDPVLARVKLISEPWDVGPDGYQLGRHPPGMAEWNDQFRDTARRFWRGDPGMAGALATRLTASRDVFDHRHRRPWSSINFAAAHDGFTLQDVVSFAERHNEANGEDGADGHGENYSSNWGVEGAASS

SEQ ID NO: 64174 - protein, 702 aa, delta proteobacterium MLMS-1
MKTRKKTFRSGAGSPLPLGVSRTPAGYNFAIAARHAEAVSLVLYPPSRAEPVAELAFDPHLNRSGDVWHLLLADFEPTLRYGFRLRGPCRSAAAGYCYRDELVMLDPYAKALTGGSDWGKAYRRPGRSDPLASFQRRCLYLEDDFDWEGDRPLNIPLSETIIYELHVRGFTRHPSSAVEHPGTYRGIIEKIPYFKELGVTAIELLPVAEFNELENTRVNPFTGEQLKNFWGYSPLAFFAPKAAYAVNGRDGNQVREFKEMVKALHAAGLEVILDVVFNHTAEGGADGPVISFKGIDNPIYYLLDPATREYLNFSGCGNTVNCNHPWVRELIVDCLRYWVTEMHVDGFRFDLASIFGRGARGEILAEPPMVEKIAEDPVLAKTKIIAEAWDAAGLYQVGSFSPHQRWAEWNGRFRDDVRRFLCGHDDTVAALATRLAGSSDLYGQNGRRPFNSINFITSHDGFTLHDLVSYNHKHNEANGEDNRDGDNHNISWNSGVEGESDEPAILALRARRLRTAAVILLLSQGVPMLCAGDEFGRSQRGNNNAYCQDNEISWLDWRLVEQNAGLLRFFRLLISLRRRHPLFRRDHFFSTAPSARQPEISWQALEPGRQDWSAGCRVLAFRLHGRAGGSGQRRDRDFFVMLNSDAQPQRFTLPKPPARRPWRLLIDTAAASPRDIYQDEKAPKVGGGRQEVAPHGAVVLIA

SEQ ID NO: 64175 - protein, 472 aa, Halobacterium sp. NRC-1
MAAVDRNAAALGVPRAQLMESSGHAVGRAVKRVADPGASVAIVAGRGNNGGDAFAAARFLDDYAVSVSLLGRPESINDRISRANWDALQAGGYDTTTVRDAHALALDDPDVVVDALLGTGISGPPREPEATAIERINATDAPTVAVDVPSGLDADTGATPGSAVDADRVVTFHDTTPGLADHDHVTVADIGIPEAAETVVGPGDLLGVDRDPHGHKGDAGSVLVIGGGPYTGAPALCAQAALRAGADLVRLAVPDAVAAEVQGFDETFIVDSVVGTRLVEEHVPDLLARAEDADAVVIGPGLGDADTTQAAVAAFLAAFEGRAVVDADALTAVPDVETDATLVCTPHRGELQAMGGPTVDGSQPSRDAVEGFAAELGQTLLVTGARDVLSDGDTTRVNRSGTPGMTVGGTGDVLAGTAAAMLATQPPIQAASAAAYATGGAGERAAEARGHGLLATDICDALPAAIWGGQDA

SEQ ID NO: 64176 - protein, 277 aa, Bradyrhizobium sp. BTAi1
MSDVSKLIATQPPAAASAPPEIVPAPASLVPHLGEVAILLDIDGTLLDLAPTPREVWVPPGLAETLNSLLQRTAGALALVSGRSLNDIDLIFAPEIYPAVGGHGAEMRLGSGNEADAVQAPPMDKELKRRLAAIAKLSPGILLEDKGYSLALHYRLAPQAEAAIYEEVSRIRAELPGAPIEVLPGKCVCEIKHAGFTKATGVRELMRRAPFEGRKPFFIGDDVTDESVFAIMPDFAGLSFSVGRRALGVDGHFDSPDDVRAFLARLAQREGQSAASR

SEQ ID NO: 64177 - protein, 235 aa, Nepenthes hamata
  misc_feature (3)..(4): Xaa can be any naturally occurring amino acid
  misc_feature (6)..(7): Xaa can be any naturally occurring amino acid
  misc_feature (10)..(11): Xaa can be any naturally occurring amino acid
  misc_feature (15)..(17): Xaa can be any naturally occurring amino acid
  misc_feature (19)..(20): Xaa can be any naturally occurring amino acid
  misc_feature (22)..(24): Xaa can be any naturally occurring amino acid
  misc_feature (26)..(26): Xaa can be any naturally occurring amino acid
  misc_feature (28)..(31): Xaa can be any naturally occurring amino acid
  misc_feature (33)..(34): Xaa can be any naturally occurring amino acid
  misc_feature (37)..(39): Xaa can be any naturally occurring amino acid
  misc_feature (47)..(48): Xaa can be any naturally occurring amino acid
  misc_feature (55)..(55): Xaa can be any naturally occurring amino acid
  misc_feature (58)..(58): Xaa can be any naturally occurring amino acid
  misc_feature (69)..(69): Xaa can be any naturally occurring amino acid
LIXXVXXNLXXALGXXXPXXSXXXAXAXXXXGXXLYXXXRPGGSPLXXMCQVLVXSFXKSKLALPEDSXLLYETSDKNSAIEGSRKLEHTDELRCLDKAAVVSDKEIKCEDFSNPWRLCTVTQIEELKILIRMFPIWATGIVFSAIYAQMSTMFVEQGEVMDRTIGSFTIPAASLSMFDTISVIFWVPVYDKILVPLARKFTGKQRGFSELQRMGIGLFISILSMAAAALVEMKR

SEQ ID NO: 64178 - protein, 235 aa, Nepenthes glabrata
  misc_feature (138)..(138): Xaa can be any naturally occurring amino acid
LIVWVQENLGWALGFGIPAISMGIAIASFFSGTTLYRLQRPGGSPLTRMCQVLVASFRKSKLALPEDSSLLYETSDKNSAIEGSRKLEHTDELRCLDKAAVVSDKEIKCEDFSNPWRLCTVTQIEELKILIRMFPIWXTGIVFSAIYAQMSTMFVEQGEVMDRTIGSFTIPAASLSMFDTISVIFWVPVYDKILVPLARKFTGKQRGFSELQRMGIGLFISILSMAAAALVEMKR

SEQ ID NO: 64179 - protein, 86 aa, Glycine max
MASSMISSPAVTTVNRAGAGMVAPFTGLKSMAGFPTRNTNSDITCVASNGGRVRWVRVWPPIGEREWESVCSLPNVPDRAVRGDVQ

SEQ ID NO: 64180 - protein, 235 aa, Nepenthes albomarginata
  misc_feature (208)..(208): Xaa can be any naturally occurring amino acid
LIVWVQENLGWALGFGIPAISMGIAIASFFSGTALYRLQKPGGSPLTRMCQVLVASFRKSKLALPEDSNLLYETSDENSVIEGSRKLEHTNELKCLDKAAVVSDKEIKREDFSNPWRLCTVTQIEELKILIRMFPIWATGIVFSAIYAQMSTMFVEQGEVMDRTIGSFTIPAASLSMFDTISVIFWVPVYDKILVPLARKFTGKQRGXSELQRMGIGLFISILSMAAAGLVEMKR

SEQ ID NO: 64181 - protein, 115 aa, Mycobacterium smegmatis str. MC2 155
MSLDPAIAARLKRNADGLFAAVTQERGTGKVLMVAWMDDDALARTLQTREATYFSRSRGEQWVKGATSGHTQKVHSVRLDCDGDTVLLEVDQVGGACHTGDHTCFDADLLLGPDE

SEQ ID NO: 64182 - protein, 427 aa, Xanthobacter autotrophicus Py2
MTAIVDIIGREILDSRGNPTVEVDVVLEDGALGRAAVPSGASTGAHEAVELRDGDASRYLGKGVGMAVDAVNGEIFDAIGGYEAEDQAHIDAALLALDGTPNKGRLGANAILGVSLAVAKAAAESKGLPLYRYVGGVNARVLPVPMMNIINGGAHADNPIDFQEFMILPAGAPSFAEGLRWGAEIFHTLKKGLKDAGHNTNVGDEGGFAPNLASAEAALEFVLKAIEKAGFKPGEDVYLGLDCASTEFFKNGVYNYEGEGTVRDIEAQVAYLAELVAKYPIVTIEDGMAEDDWVGWKLLTDTVGSKCQLVGDDLFVTNVERLSRGIKDGVGNSILVKVNQIGSLTETLDAVEMAHKAGYRAVMSHRSGETEDATIADLAVATNCGQIKTGSLARSDRTAKYNQLLRIEQELGDSARYAGKAALKALA

SEQ ID NO: 64183 - protein, 327 aa, Zea mays
  misc_feature (48)..(48): Xaa can be any naturally occurring amino acid
  misc_feature (89)..(89): Xaa can be any naturally occurring amino acid
GHCEGYNTLSLRVAQIPINTKTPIAVLNPKLVKEYELNPIVLEFRRVXKGARGTHLAKWHCSKVFVKILDKDSFSDAESINASTHAFTXLEKARHPNLVQFVGAVTQNVPMMIVSEYHQKGDLASYIEMKGRLKPHKAIRFALDIARGLNYLHECKPEPIIHGNLSPKNIIRDDEGQLKVAGFGSLSLSKVSEDKVQMAQPVTKFDNVYIAPEVYKNEPFDRSVDVFAFGLILYEMIEGAPAFHPKPQEEAAKMICLEGLRPPFKNKPKYYPSDVKELIQECWDPMPSVRPTFAEIIVRLNKIHASCAKQGSWRDTFKLPWKQTGER

SEQ ID NO: 64184 - protein, 303 aa, Pseudomonas syringae pv. phaseolicola 1448A
MPTSPVEPNVESVQYDELNCWRIRHGEAELLVAQQGAHILSYQVAGQQPLVWLNEEAVFKQGKPIRAGMPICWPWFGNLERNPQSVQAMRDSSEPAKAHGEVRALDWQLLGIGADGDALLVEFVLPEAEGHLPGWPHNVALKLSIRLDHALNVSLVSYNCGTESVVISQALHTYFAVSDVRQVSVEGLDGLRYIETLANWEEREQAGDLTFTGETDRIYKDTPGVLSIVDPQWQRRIHIRSTGSKSAILWNPWIEKTGKFTDMAADGWQRMVCVETANVLDDVVTLAPDQMHVLGVSIWSEAL

SEQ ID NO: 64185 - protein, 550 aa, Candida albicans SC5314
MSLDNSTENRDLEEKEEIPKNEHNEQGEQNENNEHIPTLEDKPLKEYIGISILCFLIAFGGFVFGFDTGTISGFINMTDFLERFGGTKADGTLYFSNVRTGLLIGLFNVGCAIGALFLSKVGDMYGRRVGIMTAMIIYIVGIIVQIASQHAWYQIMIGRIITGLAVGMLSVLCPLFISEVSPKHLRGTLVYCFQLMITLGIFLGYCTSYGTKKYSDSRQWRIPLGLCFAWALCLLGGMVRMPESPRYLVGKDRIDDAKISLAKTNKVSPEDPALYRELQLIQAGVERERLAGKASWGALITGKPRILERVIVGGMLQSLQQLTGDNYFFYYSTTIFKSVGLNDSFETSIILGVINFASTFVGIYAIERLGRRLCLLTGSVAMSICFLIYSLIGTQHLYIDQPGGPTRKPDGNAMIFITALYVFFFASTWAGGVYSIVSELYPLKVRSKAMGFANACNWLWGFLISFFTSFITDAIHFYYGFVFMGCLVFSIFFVYFMIYETKGLTLEEIDELYSTKVVPWKSAGWVPPSDEEMVRAKGYTGDIHADEEQV

SEQ ID NO: 64186 - protein, 548 aa, Arabidopsis thaliana
MANSDSGDKEAHRSSKHGGWITLPFMLVTLLGMSITYFGWVMNLIVFLIEEFNIKSIAAVQISNIVNGVVNMLPVVAAILADSFFGNIPVISASAFISLTGISLLTLIASLDYLRPRPCETGSILCQSPSKLQLGILYAALALVITGTAGTRFILASAGANQYKKPKEQGRFFNWYFFTLYGGAITGTTAIVYAQDNASWKLGFGLCVAANLISFIIFVAGKRLYEHDQPLGSPYTSLVRVLVAATMKRKAVISYKDEDYHHRELEKETKTYVAMPSKSFRFLNRAALKTEGDSNNNMWRLCSVQEVEDFKAVLRLVPLWTSVMFLSAPLAVQMSMTVLQAMVMDRKLGPHFKVSAGSMQVIALVSGCVFIILNNWTTYPMYQKLIRKPLTPLQKVGIGHVLTILSMAISAVVEAKRLKTVENSHLMSVLWLVPALVINGIGEAFHFPANIAIFYGEFPESLRNTATSLTSVVMGISFYLSTALIDVIQRTTKWLPNDINHGRVDNVYLVLVIIGVSNFGYFLVCSWFYKYRNLKNDDHEQDLKDVTN

SEQ ID NO: 64187 - protein, 366 aa, Mesorhizobium loti MAFF303099
MPACSIGWVFRTEISSNIRKALGKELDMPRIVPVLDLSRLEQGASERRTFLADLRSASRDIGFFYLAGHGISWAEISEVLTASRQFFALPEADKLAIEMVKSSQFRGYTRAGGELTKGREDWREQLDIGVERQAIAQGPGTPAWTRLQGPNQWPAALPDLKPALLAWQSKVTAVAIRLLKAFAQSLDQPEDAFDPIYSSEPNHRMKIVRYPGRDTTGGDQGVGAHKDGGFLTLLLQDDNKGLQVDYDGSWVDVDPIPGTLVVNIGELLELASNGYLRATVHRVVTPPAGVERISVPFFFSARLDATIPLLGLSEELAAQARGPASDPDNPLFRDVGTNVLKSRLRSHPDVARRHYADLLKGESRVG

SEQ ID NO: 64188 - protein, 540 aa, Candida albicans SC5314
MSSTNSTENHAVEEKYEDPQQQQQQKDALAKKPMSAYIGISIMCVLIAFGGFVFGFDTGTISGFINMSDFLERFGGTRADGTLYFSNVRTGLLIGLFNVGCAIGALFLSKMGDMYGRRVGIMGAMVIYIVGIIVQIASQHAWYQVMIGRIITGLAVGMLSVLCPLFISEVSPKHLRGTLVCCFQLMITLGIFLGYCTTYGTKTYSDSRQWRIPLGLCFAWALCLLGGMVRMPESPRYLVGNDRIEDAKISLAKTNKVSPEDPALYRELQLIQAGVERERLAGSASWKSLITGKPRILERVFVGAMLQSLQQLTGDNYFFYYSTTIFKSVGLNDSFQTSIIIGVINFASTFVGIYAIEKLGRRHCLLIGSVAMSICFLIYSLIGTQHLYIDKPGGASRKPDGDAMIFITALYVFFFASTWAGGVYSIMSELYPLKVRSKAMGIASASNWLWGFLISFFTSFITDAIHFYYGFVFMGCLVFSIFFVYFMVYETKGLTLEEIDELYSTKVVPWKSAGWVPPSEEEMATSTGYAGDAKPTEEHV

SEQ ID NO: 64189 - protein, 497 aa, Candida albicans SC5314
MSQDNVSSTSTAEAVNNEIKVKDEFPQEEQAHTSLEDKPVSAYIGIIIMCFLIAFGGFVFGFDTGTISGFINMSDFLERFGGTKADGTLYFSNVRTGLMIGLFNAGCAIGALFLSKVGDMYGRRVGIMTAMIVYIVGIIVQIASQHAWYQVMIGRIITGLAVGMLSVLCPLFISEVSPKHLRGTLVCCFQLMITLGIFLGYCTTYGTKSYSDSRQWRIPLGLCFAWALCLVAGMVRMPESPRYLVGKDRIEDAKMSLAKTNKVSPEDPALYRELQLIQAGVERERLAGKASWGTLFNGKPRIFERVIVGVMLQALQQLTGDNYFFYYSTTIFKSVGMNDSFETSIIIGVINFASTFVGIYAIERMGRRLCLLTGSVAMSICFLIYSLVGTQHLYIDKPGGASRKPDGDAMIFMTSLYVFFFASTWAGGVYSIISELYPLKVRSKAMGLANASNWTWGFLISFFTSFITDAIHFYYGFVFMGCLVFSNFLCLLYGLRN

SEQ ID NO: 64190 - protein, 645 aa, Ustilago maydis 521
MDLVAARTAGSARIGSSRHVVTASSMQYRAQPFVKLAIVALTALVHLIAPVLSAPFSFATPYLSTASDASGASHPHHDGDDPVSDDPLKLTIDILTIAALVVLGGIFAGLTLGLMGLDMVNLQVLASSGSDKERKHATKVLKLLEKGRHWVLVVLLLGNVIVNETLPVFLSDFGGGLAAVLSSTLLIVIFGEIVPQSICARYGLAIGAFCAPMVHATMLILAPIAWPTAKFLDWCLGEEHGTTYRKAELKTFVSLHQQIGTEHLHEDEVTIIRAVLELNDKTVRDVMTPIEDVYIMSSDTILDEEGVAKLVRSGYSRVPVHEPGKKDAIVGMLLVKNLIQYDPEDALAVSSFHLTPLPEASCDLTLLDCLNYFQQGRSHMILVSTHPGESRGALGVVTLEDVIEEMIGEEIVDETDIYVDVHNKIKVVRNRQAANSAGQNWQPLIRGIIERRRKLGGPMKAPLRSSYGTIGIMDNDLGARNDAKYGLPNSKVRAVDKVAIKRPGSPNSFASISRKASGSYEPNTPMRRESTSSVATSVDGLNYQDLHRAALSNQTSGSVQNSYSEPFIVEVGSQDRTPHIVRISDIQEYPGAEERARKEDERHQHQSANDIRNGDFINDDAAENDESGERRPLLDGIKRVSGRSN

SEQ ID NO: 64191 - protein, 127 aa, Erythrobacter sp. NAP1
MPIDPTLPYDDDNIFAKILRGEIPSNKVYEDEWAFAFEDINPQAEIHTLVIPKGKYVSWDDFSAKASADEIAGFIRAVGEVARMKGLVEPGYRLMANIGAHGGQEVPHLHVHIFGGQPLGPMIWKKG

SEQ ID NO: 64192 - protein, 235 aa, Nepenthes boschiana
  misc_feature (7)..(7): Xaa can be any naturally occurring amino acid
  misc_feature (77)..(77): Xaa can be any naturally occurring amino acid
  misc_feature (109)..(109): Xaa can be any naturally occurring amino acid
  misc_feature (185)..(185): Xaa can be any naturally occurring amino acid
  misc_feature (208)..(208): Xaa can be any naturally occurring amino acid
  misc_feature (220)..(220): Xaa can be any naturally occurring amino acid
LIVWVQXNLGWALGFGIPAISMGIAIASFFSGTALYRLQKPGGSPLTRMCQVLVASFRKSKLALPEDSNLLYETSDXNSVIEGSRKLEHTNELKCLDKAAVVSDKEIKXEDFSNPWRLCTVTQIEELKILIRMFPIWATGIVFSAIYAQMSTMFVEQGEVMDRTIGSFTIPAASLSMFDTISVIXWVPVYDKILVPLARKFTGKQRGXSELQRMGIGLFXSILSMAAAALVEMKR

SEQ ID NO: 64193 - protein, 636 aa, Vibrio cholerae
MCGVAGFISKRLSPVDCLTSMVGSIMHRGPNDSGLWVDDDFGVCLAHARLSIQDLSSAGHQPMHSKSERYVMIFNGEIYNHLTLREELIEIVPSYWNGHSDTETLLAGFEVWGIEQTIQKCVGMFAIVLWDKVLKQLILIRDRFGEKPLYYGWQRDTFLFASELKALKAHPSFEGSINRQALSHFFRLNYIPTPLSIYEGIFKLEPGVIAVFSHEGQLLSKQTFWDASHAVSLQNFSDHDAVDKLDDLIKQSIQDQALSDVPLGAFLSGGVDSSTVVGILQSLSTRPVKTFTIGFDHADFNEASEASDVAKHLGTDHVELIVSAEDALAIINQLPVMYDEPFADASQVPTFLVSKLAKKEVTVCLSGDGGDELFCGYNRYHYTAKVWSYLEKIPFPIRKMLSVFLLTLSPSSWDVLSKTLGLNTRLPNLGNKIQKGAQALKARDIEDLYTRVVSNWDLDEPLVKNTAVEKLPFLSDLTELSHLNDLEKMMLWDKQSYLMDDVLVKTDRATMACSLEGRVPLLDHRIAEFAASLPIHLKYRGGKGKWLLREVLYRYVPKKLIERPKKGFSLPIAEWLRGPLKDWANVLLDSDRIDKEGFLSSELVQKKWREHLAGKRDWSSQLWSVLMFQLWLEKNK

SEQ ID NO: 64194 - protein, 235 aa, Nepenthes burbidgeae
  misc_feature (39)..(39): Xaa can be any naturally occurring amino acid
  misc_feature (138)..(138): Xaa can be any naturally occurring amino acid
  misc_feature (211)..(211): Xaa can be any naturally occurring amino acid
LIVWVQENLGWALGFGIPAISMGIAIASFFSGTALYRLXKPGGSPLTRMCQVLVASFRKSKLALPEDSNLLYETSDENSVIEGSRKLEHTNELKCLDKAAVVSDKEIKREDFSNPWRLCTVTQIEELKILIRMFPIWXTGIVFSAIYAQMSTMFVEQGEVMDRTIGSFTIPAASLSMFDTISVIFWVPVYDKILVPLARKFTGKQRGFSEXQRMGIGLFIAILSMAAAALVEMKR

SEQ ID NO: 64195 - protein, 519 aa, Coxiella burnetii RSA 493
MTQADNQNPKPMVLIILDGFGESDETTHNAIKEANTPTLDKLFRHYPHTLLEASGRAVGLPDGQMGNSEVGHLHIGGGRKVPQDLTRIDAAIASGEFYENPALIEALEKAKALNKAVHILGLLSPGGVHSRDNQIAALVELAHRCGIKKIYLHAILDGRDTPPKSALLSIEKITDQFHAYGNGKIASLIGRYYAMDRDKRWDRTEKAYDLLTQGTAQFHALTAKEGLMLAYEQGNTDEFVSPTSIHRHNETPITIEDGDVVVFMNFRADRARQLTYAFLDDHFTAFNRQVRPKLSAFVTLTAYAKDIHAAVAFPPLELHNTLGEYLSARGYRQLRIAETEKYAHVTYFLNGGQEAPFNGEDRLLIPSPKVATYDLQPEMSAVEMTNKLVEIIQNDDYDLIVCNFANPDMVGHTGDETATREAIQVIDDCLKRIITALQSVGGEALITADHGNAEKMFDEKTNQPHTAHTSNLVPLIYVGREAQFCKEVGALDDVAPTLLYLMGLEKPREMTGRNLITLK

SEQ ID NO: 64196 - protein, 431 aa, Oryza sativa
MAEASEEDGIDVLPDALLQHILSFLPAEDAVKTCVLSRRWRHLWKLTPILCITNTERWRSPKDFIKLVNHLVLFRGSSPLHKFEIKINSCAHWMIMSGDSNPFHCAIMWVMYALMCQVQVLTIKNMHAYIEMDDGFSLFSRHLTELNLSGLDFRKFVLNFSSCPALEYIYFSASCCFNSVEKILSQSVKYLTFDFPEFSEHHRTHIYAPNLITLRLDDCWGRVPFLESMPSLIAAFVRPHRDSDDLCSNTYSGNCEDEYCHGCYGMVDNAGNDSAKCVLLGGLSEAKKLELIAGPEMRIFRSDLRWCPLFSKLKSLLLNEWCVANNFWALACILEHSPVLLKLTLQISKETKPMIGAVENYSALVKPAAISKHLKVVKVHCKEVDEGVCETVKFLSTLDVVVLIRRMDRSTNLFSFEEGNSSSSHDEGSSR

SEQ ID NO: 64197 - protein, 310 aa, Cryptococcus neoformans var. neoformans B-3501A
MSYLLSVPAGRAFRRENSKWVDPQPEKGLIQMKLEDDLMQLSWKSRETNRVEDELIIFPGEATFEKVSQDPTGRTHILKFSSSNQKYFFWFQRLSREGDLRAQVDINELLQDPSYQPGSADLPAQQLERDWPPTPGAPRLTNPQPAPAANADANADANADANADAGSSSNPETSRKNMARLLAEWARGGALGQPEDDARLTDVLSPSNISALISSDPALISTITPLLPPGLSLPENPTAEDITPILSAPQFTDAIASLDNALRSGGLPGGMMRELGLPESAGSSVKGFLDGLVALGNKEAEDQDDKMEED

SEQ ID NO: 64198 - protein, 479 aa, Cryptococcus neoformans var. neoformans B-3501A
MPPINKAQAEQVGEYDYFVIGGGSGGLASARRAGSYGAKVGLVEVSPRLGGTCVNVGCVPKKIMWYTADVAENLRKSAQYGFGKEGEGYKLAADFNWTELKHKRDAYIHRLNGIYESNLEKDHVDHHQGWASFVDANTVAIEPPNGDKYTVKAKNIVIAVGGRPTVPSEKDIPGASYGITSDEFFELETQPKRVAVIGAGYIAVELAGVFNTLGSETHLVIRHNQLLRTFDPMMSEVLVPCMEKAGMKIHKKTHVKKVEKTSSGSLLVHLDSSSESIEVDCLLWAIGRHADTAKLGLDKAGVKYDKKGDVIVDDYQNTNVPGIYAVGDVGGRMLLTPVAIAAGRRLSNRLFGPEKYKNDKLSYDNIPSVVFSHPTIGSIGLSEPEAREKFGDDNIKIYKTSFRAMSFAMLDEDHKQPTAYKLICTGPDEKVVGLHIIGEGSDEMLQGFGVAIKMGATKEDFDACVAIHPTSSEELVTLR

SEQ ID NO: 64199 - protein, 342 aa, Legionella pneumophila subsp. pneumophila str. Philadelphia 1
MTMKSLVKAKKEPGIWMQDIPVPEYGVNDVLIKIKRTAICGTDIHIYSWDEWAQATIPVPMTVGHEFYGEIVEVGKEVQGLKVGQRVSGEGHITCGFCRNCRAGKRHLCRNTLGVGVNRPGCFAEYLALPATNVIALPDNITEEQAAILDPFGNAAHCALAFDVVGEDVLITGAGPIGIMAAAIVRHIGARHVVITDVNDHRLELARQMGVSRAVNVKYQKLSDVANELGMLEGFDVGLEMSGNPMALNDMMKAMNHGGHVALLGIPPQETPIDWNQVIFKGLVIKGIYGREMFETWYKMIAMLQSGLNISPVITHNFPVDEYQHAFQIMASGQSGKVILNW

SEQ ID NO: 64200 - protein, 346 aa, Arabidopsis thaliana
  misc_feature (104)..(104): Xaa can be any naturally occurring amino acid
VRLDLPWDLVDEILSRLPATSLGRLRFTCKRWNALFKDPEFITKQFHKAAKQDLVLMLSNFGVYSMSTNLKEIPNNIEIAQVFHCNGLLLCSTEEGNKTKLVVXNPCTGQTRWIEPRTDYNYNHDIALGYGNNSTKKSYDSYKILRITYGCKLVEIFELKSNSWRVLSKVHPNVEKHYYGGVSFKGNTYWLSYTKFNILSFDFTTETFRSVPLPFLYQDGFVTLALSVVREEQLLLLRSRFDMGQVGIWMCNKIDTETVLSWSKSFTLEFDSLRDLPVMSILRIFIEEDKKVIVVDCDDRWKENMIYIVGKNGFKKLSYEKDRSNLWRLPFFFSYVPSLVGLYPPM

SEQ ID NO: 64201 - protein, 201 aa, Erythrobacter sp. NAP1
MTDQPRTGKVERKTAETSIEIAVNLDGTGTYDVSTGIGFLDHMVEQFSKHSLIDVTMKVEGDLHVDQHHTTEDSAIALGQALTDALGDKAGIGRYGSAYSPMDETLSRVSLDISGRPYLVWKAQFSQEKLGEWDTELIEHWFHSVAQSAGLTLHCELLYGTNNHHICESLYKGFARAMRIAVERDPRKGGAIPSTKGQLGG

SEQ ID NO: 64202 - protein, 428 aa, Oryza sativa
MGAVLGTGRVGTLTRVALTIVVFLLLLPSHALAAAVAKDTSATLVETLPLPTTLVGPESVAFDKFGDGPYSGVSDGRILRWDGADKGWTTYSHAPGYNVAKCMAPKLHPAELTESKCGRPLGLRFHNTSGNLYIADAYKGLMRVGPRGGEATVLATEADGVPFKFTNGVDVNQVTGEVYFTDSSTRFQRSQHEMVTATGDSTGRLMKYDPTTGYLDVLQSGMTYPNGLAISADRSHLVVALTGPCKLVRHWIEGPKAGTSEPFAELPGYPDNVRPDGKGGYWVALHREKTETPYGSDTHLLAVRIGRKGKILQELRGPKNVRPTEGLTFGPRTNFYLGTGFFPRPQRCRLGAAVGWARGSPAEKRAADAATARRHGSGWVAGEDLGRREEQPPRRGRIPLQLIPSTVEFAREGLYSISCAMWAATGLR

SEQ ID NO: 64203 - protein, 464 aa, Bacillus licheniformis ATCC 14580
MVNEKKISSGFIYFFGAFAGILFGYDIGVMTGALPFLQNDWNLQDNAGVIGWITSSVMLGAIFGGALAGQLSDRLGRRKMILISAIIFVVGSILSGIAPHNGILFLIVSRVLLGLAVGAASALVPAYMSEMAPARLRGRLSGINQTMICSGMLLSYIVDFLLKDLPETMAWRLMLGLAAVPALILYVGMLKLPESPRFLIKNNKLDEARKVLSYIRSNKGEIDSEITQIQETAREEAKANQNASWATLLSNKYRFLLIAGVGVAAFQQFQGANAIFYYIPLIVEKATGNAASSALMWPIIQGVILVLGSLIFLVIADKFNRRTLLTVGGTIMGLSFILPAILNILIPNANPMMMVVFLSIYVALYSFTWAPLTWVIVGEIFPLVIRGRASGLASSFNWIGSFLVGLLFPVMTASMSQEAVFAIFGVICLLGVVFIRTRVPETRGRSLEEIGKNGENKRVDGKSA

SEQ ID NO: 64204 - protein, 353 aa, Candida glabrata CBS 138
MSGRRGKIINPRTRGAVRNVGFRNLISDPFAISSILIGLISWVITLGGCISVQVNEDFPRFTWWGIAFQFLIILMLIGFYIYDLVDYYRNFLTASIGVAFVYSTNSANYLIYGSGNQKAAASAGVVLLSMVNLIWIFYYGGDNASPINRWVDSFSLNGIRPSPFEAAKIKAYRRSSKQTQFRGSSVKLTHSTNNLHSASENLGLDNGFYNNPHTSNYVSSTALTEFENTGPPYPSASDLPTNNNAPLRSPQLGNNTIGDTYITATTNNNTNTTMGDTMGLYADLADESFPYRVKALYSYEADSADAYEMSFEQGEILMVSDIEGRWWKAKKESGETGIIPSNYVTIIDNDTEA

SEQ ID NO: 64205 - protein, 265 aa, marine gamma proteobacterium HTCC2207
MQNKTSLVTGASDGIGLECCKILAAKGYNLILVSRRQAQLDEIAESLKAQYPTITCTVLAADLAAPQAAQELFQQVQEQGLEVDFLINNAGLLQNGFFTQLDLATQESMINVNILALTSLTHLFANNMTSRNGGHILNVASLAAWTPIPNQNVYAATKAYVLSFTQALHDELKASKSGVTVTALCPGYTATKMMDNPAQGGKLLVPSSMLQSPREVAEQGIEACLAGRSTIVTGLANRITVAITRLFSKMALAKIAGRYYRSNMH

SEQ ID NO: 64206 - protein, 551 aa, Lactobacillus plantarum WCFS1
MKDIEIAQQVTPEPITAIAAKAGLTVDQIDQYGSTKAKLKLPLPVKKTQRNLILVTSINPTPAGEGKSTVTIGLGDALTKIGKSTMIALREPSLGPVMGMKGGATGGGYSQVIPMEDINLHFTGDMHALTAANNTLAALIDNHIQQGNQLGIDQRRIQWKRALDINDRALRHTVIGLGGATSGVPREDGFDITVASELMAILCLSENIADLKQRVNRIVIGYTHDRQPVTVADLNVGGAITLLLKDALRPNLVQTLAHTPALVHGGPFANIAHGCNSVLATQAGLNLADYTVTEAGFGADLGGQKFMDINVPAVGQAPNAVVIVATIRALKLHGGVALQDLATENVAALKAGAANLGHHIHAMQRYGVPVVVAINEFTADTDAEIHAVKDYCADLGVDAVLADVWGRGGDGATDLAAAVVDLCAQPSHFQPLSPADADLKTKINDIVTKTYGGANVEYSAKAQRQLRTFAKQGWDHLPVCMAKTQYSLSDDPKRLGAPTGFTINVREFVPKLGAGFIVALTGNVLTMPGLPKHPAALDMDISDDGKISGLF

SEQ ID NO: 64207 - protein, 401 aa, Ustilago maydis 521
MSRVTQSRQQTEANAKILRALVKSADNKVCVDCKKNDPRWASWNLGCFLCIRCSGIHRSMGTHISKVKSIDLDIWTPEQMDSVQKWGNRRCNLYWEAHLKAGHVPADHKIESFIRSKYESRRWAKDGPPPSDPSVLDGGAEAAPSAVAAASTSSLAAARSAASANSASAAKKPVPAIDLLDDPSPSPAPAAPAAPVAPVASTTKQPSAAAATAPTKASVGGGGGIFELDWHEPSASTPATSATTSATTSATTSATTSATTSSSAKDKNDIMSLFAAKPAAASSAPALRVSGNTGFGEFASLASPSIGSAGAGAATGIAGLNSSFGSLDLSSSATRASNSAAFVGTGSNPWSSNTTPSHPPSKNGAGALFDTQDVWGSARTSATLPSKPKDDAFADIWGDFK

SEQ ID NO: 64208 - protein, 429 aa, Staphylococcus aureus subsp. aureus MRSA252
MNFSESERLQQLSNEYILGGVNSPSRSYKAVGGGAPVVMKEGHGAYLYDVDGNKFIDYLQAYGPIITGHAHPHITKAIQEQAAKGVLFGTPTELEIEFSKKLRDAIPSLEKIRFVNSGTEAVMTTIRVARAYTKRNKIIKFAGSYHGHSDLVLVAAGSGPSQLGSPDSAGVPESVAREVITVPFNDINAYKEAIEFWGDEIAAVLVEPIVGNFGMVMPQPGFLEEVNEISHSNGTLVIYDEVITAFRFHYGAAQDLLGVIPDLTAFGKIVGGGLPIGGYGGRQDIMEQVAPLGPAYQAGTMAGNPLSMKAGIALLEVLEQDGVYEKLDSLGQQLEEGLLKLIEKHNITATINRIYGSLTLYFTDEKVTHYDQVEHSDGEAFGKFFKLMLNQGINLAPSKFEAWFLTTEHTEEDIKQTLKAADYAFSQMK

SEQ ID NO: 64209 - protein, 228 aa, Nepenthes stenophylla
  misc_feature (4)..(4): Xaa can be any naturally occurring amino acid
  misc_feature (6)..(6): Xaa can be any naturally occurring amino acid
  misc_feature (8)..(8): Xaa can be any naturally occurring amino acid
  misc_feature (14)..(14): Xaa can be any naturally occurring amino acid
  misc_feature (22)..(22): Xaa can be any naturally occurring amino acid
  misc_feature (30)..(33): Xaa can be any naturally occurring amino acid
  misc_feature (42)..(42): Xaa can be any naturally occurring amino acid
  misc_feature (106)..(106): Xaa can be any naturally occurring amino acid
  misc_feature (113)..(113): Xaa can be any naturally occurring amino acid
  misc_feature (131)..(131): Xaa can be any naturally occurring amino acid
  misc_feature (178)..(178): Xaa can be any naturally occurring amino acid
  misc_feature (181)..(181): Xaa can be any naturally occurring amino acid
  misc_feature (187)..(187): Xaa can be any naturally occurring amino acid
  misc_feature (190)..(190): Xaa can be any naturally occurring amino acid
  misc_feature (194)..(194): Xaa can be any naturally occurring amino acid
  misc_feature (196)..(203): Xaa can be any naturally occurring amino acid
  misc_feature (218)..(218): Xaa can be any naturally occurring amino acid
  misc_feature (220)..(220): Xaa can be any naturally occurring amino acid
  misc_feature (224)..(224): Xaa can be any naturally occurring amino acid
NVGXAXGXGIPAIXMGIAIASXFSGTALYXXXXPGGSPLTRXCQVLVASFRKSKLALPEDSNLLYETSDENSVIEGSRKLEHTNELKCLDKAGVVSDKEIKREDFXNPWRLCXVTQIEELKILIRMFPIWXTGIVFSAIYAQMSTMFVEQGEVMDRTIGSFTIPADSLSMFDTISVIXWVXVYDKIXVPXARKXTXXXXXXXXLQRMGIGLFISILSXAXAALXEMKR

SEQ ID NO: 64210 - protein, 235 aa, Nepenthes thorelii
  misc_feature (7)..(7): Xaa can be any naturally occurring amino acid
  misc_feature (39)..(39): Xaa can be any naturally occurring amino acid
LIVWVQXNLGWALGFGIPAISMGIAIASFFSGTALYRLXKPGGSPLTRMCQVLVASFRKSKLALPEDSNLLYETSDENSVIEGSRKLEHTNELKCLDKAAVVSDKEIKFEDFSNPWRLCTVTQIEELKILIRMFPIWATGIVFSAIYAQMSTMFVEQGEVMDRTIGSFTIPAASLSMFDTISVIFWVPVYDKILVPLARKFTGKQRGFSELQRMGIGLFISILSMAAAALVEMKR

SEQ ID NO: 64211 - protein, 545 aa, Xanthobacter autotrophicus Py2
MTTLSARLSDADEPHGSHRAASPLIGFIGPGGDTQPLSAHAFGSKAAQLWRMNALGLNVPPAFVLSTALCGKPHAEKRIGSLLEQGIAYLERVTARGFGDRRRPLLVSVRSGAEKSMPGMLETVLDVGMTAATTRGLMRLYGNPRLAADCRRRFIEGYCEVVAGLPRGPFEDVLRAVQTAEDVTSDRELDPEALDRLAGLYLDLARDRFGTAIPEEPMDQLRAAAEAVFRSWDAPKAQDYRRLNHLENLSGTAVTVQAMVFGNASARSGSGVAFSRDPATGANGLYADMLFEAQGEDVVSGRRQPVGLGRLEALLPDVATQLAAGVGALEAAYRDVQDVEFTFEDGRLFFLQTRSAKRTPRAALKIAVDLVAQGMRTEAEGLALLDGIDLSQVGTTRFTGTAEVAARGVAASPGTVSGRVAFDGEAAKRLSEGGDPVILVRPDVATDDIAGMALAAGVLTRVGGRTAHAAVVARQLGRVCVVGCAPLAIDLDSRSARLGRAQVQEGDWLSLDGDEGTVFVGRRESVVDRPEAELDTVAGWMARTR

SEQ ID NO: 64212 - protein, 234 aa, Nepenthes tobaica
  misc_feature (1)..(3): Xaa can be any naturally occurring amino acid
  misc_feature (16)..(16): Xaa can be any naturally occurring amino acid
  misc_feature (19)..(19): Xaa can be any naturally occurring amino acid
  misc_feature (25)..(27): Xaa can be any naturally occurring amino acid
  misc_feature (37)..(38): Xaa can be any naturally occurring amino acid
  misc_feature (53)..(53): Xaa can be any naturally occurring amino acid
  misc_feature (58)..(58): Xaa can be any naturally occurring amino acid
  misc_feature (65)..(66): Xaa can be any naturally occurring amino acid
  misc_feature (68)..(69): Xaa can be any naturally occurring amino acid
  misc_feature (76)..(77): Xaa can be any naturally occurring amino acid
  misc_feature (84)..(84): Xaa can be any naturally occurring amino acid
  misc_feature (135)..(135): Xaa can be any naturally occurring amino acid
  misc_feature (137)..(137): Xaa can be any naturally occurring amino acid
  misc_feature (193)..(193): Xaa can be any naturally occurring amino acid
  misc_feature (198)..(198): Xaa can be any naturally occurring amino acid
  misc_feature (201)..(201): Xaa can be any naturally occurring amino acid
  misc_feature (203)..(203): Xaa can be any naturally occurring amino acid
  misc_feature (207)..(207): Xaa can be any naturally occurring amino acid
  misc_feature (218)..(218): Xaa can be any naturally occurring amino acid
  misc_feature (220)..(220): Xaa can be any naturally occurring amino acid
  misc_feature (224)..(225): Xaa can be any naturally occurring amino acid
  misc_feature (233)..(233): Xaa can be any naturally occurring amino acid
XXXVQENLGWALGFGXPAXSMGIAXXXFFSGTALYTXXKPGGSPLTRMCQVLXASFRXSKLALPXXRXXLYETSDXXSVIEGSXKLEHTNELKCLDKAAVVSDKEIKCEDFSNPWRLCTVTQIEELKILIRMFPXWXTGIVFSAIYAQMSTMFVEQGEVMDRTIGSFTIPAGSLSMFDTISVIFWVPVYDKIXVPLAXKFXGXQRGXSELQRMGIGLXIXILSXXAAALVEMXR

SEQ ID NO: 64213 - protein, 235 aa, Nepenthes densiflora
  misc_feature (55)..(55): Xaa can be any naturally occurring amino acid
  misc_feature (138)..(138): Xaa can be any naturally occurring amino acid
  misc_feature (185)..(185): Xaa can be any naturally occurring amino acid
  misc_feature (220)..(220): Xaa can be any naturally occurring amino acid
LIVWVQENLGWALGFGIPAISMGIAIASFFSGTALYRLQKPGGSPLTRMCQVLVXSFRKSKLALPEDSNLLYETSDENSVIEGSRKLEHTNELKCLDKAAVVSDKEIKYEDFSNPWRLCTVTQIEELKILIRMFPIWXTGIVFSAIYAQMSTMFVEQGEVMDRTIGSFTIPAASLSMFDTISVIXWVPVYDKILVPLARKFTGKQRGFSELQRMGIGLFXSILSMAAAALVEMKR

SEQ ID NO: 64214 - protein, 235 aa, Nepenthes diatas
  misc_feature (7)..(7): Xaa can be any naturally occurring amino acid
  misc_feature (39)..(39): Xaa can be any naturally occurring amino acid
  misc_feature (55)..(55): Xaa can be any naturally occurring amino acid
  misc_feature (136)..(136): Xaa can be any naturally occurring amino acid
  misc_feature (138)..(138): Xaa can be any naturally occurring amino acid
  misc_feature (220)..(221): Xaa can be any naturally occurring amino acid
LIVWVQXNIGWALGFGIPAISMGIAIASFFSGTALYRLXKPGGSPLTRMCQVLVXSFRKSKLALPEDSNLLYETSDGNSVIEGSRKLEHTNELKCLDKAAVVSDKEIKCEDFSNPWRLCTVTQIEELKILIRMFPXWXTGMVFSAIYAQMSTMFVEQGEVMDRTIGSFTIPAASLSMFDTISVIFWVPVYDKILVPLARKFTGKQRGFSELQRMGIGLFXXILSMAAAALVEMKR

SEQ ID NO: 64215 - protein, 138 aa, Glycine max
MAARLALVATLLCAGAAAAAAQQASNVRATYHYYRPAENGWDLGAPAVSAYCSTWDAGKPYSWRSKYGWTAFCGPAGPRGQASCGRCIRVTNTGTGAQITARIVDQCANGGLDLDWDTVFVKIDTDGMGYQRGHLIVN

SEQ ID NO: 64216 - protein, 203 aa, Helicobacter hepaticus ATCC 51449
MQERMAKNVIEISRTTKETDISLKLLVYGNGNAQIQSGIGFFDHMLQSLTKHSLIDLELACKGDTFIDGHHSVEDCGIVLGQGLAQGIYPAAGIERFGNASIVMDEACVECDIDVSNRAFLVFETNAYKLPFKGRVGELDVELVEEFFRALCFNAHLSAHIVLKRGKNLHHIIEAMFKAFGVSLRRALTLNPRILTPSTKGVL

SEQ ID NO: 64217 - protein, 341 aa, Arabidopsis thaliana
MDNSAPDSLSRSETAVTYDSPYPLYAMAFSSLRSSSGHRIAVGSFLEDYNNRIDILSFDSDSMTVKPLPNLSFEHPYPPTKLMFSPPSLRRPSSGDLLASSGDFLRLWEINEDSSTVEPISVLNNSKTSEFCAPLTSFDWNDVEPKRLGTCSIDTTCTIWDIEKSVVETQLIAHDKEVHDIAWGEARVFASVSADGSVRIFDLRDKEHSTIIYESPQPDTPLLRLAWNKQDLRYMATILMDSNKVVILDIRSPTMPVAELERHQASVNAIAWAPQSCKHICSGGDDTQALIWELPTVAGPNGIDPMSVYSAGSEINQLQWSSSQPDWIGIAFANKMQLLRV

SEQ ID NO: 64218 - protein, 385 aa, Aspergillus oryzae
MAFFFNRGRSRHPSDIVRSIKDQLVRLREASPTAAKVEDELAKQLSQMKLIVQGTQEIEVSPEQVHALVQATLQEDLLYELARSLYILPFEARKDTQTIFSHILRFKPGNSNQADPPVISYIVHNRPEVIIELCKGYEHSQSAMPCGTILREALKFDVIAAIILYDQSEDGEPAIRLGEVQPGVPQTGNGIFWNFFHWIDRGTFELSADAFTTFREILTRHKSLVTGYLATNFDRFFDQFNSVLVQSDSYVTKRQSIKLLGEILLDRANYNVMMAYVESGENLKLCMKLLRDDRKMVQYEGFHVFKVFVANPNKSVAVQRILINNRDRLLKFLPRFLEDRTDDDQFTDEKSFLVRQIELLPKEPIDPTRSAREPSRPGVNTATVA

SEQ ID NO: 64219 - protein, 222 aa, Helicobacter hepaticus ATCC 51449
MVQVIESRFMSSASHLDNAPPPNASEIVFLGRSNVGKSTLINTLLNKPLAKSSSTPGKTQLINFFASVWVWHNQRLPLTFIDLPGFGYAKVSKTIKKEWERHLLNFLFMRQSIKLFLHLVDARHTDLAIDTSVATMLEQICRGDQCILRIYTKADKLNQSALNALYKRVYIQKNKVQGVDTDDTHTQSLLFSAISKNHRKMVSLTHLREEIVKYTLGLENGI

SEQ ID NO: 64220 - protein, 1033 aa, Arabidopsis thaliana
MDRISNLPNEIICHIVSFLSAKEAAFASILSKRWRNLFTIVIKLQFDDSVKNEGSLKDFVDGVLALPTSSRVRSCSLECRREFDPTHYDDFNRCICALLKRGILDLKLDICAGRRYSLPLEVFTCKTLVKLELGSDFGGFVVDLVPEDAFLPALETLLLNYIRFKDLRRCAFEKLLSACLVLKELVIHNMEWERWKWSGNISSPTLERLTISHVDLYECEFTRINLDTPNLTYLELSDAVPDDYPIVNLDSLVEVKLDLTLMVDHKYHGYVDDNDTISSNPTNLINGLRNVEIMNLQSPNTFQAFSYFHEAIPVFKNLYHLTITNNDTVIGFCWEFLPFVIKKCPNLKTLVIDGPLHYNEDRPKSVCHCLSGYSFLLSCPLEVLQITDYSGTPGEVEQLKHFLEKLSGLKLVKLHSLTRFGSDKKKLLMLPRASSKCKIKHYDSLENALLPSLKTLILDSVKFYDRCGCCAFQKLLSACPVLVESVMRNLEWEDWEWSGCASSQTLERLTIDHRYWAEHNLESFTFDTPSLTYLDYNAHVPGSYPTVNLDSLVEAKLNLGFTTDLVEDDDDPFTSDPTNLIKGLRNVEILRLWIPRSGVPDLVYRIKPVVSKPDKIEPITHTRFDILIPPLKFKSRVQKVDLVSNLPEEVRCHILSFLPTKHAALTSVLSKSWLNLWKLVPNLDIDDSEFLLPEEGKGERDEIRQSFVDFVDRVLALQEIPEIFLSRTLVELKIRSERYVDWWRRDRGTVLPMLKTLDIDSESIHCGTIDMFLPSFPVLEYLRMANMEWTESDETVSSATIKLLSIHGTVAEDYPLVNMKALFEARINFIVTEKQIKRVRAPNEDWLQDDEVDVVLRFSNVVKLMNGIQNVQKLYLTADTIEVLSLCCESVPLFNNLKTLGITSEEGRGWQAMPVLGLLHYMTDKCGDACDCISREDKGRSLTSCPVKKLEIRGFRGTMKEMTMIKHFLVYFPCLKEMNIYVEEYDPTELRFPQVSKVIIQMMEEYNKLSSCNVQLLITDYLSEKWTAAGRIL

SEQ ID NO: 64221 - protein, 253 aa, Triticum aestivum
MMHGVGPSDDAAAAAALELQESGWEELRREARKLEGDLDVKLSSYARLAARSSSASASASASAASPTADRSSWKSTELEIQALLDKLQDVNDAMSRCAAPAAPATASVSQKLARHRDILHEFTQEFRRTRGNLSSMREHADLLSSVRGDITESKATGGMSPRVHLLRERASIHGSVNQIDEVIGQAQSTRAALSNQRALFGDVQGKVKQLGEKFPVVRGLLGAIKRKKSKDTIILSAVIAACTIFLIIYWLSK

SEQ ID NO: 64222 - protein, 121 aa, Oryza sativa
MSSPHVLVVDDTHVDRHVVSMALMRHNVRVTAVESVMQALMFLDSEHDVNMIVSDYCMPDMTGYDLLMEVKKSPKLAHLPVVIASSDNIPERIRKCLDGGAKDYILKPVKIVDVPRILNYI

SEQ ID NO: 64223 - protein, 235 aa, Nepenthes ephippiata
  misc_feature (7)..(7): Xaa can be any naturally occurring amino acid
  misc_feature (39)..(39): Xaa can be any naturally occurring amino acid
LIVWVQXNVGWALGFGIPAISMGIAIASFFSGTALYRLXKPGGSPLTRMCQVLVASFRKSKLALPEDSNLLYETSDENSVIEGSRKLEHTNELKCLDKAAVVSDKEIKREDFSNPWRLCTVTQIEELKILIRMFPIWATGIVFSAIYAQMSTMFVEQGEVMDRTIGSFTIPAASLSMFDTISVIFWVPVYDKILVPLARKFTGKQRGFSELQRMGIGLFISILSMAAAALVEMKR

SEQ ID NO: 64224 - protein, 759 aa, Coxiella burnetii RSA 493
MNMLKILRQITQEVNAAPNLEQALKLVVVRLCEALPADACSLFICDDVHGEYVLMATQGLNSKQVGKLRLKFGEGLIGLVGEREEPINLADAPLHPAYKHRPELGEEDYHGFLGIPIIEQGELLGILVIQQLESHHFAEEEEAFCVTLAIHLAAEIAHARAKGALEKLGARKRRRRKTETVLYGVPGSSGVAIGTAMIVYPPADLDAVPDQEITDIEAEVSDFEAALAAARDEIQTLQARAKNSLSVAENALFDAYLRLLDSRTFINEVIHEIKEGQWAQGALKRIIKKHVLHFESLEDPYLRERAADFRDLGRRILAHLQFSEQEELEYPKNTILVSEEVTATSLIEVPQDRLRGVISGTGSSNSHVAILARALGLPAVMGVRGTPLFKLGEQEIIVDGYNGQIYLSPSAEIKKEFKALAEEEQQLDEELQALRELPAETKDGHALALYVNTGLAIEGGLSLSVGAEGVGLYRTEMPFMIRDRFPSEEEQRIMYRQLLNTFAPRPVIMRTLDIGGDKTLPYFSVEEDNPFLGWRGIRVTLDHPEIFLQQVRAMLHASEGLNNLSVLLPMITSINEVETATRMINQARDELIEEGINVELPSVGLMIEVPATVYQAFELAKRVDFLSVGSNDLIQYLLAVDRNNPRVANLYDGLHPAVLQALKIVVKAGHRAGKPVSICGEMAGDPLAVILLLAMGFDTLSMNARILPRVKWVIRNFEMAHAKELLDEALKMDDPKDIRLLMEHTLEEAGLGGLIRAGR

SEQ ID NO: 64225 - protein, 234 aa, Salinibacter ruber DSM 13855
MSKPDNPRDENPKNPEELRFHYTPTDEPGAEQETENAHAKDTTRVPAVIDALREEFGAAVLDVERYANEDTIYVEKNRIREVCRFLKEEEGFDYFVDLGGIDNFTAEDRYEVFYNLVSTERQKRLRLKVQVDEGDMQVPSVTEVYRAANWNEREAYDMFGFSFVDHPDPRRMYMPEDFDYHPLRKEFPQLGIPGSLPLPPQTPDGDLTMDPFAAAHGSQPVKSYEEPATDPDSE

SEQ ID NO: 64226 - protein, 235 aa, Nepenthes eustachya
  misc_feature (6)..(7): Xaa can be any naturally occurring amino acid
  misc_feature (13)..(13): Xaa can be any naturally occurring amino acid
  misc_feature (15)..(15): Xaa can be any naturally occurring amino acid
  misc_feature (17)..(17): Xaa can be any naturally occurring amino acid
  misc_feature (24)..(24): Xaa can be any naturally occurring amino acid
  misc_feature (34)..(34): Xaa can be any naturally occurring amino acid
  misc_feature (38)..(38): Xaa can be any naturally occurring amino acid
  misc_feature (66)..(66): Xaa can be any naturally occurring amino acid
  misc_feature (185)..(185): Xaa can be any naturally occurring amino acid
  misc_feature (230)..(230): Xaa can be any naturally occurring amino acid
LIVWVXXNLGWAXGXGXPAISMGXAIASFFSGTXLYRXQKPGGSPLTRMCQVLVASFRKSKLALPXDSNLLYETSDGNSVIEGSRKLEHTNELKCLDKAAVVSDKEIKCEDFSNPWRLCTVTQIEELKILIRMFPIWATGIVFSAIYAQMSTMFVEQGEVMDRTIGSFTIPAASLSMFDTISVIXWVPVYDKILVPLARKFTGKQRGFSELQRMGIGLFISILSMAAAAXVEMKR

SEQ ID NO: 64227 - protein, 101 aa, Brassica napus
  misc_feature (82)..(82): Xaa can be any naturally occurring amino acid
MAANFWASSHSKQLLDPEDVDVVPAADRERGITTEEFRLVKIHMSSHIWRLAQQVKVRQRVIATAITYFRRVYTRKSMSEYXPRLVAPACLYLASKVEEST

SEQ ID NO: 64228 - protein, 214 aa, Nepenthes faizaliana
LGFGIPAISMGIAIASFFSGTALYRLQKPGGSPLTRMCQVLVASFRKSKLALPEDSNLLYETSDENSVIEGSRKLEHTNELKCLDKAAVVSDKEIKREDFSNPWRLCTVTQIEELKILIRMFPIWATGIVFSAIYAQMSTMFVEQGEVMDRTIGSFTIPAASLSMFDTISVIFWVPVYDKILVPLARKFTGKQRGFSELQRMGIGLFIAILSMA

SEQ ID NO: 64229 - protein, 322 aa, Xanthobacter autotrophicus Py2
MEIVAVDIGGTHARFAHAEVADGRVVSLGEPVIKHAADHASFQLAWQAFAETVGTPLPRAAAIAIACPVEGDVLKLTNNPWVIHKHLIPEKLSVDTWTLVNDFGAIGHAVAQIGEEGFAHFAGSDRPLPETGVISIIGPGTGLGVAHVLRQDGRYNVIECEGGHIDFAPLDSLEEAILHRLRQRYPRVSVERIVSGPGLVNIYEALAAIEGCQIDQLEDKALWALATEGKDGLAAAALDRFCLSFGAVAGDIALVQGAKAVVIAGGIAPRIAHLIPQSGFASRFSAKGRFAQRMEDIPVRLITHPQPGLYGAAAAFAEQHTR

SEQ ID NO: 64230 - protein, 456 aa, Xanthomonas campestris pv. vesicatoria str. 85-10
MSARYDYDVVILGGGSGGLAAGFRAAKHGARVAIMEPDELGGTCVNLGCVPKKAMWLAADLAGKIELASVLGFDVPRPTLAWQELVTHRQGYISNIHASYRRRLNEDGVVLIPQRGVLQDRHTVMGSDGVPVTAEHIVIATGAHPLRPDVEGAEHGEVSDDFFNLCHAPEQVAIVGGGYIAVEIAGLLQALGSRVHLFVQDERLLERFDAELTLQLADNLRHLGVRLHFGFTTTALERDLHGALRVHGHCVHPREQGNDVFDKVFFAVGRRANTAGLGLDTVGVALGDKGEVVVDDGQTTNVPNIHAIGDVGGKVGLTPVAIAAGRKLMDRLFGHQPDARMDYENVPSVVFSHPPLGNVGLTEEQARARYNGAVRVYRSNFRPMLHALADAPQRSLFKLVCVGEEERVVGVHLLGESADEMLQGFAVAVKMGATKRDFEETVAIHPTSSEEIVLMH

SEQ ID NO: 64231 - protein, 235 aa, Nepenthes fusca
  misc_feature (7)..(7): Xaa can be any naturally occurring amino acid
  misc_feature (39)..(39): Xaa can be any naturally occurring amino acid
  misc_feature (77)..(77): Xaa can be any naturally occurring amino acid
  misc_feature (185)..(185): Xaa can be any naturally occurring amino acid
LIVWVQXNVGWALGFGIPAISMGIAIASFFSGTALYRLXKPGGSPLTRMCQVLVASFRKSKLALPEDSNLLYETSDXNSVIEGSRKLEHTNELKCLDKAAVVSDKEIKREDFSNPWRLCTVTQIEELKILIRMFPIWATGIVFSAIYAQMSTMFVEQGEVMDRTIGSFTIPAASLSMFDTISVIXWVPVYDKILVPLARKFTGKQRGFSELQRMGIGLFISILSMAAAALVEMKR

SEQ ID NO: 64232 - protein, 479 aa, Zea mays
MECARELRVRSTFTAAAMASKKQVGPGGAVPAQEQMNGGDAARLVRKPMDTFPQPAAARGRRALVDVGNLMNGRPSLVNHQKQAVAAAATSHKPLNVGNKKPLVPQAAARGLRPLADVTNLMINDRAAPANRQKPLDAVFNRNGKAVKLKECKVKPEVIVSIPDSEKEKKSKFPGGQKVCRRVPTLFDNLTKCSRASDGITTPKKKNPYDIDAPDSCNELAVVEYVEDIYRFYKSTEGTCLPLSSYMSSQAEISERMRAILIDWIIEVQYRLTLMPETLYLTVYIIDQYLSMESVPRKELQLVGISAMLIASKYEEIWAPLVKDLMCLCDNAFTRDQILTKEKAILDMLHWNLTVPTMYMFIVRYLKAAMCDAELENMAFFYSELALVQYAMLVYPPSVTAAAAVYAARSTLGMNPPWTDILEHHTGLAEPQLLDCARRLISFHALAPESKQKAVYRKYSKPKLGSVALQSPDKKLLSG

SEQ ID NO: 64233 - protein, 525 aa, Oryza sativa (japonica cultivar-group)
MDTSTLLIALTLVLLLLLLTARRRRSGRLRLRLPPEPPGLPLVGHLHLFRKPLHRTLARLAARHGAVFRLRLGSRRVAVVVSSAPAAEECLGAHDVAFAGRPRLPSAGILSYGWSTMGTAAYGPYWRHVRRVAVAEILSAHRVRQFAGAHAREARATARRLCRAASRQRHGAGAAAGRVRVELKSRLFELLMNTMMAMICDKTYYGADDDGEVSEEARWFREMVEETMALSGASTVWDFLPAALRWVDVGGVGRRLWRLRESRTRFLQGLIDDQRKEMEHDGDGRELPAAAARPRSMIGVLLSVQRQDPEECPDQLISSLCISSLEAGTGTSTDTIEWAMSLLLNNPDVMRKARDEIDAFIGQPVRLLEADDLPKLQYLRCIIMETLRLYPPAPLLVPHESSSDCTVAGFHIPRGTMLLVNTFDIHRDPHIWDEPTSFIPERFEDGRSEGKMAIPFGMGRRKCPAENLGMQMVGLGLGTMIQCFEWERVGEELVDMTEGSGLTMPKKVPLEAFYQPRASVMHLLS

SEQ ID NO: 64234 - protein, 509 aa, Oryza sativa (japonica cultivar-group)
MDALLIALFLLLLIALMETARVRRSGTQRRAGNVPPPPPEPAGLPLVGHLHLFRKPLHRTLARLAARHGGAVFGLRLGSRRVAVVSSAPAAEECLGAHDVAFADRPRLPSGRILSYDWSTMGTASYGPYWRHVRRVAVTEILSARRVQHFADVHVREARAMARHLHRAAVRHGVGGAARVRVELKSRLFELLMNTMMAMICDKTYYGDDDDGKVSKEARWFREMVEETMALSGASTVWDFLPAALRWVDVGGVGRRLWRLRESRTRFLQGLINDERKEMEQEQGGDRAQPAARRRTMIGVLLSVQRQDPDACPDQLIRSLCISSLEAGTDTSADTIEWAMSLLLNNPNVMRKARDEIDAFIGQPCIIMETLRLYPPAPLLVPHEASTDCSIAGFHITRGTMLLVNTFAIHRDPQVWNEPTSFIPERFENGRSEGKMAIPFGMGRCKCPAENLGMQMVGLALGTMIQCFEWERVGEELVDMTEGSGLTMPKEVPLQAFYQPRASLMHLLY

SEQ ID NO: 64235 - protein, 545 aa, Oryza sativa
  misc_feature (80)..(80): Xaa can be any naturally occurring amino acid
KAANNKPVLSEDPPVISEPALVNSHNDGNAENCKLPNGVAVEAMGQGVENQNIVGSKAPTSPEKLSEELAAVKAQAAFRXGYLARRAFRALKGIIRLQALIRGHLVRRQAASTLRVTWLIVKLQALVRGRNVRLSGASIQFVVKSGQHKFLSDKPSDAWKEKVSSNAYVRKLLSSSIGLEALHLQYDKRDPNSLYNWLERWTISQIWKSSSQPKKVADGKPQVRKASYAMETESAKLKRNVRKSSAVTVDSFQTNMTVEPEKIKRNSRKFSSSAADSVPDSQLSELEKVKRNLRKVTNSMAEASKISSSRADASKVSSSMADASKVSSSTADASKVSDSVAQIPPSLVNGISDHQDNQCEEAQQNACVSFPPETQELHSGILLEDNSHMNLLEPDLISNPETPFTSILTWEKFNDSTADAQEVEVLPLQNIDNEDNFPENGVLGKKEKPRSKEEPLSNGNLKTSKRRSSFSTKSDYPENGAQNTPVPRRKPSYMAATESAKAKLRGQNSPRLDSDSPADMNGFTRRQSLPSSTNNRAIRAEWRRW

SEQ ID NO: 64236 - protein, 225 aa, Mesorhizobium loti MAFF303099
MKTYLAEVLGTFLLVFIGTASVVTGGFGGALPLGQEGIGLAFGIGLIAAAYAIGPISGAHLNPAVTLGVFLAGRLPAKDVIPYWIAQIIGAILASLALWIIVSGQAGGHTGGFGANGWDETKWGMSSAFLWELIGTFTFVTVILGVTAEKHSTAFAGLVIGLTLAGIHFAMIPVTGTSVNPARSIGPALFTGGAALSQLWLFIVAPLIGGAIAGVVAKARIFEKD

SEQ ID NO: 64237 - protein, 247 aa, Synechococcus sp. CC9311
MSRWQRQQGCWCLWPASPQGLIEFIGGSYLATNPQISYRRLLEGLAARQFAVHAWSYVPGFDHQLQAREGWQALRTCRSALNQRLGQDLLPVRVGHSLGCKLHLLAPDGGRNSLAMAALSFNNFTAERSIPLLGTLAPSLGVVTEFSPGPEETLRLIERYYLQPHNLVIRFGTDQLDQSQDLMQALSRRSGDQSQFVAMKGDHLTPASAGLRQGLLGDWADDPSRARVIGELIDSIANVGLGLERQR

SEQ ID NO: 64238 - protein, 235 aa, Nepenthes gracilis
  misc_feature (50)..(50): Xaa can be any naturally occurring amino acid
  misc_feature (66)..(66): Xaa can be any naturally occurring amino acid
  misc_feature (80)..(80): Xaa can be any naturally occurring amino acid
  misc_feature (110)..(110): Xaa can be any naturally occurring amino acid
  misc_feature (124)..(124): Xaa can be any naturally occurring amino acid
  misc_feature (129)..(129): Xaa can be any naturally occurring amino acid
  misc_feature (136)..(136): Xaa can be any naturally occurring amino acid
  misc_feature (138)..(138): Xaa can be any naturally occurring amino acid
  misc_feature (167)..(167): Xaa can be any naturally occurring amino acid
  misc_feature (176)..(176): Xaa can be any naturally occurring amino acid
LIVWVQENLGWALGFGIPAISMGIAIASFFSGTALYRLQKPGGSPLTRMXQVLVASFRKSKLALPXDSNLLYETSDENSXIEGSRKLEHTNELKCLDKAAVVSDKEIKCXDFSNPWRLCTVTQXEELKXLICMFPXWXTGIVFSAIYAQMSTMFVEQGEVMDRTIGXFTIPAASLXMFDTISVIFWVPVYDKILVPLARKFTGKQRGFSELQRMGIGLFISILSMAAAALVEMKR

SEQ ID NO: 64239 - protein, 235 aa, Nepenthes hirsuta
  misc_feature (7)..(7): Xaa can be any naturally occurring amino acid
LIVWVQXNLGWALGFGIPAISMGIAIASFFSGTALYRLQKPGGSPLTRMCQVLVASFRKSKLALPEDSNLLYETSDGNSVIEGSRKLEHTNELKCLDKAAVVSDKEIKCEDFSNPWRLCTVTQIEELKILIRMFPIWATGIVFSAIYAQMSTMFVEQGEVMDRTIGSFTIPAASLSMFDTISVIFWVPVYDKILVPLARKFTGKQRGFSELQRMGIGLFISILSMAAAALVEMKR

SEQ ID NO: 64240 - protein, 446 aa, Lactobacillus plantarum WCFS1
MENQQLARKLKRRHVQMIALGGAIGTGLFLGSGLAIKQAGPSILLAYAIGGFFCYLMMRALGELLLSDTRLHSFLEFINRYLGKRFEFAIGWTYWLCWISLAMADLTASGIYIRYWFPWIPQWVTPLIIILILLVFNMLSVSAFGELEYWFSMIKVVAIIALIVTGAILIGSSAHVGGQTVSVTNLVSHGGFFPTGVQGFLMSFSLVIFAFTGIEMVGITAGEAENPEKELPRAINSLPIRISFFYVGALFVIMAIYPWNQITTSQSPFVQVFSDVGIKAAASIINFVVLTAALSACNSAIFSTSRTLFTLAHGDNAPKWMGKVNRYNVPARSLLFSSLILLVIVALNYVIPSTVFTLISNVATTNFIIVWCALLVCHYVYKRTTDSTHNPFKLPLFPVTNIATLAFFIAVTVVLCFDQVNRWAVIGSVVWFVILLVIERSMHRTV

SEQ ID NO: 64241 - protein, 235 aa, Nepenthes inermis
  misc_feature (39)..(39): Xaa can be any naturally occurring amino acid
LIVWVQENLGWALGFGIPAISMGIAIASFFSGTALYRLXKPGGSPLTRMCQVLVASFRKSKLALPEDSNLLYETSDENSVIEGSRKLEHTNELKCLDKAAVVSDKEIKCEDFSNPWRLCTVTQIEELKILIRMFPIWATGIVFSAIYAQMSTMFVEQGEVMDRTIGSFTIPAASLSMFDTISVIFWVPVYDKILVPLARKFTGKQRGFSELQRMGIGLFIAILSMAAAALVEMKR

SEQ ID NO: 64242 - protein, 249 aa, Salinibacter ruber DSM 13855
MQVDLHGSTVLVTGGTRGIGRALVEAFAEAGAHVAFTFRSSTDAAAALVESLEEQGTETLSLQGDVADLDAAQAHVNAVTEHFGSLDVLVNNAGITRDGLLLRMGEDDWDDVIDTNLKGTFNFCKAAYMPMMRQQSGSIVNISSVVGTTGNAGQTNYAASKAGIVGFSKSLAKELGGRNVTVNVVAPGYVQTDMTDELDEETRDSILDAVPLDRLATTEEIAEAVLFLAAPASDYITGHVLQVNGGLSM

SEQ ID NO: 64243 - protein, 101 aa, Nicotiana sylvestris
AGPVVAKYGDKSVYFDLEDLGNTTGQWDLYGSDAPSPYNSLQSKFFETFAAPFTKRGLLLKFLILGGGSTLAYFSSTASGDILPIKKGPQLPPKLGPRGKI

SEQ ID NO: 64244 - protein, 595 aa, Xanthobacter autotrophicus Py2
MWPPARRRVTSRAIALSASARYGRRCGAARARRMSSISIARRWCSVSLPISPKPCAEKPPRRAGPEPFSEQACFERPMSAKPPFYITTAIAYPNGVPHMGHAYEAIATDCIARFKRLDGYDVRFLTGTDEHGIKMLQTAQKAGVTPRELLARNVPRFEAMVEAFNLSIDDFIRTTQERHHASSQAIWAKMAANGDIYKSTYAGWYSVRDEAYYAEDETQLNEQGIRLGPQGTPVEWVEEESYFFRLSAYQDRLLAYYAENPGFIMPEARRNEVVSFVSGGLTDLSISRTTFDWGIPVPGDDKHIMYVWVDALTNYITALGYPDTEAELFKRFWPANLHVIGKDIIRFHAVYWPAFLWSAGLEAPKRVFGHGFLFNRGEKMSKSVGNVIDPFDLAATYGVDAIRYFFLREVSFGQDGSYSHEAIVARMNADLANDLGNLAQRSLSMIAKNLDGVVPQPGPLSPEDEAILALADGMLEKSREAMEGQAIHHYLAAVWNVVAEANRYFAAQAPWALRKTDPARMATVLWVTAELIREVGILVQPVMPESAARLLDLVVVPADERGFDRLGAGHRLPAGRVLPAPVGVFPRYVEPETAS

SEQ ID NO: 64245 - protein, 234 aa, Nepenthes maxima
  misc_feature (1)..(1): Xaa can be any naturally occurring amino acid
  misc_feature (228)..(228): Xaa can be any naturally occurring amino acid
XGWVQENLGWALGFGIPAISMGIAIASFFSGTALYRLQKPGGSPLTRMCQVLVASFRKSKLALPEDSNLLYETSDENSVIEGSRKLEHTNELKCLDKAAVVSDKEIKREDFSNPWRLCTVTQIEELKILIRMFPIWATGIVFSAIYAQMSTMFVEQGEVMDRTIGSFTIPAASLSMFDTISVIFWVPVYDKILVPLARKFTGKQRGFSELQRMGIGLFISILSMAAAXLVEMKR

SEQ ID NO: 64246 - protein, 1119 aa, Oryza sativa (japonica cultivar-group)
MELSNQGQTPMSTNMGSQPLPSSNIQPNQAEYPSMFYPSLPADWGAQPMFSMGASVPISSYFIVPMSQQSVQIGASRPETPRSSGAHSLSRVSLRPPQQVLSIRTSLPTMVGSQHSPAGKKLQPTIASPKVQILKSTQSQSSNKRSAQKETPSKVQTQQLESVRSKFRESLSAALRTDSDQSKNQSSDVQPDGSADQKKEMDVDADQVATTSQGMSAAKSEVLTSVGAERRAEDEKLNSDLVSNIATPLNADIQQQPENASLQDEMLGQYTVVADELLQGHGLCWVSDFDAGVPEPATQPNLKRSRASDIDPVVADTLSESESKRMKSANDEEAIDKDSIIQKADDLAVRVEEELFKLFGGVNKKYKEKGRSLLFNLKDKSNPELRERVLSGDITPDRLCSMTAEELASKELSEWRLAKAEELAQMVVLPSTEVDVRRLVRKTHKGEFQVEVEETDGISVEVELGGNLLTQVPSKAPEDQTKSDDKESTDDKTGIQDNDKAPDGTSQDEDNGAGKNDPQDDLEYVDNEKSDLMQELMVDDLKDTENLPPIPSLDEFMQGLDSEPPFENLSAGTPEEDSDDRDEADTTAESAELPEEEVKVSAAEKIVSEADLPSSQDKSESKLESPKDEVGSNLGPVEQREGKLIKSSPDSVEVKQTTTENVLNRDSTVHNMATTLPMIRESIWEGAIQLTMSSLTNVVAIFKSGEKPPVKEWRSFVEIKGRVKLSAFQEFVEQLPKSRSRAIMVTELCWKEGSHESGRQHLLQTIDSYISDERVGLAEPADGIELYLCPSQGKTVEILSRHLPKEHLESLAVSASSIIGVIVWRRPNVPRMPAHPRHDGSRRPSILKKPQVTGSTPGPRPSLPMSSHGAPPGFPVQRHRHEEDVTDDVPPGFGPGVARDEDDLPEFNFVNSSNPAANVTTTQAYKGRQHVPLTSARPVEQMRELVQKYGKRSSVQARPWDDDDDDDIPEWNPNQLVTQQQPTRQLPVPPTPQQPLPPPPPPPSLQQLHHPYQHQQQQQQQLYHHQNALQPQIPSNSIPQAYLRTQQPLQQLPLMQQQLQPAQAWQQTNAWWPAQGGAAAAAAPASMVQQSQYGVIPNSNNSAQSYGSGSVGGMAWRPR

SEQ ID NO: 64247 - protein, 556 aa, Arabidopsis thaliana
MTTQDVIVNDQNDQKQCSNDVIFRSRLPDIYIPNHLPLHDYIFENISEFAAKPCLINGPTGEVYTYADVHVTSRKLAAGLHNLGVKQHDVVMILLPNSPEVVLTFLAASFIGAITTSANPFFTPAEISKQAKASAAKLIVTQSRYVDKIKNLQNDGVLIVTTDSDAIPENCLRFSELTQSEEPRVDSIPEKISPEDVVALPFSSGTTGLPKGVMLTHKGLVTSVAQQVDGENPNLYFNRDDVILCVLPMFHIYALNSIMLCSLRVGATILIMPKFEITLLLEQIQRCKVTVAMVVPPIVLAIAKSPETEKYDLSSVRMVKSGAAPLGKELEDAISAKFPNAKLGQGYGMTEAGPVLAMSLGFAKEPFPVKSGACGTVVRNAEMKILDPDTGDSLPRNKPGEICIRGNQIMKGYLNDPLATASTIDKDGWLHTGDVGFIDDDDELFIVDRLKELIKYKGFQVAPAELESLLIGHPEINDVAVVAMKEEDAGEVPVAFVVRSKDSNISEDEIKQFVSKQVVFYKRINKVFFTDSIPKAPSGKILRKDLRARLANGLMN

SEQ ID NO: 64248 - protein, 371 aa, Zea mays
LDLWWHGERDRNLVGWCLRVRGVRYMARTYSAAAKEITVREALNTALDEEMSADPSVFLMGEEVGEYQGAYKISKGLLDKYGPDRVLDTPITEAGFTGIGVGAAYHGLRPIVEFMTFNFSMQAIDHIINSAAKSNYMSAGQISVPIVFRGPNGAAAGVGAQHSQCYAAWYAHVPGLKVLAPYSAEDARGLLKAAIRDPDPVVFLENELLYGESFPVSAEVLDSSFCLPIGKAKIERQGKDVTITAFSKMVGYALQAADILAKEGISAEVINLRSIRPLDRATINASVRKTNRLVTVEEGFPQHGIGAEICMSVVEDSFEYLDAPVERIAGADVPMPYAANLERMAVPQVDDIVRAAKRACYRAAVPMAATA

SEQ ID NO: 64249 - protein, 643 aa, Helicobacter hepaticus ATCC 51449
MSQKILITSPIYYVNDIPHIGHAYTTILCDMLKKFYQLQGNDVKFLTGTDEHGQKIEQSAQKHSLDPQSYADKISIRFKELWNEFNIDYDIFVRTTDNMHCLSVQKAFEIMYAKGDIYKGSYEGHYCISCETFFTQKQLNENNACPDCGKPTQIVQEESYFFALSKYQNKLLDWYKSHPDFILPQFRQNEIIKFVNEGLNDLSITRTSFEWGVPLPHNPVRKDDKKHVMYVWLDALLSYLSPLGYLSDSAKMPYWENAIHFVGKDILRFHAVYWLAFLMSLELPLPQHIYAHGWWTKDGTKMSKSIGNVINPKEVANAYGIESLRYFLLREMPFGQDGDFSQKAFIERINAELGNDVGNLLNRLIGMSEKYFALQVDSVQVEMFFAPELNELKNIIAQAQEKMLSMQPHRYVEELWKAFGLGNSVITKYEPWNLIKSHQTDKAMALLGLIANILAQSSLLLYPIMPQSACKIANTLNFDINAQNYEKLIKQGQLLASFKLNKIPPLFPRIESPLLAESPTNTKEDSQNKHTPEKTGLIDIKDFSKIDIRVGTIIECTPIEKSEKLLKLMVDIGESKPRQILSGIAQYYTPQSLINKQICLIINLKPAKLMGEISEGMILASKDKNGLSLLGVDNPRINGSPIS

SEQ ID NO: 64250 - protein, 279 aa, Helicobacter hepaticus ATCC 51449
MISIIIDSLRESALHIDSLLKDTSTSYLQSINASGDMQLEIDVRVDKFLSEKLLNLPCVKAICSEEQEEIMYSENKNAPYIIAYDPLDGSSLIDSNLSIGTIFGIYNEELSAKHLIASGYIIYGPRLEMVVAQEQALHYRYNGNMWRNLGALALNTKGKINAPGGTQKHWENKHKAMIESLFAQGYRLRYSGGMVPDLHQILIKGGGLFSYPATSDAPNGKLRKLFEVFPFAFVYEKAGGFATNGTYRILELEVAHLHDSTPCFFGSQSEMNLVKEVYE

SEQ ID NO: 64251 - protein, 483 aa, Rhizobium leguminosarum bv. viciae 3841
MVNLKKTELLRDRCLIDGKWVAGSQNNIAVKNPATGEIVGTVPSLEAGDVEQAVVAAEVAFRSWSALAAKERAAVLLRWFYLIIENADDLAALMTAEQGKPLSEARGEMLYAASFIEWFAEEAKRVYGDIIPAPTTDKRILVFKQPIGVCAAITPWNFPAAMITRKAAPALAAGCTMVVKPAEQTPLTALALGVLAEQAGIPAGVFQIVTGKSREIGKVLTESDIVKKLSFTGSTEVGRILMAQSAPTIKKLSMELGGNAPFIVFDDADLDAAVDGAVASKYRNAGQTCVCTNRIYVQSGVYDVFAEKLAAKVSALKVGEGTQVDVTIGPLIDAEAIAKIEDHISDAIGKGAKVVVGGKRHSLGGRFFEPTVLTGATQAMKIAREETFGPVAPLFRFETEEEALAMANDTEFGLAAYFYTENIRRTWRVAEALEYGMVGHNTGQISNEVAPFGGVKQSGLGREGSRYGIDDYLEIKYLCSAIA

SEQ ID NO: 64252 - protein, 915 aa, Prosthecochloris aestuarii DSM 271
MPTSRLNIQATSGKQYIYSFTEGGAEGDATMKNLLGGKGANLAEMANIGLPVPPGFTLSTEVCTYYYDHSQTYPEGLFEQDIPDALEKIETALGKKFGDPEDPLLVSVRSGARASMPGMMDTILNLGLNDTTVEGLAHRSGNPRFAWDCYRRFVQMYGDVVMDLKPQDSKHSDPFESILDEHKKKKGCSLDTQLDTDDLKAIVSAFKAAILERTGQEFPEDPHVQLQGAIGAVFGSWNNERAIVYRKLNHIPGYWGTACNVQAMVFGNMGDRSGTGVAFTRDAATGENIFYGEYLMNAQGEDVVAGTRTPLKIRHLQEEKPDIYQQLDCIRTRLEQHYRDMMDIEFTIENDRLFMLQCRVGKRTGLAAIRIAYDMCKEGLIDEKEALLRIEPDQLNQLLRPVFDQKEKDRAISEGRLLATGLNAGPGAATGSICFSARQAQEVKERGQLAILVRIETSPEDIEGMSLAEGILTERGGMTSHAALVARQMGKVCVAGCGELDIDYQKGEMRIEGTDIVLKEGDSISLDGTTGEVIQGEIKTRNPEVIEVLADKTLKPEDAPTWQIFDQVMQWADHYRTLKVRTNADQPEQAELAVTFGAEGIGLCRTEHMFFGGQRIDAMREMILADDIGDRQKALEKLLPYQRDDFYGLFKAMGSRPVTIRLLDPPLHEFLPQEDAEIEALAKKIGMAFHDVKTRIDNLHEFNPMLGLRGCRLGILHPEIPAMQVRAIIEAACIIKKEGHDIIPEIMVPLVSTVRELELTSEIIHKVARRVMAEQEIGVTYLVGTMIEVPRAALTSGDIAKAADFFSYGTNDLTQMGLGMSRDDSGQFLPVYQNYDIFPHNPFESLDQEGIGRLIKLSAKEGRSVKSDLKLGICGEHGGDPATIEFCHTTGINYVSCSPFRIPIARLAAARAAIG

SEQ ID NO: 64253 - protein, 136 aa, Triticum aestivum
  misc_feature (4)..(4): Xaa can be any naturally occurring amino acid
  misc_feature (9)..(9): Xaa can be any naturally occurring amino acid
  misc_feature (12)..(12): Xaa can be any naturally occurring amino acid
  misc_feature (63)..(63): Xaa can be any naturally occurring amino acid
  misc_feature (108)..(108): Xaa can be any naturally occurring amino acid
  misc_feature (127)..(127): Xaa can be any naturally occurring amino acid
SSKXKPRLXHSXPATNNNILPSFKVRKEKLGDRIAALQQLVSPFGKTDTASVLMEAIGYIKFXQDQVETLSGPYMRSAKHKKARTTQQRGPSDTGDQKEEAKVDLRSXGLCLVPLACTSYVTNENGXWAPPNFRGN

SEQ ID NO: 64254 - protein, 220 aa, Oryza sativa (indica cultivar-group)
MAAASIPASSQPFKLILGSSSVARKHILTEMGLEFEVMTADIDEKSIRRENPDALVTVLAEAKMVFMVMIGLYQVLEFEKSETLAAPMGHLDWTRSIDLEVVVHEGIIREKPTTKEEARQFLKGYSGSHVSTVGSVVVTNLTTGKRLESLDKAEVYFHDIPDEIIENLIDEGVVFRVAGGLLLEHPLTLPFVEAVVGSSDSVMGISKDLANKLIQDALSS

SEQ ID NO: 64255 - protein, 503 aa, Idiomarina baltica OS145
METSQSISLAQNLYCAEQLQRSEARAGELAGYSLGQLMSLAGRSVFEELERIVSVGASIAICCGEGNNGGDGYIVARLAHQAGYKVSLYALNAKAELKQTSHEPAVQARRACRELGLEERPLTDCTANDYDLIVDAVFGIGLSRPVEGALAEWVRALNKSRVPVLAIDVPTGINADSGCIMGEAIVAQVTVTMIAYKRGLFTGASPGHVGRIVLADLGAGKYFERLEQPAWRRVTENPYSWLGDRVAHSHKGTHGHVLIVGAGPGMPGAAILAMVAALRAGAGKVSVACHPSNVGIIASQQPEAMVHGVEAPEQLNHLLNAATSLVVGPGLGRDEWGYKIYQACMAVNTCKVIDADGLYWLAQDPVHSSQLILTPHPGEAARLLKCNTRDIEANRFEHALSLHNQYHAQIVLKGAGSLISSTRGNWLIDRGSPAMASGGMGDCLAGLIGALVAQGLAPAQALTAGVYWHAVAGEVAGSKAPRGTLASDLMPIIRKLVNGWIPE

SEQ ID NO: 64256 - protein, 520 aa, Mesorhizobium loti MAFF303099
MKTANHPDTVLIVDFGSQFTQLIARRIREAGVFSEIVPFQSAEAAFKRINPKAVILSGGPASTSDIGSPRAPQIVFDAGVPVLGICYGQMAMCVQMGGVAESSNHREFGRAFVEIEKDSPLFEGLWATGQRHQVWMSHGDRVIALPPGFQVFGKSESSPFAIFGNVERKMYGIMFHPEVVHTPDGARLLRNFVHNIAGIEGDWTMRAYREHAVEAIRKQVGKGKVICALSGGVDSSVAALLIHEAVGDQLTCILVDHGLMRKDEAAGVVAMFRQHYNLPLILVDASEKFISALEGEVDPEKKRKTIGRLFIEVFEEEAKKLGGADFLAQGTLYPDVIESVSFTGGPSVTIKSHHNVGGLPERMNMQLVEPLRELFKDEVRALGKELGLPESFIGRHPFPGPGLAIRCPGGITREKLEILREADAIYLDEIRKAGLYDAIWQAFAVLLPVQTVGVMGDGRTYEFVCALRAVTSVDGMTADFYHYDMAFLGAAATRIINEVRGINRVVYDVTSKPPGTIEWE

SEQ ID NO: 64257 - protein, 1338 aa, Yarrowia lipolytica CLIB122
MSMPNVSAPTLAIPETNGARAIGAALAGATAAGRKRSGSLDAPSAATVTRGGTTSPLLCNSAYSPHPGSSSPGGYFDSNHNLSVRTLSTPASPNDNASVHPVTPQTVPATNNSNTVRPKSPSRQPSNTYAPARHPSQNNQRGTRKTSQGAVPSVSGSKPSSNAQYYAQERAYLQKMRNNLADDYYTKGIPASDLDRSSDEESLSEFEGDFVGLGGVGTFFDDSGAISYPFLEAKYNADDAEKSESIRERLQWQSMLTSVLTGEVVKNEKQRLRAPPEMDKKLVAEELWMGVRAKVCGRSMDEQRRIIEYSRNTKDGILLEVVNFRAKPADEAGGRSASDQVEDLLNRLDNFEQLWRSYSLIETDKPFYGSQEFQERLTALLTWSSLTWNIGTEIRLLQQWIGNEDIDLTRPAEGNDMMADKSPFIERLLKGQDLKNIFENRVLGPLSQLVDRARTSALEYHDTFQTLGLPVLYDHIGSLARFPSLLIMEVMRTRLNYARKLANPTMMMIDQTMVDIRGYIELSLKAKERYMFFVSPTQDGPWPLKDTIGDAFDETLIDCVSFYFDLLSRKFLESSNAVFRTFKEGEQLEFQYKFLSKIGEWISGGDYLVAEQFSYLTSKLMTKLLDYWQDSLKGPASDQANEIAAFYSETAEQIRSFERNLIRFYTSMCSSYENASEYAIQPSRLGAIVNSVRRANYFLVYTGVLERDGIYVFADPSLRERPHKLKEIIRGYSRYRRPEEDSVEYDHIAHVLILCSEEPFIWEGEILNIDMPSFDLEIKMGRMRIVSEGGTHMLQLAKTQFAEVCEREFLNTVVEAKSNQLRVDHEFGRLRKLFFRLSMSVIDNVATIRHTLKGLGCQDTVQNMFVFAREFGQRGLRSLEGPKRGYVTMKLINLCIEWVSFVVDDCTSTEYRTFRYTVTALEFASVMTSGVNILAVNEEAFLRLRVKVAGCMSLLISHFDIMGARSKAKAQQKVEVTSARRKKISHMSFKDDTELMEAFRNDAVKKLEDLERKRNDLEFEHHYVGRVLDDGSADDQFLMSLASAFSNVTMRWQLGRFIGSGTFGDVYSALNLDNGEMMAVKEIRLQDAQSIRTIVKAIKDEMTVLEMLHHPNIVQYFGVEVHRDRVYLFMEICQGGSIADLLSHGRIEDEQVIQVYTFQMLQGLAYLHHAGIVHRDLKPENILLDHNGLIKFVDFGAAKVIARNGRTRAAQTGTRSKINSLTGTPMYMSPEVITGSNPGRQGAIDIWSLGCVVLEMATGRRPWSNLDNEYAIMFHIASGHMPQLPSAEQLSPEGQAFLLKCLDRDPNKRESAIELSNDPWLARVKNDHLEQLTPMGEE

SEQ ID NO: 64258 - protein, 223 aa, Pseudomonas fluorescens PfO-1
MAIRAVLFDMDGTLLDTAPDFIAICQAMRADRGLPPMNDKHIRDEISGGARAMVAVTFSMDPESPGFEELRLEFLERYLVGCAVHSKLFDGMGELLADIEKANLVWGVVTNKPLRFAEPIMRQLGLAERSALLICPDHVKNSKPDPEMLTLACKMLDLDPSTVLFIGDDLRDIESGRDAGTRTAAVTYGYIHPDDNPRHWGADVVVDHPLELRKVLDNALCSC

SEQ ID NO: 64259 - protein, 495 aa, Cryptococcus neoformans var. neoformans JEC21
MSATVAEVTFNTGLYINGLWKNGRGEPLLSVNPATEEVIAEVQTASKEDVDEAVKAARHCFETAWGTEVSSQLRGQLLFKLADGMEAAMEELAKLEYLDSGKPLAWCKADIEDSVACLRYYAGSADKIQGSMIELDDKHKHALARKEPIGVCAQIVPWNYPLLMMIWKIAPALAAGCTIVFKPAEQTPLSTLKFAELFELAGYPAGVFNLVNGLGRTTGDALSRHMDVDKIAFTGSTITGRRIAIAAAESNLKSVTLELGGKSANIVFDDANLQEAAKWAAFGVYENMGQSCSAGSRVLVQESIYDQFITHFKAAAEAFKVGDPADPDTFQGPQVNEAQFRKVLDYIESGKRSGAKLLTGGSRHGSRGYFIQPTVFGDVTMDMKIAREEIFGPVASVIRFKDEADAISIANNTEYGLAAAVHSQNYARVQRVTRKLKAGTVWINQYVALSHQVPFGGYKQSGWGRELGLEGLEPYLITKSVHHYYGGDFEWPIKI

SEQ ID NO: 64260 - protein, 174 aa, Legionella pneumophila subsp. pneumophila str. Philadelphia 1
MLSINELNPSLFCAIFIQRVANLVLIRESAMAHLIHSVLPVPPRKIAYIHPDDSVKECIKQMVEKDIGALVVFDNDAHLIGIVSERDILRCYFHKSLSLETAKVSDVVYTNVTILSPHDSVEKAMQVITETKRRHVLIQEEGELLAILSIGDLLYHVLEDKLRVIEHLENYIHS

SEQ ID NO: 64261 - protein, 362 aa, Rhodococcus erythropolis
MPQQVRGVIARSKGAPVEIVPITIPDPGANEVVVAIAACGVCHTDLTYRDGGINDEYPFLLGHEASGIVESVGPGVTHVEVGDFVVLNWRAVCGQCRACKRGRPQYCFDTFNAEQKMTLEDGTELTPALGIGAFADKTLVHEGQCTKVDASADPAVVGLLGCGVMAGMGAAMNTGNVGRGDSVAVIGCGGVGDAAIMGSRLAGANTIIAIDRDPRKLEWATELGATHTINATEVDDVVEAVQELTGGFGADVVVDAVGRPETWKQAFYARDLAGTVVLVGVPTPDMKLEMPLVDFFSRGGALKSSWYGDCLPERDFPVLVDLYQQGRLPLEKFVSERIKLDEVEKAFETMHRGEVLRSVVVL

SEQ ID NO: 64262 - protein, 289 aa, Brassica napus
MAAGKEIFHKMKESVKEKVGLGASDSADSGKGKSKMSKQITHGFHLVKGKAFHEMEDYVVAKFKEVDDNELGLFAIFDGHLSHEIPDYLCSHLFDNILNEPNFWQEPEKAIKKAYYITDTKILDKASDLGKGGSTAVTAILINCQKLVVANVGDSRAVLSKGGVAKPLSVDHEPNMEKDEIENRGGFVSNFPGDVPRVDGQLAVARAFGDKSLKMHLSSEPYVSLEILQDDAEFLILASDGLWKVMSNQEAVDSIKGIKDAKSAAKHLSEEAVARKSSDDISVVVVKFH

SEQ ID NO: 64263 - protein, 495 aa, Prosthecochloris aestuarii DSM 271
MPKREDIKSILVIGAGPIVIGQACEFDYSGTQACRALKEDGYRVILVNSNPATIMTDVEFAHSTYIEPITPEYVQKIIEKEKPDALLPTMGGQTALNTAVALAERGILERNGVELIGAKLRAIRKAENRELFSDAMKKLGLEMAKGFFVRNEKEAKEALESIGLPIVIRPSFTLGGTGGGFAETKADYYDAVRRGIAESPIGEVLVEECLIGWKEFELEVIRDLADNVIIVCSIENVDPMGVHTGDSITVAPAQTLSDRQYQALRDASVKIIREIGVETGGSNIQFAINPDNGRIVVIEMNPRVSRSSALASKATGFPIAKVAAKLAVGYTLDEIQNDITKSTPASFEPVIDYCVVKVPRWDFEKFKNVDARLGVQMKSVGEVMAFGRNFREALQKSLRGLEIGRAGLGCDGKDIMNVLGMTPQQKKFAKDDVLEKIRIPKADRMFYLRYAFQAGATVEEVHESTKIDPWFLDNIRQIVDCEAELRLLAETQASS

SEQ ID NO: 64264 - protein, 184 aa, Arabidopsis thaliana
YPYIAGMGVYVFRKEGLLKLLRSSYPTSNDFGSEIIRARRKLHNVQAFLFNDYWEDIGTIGSFFDANLALTEQPPKFQFYDQKTPFFTSPRFLPPTKVDKCRILDSIVSHGCFLRECSVQHSIVGIRSRLESGVELQDTMMMGADFYQTEAEIASLLAEGKVPVGVGQNTRIKNCIIDINARIG

SEQ ID NO: 64265 - protein, 183 aa, Arabidopsis thaliana
YPYIAGMGVYCFKTEALLKLLTWRYPSSNDFGSEIIPAAIKDHNVQGYIYRDYWEDIGTIKSFYEASIALVEEHPKFEFYDQNTPFYTSPRFLPPTKTEKCRIVNSVISHGCFLGECSIQRSIIGERSRLDYGVELQDTLMLGADSYQTESESRLLAEGNVPIGIGRDTKIRKCIIDKNARIG

SEQ ID NO: 64266 - protein, 349 aa, Bacillus cereus E33L
MKAAVWYGQKDIRIEDKELKPLKDNEVTVRVAWAGICGSDLHEYQEGPVFVPVDAPDELTGEVAPIIMGHEFAGVVEKVGSAVKKYKVGDRVVVNPTITHGNKPEDIDCYDGFSFIGLHGDGGFTTFANAPEHNIYKLPDTLTLQDGALVEPTAVAVQAVKEGGMQFGDTVAIFGAGPIGLLTTIAAKAAGASKILVFDLSETRLEKAKELGATEVFNSGKINPVEAVKQHAPNGVDVTFEVAGVAPTFKSAIDVTRPRGTVVIVSIFAHSIEWNPMQLTNTGVKVTSTIAYTPTSFQQTVDLMGTGQLKPQGIVTSQIELENIVEKGFEALTSDKSQAKILVKLSGEM

SEQ ID NO: 64267 - protein, 466 aa, Mesorhizobium loti MAFF303099
MVEPALSLNETGAPTNERFHLIQAAPLAGSIGAEARELITSSEDIFVTDQSGRKLIDGPAGMWCINVGHRNQALADTLRDQAMSMTYSTPWYTSNAPAEKLAQMLAERAPGDLNHVFLTTGGSSAVETAIRLVQFYNNVRGLPQKKLLISRQGSYHGSTYLTASLNGRPRDHDWMDGAGDLVRKLTCPNPFHRPANLSLEAFEDFLVNEFRALIEHEGAQQIAAFIAEPIQASGGVLMSPPNYLKRMRALCTENDILFITDEVVTAFGRLGHIFASQDVFGIQPDMITFAKGVTSGYFPLGGVMVSDRLLSELRRLNHPKANFVHGLTYSSHPIGCAVAIRNIELLEDGLLHHAREIGPYFQEQLRTLEELPLVGEVRGAGLMAGIECVADAKTEDRLDLDLTVGKRIDFHCQENGLLVRPLINMCVMSPPLTISRSQIDMMTDALRKGIEATADDLIREGLWKPA

SEQ ID NO: 64268 - protein, 446 aa, Arabidopsis thaliana
MDFSGLFLTLSAAALFLCLLRFIAGVRRSSSTKLPLPPGTMGYPYVGETFQLYSQDPNVFFAAKQRRYGSVFKTHVLGCPCVMISSPEAAKFVLVTKSHLFKPTFPASKERMLGKQAIFFHQGDYHSKLRKLVLRAFMPDAIRNMVPHIESIAQESLNSWDGTQLNTYQEMKTYTFNVALISILGKDEVYYREDLKRCYYILEKGYNSMPINLPGTLFHKAMKARKELAQILANILSKRRQNPSSHTDLLGSFMEDKAGLTDEQIADNIIGVIFAARDTTASVLTWILKYLADNPTVLEAVTEEQMAIRKDKKEGESLTWEDTKKMPLTYRVIQETLRAATILSFTFREAVEDVEYEGYLIPKGWKVLPLFRNIHHNADIFSDPGKFDPSRFEVAPKPNTFMPFGSGIHSCPGNELAKLEISVLIHHLTTKYRLVHLQNDNSPFGN

SEQ ID NO: 64269 - protein, 496 aa, Mesorhizobium loti MAFF303099
MPSAAEPMARTNNNLTGASMQSDNASKFYIDGQWVMPGGAGRMDVVNPATEQSFMQIAIGTTEDADLAVQAAFEAFPTFSQTSRTERVELLRNVLRCYNDRYDDIARAVSTELGAPLKFAREAQAWAGQIHLESTIAALEAFSFDELHGSSMITWEPIGVCALITPWNWPLNQIVCKVAPALAAGCTVVLKPSELAPLSAIIFAEVLEEAAIPKGVFNLINGTGPEVGQYLAGHPRVDMVSFTGSTRAGIMVAKTAAETVKRVAQELGGKSANIVLADADLENAVVKGVEACFSNSGQSCDAPTRLLIPADRHAEALDIARRVAAATRVGDPSSEDTDMGPVISQQQFDKIQRMIGLGIEEGATLVAGGPGKPEGLDVGFYVKPTIFGGVTPEMTIAREEIFGPVLSIIPYDTEADAIRIANDSIYGLAAYVQGGSLEGARAVARKLQAGSVYVNYAPWDTHAPFGGYKQSGNGREYSHWGIRDFMEVKGIVGWGA

SEQ ID NO: 64270 - protein, 340 aa, Triticum aestivum
MATQLLSTVAHRDTLPEGYTRPENDRPQLADVVTDSNIPLIDLASPDKHRVIAEIDQACRTYGFFQIINHGISEELLEKVMAVGLEFFRLPPEEKAKLYSDEPSKKIRLSTSFNVRKETVHNWRDYLRLHCHPLEEFVPDWPSNPETFKEIISTYCCEVRLLGLRLLGAISLGLGLEEDYIENVLGEQEQHMAVNYYPRCPKPDLTYGLPKHTDPNALTILLMDPHVSGLQVLKDGAQWIAVDPRPNALVVNLGDQLQALSNGAYKSVWHRAVVNAARERLSVASFLCPCNSAVIGPVAKLVGDGDEPVYRSYTYDEYYKKFWSRNLDQDHCLELFTGQK

SEQ ID NO: 64271 - protein, 377 aa, Idiomarina baltica OS145
MNSINAKPPIIWLNVWVFAITFAIAAIGVPVYAYVHGIDSSLWWAMIGTACFAGISITAGYHRLWSHKAYKAHPIVRFLFAIGGAVALQNSVLHWSSDHRVHHTHVDDNDKDPYSAKRGFWYSHIGWMLREYQASRYSDYNNVKDLQEDPIVMWQHKHYLSLTLLTNFGWPLLFGWMVGDVLGGLLVVGVLRLVLNHHTTFFINSLAHIWGSQPYTDKNTARDNGVLAFLTFGEGYHNYHHIFSADYRNGIRWYQFDPTKWLIRGLSYAKLTTDLKRTSGYQIERAKLTMQLTRASKKAKSAPQVLIDSAHEHYQQMATCLREYYQTRKKLLDAKAKQLKEQVHFDGLQDRIDELKQNLDEQQRHWRSLLSEIKRYA

SEQ ID NO: 64272 - protein, 436 aa, Geobacter metallireducens GS-15
MATTQLEYARQGIITDKMKEAALAEGVSPEFIREGIAAGTIIICHNIKHGNGRPLAVGKGLRTKVNANIGTSADDTDITKELEKARVAVRHGADAIMDLSTGGPVDEIRRAIIAETNACIGSVPLYQAALDAVRTKKKAIVDMTVDDIFEGIIKHAEDGVDFITVHCGVTRSTVERMKNEGRLMDVVSRGGAFTVEWMAYNNCENPLFEHFDRLLEITKAYDMTLSLGDGFRPGCLADATDRAQIHELIILGELTQRAQAAGVQVMIEGPGHVPLNQIEANILLQKRLCHGAPFYVLGPLVTDIAPGYDHITCAIGGAIAASAGADFLCYVTPSEHLRLPSVEDVREGVIASRIAAHAADIAKGVKGAMEKDIAMAKCRKKLDWEGQFNLSLDPEKAQRLRAESGVAEHGACTMCGEFCAYKVMDDAMEKQRAAGH

SEQ ID NO: 64273 - protein, 370 aa, Oryza sativa (japonica cultivar-group)
MTKQSVVVPEVAVPMPPNSAPLLPYPPPRAAPGVAVRKKYLQAQLDLGAGLPLINGWVESMRASSPTHAKAAAALAAAGAVDDERAAWMVRHPSALSKFEQIVAASKGKKIVMFLDYDGTLSPIVDDPDSAFMSDTMRRAVRSVAKHFPTAIVSGRCRDKVFEFVKLAELYYAGSHGMDIKGPAKASRHNKAKAKGVLFQPASEFLPMIEQVHDSLIERTKCIPGAKVENNKFCVSVHFRCVDEKSWSTLADIVKAELKDYPKLKLTQGRMVFEIRPTIKWDKGKALEFLLESLGFADCTNVLPVYIGDDRTDEDAFKVLRKRGQGIGILVSKYPKDTNASYSLQEPAEVMEFLLRLVEWERLSRARPKW

SEQ ID NO: 64274 - protein, 175 aa, Salinibacter ruber DSM 13855
MVWPNSYTSSNALPAMDERELVETRVRDVLRTKGTLQQNGDVLTATPTDTVYECIDAMVDRGIGSIVITEDDEMVGIFTERDYMRDIALKGRSSPETEVQEVMTEDVVTAEAEDQLRDCLDRMNDLQCRHLPVVDDEGNLADIISMRDCAKQVAESAESGATQLVNYVTGQYSTR

SEQ ID NO: 64275 - protein, 536 aa, Corynebacterium efficiens YS-314
MTTTVIVGGVAGGMSTAARLRRRDEEMEIIVLEASGYVSFANCGLPYHVSGVIPERDSLLLQTPESLAQRFNLDVRVNTRATSIDRENKTVTTENGEVISYDYLVLSPGAAPIMPPIPGIERALTLRTVEDVDTVIAALSEDVKTAAIIGGGFIGLEMAENLRHRGLEVTVIERAPQIMTPLDEEMALIVEKHLVDNGVTVITGGDTTDIAADHLTLSDGRTVPADVVIASIGVKPASDLAADAGLEVGERGGIKVDDQQRTSDPSIFALGDAAEKLDAVSGEDTLVPLAQTANRHGRLVADIITGRDVRRTPTLGTAIVGLFDMAAGSVGWNERRARAAGKNIRVIHTHPSDHAGYYPGAEMLHLKLVVDADTDAILGAQAVGGAGVDKRIDVIATAMRGGLTATDLADLELAYAPQFGSAKDPVNLLGYVNDNMVSGEKTVQWHELNDALSDGWTLVDVRTPGEFNAGTIPGAVNIPVDDIRDRIDELEGRKALAFCRVGQRGHVAASLLTHLGVESANLDGGFITWELSPANK

SEQ ID NO: 64276 - protein, 171 aa, Zea mays
MLKQHYARYTPDLVQQACGTPKEKFLKVCEMLASTAVPGRAGTVLYALGWTHHSIGAQIIRTGAMVQLLLGNIGIAGGGMNALRGHSNIQGLTDLGLMSNLLPGYMTLPMQAEQDFDGYIKKRTQLPLRPNQLSYWKNYKAFHVSFMKSWWGDAATAENNWAYDYLPKLDK

SEQ ID NO: 64277 - protein, 294 aa, Sinorhizobium meliloti 1021
MFKGSIPALVTPFTAAGSVDADSFVAHVEWQIKEGSHGLVPVGTTGESPTLSHDEHKKVVELCVEASARRVPVIAGAGSNNTIEAIELAQHAEKAGADAILVVTPYYNKPTQKGLFAHFAAIAESVKLPIVIYNIPGRSVVDMSVETMAALAKAHPTIVGVKDATGRIERVSEQRMACGKAFVQLSGEDATALGFNAHGGVGCISVTANVAPRLCAEFQEATLAGNYAKALELQDKLMPLHKAIFLEPGVCGAKYALNRLGRMSFTVRSPLLSALEPATASAIDAALRHAGLMN

SEQ ID NO: 64278 - protein, 186 aa, Arabidopsis thaliana
YPYIAGMGIYVVSRDVMLDLLRNQFPGANDFGSEVIPGAPFLGLRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETATEKSLLSAKGSVPIGIGKNSHIKRAIIDINARIG

SEQ ID NO: 64279 - protein, 178 aa, Helicobacter hepaticus ATCC 51449
MDKQKIADSIRAVYNYKPGVIFRDITTLIGDAEVFKEVINILRSRYENQSIDFIAAIEARGFIFGSALAYALGIGFVPIRKKGKLPYNTISEKYTLEYGTDELHIHTDAFRDKKNAKVVLIDDLIATGGTAEASVKLIKSIGAQCVEAAFVINLKGLEGEKKLAPYTQVFSIVEYEGK

SEQ ID NO: 64280 - protein, 503 aa, Chrysanthemum lavandulifolium
MTTIPSRQLFIDGEWREPVKKNRIPVINPSTEQIVGDIPAATAEDVDVAVKAARKALKRNGGKDWASATGAHRAKYLRAIAAKITGKKELFSKLEAIDCGKPYDEAAWDIDDVAGCFEYNADLAEALDKKQNAPIELPMDTFKCHVIKEPIGVVGLITPWNYPLLMATWKVAPALAAGCAAILKPSELASLTCLELGEVCKEVGLPAGVLNILTGLGPDAGAPLAAHPDVDKIAFTGSSATGSKIMTAAAPNVKPVTLELGGKSPIVVFDDVDIDKAVEWTLFGCFWTNGQICSATSRLILHESIAKEFLDKLVKWAKNIKISDPLEEGCRLGPVVSSGQYERVLKFVETARSEGATILSGGQRPQHLKKGFFIEPAIITDITTSMQIWRDEVFGPVLCVKTFSSEEEAIELANDTHYGLGSAVISNDLDRCDRVTRAFDAGIVWVNCSQPCFCQAPWGGKKRSGFGRELGEWGLDNYLSVKQVTRYISNDAWGWYTPPSPKL

SEQ ID NO: 64281 - protein, 384 aa, Rickettsia bellii
DISKVYSEADCFTYDPGFMSTASCRSTITYIDGDQGILRHRGYDIKDLAEKSDFLEVAYLLIYGELPNNKQYNDFTKKVAHHALVNERLHYLFQTFCSSSHPMAIMLAAVGSLSAFYPDLLNFFKEADYELTAIRMIAKIPTIAAMSYKYSIGQPFVYPDNSLDFTENFLHMMFATPCEKYKVNPVIKNALNKIFILHADHEQNASTSTVRIAGSSGANPFACVSTGIASLWGPAHGGANEAVINMLKEIGSVENIPKYIAKAKDKNDNFRLMGFGHRVYKNYDPRAAVLKETCKEVLKELGQLDNNPLLQIAIELEAIALKDEYFIERKLYPDVDFYSGIIYKAMGIPPQMFTVLFATARTVGWMAQWKEMHEDPEQKISRPR

SEQ ID NO: 64282 - protein, 506 aa, Chrysanthemum lavandulifolium
MTTTIPIPSRQLFIDGEWREPVKKNRISVINPSTEQIVGDIPAATAEDVDVAVKAARKALKRNGGKDWASATGAHRAKYLRAIAAKITEKKELFSKLEAIDCGKPYDEAAWDIDDVAGCFEYNADLAEALDKKQNAPIELPMDTFKCHVIKEPIGVVGLITPWNYPLLMATWKVAPALAAGCAAILKPSELASLTCLELGEVCKEVGLPAGVLNILTGLGPDAGAPLAAHPDVDKIALTGSSATGSKIMTAAAQNVKPVTLELGGKSPIVVFDDVDIDKAVEWTLFGCFWTNGQICSATSRLILHESIAKEFLDKLVKWAKNIKISDPLEEGCRLGPVVSSGQYEKVLKFVETARSEGATILSGGQRPQHLKKGFFIEPAIITDITTSMQVWREEVFGPVLCVKTFSSEEEAIELANDTHYGLGSAVISNDLDRCDRVTRAFDAGIVWVNCSQPCFCQAPWGGKKRSGFGRELGEWGLDNYLSVKQVTRYISNDAWGWYTPPSPKL

SEQ ID NO: 64283 - protein, 341 aa, Idiomarina baltica OS145
MKALAKLHSKPGIWMTDVEKPEFGYNDVLIKIKKTAICGTDVHIYKWDDWSQKTIPVPMVVGHEYVGEVAAMGDGVRGFEVGDRVSGEGHITCGHCRNCRAGRRHLCRNTYGVGVNRPGAFAEYLVIPADNAFKLPDDVTDDMAAIMDPLGNAVHTALAFDLVGEDVLITGAGPIGIMAAAVARHVGARHVVITDVNEYRLELAKKMGVTRAVNVAEESLKDVMSELGMKEGFDVGLEMSGVPSAFSQMLATMNHGGKVAMLGIPPENVAIDWNEVIFKGLVIKGIYGREMFETWYKMASLLQSGLDISPILTHQMSVDDYEEGFETMVSGQSGKVILNWD

SEQ ID NO: 64284 - protein, 385 aa, Rickettsia rickettsii
MTNENNNDSEFAELKIRGKIFKLPILKASIGEDVIDISRVSAEADCFTYDPGFMSTASCQSTITYIDGDKGILRHRGYDIKDLAEKSDFLEVAYLLIYGELPSGEQYNNFTKQVAHHSLVNERLHYLFQTFCSSSHPMAIMLAAVGSLAAFYPDLLNFKEADYELTAIRMIAKIPTIAAMSYKYSIGQPFIYPDNSLDFTENFLHMMFATPCTKYTVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAVVLKETCKEVLKELGQLDNNPLLQIAIELEAIALKDEYFIERKLYPNVDFYSGIIYKAMGIPSQ

SEQ ID NO: 64285 - protein, 394 aa, Aspergillus nidulans FGSC A4
MASQSFPPPPVDTIDWSNIGFKVREVNGHVESHYTPATKSWSPPKLVKSPYLPIHGMAPGLNYGQQAYEGLKAFRHPNNSKITIFRPDRNALRMQRSASFISIPPVPEDLFLEAVELAVGANAGFVPPHETGAAMYIRPLIFGSSAQLGLSPPEEYTFVVFVMPTGVYHGVHAVDALILEDFDRAAPEGTGSAKVGGNYAPVLRHSAKAHAEGFGITLHLDSRTRSEIDEFSTSGMIAVKKNKESGKVTLVQPDSPNVIDSVTAASVCEIGKLWFGYDVEKRRIPYEELNEFDEVMAAGTAAALVPIRSITRRSSGNRFEYECGGEEAGGGEVCVKLLRTLKGIQLGKIEETLGWNRVVKAPPAEWVGAADEKEEAGIEVPQACRMICTASNWY

SEQ ID NO: 64286 - protein, 294 aa, Shigella flexneri 2a str. 2457T
MIKKIFALPVIEQISPVLSRRKLDELDLIVVDHPQVKASFALQGAHLLSWKPAGEEEVLWLSNNTPFKNGVAIRGGVPVCWPWFGPAAQQGLPAHGFARNLPWTLKSHHEDADGVALTFELTQSEETKKFWPHDFTLLAHFRVGKTCEIDLESHGEFETTSALHTYFNVGDIAKVSVSGLGDRFIDKVNDAKEDVLTDGIQTFPDRTDRVYLNPQDCSVINDEALNRIIAVGHQHHLNVVGWNPGPALSVSMGDMPDDGYKTFVCVETAYASETQKVTKEKPAHLAQSIRVAKR

SEQ ID NO: 64287 - protein, 590 aa, Pseudomonas fluorescens PfO-1
MCGLAGELRFDQQPADLAAIERITHHLAPRGPDAWGFHAQGPIALGHRRLKIMDLSDGSAQPMIDSQLGLSLAFNGAIYNFPELRAELEALGYAFYSGGDTEVLLKGYHAWGEALLPKLNGMFAFAIWERDAQRLFIARDRLGVKPLYLSRTGQRLRFASALPALLKGGDINPILDPVALNHYLNFHAVVPAPRTLLAGIEKLPPASWMRIEADGTTEQKTWWTLPYGPHADEKNLTLEDWRDRVLDSTREAVAIRQRAAVDVGVLLSGGVDSSMLVGLLREVGVENLSTFSIGFQDAGGERGDEFQYSDLIAKHYGTQHHQLRIDEKEIIEQLPAAFRAMSEPMVSHDCIAFYLLSREVAKHCKVVQSGQGADELFAGYHWYPQVDGAADPYAAYREAFFDRSYDDYAATVQPKWLTANDAAGDFVKEHFAQPGADAAVDKALRLDSTVMLVDDPVKRVDNMTMAWGLEARTPFLDYRLVELSARIPGQFKLPDGGKQVLKEAARRVIPSEVIDRKKGYFPVPGLKHLQGETLSWVRELLLDPSQDRGLFNPAMLDQLLTDPQGQLTPLRGSKLWQLAALNLWLSEQGI

SEQ ID NO: 64288 - protein, 500 aa, Legionella pneumophila subsp. pneumophila str. Philadelphia 1
MMIRNSMKSHTELLSWNLLQKEADRVRLNSDSLTCVVPDSNNYESSKQINCIEYDYSRQRVNRTIIDLLIDLANEVKLQEKIDNLINGKKINISENRPALHTALRDLGNKSIMIDGLDIMSAVINTREKIKVISNQIREKKWLGHSGLPITDIVNIGIGGSDLGPRVCINALSNYISKEFNYHFISDVDPASFNDVIAKINPQTTLFIVSSKSFTTKETLLNARKAFALYEDTASIDQHFIAVTAHPERAYQMGIKTVLPIWDWVGGRFSFCSAVNLITAIAIGYEQFVELLAGAHDVDTHVQFTDFKNNIPVLMALIGIWNNNFLNIHNLLILTYSKKLEYFVPYVQQLDMESNGKSIDVNGSMVDYATGPIVWGGLGNQAQHSYFQLLCQGTHRCVGDFITLKTNDEHEINSMCHYKMKVLSEGIQTIENPYGYIPGNMPMNHLILSDCSPYTLGALVALYEHKIFVQSVIWNINPFDQPGIESAKSAHREITLSSES

SEQ ID NO: 64289 - protein, 141 aa, Geobacillus kaustophilus HTA426
MQTVRDVMSTDVQYCTPLDNLYEAAVKMRDFNVGAIPIIDDGRLVGMITDRDIVVRGMAEKRPGSTAVTEVMSRDLVTLSPDDSVQKAADMMARHQIRRLPVVENGRLVGIISLGDLATNRYSDERAGRALSEISEQDAIH

SEQ ID NO: 64290 - protein, 222 aa, Oenococcus oeni PSU-1
MSKLVLIRHGESTANHDNIFTGWTDVPLTEKGISQAHVAGKQLSHSGIDFDIVYTSMLQRAIVTSYIILNEINQAWLPIVKSWRLNERHYGALRGLNKAETAQKYGDTQVREWRRSYTTVPPLLGHEESSERYLKLGIKEPLGESAEMSWKRVQPFWEDQIAKQLRSEKNVLLVAHGSSIRVLLKFLDRISDDNFMKVEVGNGEPIIYNFDQQLKVISKSNL

SEQ ID NO: 64291 - protein, 383 aa, Rickettsia sp. COOPERI
DISRVSAEADCFTYDPGFMSTASCQSTITYIDGDKGILRHRGYDIKDLAEKSDFLEVAYLLIYGELPSGEQYNNFTKQVAHHSLVNERLHYLFQTFCSSSHPMAIMLAAVGSLSAFYPDLLNFKEADYELTAIRMIAKIPTIAAMSYKYSIGQPFIYPDNSLDFTENFLHMMFATPCTKYTVNPIIKNALNKIFILHADHEQNASTSTVRIAGSSGANPFACISTGIASLWGPAHGGANEAVINMLKKIGSSEYIPKYIAKAKDKNDPFRLMGFGHRVYKNYDPRAAVLKEACKEVLKELGQLDNNPLLQIAIELEAIALKDEYFIERKLYPNVDFYSGIIYKAMGIPSQMFTVLFAIARTVGWMAQWKEMHEDPEQKISRPR

SEQ ID NO: 64292 - protein, 214 aa, Brassica napus
MKIRLSITLVLLSYTAAMVAGQQCGRQAGGQTCAGNICCSQYGYCGTTGDYCSPDNNCQSNCWGSGPPSGSGESATGVRATYHYYNPAQNNWDLRAVSAYCSTWDADKPYSWRSKYGWTAFCGPAGPRGQASCGKCLRVRNTRTNAAVTVRIVDQCSNGGLDLDVAMFNQIDTDGDGYRKGHLIVDYQFVDCGNELIDQPADFKNILVSATDRV

SEQ ID NO: 64293 - protein, 974 aa, Zizania latifolia
MAAAGIRFIGIKQPKLEMILPDRAYGFFSHTHKAQKENMPLLDKILEERVSLFDYELIVGDDGKRLLAFGKFAGTAGLIDFLHGLGQRYLGLGYSTPFLSLGQSHMYPSLAAAKSAVIAIGEEIATFGLPSGICPIVFVFTGTGSVSQGAQEIFKLLPHTFIDAEKLPELSAVQSTKRVFQLYGCVVSSRDMVTPNDPNTRFNKADYYAHPEHYRPVFHERIAPYASVIVNCMYWERRFPRLLSIDQFQQLMKNGCPLVGISDITCDIGGSIEFVNKSTSIESPFFRYDPSTNSCHDNMEGSGVICLAVDILPTEFSKEASQHFGDILSKFVASLASAKGLLELPLHLRKACIAHAGGLTSLYEYIPRMRKTLIELPPAPTNPLLDKKYSTLVSLSGHLFDKFLINEALDIIETAGGSFHLVRCDVGQSIDDTSYSELEVGADDTATLDKIIDSLTSLAALHGDTNARRDIELSLKIGKVNECGTDDSMVEGGSMVLILGAGRVCRPAAEFLTSYSNFISSSDNNRDTDQIHVIVASLYKKDAEETIDGIKNATATQVDVADTKNLSNLVSQAEVVVSLLPASFHAAIARVCIELKKHLVTASYVDEPMSKLDQAAEGAGVTILCEMGLDPGIDHMMSMKMIDEAHARKGKIKSFTSFCGGLPSPASANNPLAYKFSWSPAGAIRAGRNPAVYKFLGEIIHVDGDKLYESAKRLRLPELPAFALEHLPNRNSLMYGDLYGISEEASTVYRATLRYEGFSEIMATFAKIGFFDVVNHPLLQQTTRPTYRDFLIELFNAQNISTTAIKGSSEVSGGQEGELISRLLSFGHCKEKEIAVKTVKTIKFLGLYEETEIPKNCSSAFDVICQRMEQRLAYGHNEQDMVLLHHEVEVEYPDGRPTEKHQATLLEFGKVENGRSTTAMALTVGIPAAIGALLLLQNKIQRKGVIRPLEPEIYIPALEILESSGIKLAERVET

SEQ ID NO: 64294 - protein, 205 aa, Vibrio cholerae O1 biovar eltor str. N16961
MEQGMSKRILVPVAHGSEEMETVIIVDTLVRAGFQVTMAAVGDKLQVQGSRGVWLTAEQTLEACSAEAFDALALPGGVGGAQAFADSTALLALIDAFSQQGKLVAAICATPALVFAKQQKFVGARMTCHPNFFDHIPSERLSRQRVCYYATQHLLTSQGPGTALEFALAMIALLAGVELAQHVAAPMVLHPQQLTELSGFIDAQS

SEQ ID NO: 64295 - protein, 625 aa, Xanthomonas oryzae pv. oryzae KACC10331
MNSSRRLPARPVELQEKQMAVIEIKVPDIGDYSDVPVIEVLVAVGDSVAKDQGLVTLESDKATLEVPSSAAGVVKELKVKVGDILSEGALVLLLETEGEAAAPAKAETKAAPAAVAPAAAPGSKPPVTPSHRAPAEPAPSKPALASDKPADIACKMVVLGAGPGGYTAAFRAADLGLDTVLIERYASLGGVCLNVGCIPSKALLHAAAVIDEVAHAGDFGVDFGQPKITLGTLREYKEKVVGKLTGGLASMAKQRKVRTVTGVATFVSPNELEIVGDDGKTQLLRFEHCIIAAGSQAVKLPNFPWDDKRVMDSTDALELHDIPKTLLVVGGGIIGLEMATVYSALGSKVTVVEFMDQLMPGADKDLVKPLADRLKKQGVDVHLKTKATDVTAGKKGITVSFEAAVEGDKPGLQATAYDRVLVAVGRSPNGKKIGADKAGVTVTERGFIPVDRQMRTNVPHIFAIGDIVGNPMLAHKATHEGKLAAEVAAGEKKEWVARVIPSVAYTNPEIAWVGVTETEAKAKGLKVGVAKFPWAASGRAIGIGRTEGFTKLIFDEETHRVIGGAIVGVHAGDLLAEIGLAIEMGAEAEDIGHTIHAHPTLSESVGMAAEVYDGTITDLYIPKKK

SEQ ID NO: 64296 - protein, 683 aa, Oryza sativa (indica cultivar-group)
MAQSRSHAMAAFAFVVVFLLSGAPGARSQQPYGSQVADCPNKHNDTGLLGYFCSSGGGGGAPSSSSSSCQTYLTFHATPRYPDLAAIASLLGADASSLAAANSAASPTAALAPGAKVLVPATCSCTGAAYYQRNATYVAVAGDTLLVIANDTFQGLSTCQAVQEQALGDAPARSLLAGQRVTVPLRCACPSAAQAAAGVRYLVTYLVDEFDEVGAIAARFGVDAGNISAANEMAITDTIYPFTTLLIPVKSKPDVSQLRSPPPPPPPPPAAPAPTTNRKNHTGVYVGIGAAAVAVLAVVTAVVAALAVRARRRRRRATAAVAAAGGKGGKGNDKASPAFTGGEVSVSISEAFSGLSDIKSSLKVFTYAELAAATDGFSPDRRVGGSVYRAVFNGDAAAVEVVDRDVSAEVEIMRKINHLNLVRLIGLCHHRGRWYLVSEYAEHGTLRDRLLAGGGAPPLSWSQRVQVALDVAEGLRYLHGYTRPPYVHMDVSSDSVLLAGGADLRGKLRNFGGARVIRAGGGEAFTMTSNIAGSRGYTAPEYLEHGVVSPKADVYSLGVVLLELVTGKGVDELEADGAGDPFAGMNALAGDLDGGSEDDAAVTRRMEEFLDPAMAATGSSCPREAVAMMVKLIERCVRRDAAARPGMGEVAQHLLMLHGVSGDGWHSSLEHYRSSGGDGGEQP

SEQ ID NO: 64297 - protein, 367 aa, Glycine max
AVAWEAGKPLSIETIEVAPPQKGEVRLRILFNSLCRSDVYWWDAKDQTPLFPRILGHEASGIVESVGEGVTHLKPGDHALPIFTGECGECTYCKSEESNLCELLRINTDRGVMLSDGKTRFSKNGQPIYHFVGTSTFSEYTVLHEGCVAKINPNAPLDKVAIVSCGFCTGFGATVNVAKPKPNNTVAVFGLGAVGLAACEGARVSGASRIIGVDLLPNRFEQAKKFGVTDFVNPKDHNKPVQEVIAEMTNGGVDRAIECTGSIQASISAFECTHDGWGTAVLVGVPKKDVEFKTNPMKFMEGRTLKGTFYGHYRPRTDIPGVVEKYLNKELELDKFITHSVPFSKINTAFDLMLKGEGIRCLICMEE

SEQ ID NO: 64298 - protein, 485 aa, uncultured bacterium
MPAGLLISSAGLGSPPSAKQPCCRPGTSIKKGHQMTEHELQPFPKGFLWGAATSSYQIEGAWNEDGKGESIWDRFTRIPGKIKNGDSGDVACDHYHRYEQDLDLMRQLGLKTYRFSIAWARIQPDSSRQINQRGLDFYRRLVEGLHKRDILPMATLYHWDLPQWVEDEGGWLSRESASRFAEYTHALVAALGDQIPLWVTHNEPMVTVWAGYHMGLFAPGLKDPTLGGRVAHHLLLSHGQALQAFRALSPAGSQMGITLNFNTIYPVSAEPADVEAARRMHSFQNELFLEPLIRGQYNQATLMAYPNLPEFIAPEDMQTISAPIDFLGVNYYNPMRVKSSPQPPGIEVVQVESPVTAMGWEIAPEGLYDLLMGITRTYGKLPIYITENGAAFDDQPDQSGQVNDPQRVGYFQGHIGAARRALADGVDLRGYYAWSLLDNFEWAEGYSKRFGIIYVDFETQQRTLKQSAQWYRDVIARNGLAAPAI

SEQ ID NO: 64299 - protein, 319 aa, Medicago truncatula
MLYQVDQNQAISMVSYYASSSEPAQVRGKTVYIQYSNRHEIVNNKSPGDIPGNVLLVTIEGVEAGDVSIDVIHLKLSSPPKLPPERIEPETLRRSTLQGAKEGSYLAIYRDLGAGAFGFAMVFSAFGFVHKIATFEKTAGFQALIQFTDAETAASARDALDGRSIPRYLLPEHVGSCNLRISYSAHRDLNIKFQSNRSRDYTNPMLPVNHSAIEGAAQPAIGPDGKRIETESNVLLASIENMQYAVTVDVINTVFSAFGTVQKIAMFEKNGQTQALIQYPDVTTAAAAREALEGHCIYDGGYCKLHLSYSRHTDLNVKV

SEQ ID NO: 64300 - protein, 385 aa, Rickettsia rickettsii
MTNENNNDSEFAELKIRGKIFKLPILKASIGEDVIDISRVSAEADCFTYDPGFMSTASCQSTITYIDGDKGILRHRGYDIKDLAEKSDFLEVAYLLIYGELPSGEQYNNFTKQVAHHSLVNERLHYLFQTFCSSSHPTAIMLAAVGSLAAFYPDLLNFKEADYELTAIRMIAKIPTIAAMSYKYSIGQPFIYPDNSLDFTENFLHMMFATPCTKYTVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAVVLKETCKEVLKELGQLDNNPLLQIAIELEAIALKDEYFIERKLYPNVDFYSGIIYKAMGIPSQ

SEQ ID NO: 64301 - protein, 385 aa, Rickettsia rickettsii
  misc_feature (345)..(345): Xaa can be any naturally occurring amino acid
MTNENNNDSEFAELKIRGKIFKLPILKASIGEDVIDISRVSAEADCFTYDPGFMSTASCQSTITYIDGDKGILRHRGYDIKDLAEKSDFLEVAYLLIYGELPSGEQYNNFTKQVAHHPLVNERLHYLFQTFCSSSHPMAIMLAAVGSLAAFYPDLLNFKEADYELTAIRMIAKIPTIAAMSYKYSIGQPFIYPDNSLDFTENFLHMMFATPCTKYTVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAVVLKETCKEVLKELGQLDNNPLLXIAIELEAIALKDEYFIERKLYPNVDFYSGIIYKAMGIPSQ

SEQ ID NO: 64302 - protein, 315 aa, Shigella flexneri 2a str. 2457T
MDNLDVICIGAAIVDIPLQPVSKNIFDVDSYPLERIAMSTGGDAINEATIISRLGHRTALMSRIGKDASGQFILDHCRKENIDIQSLKQDVSIDTSINVGLVTEDGERTFVTNRNGSLWKLNIDDVDFARFPQAKLLSLASIFNSPLLDGKALTEIFTQAKARQMIICADMIKPRLNETLDDICEALSYVDYLFPNFAEEKLLTGKETLDEIADCFLACGVKTVVIKTGKDGCFIKRGDMTMKVPAVAGITAIDTIGAGDNFASGFIAALLEGKNLRECARFANATAAISVLSVGATTGVKNRKLVEQLLEEYEG

SEQ ID NO: 64303 - protein, 534 aa, Shewanella sp. MR-4
MAYDQESQLELGKYSSLIDLIERTSQRFGDKTAYACLGKTSSFNDIERDSRYFSAYLQNNTNLKPGDRIAIQLPNITQFVIAAYGALRAGLILVNTNPLYTERELIHQFNDSGAKALVVLSDLLPTLAKVVATTPIELVISTHPLDLIDPQVQPKTGLKNVEFCQVLKQGAELPFNRIVPAAGDLAALQYTGGTTGLSKGAMLTHGNMLANAAQVKSRIGSVISEGEDIFVAPLPIYHIYAFMVNLVLYFECGGCSVLIPNPRDISGLIKTLAKYPFTGFAGLNTLFVALCHQPEFKALDFSHLKITISGGTALTAAAANIWQQTTGNTISEGYGLSETSPVISLNAPGYQKIGTIGKPVLGTEVKLLDENGNEVAQGEAGELAARGPQVMLGYWNNLQETANVMTADGFFKTGDIAILNEEGFHQIVDRKKDMIIVSGFNVYPNEVENVLASHPNIIECAVVGVKDEHSGEAVKAFVVLKDDSQDHEQMKTAIINFCREQLTAYKLPKLIEFMPQLPKSTVGKILRRELKHQA

SEQ ID NO: 64304 - protein, 297 aa, Oryza sativa (indica cultivar-group)
MPATAGRVRMPANNRVHSSAALQTHCIWQSAIGYDPYAPAERSKHQAPSSSSVSAAAAAASAPSENTYTSYQSLLTIIRATGSTSDETRGGCRKCGRVGHLTFQCRNFLCVKDLDMDDDVEAGIRQAASSQAKLDEFRKKTSGGSSDAEEGSAEDDEEDSYDSSDSDIDPELERIIAKRELHKDGSKQSREEEKKEKKTSRQRRSSRGRSKHRRSSSKEDKKKSRRKRRERSCEEDSETDSDKKIKRRHHRKSSKEERERGRSRHRRRSYDDDSSDDDHHTLRRRRRRRRKDAFDRQ

SEQ ID NO: 64305 - protein, 183 aa, Triticum aestivum
MSDADDYRCFVGSLSWNTTDVDLKDAFGKFGRVTETKVVLDKFSGRSRGFGFVTFDDKKAMEEAVEAMNGIDLDGRNITVERAQPQGSGRDRDGDRDYRGGGDRYGGGRDFGGGRGGGRGGGGDCYKCGKPGHFARECPSGDGGDRYGSRDDRYSSRDDRYSSRDDRYSSRDDRYWWQGWCKG

SEQ ID NO: 64306 - protein, 448 aa, Burkholderia xenovorans LB400
MRLARGCSLEPQALMNTNPSALRPNRRRRLPASGPARPPHWFSFVGAGALIAVGYIDPGNWATALGAGAGYGYRLLSMVLLASLMAMLLQWLSSRLGVVTGRDLAQICRERTSRRGTLFLWLTSEVAIIACDVAEVVGSAVALQLLLGVSLTVGVLMSAVCTFALLALQQKGGRKLEAVIAALIGFVGLCFVVQLALARPDWHAALAGTVPSVELLRNAGMVWLAAGIVGATVMPHNLYLHSALVKHHAPEGSDAQIKAALHVVNLDTFGSLSFAFVINAALLIVAAAVFYVSGHRDVTDLADAHRLIAPLVGTHWAGILFAAALLACGLSATVTGTLAGQAVMEGFLRIRLPRWQRALLTRALAIGPALLAVALFGQHGSNQLLVASQVVLSLQLPLAVVPLIRYTSDAGLMRGWRVRGVPLALAWLSAAFIVMLNGALLWQLAFGN

SEQ ID NO: 64307 - protein, 498 aa, Shewanella oneidensis MR-1
MSTPKTRSDWENLAVSLAINGKAFINGEYRDASSGNTFDCISPIDGRLLAPVASCDLMDANIAVANAREVFDSGVWSKAAPVKRKQVMIRFAELLEENANELALLETLDMGKPIRFSKAVDVAGAARAIRWSGEAIDKLYDELAPTAHNEIGMITREPVGVVAAIVPWNFPLLMACWKLGPALVTGNSVILKPSEKSPLTAIRIAELAVQAGIPKGVLNVLPGYGHTVGKALALHMDVDTLVFTGSTKIAKQLMIYAGESNMKRVWLEAGGKSPNIVFNDAPDLKAAAVAAAEAIGFNQGEVCTAGSRLLVESGVKDELVGLIAEELASWQPGHPLEPTTVSGAVVDKQQLDTILSYIKAGQNEGASLVYGGQQVLAETGGVYVQPTVFSNVKNQMKIASEEIFGPVLSVIEFNGMEEAIAIANDTIYGLAAGVWTADISKAHKTAKALRSGMVWINHYDGGDMTAPFGGYKQSGNGRDKSLHSFDKYTEIKATWIVL

SEQ ID NO: 64308 - protein, 446 aa, Shewanella oneidensis MR-1
MADSPNNLAHEHPSLEHYWMPFTANRQFKASPRLLAQAEGMYYTDINGNKVLDSTAGLWCCNAGHGRREISEAVSKQIRQMDYAPSFQMGHPIAFELAERLTELSPEGLNKVFFTNSGSESVDTALKMALCYHRANGQASRTRFIGREMGYHGVGFGGISVGGLSNNRKAFSGQLLQGVDHLPHTLDIQHAAFSRGLPSLGAEKAEVLEQLVTLHGAENIAAVIVEPMSGSAGVILPPQGYLKRLREITKKHGILLIFDEVITAFGRVGAAFASQRWGVIPDIITTAKAINNGAIPMGAVFVQDYIHDTCMQGPTELIEFFHGYTYSGHPVAAAAALATLSIYQNEQLFERSFELERYFEEAVHSLKGLPNVIDIRNTGLVAGFQLAPNSQGVGKRGYSVFEHCFHQGTLVRATGDIIAMSPPLIVEKHQIDQMVNSLSDAIHAVG

SEQ ID NO: 64309 - protein, 474 aa, Burkholderia xenovorans LB400
MKTYEQLYIDGKWIAPCGTGTIDVIDSGTEEIMGRIPEGVEADAESAIAAARVAFDAWAATPAAERGEYLRKVAANLKARTDELAGLIAGEVGMPLKLARAIQVGSPVYNWGAYAKLASEFQYEERVGNSLVVREPVGVVAAITPWNYPLNQVTLKVAAALAAGCTVVLKPSEIAPLTAFVLAEAIHEAGLPAGVFNLVSGYGPVVGEVLASHPSVDMVSFTGSTRAGKRVSELASATVKRVALELGGKSASVILDDADFAAAVKGTVSACFLNSGQTCSAHTRMLVPEARYDEARVLAKQAAETYVAGDPRNETSRLGPLASAAQQARVQQYIAKGIEEGAELVTGGVGLPDGLSKGFFVKPTVFGRVHPKATIAQEEIFGPVLSILTYKDEEEAVRIANDSPYGLGGAVWAGSDERAVGIARRIRTGQVDINGGTWNMAAPFGGFKQSGFGRENGVYGLEEYFELKSMQFRV

SEQ ID NO: 64310 - protein, 357 aa, Buchnera aphidicola str. Bp (Baizongia pistaciae)
MSEKVLFIDRDGTLISEPLDNFQVDSFDKLEFKQDVISSLITLKKFNYKFVMVTNQDGLGSKNFPYKSFIRPHEFMIDVFLSQGIKFEEVLICPHELKSGCQCRKPNLGMVQHWLLNDMLDKQHSCVIGDRKTDMILANNMGILGIRYGTKQGNSWSDIVFKLTKKHDRHAKVVRNTKETNVSIEVWLDKQGGSLINTGLNMFNHMLDQIAVHSCIRMKIISSGDICVDDHHTVEDVGIVLGKAILKALGNKLGINRFGFALPMDDSSSYCLLDISGRPFLKFRSYFKHQYIGDMSSEMVRHFFQSLAFAMKCTLHLRSMGINDHHRLESLFKVFGKTLKQAIVVSGKNLPSSKGLL

SEQ ID NO: 64311 - protein, 1209 aa, Oryza sativa (japonica cultivar-group)
MWAEPEIAVNYGPRRGGCESSSSRPTLQPAPILRHPFAGGFSPPLPPPLHRRPRNLDTSPLAGDHHHGASRFASTSVVKQSSGGLLGWFLGGNSSQLPPLDVPLPGVIISPPLPDFVEPSKTKITTLPNGIKIASETSPIPAVSVGLYIDCGSVYETSSSSGTSHLLERMAFKSTTNRSHLRLVREVEAIGGNVFASASREQMSYTYDALKCYAPEMVEVLIDSVRNPAFLEWEVKEQLQKIKSEISEVSGDPHGLLMEALHSAGYSGALAKPLMASESAVNRLDVATLEEFVSENYTAPRMVLAASGIEHDELVSVAEPLLSDLPSVKRPEEPKSVYVGGDYHCQADSTSTHIALAFEVPGGWRQEKTAMIVTVLQVLMGGGGSFSTGGPGKGMHSWLYLRVLNNYGQIESFSAFSSIYNNSGLFGIHATTNPDFVSSAVDLAARELHEVATPGKVTQEQLDRAKEATKSSVLMDLESRIVASEDIGRQVLTYGERKPIEYFLKTVEEITLNDISSTAKKIISSPLTLASWGDVACCVFVQTHANIVLPVLHFNIESDVMASWLSHLPIHRCQLSFPAAQASYATPGIDSALLLDVDDMAGGDAGLNEGLKKQAKPRLRLPKPAAKRSESEFLRSRPLALLMASSHIILPPDDDDEEQRRLEEEEDEDPWARSGPPPAAPEHAMKAALPFSATCVRISRDSYPNLRALRNASSVSLADAAYVKISEGDFGYVLDDVPHLVDHLPDAPTYPNPLQDHPAYSTVKQYFVNEDDTVPQKVVVQKNSRRGVHFRRAGPRQKVYFESDEVKACIVTCGGLCPGLNTVIRELVCGLAHMYNVSKIYGIQNGYKGFYSSNYLTLTPKSVDDIHKRGGTVLGTSRGGHDTKKIVDNIQDRGINQVYIIGGDGTQKGAYEIFKEIRKRGLKVSVAGIPKTIDNDIAIIDKSFGFDTAVEEAQRAIDSAHVEACSAENGIGLVKLMGRYSGLIAIYATLEIRDVDCCLIPESPFYMDGEGGLLQYVERRLKENKHMVIVVAEGAGQDLIAKSLSTSEQQDASGNKLLLDIGLWLTHKIKDHFKSKKMEMTIKYIDPTYMIRAIPSNASDNVYCTLLAHSAIHGAMAGYSFTVGNVNGRHAYIPFYRVTSTRNKVKITDRMWARLLSSTNQPSFLSQKDIDEAKENDRTANKPPLPTGLSHHVANSFDQSASSSSNSQI

SEQ ID NO: 64312 - protein, 311 aa, Oryza sativa
MSPNLESHIKSQVPALLLRRFFGGAGRRRVFVQTETGCVLGMDLDRSDNAHTVKRRLQLALNVPTGETSLTFGDRVLENDLSFIRPDSPLLLTRNSINRSCSTPCLCPVSKDFEHKDRSGLVEMLGCSISCARVKRLVDDVVTAIRSGVDPVPIGSGLGGSYYFRNISGDRVAIVKPTDEEPFAPNNPKGFVGRALGQPGLKKSVRVGETGFREVAAYLLDHDNFANVPPTALVKITHSIFHINCPVNGGSPAHDQKQQVSSKIASFQQFIAHDFDASDHGTSSFPVAAVHRIGILDIRIFNTDRHAGNVL

SEQ ID NO: 64313 - protein, 267 aa, Triticum aestivum
  misc_feature (114)..(114): Xaa can be any naturally occurring amino acid
  misc_feature (216)..(216): Xaa can be any naturally occurring amino acid
  misc_feature (228)..(228): Xaa can be any naturally occurring amino acid
  misc_feature (235)..(235): Xaa can be any naturally occurring amino acid
  misc_feature (244)..(244): Xaa can be any naturally occurring amino acid
  misc_feature (259)..(259): Xaa can be any naturally occurring amino acid
NKFVQKSRLVPVRNSRDIVDPRVRLGEERTRKELIPFLSENNDDEEEVLLAMAEKLGVFIPYVGGVEHAHVLLPPLETLSTVEETCVRDKAVESLCRIGAQMKENDIVDYFIAXIKRLAAGEWFTARVSSCGLFHIAYPSATDPLKTELRTIYGQLCQDDMPMVRRAAASNLGKFAATVEQSHLKTEIMSIFDDLTQDDQDSVRLLAVEGCAALGXLLNPKMCSHILXLVNFSRXSWLVRYMVXNQLYELCEAVGPKPXRADLVPAY

SEQ ID NO: 64314 - protein, 206 aa, Buchnera aphidicola str. Bp (Baizongia pistaciae)
MLKKINFIDINWNKVDNMLPVVIQHNLSGKVLMHGYMNQEALKRTQNEGIVTFYSRTKQRLWTKGETSKNFLYVTDIRLDCDQDALLIFVRPVGKTCHLNHVSCFQVPSENLFFLHDLDCMLKFKKHYGLENSYTFNLHKNGVNRIAQKVAEEAIETAISAVSKNKVELINESSDLVYHLLVLLHSYDLDLYDVIKNLKMRSNKQV

SEQ ID NO: 64315 - protein, 342 aa, Ostreococcus tauri
  misc_feature (184)..(190): Xaa can be any naturally occurring amino acid
MFASRGKKPASKSARALETVRGVVQKIRRSSVVVDVEKSLMRSWRVYKKAMTASKEFKHLRKTLPGWVMRNARFKRLAWNDDFACAFVLLSPVALITLLWCVGAVVRMVMRRDANDVYRKVFGKARERQRSLARREAEAKMAKALPNQPPETIDRTQSGTVINMTTKDSQKLFELRTKLDEASXXXXXXXLENILWKSSRPGEPLGSNADLAPEQITILIDFTKWSLKNAVPMATARETLSILQNHYPERLGLAVCFNPPTIFRVFWAVISPFIDPKTYTKIVFVSKRRKAKAAATMGAIFHAASTDTDLGGAVDPTWNFNDYAKHMRDYDAKKLDVTRTWA

SEQ ID NO: 64316 - protein, 148 aa, Rickettsia sibirica 246
MRQSGNPYYSHPIEVKIMLAEFVAEEAPKLYNIIMLQAALLHDTIEDTEFTEEAITKIFGPEVAKHVEGLTRIKSYGKISSGESLNLLIKEKRYNTALIKLFDRIHNVQTLGVKSPEKARKIIEATLINFLLVAANINYKLEQELSYA

SEQ ID NO: 64317 - protein, 253 aa, Streptomyces avermitilis MA-4680
MADAPYKLILLRHGESEWNAKNLFTGWVDVNLNEKGEKEAVRGGELLKDAGLLPDVVHTSLQKRAIRTAQLALESADRHWIPVHRSWRLNERHYGALQGKDKAQTLAEFGEEQFMLWRRSYDTPPPPLADGSEFSQSDDPRYASIPPELRPKTECLKDVVNRMLPYWYDGIVPDLLTGRTVLVAAHGNSLRALVKHLDGISDEDIAGLNIPTGIPLSYELDTDFKPLNPGGTYLDPDAAAAAIEAVKNQGKKK

SEQ ID NO: 64318 - protein, 888 aa, Geobacter metallireducens GS-15
MAEKYVYFFGNGKAEGKADMKNLLGGKGANLAEMTAIGLPVPPGFTITTEVCTYYYANNKSYPSVLAAQVAENLKSVEAIMGRTFGDPKNPLLVSVRSGARASMPGMMDTILNLGLNDETVQGIIVQSGDERFAYDAYRRFVQMYSDVVMGMDKEALEHLLEEKKAAKGVHLDTDLTAADWKELVGAFKAKIRETLGTAFPENPQEQLWGAVGAVFGSWMNQRAITYRRLNGIPADWGTAVNVQSMVYGNMGNDCATGVAFTRDPSTGENYFYGEYLVNAQGEDVVAGIRTPQPINRANSKDATLPSMEEVLPECYQQLVQIRGILEKHYRDMQDIEFTIEKGKLFMLQTRNGKRTAKAAIKVAVDMVKEGLIDEKTAVLRVSPSQLDQLLHPSLDPKAPRTIIAKGLPASPGAASGEVVFTADEAEAAGRLGLKVILVRIETSPEDIHGMHAAQGILTARGGMTSHAAVVARGMGKCCVAGCGDIKVDYAAGQFVTAKGQVVKRGDTITLDGSTGEVMLGEVPTVAPQLTGDFGVLMGWVDTYRKLKVRTNADTPNDSRVAREFGAEGIGLCRTEHMFFEADRIAAVREMILSEDVEGRTKALAKILPMQKGDFLGIFREMKDLPVTIRLLDPPLHEFLPQEEKDVDALAKTMGVTAQTLKNKVDYLHEFNPMLGHRGCRLGLTFPEIYDMQVQAIMEAACELTKNEGFTIVPEIMIPLVGVVSELARLRENTVRVCEEVIARYGVKIDYLIGTMIELPRAALTADEIAREADFFSFGTNDLTQTTFGLSRDDAGKFLPFYVESGLLEEDPFVSLDQNGVGILVKMAVEKGRTTRAGIKLGICGEHGGDPSSVIFCHKIGLDYVSCSPFRVPIARLAAAHAALGEGN

SEQ ID NO: 64319 - protein, 273 aa, Pseudomonas putida GB-1
MSTTPSRDTVLCISLAGRPGTFGVRFHNHLYQQLGLHFYYKAMRTDDLPAAVAGIRALGIRGCGVSMPYKEACMALVDEIDPSAQAIESVNTLVNSNGHLKAYNTDYLAVRQLLAQHQVDPGTAFALRGSGGMAKAVASALRDAGFAEGIIVARNEQAGRQLADVCGYRWLPQLGDICPPMLVNVTPIGMAGGSEADVLAFSEQAIAAAERVFDVVAMPAQTPLIRQAQALGKPVITGLEVIALQALEQFVLYTGVRPTRAQVDAAVAYARDI

SEQ ID NO: 64320 - protein, 697 aa, Desulfovibrio vulgaris subsp. vulgaris str. Hildenborough
MCGIAGIVSPGAPVASATLAAMTESLAHRGPDACGLFIRPSGAGSPHVGLGHRRLSILDLSDAGAQPMQSEDGAFTLVFNGEIYNYPDLRRDLEAAGHIFRSTSDTEAILRGYMAWGEGVVARLKGMFAFALWDERKRSLLLARDRFGKKPLHYAVTRQGTLLFASEPKALLAHPEFRPEPDAASLLHFLRYDYVPAPRSIYAGAAKLPPSHLMVWRDGRLEVRRYASLAFSGATGDRGVPLREAEAAVDALLDAAVQRRLASDVPLGVFLSGGLDSSTVLAYMTRHIPAHDIRTFAIGFDEASYDESAHAEAMARHAGSHHTMMRLPAARMLDLLDMVWTTQDEPMADASIIPTLLLCRFAREHITVALGGDGGDELFAGYDPVLADLPARCLDWLPPAALRLLQGIALRLPTGDANMSLGFKVQRFLSGLGAREVAARHQTWLGAFDDEGARAMLHPDLRAATRDVSPLDALDMLREECRDASRFDAMLHFYQRFYMCGSILTKVDSASMAVSLEVRSPFLDQDLADYVNRLPREHKLRGLTRKVLLRRLMRSRMPDALLKRPKKGFGLPLARWFRHELRPLVTAMLDPGRVAQGGLLDPVTVERMVRDHLSGRRDHRKEIWSALCVEAWRERYLHHSRATASDTIEFGTTPHGDGHLITAQAVPARSSAAINDSTNDSPSWAASPSRHRCNDSI

SEQ ID NO: 64321 - protein, 816 aa, Saccharophagus degradans 2-40
MPALNHDNSIKSKDMKFSESWLREWVNPNASTQQIVDQLTMAGLEVDAVEPVAGTFNGVIVGEIIDAQQHPDADKLRVCTVAGLPEGETQVVCGAPNARVGLKIPFATVGASLPPGEDGKPFKIKKAKLRGVESFGMLCGQTELQAGDDDEGLWELPADAPVGQDLREYLSLNDNLIEVDLTPNRSDCLSIKGLARELGVLSKIEVKAPVIAAVEPQISDVLSVALSAGSACSRYVGRVIKGIDVAKPSPLWLQEKLRRSGIRSIDAVVDVTNYVLIELGQPMHAFDLAKINGGINVRLANAKEELTLLNDQKVELKEDTLVIADESGALAMAGIMGGEASAVTSATQDIFLESAFFEPIAIAGRARSYGLHTDSSHRFERGVDYNGAQAAIERATALLLEIVGGQAGPVIVAESQQDLPSVSNVNLSKARIESGLGFAIPDVEVEDILTRLGLKLVERNESGWTFAVPSYRFDVAIEADLLEELARIYGYNNLPTTTVRIPAQLPSKTETVTKLDRIKDHLASRGYREVITYSFVDPALQNLINGEQANVPIINPISSDMGIMRTSLLPGLLNTLSKNVKRQVQRVRIFESGLTFVAPEGMDSQTLEGLTQPSMFAGLIYGARAPVGWHADKDDVDFYDIKGDLESLLAFTGQAVTFESAEVKALHPGQTAKVKLAGTEIGYIGALHPEVAKQLDLPKAAYVFEVSLDAIKQAKVPAFTALSRYPEVARDIAILVDKGVNGAALEAEIRSVAGDYLKNLKIFDVYSGKGIDPQRKSIAFNLIFQHPSRTLTEDEISAPMAEIVKKLEQSFNAQLR

SEQ ID NO: 64322 - protein, 364 aa, Zea mays
MRPGGPPNSRALQQPGTPGRSRRRPDLTLPLPQRDLVSLAVPLPLPLPLPPSSASSSGSLSAPASLGGPSPGPPPQNPASLGAPTPPANPPPLCELERVRRIGSGAGGTVWMVRHRPTGRPYALKVLYGNHDDAVRRQITREIAILRTAEHPAVVRCHGMYEQAGELQILLEYMDGGSLENRRIADERFLAHVARQVLSGIAYLHRRHIVHRDIKPSNLLIDSGRRVKIADFGVGRILNQTMDPCNSSVGTIAYMSPERINTDLNDGAYDGYAGDIWSFGLSILEFYMGRFPLGENLGRQGDWAALMCAICYSDSPQAPRTASSDFKDFISLCLQKNPANRPPAMRLLQHPFVAQPPLTAGPPS

SEQ ID NO: 64323 - protein, 266 aa, Helicobacter pylori J99
MKLKSFGVFGNPIKHSKSPLIHNACFLTFQKELGFLGHYHPILLPLESRIKNEFLHLGLSGANVTLPFKERAFQICDKIKGIALECASVNTLVLENDELVGYNTDALGFYLSLKHQNYQNDQNALILGAGGSAKALACGLQKQGLKVSVLNRSARGLDFFQRLGCDCFMEPPKSAFDLIINATSASLHNELPLNKEVLKGYFKESKLAYDLAYGFLTPFLSLAKELKIPFQDGKDMLIYQASLSFEKFSDSQIPYSKAFEVMRSVF

SEQ ID NO: 64324 - protein, 484 aa, Oenococcus oeni PSU-1
MALKQYQMYINGEWVDSDNGEKITVYNPSNEEAISQVPSASLKQVKEAIDDAYAAQKDWKRVPAATRGSYLVRIAALIRKNADYLARTLSEEEGKILSLAMTEVTFSADYIDYMAAQGRTYEGEVIQSDNANENIALLKQPIGVAAGILPWNFPFFLITRKFAPALVTGNTIVIKPSSDTPNIALEFAKLANQVGLPKGVLNFVTGPGSVVGSELSKNEKIGIISLTGSVDSRKRVMADASNHVAKVSLELGGKAPAIVCKDADIDLAVDSIINSRIDNNGELCNNCERVYVQEDIAEEFTKKLVAKMAATTIGDPIEHENIGMGPLINKAAVEKVDAMVQRAVKAGAKVECGGKRPEGKGYFYPATVVTNVKQSDELVQEEIFGPVLPILTFKKLDQAIDMANDSKLGLTSSIFTENMDAAATAANELEDGETYINRFNFEAMQGFHAGWKESGLGGADGKHGLEEYVNTHVVYLQRHPEKAD

SEQ ID NO: 64325 - protein, 331 aa, Shewanella sp. MR-4
MAPQPESIMDLNAIRQLADTDMQAVNQLIYKQLESDVALINQLGFYIINGGGKRLRPLLSVLAARAVDYQGEAHLKLAAIIEFIHTASLLHDDVVDESTLRRGRETANALFGNSASVLVGDFLYTRSFQMMTELDSMRVLRVLADTTNVLAEGEVLQLMNCNDPNTTEESYMRVIYCKTAKLFEAATLLAAVLAGATPEQETALGDYGKYLGTAFQLTDDLLDYTADSEELGKNIGDDLAEGKPTLPLIYAIAHGTEEEQQLIRQAIEQGDGTHAIEKIVAALHHCGALTYTQQKAIEESNKAIAALAVLPDSDFKTALISLAKISVDRNH

SEQ ID NO: 64326 - protein, 500 aa, Atriplex centralasiatica
MAFPMPVRQLFIDGEWREPLLKNRIPIINPSTEEIIGDIPAATAEDVEVAVVAARKAFKRNKGRDWAATSGAHRARYLRAIAAKITERKDHFVKLETLDSGKPLDEAVLDIDDVATCFEYFAGQAEALDAKQKAPVTLPMDRFKSHVLRQPIGVVGLISPWNYPLLMATWKIAPALAAGCTAVLKPSELASVTCLEFGEVCNEVGLPPGVLNILTGLGPDAGAPIVSHPDVDKIAFTGSSATGSKIMASAAQLVKPVTLELGGKSPVIMFEDIDIETAVEWTLFGVFWTNGQICSATSRLLVHESIAAEFVDRMVKWTKNIKISDPFEEGCRLGPVISKGQYDKIMNFISTAKSEGATILCGGSRPEHLKKGYYIEPTIITDITTSMQIWKEEVFGPVICVKTFSTEDEAIELANDTEYGLAGAVFSKDLERCERVTKALEVGAVWVNCSQPCFVHAPWGGVKRSGFGRELGEWGIENYLNIKQVTSDISDEPWGWYKSP

SEQ ID NO: 64327 - protein, 378 aa, Oenococcus oeni PSU-1
MSNISKTNDQILDFDYQLKAQDDAFPTLKVLDNDGKIVDEKALERADLSDDDLINIFHNMLLNRQLDIRSTKLARQGRFGFFAPTAGQEASQMASAYAFHDEDWLFPGYRDIPEIVAKGWPIWKAILWSRGHVVGNEYTTDDGKEVNSWFPQIIIGAQYVEAAGVALGLKKRNKKAVSYAYTGDGGTSQGDFYEGMNFAAAYHANEVFFVQNNGFAISTPRKLQTAAPHLAAKGWAVGVPSLVVDGQDAIAVYLAAKEARAWAVSGKGPVLIETLTDRFEAHSTAGDDPLRYRTKEDIADWWKKDPLIRMRKYITDKGLWDEDKENDYIAQIDARIDEDIKKADNIDKQKISDYLKNTLEVPGYAMKEQIEKFESEGK

SEQ ID NO: 64328 - protein, 326 aa, Oenococcus oeni PSU-1
MAVKSYIDAVKEAQDLALEHDKNVLILGEDVGKNGGVFRATDGLQDKYGEDRVFNTPLAESGIGGLAIGLTTQGYRPIMEIQFYGFIYEVLDSLAGQMARNRFRFNGTRQMPIVVRAPYGGGTKTPEMHSDNLEGLVAQTPGLRVVMPSNPSDAKGLLLSAIESNDPVIFLENLHLYRSIKGEVAEGYYTTPLDKAAVVRKGKDISIITYGGMTPVALNAAEELSKQGIDAEIIDLRTVSPLDIETIGESVKKTGRVVVAQETQRMAGIGASVMAEISERFILSLKAPVGRVAAPDSIYPFAQAENDWMVNADDIIDKVKEIVNYD

SEQ ID NO: 64329 - protein, 281 aa, Prunus mume
MAKDVEGAEHGEFAAKDYHDPPPTPFFDAEELTKWSFYRALIAEFVATLLFLYITVLTVIGYKSQSSGDQCGGVGILGIAWAFGGMIFVLVYCTAGISGGHINPAVTFGLFLARKVSLPRAVLYIIAQSLGAICGVGLVKAFQKTYYEEYGGGANELAAGYNKGTGLGAEIIGTFVLVYTVFSATDPKRNARDSHVPVLAPLPIGFAVFIVHLATIPITGTGINPARSFGAAVIYNKDKAWDDQWIFWLGPFIGAAIAALYHQYILRAGAIKALGSFRSNA

SEQ ID NO: 64330 - protein, 520 aa, Suaeda salsa
MAALEELKKKLTPLFDAEKGFSAGTTLECGDSDMLSDSGTINLLSRSYGVYNFNEQGLQKCTSSPVDENSPSEKTYRISSREMRVFGAIGSGASSIVQRAIHIPTHRIIALKKINIFEKEKRQQLLTEIRTLCEAPCSEGLVEFYGAFYIPDSGQISIALEYMDGGSLADVIQVQKCIPESVLSAIVRKLLHGLNYLHGVRHLVHRDIKPANLLMDLKGEPKITDFGISAGLENSMAMCATFIGTVTYMSPERIRNESYSYPADIWSLGLALFECGTGEFPYIANDGPVNLMLQILDDPSPSPSKEKFSSEFCSFVDVCLQKDPEARPTAEQLLSHPFITKYKDSQVDLATFVQSIFDPVQRLKDLADMLTIHYYLLFDGPDEEEWQQAKSLYNEGSVFSFSGKQYAGTNDIFSVLSDVRRKLAGKWPPEKLIHVVEKLQCKAHGQGGIAIRVSGSFIAGNQFIICGDGMQVEGLPNFRDLNVDIASKRMGTFKEQFIIEPGDAIGCYNISNQELYIMSQ

SEQ ID NO: 64331 - protein, 448 aa, Oenococcus oeni PSU-1
MTEIFKMPDIGEGMAEGEISDWLVKVGDQVKTDDSVAEVQNDKLLQEILSPYSGKVTKLFVEPGTTVKVGEPLIEFDGDGSGSAADDGQKGKTEAKEIEEPAESEKKTAVSSQASPAAPTSDSSNSSGAATASNGNILAMPSVRHYAHEHGIDLSQVTASGHHGHITMSDVENFSTSSAAPEKEPENQPSEAETTTKQTASESAPTKKAAAPDPLKEGRVSMTPVRKAIAKAMSLQNSTIPTVTNFDQTEVSKLVAHRKQFKPIAADQNIHLTYLAYAAKALAATAKKFPEINASLDMDKQEIVYHDDINLGIAVNAPSGLYVPVIAHADQKSIMAIAQEIEDLAAAVRDGSIKPDQMRGGTITISNIGSARGTWFTPIINAKEVAILGLGSIVKEPIISDDGTIVAGQMMKLSLSYDHRLIDGMLGQTSMNYLKSLLADPAYMLMEV

SEQ ID NO: 64332 - protein, 473 aa, Oenococcus oeni PSU-1
MATGGVVGAQATDIDTVVIGSGPGGYVAAIRAAELGQKVTIIESTFIGGVCLNVGCIPSKALINVGHHYHDAVSEQPFGLKSSGTELDWKTTQEWKQKKVVNQLTGGVEMLLKKHRVDIIHGVASFVDNKQINVVKGDDHELFQFNNCILATGSRPIEIPGFAFGKRIVDSTAALSLPEIPKHLIVIGGGVIGFELGSVYQNLGSKVTVIEGLDHVLSGFDKEMIQPVLDDFKAQGGEIFTSAKAKSASQTEKDVTVTFEADGKEQTVDGDYLLVSVGRRPNTDNIGLNNTNVKLTDRGLVEIDDTMKTNVSHIYAIGDITVGPALAHKASFQGKIAAAAISGDQNAHDLHYSLPAVAYTNYELATTGETPESVKEKKLDAKAYKFPFAANGRALSINEGKGFIRLISDNQTKALIGSQIVGPGASDLISELSLAIENGLTTEDISLTIHPHPTLGEAIMDASELADGLPIHI

SEQ ID NO: 64333 - protein, 500 aa, Atriplex centralasiatica
MAFPMPVRQLFIDGEWREPLLKNRIPIINPSTEEIIGDIPAATAEDVEVAVVAARKAFKRNKGRDWAATSGAHRARYLRAIAAKITERKDHFVKLETLDSGKPLDEAVLDIDDVATCFEYFAGQAEALDAKQKAPVTLPMDRFKSHVLRQPIGVVGLISPWNYPLLMATWKIAPALAAGCTAVLKPSELASVTCLEFGEVCNEVGLPPGVLNILTGLGPDAGAPIVSHPDVDKIAFTGSSATGSKIMASAAQLVKPVTLELGGKSPVIMFEDIETVVAVEWTLFGVFWTNGQICSATSRLLVHESIAAEFVDRMVKWTKNIKISDPFEEGCRLGPVISKGQYDKIMNFISTAKSEGATILCGGSRPEHLKKGYYIEPTIITDITTSMQIWKEEVFGPVICVKTFSTEDEAIELANDTEYGLAGAVFSKDLERCERVTKALEVGAVWVNCSQPCFVHAPWGGVKRSGFGRELGEWGIENYLNIKQVTSDISDEPWGWYKSP

SEQ ID NO: 64334 - protein, 587 aa, Streptococcus pyogenes M49 591
MAVEIIMPKLGVDMQEGEIIEWKKQEGDTVNEGDILLEIMSDKTNMELEAEDSGVLLKITRQAGETVPVTEVIGYIGAEGESVEVSSPAASDVNVARTTEDLEAAGLEVPKAPAQAASAAPKAALADDEYDIIVVGGGPAGYYAAIRGAQLGGKIAIVEKSEFGGTCLNVGCIPTKTYLKNAEILDGIKIAAGRGINLASTNYTIDMDKTVDFKNIVVKTLTGGVQGLLKANKVTIFNGLGQVNPDKTVTIGSQTIKGRNVILATGSKVSRINIPGIDSKLVLTSDDILDLREMPKSLAVMGGGVVGIELGLVWASYGVDVTVIEMADRIIPAMDKEVSLELQKILSKKGMKIKTSVGVSEIVEANNQLTLKLNNGEEVVAEKALLSIGRVPQMNGLENLNLEMDRNRIKVNDYQETSIPGIYAPGDVNGTKMLAHAAYRMGEVAAENAIHGNTTRKANLKYTPAAVYTHPEVAMVGLTEEQAREQYGDVLIGKNSFTGNGRAIASNEAHGFVKVIADAKYHEILGVHIIGPAAAEMINEAATIMESELTVDELLLSIHGHPTFSEVMYEAFADVLGEAIHNPPKRK

SEQ ID NO: 64335 - protein, 388 aa, Bacillus cereus E33L
MERNPTQKTILFLPFLQIPSGHHQVANALMEGIQKDQLNTKCDQVDILSYSYGRIEALVSNIYLKWIKVFPNFYNWIYQISVYKNVEDNKRYRLYELLFVPFMRRLIRDKQPDLIICTHALPSYILNYLKEKGELKTPIINVYTDYFIHSCWGIEHIDFHFVPSHHMKEFLKKKGVNDEQIFITGIPIHNKIKKQKEYIVNTASSAWSVLITGGSLGVGAIEDLICKIGMETKIHFYVLCGKNENLYQKLQQLQRDNITPLKYITCRKKMNKLYDQIDAIVTKPGGVTISESLFKRKPIFIYHVLPGQEEINLQQLKKLGVIFHLDRWKDEKNTIEEQLHSFFQNKNQLQQYQDRITEYHRQLITKEPSQIIKELIKKGGRLSTKIDF

SEQ ID NO: 64336 - protein, 469 aa, Streptococcus pyogenes M49 591
MAFEIIMPKLGVDMQEGEIIEWKKQEGDTVNEGDILLEIMSDKTNMELEAEDSGVLLKIVRPAGDTVPVTEVIGYIGAEGESVDTIASSEKTTEIPVPASADAGPTVAPKENVASPAPQVAATAIPQGNGGKVRATPAARKVAAEMGIDLGQVPGTGPKGRVHKEDVENFKGAQPKASPLARKIAADKGIDLATVSGTGFNGKVMKEDIMAILEAAKPAEAKAPAAKEEKVVDLPEGVEHKPMSAMRKAISKGMTNSYLTAPTFTLNYDIDMTEMIALRKKLIDPIMAKTGLKVSFTDLIGMAVVKTLMKPEHEYMNASLINDANDIELHRFVNLGIAVGLDDGLIVPVIHGADKMSLSDFVLASKDVIKKAQTGKLKAAEMSGSTFSITNLGMFGTKTFNPIINQPNSAILGVGATIPTPTVVDGEIVARPIMAMCLTIDHRLVDGMNGAKFMVDLKKLMENPFELLI

SEQ ID NO: 64337 - protein, 404 aa, Oenococcus oeni PSU-1
MPEVKKNLDKKTNSFVQGAKPSQIISLNKEFKKIDNIVLLTVGEPDFNTPEHIKKAAIADIQANDSHYGPSSGTPELLQSVADFLKNHYHLNYDPATEIVNTLGVTEGICDTMKTILNPGDELIVPEPTFPVYAAAASAFGGKIVPVSTEESGFILTAEKLKQVLLAHPQAKAIVLTTPGNPTGVAYNEKQIQALVNVLKNHDIFVISDEIYSELTYDRPHSSFAAALPGQTILFNGVSKSHAMTGYRLGIIAGPQSIISQIAVIHQLITTALPDVVMAAATEAFSAGENDAATMRVEYKKRRDYLIDAFTKLDISFAYPDGAFYFFFKIPDYLEQDGFKLARQIAEEAKVGLTPGVAFGQAGYLRLSYAASLDQIKIAVNRLSEFFSKQKQAQAKIYEKSTTK

SEQ ID NO: 64338 - protein, 348 aa, Ustilago maydis 521
MGAEDYSPPATDIITLTRHVLTEGFKLRTESAASGDLTILLSSLQTTCKFIESNVRKASLINLIGAAGNTNVQGEDQKKLDVLSNEIMINALRASGKTAVLVSEEDDEAIFVGEKEEGGTFESTKGKYCVVFDPLDGSSNIDAGVNIGTIFGIYLVKEGSKGTLEDVLRPGREMVAAGYCMYGSSANLVLTTGNGVNGYTLDNQIGEFILTHPNIRLPSRGKIYSVNEGNSMYYYEPVLKYLDSIKYPKGEGAKPYSARYIGSMVADVHRTLLYGGIFIYASDKKSKDGKLRMLYEAFPMAFITEQAGGLATTGTQRILDIQPTSIHQRCPVFLGSKDDVEDLMKCFQ

SEQ ID NO: 64339 - protein, 117 aa, Burkholderia xenovorans LB400
MGKLTTHVLDTANGRPGAGIKIELFALSGDTRRALKTTLTNDDGRCDQPLLEGDALVPGEYELVFGAGDYFASIGTKVPEPRFVDRVVLRFGVADAGAHYHVPLLVSPWSYSTYRGS

SEQ ID NO: 64340 - protein, 319 aa, Solanum tuberosum
MAVNGSALSSGLIVSFGEMLIDFVPTVSGVSLAEAPGFLKAPGGAPANVAIAVTRLGGKSAFVGKLGDDEFGHMLAGILKTNGVQADGINFDKGARTALAFVTLRADGEREFMFYRNPSADMLLTPDELNLDLIRSAKVFHYGSISLIVEPCRSAHLKAMEVAKEAGALLSYDPNLRLPLWSSEAEARKAIKVSDVELEFLTGSDKIDDESAMSLWHPNLKLLLVTLGEKGCNYYTKKFHGSVGGFHVKTVDTTGAGDSFVGALLTKIVDDQAILEDEARLKEVLRFSCACGAITTTKKGAIPALPTESEALTLLKGGA

SEQ ID NO: 64341 - protein, 160 aa, Glycine max
MATDQMKPIATLLLGLNFCMYVIVLGIGGWAMNRAIDHGFVIGPGFDLPAHFSPIYFPMGNAATGFFVTFALIAGVAGVGSIISGVNHVRSWTSESLPSAASVASIAWALTVLAMGFACKEIQLTGRNARLKTMEAFMIILSATQLFYIAAIHGAAAYRR

SEQ ID NO: 64342 - protein, 208 aa, Ureaplasma parvum serovar 3 str. ATCC 700970
MAKFIKSAHYFDQYPIDKQFEICVIGRSNVGKSSLINALANKKIARTSNTPGRTQLVNFFDFNNFRLVDLPGYGFAKVSKEKQTDLAAIIDQYLGYRQNLCAVFQICDINVLTNDDVEMSRYFENQKYAHFVVLNKLDKVNKSYFNNNKHKIAKFLNISTDRLLCVSAQNNINIITLFALMKKVVIQAKQEKILSKKEEKMSSEEEIK

SEQ ID NO: 64343 - protein, 211 aa, Zea mays
  misc_feature (28)..(28): Xaa can be any naturally occurring amino acid
  misc_feature (89)..(89): Xaa can be any naturally occurring amino acid
SRSARYAEAAVLIDAENLAAHLFEISAXSSYENQQDIQLMRFADYFGRAFAAVSASQFPWAKMFKESTVSKMVDIPLCHIPEAVIKTAXSDWISQRSSDALGDFVLWCIDSIMSELSGPSAGPKGSKKVAQQSPRAQVAIFVVLAMTLRRKPDVLVNVMPKIMGNDKYLGQEKLPIIVWFIAQASQGDLVSGMFCWAHSLFSPLCAKSSGN

SEQ ID NO: 64344 - protein, 221 aa, Lactococcus lactis subsp. lactis Il1403
MFKAVLFDLDGVITDTAEYHFRAWKALAEEIGINGVDRQFNEQLKGVSREDSLQKILDLADKKVSAEEFKELAKRKNDNYVKMIQDVSPADVYPGILQLLKDLRSNKIKIALASASKNGPFLLEKMNLTGYFDAIADPAEVAASKPAPDIFIAAAHAVGVAPSESIGLEDSQAGIQAIKDSGALPIGVGRPEDLGDDIVIVPDTSYYTLEFLKEVWLQKQK

SEQ ID NO: 64345 - protein, 180 aa, Zea mays
  misc_feature (8)..(8): Xaa can be any naturally occurring amino acid
  misc_feature (167)..(167): Xaa can be any naturally occurring amino acid
  misc_feature (169)..(169): Xaa can be any naturally occurring amino acid
  misc_feature (172)..(175): Xaa can be any naturally occurring amino acid
  misc_feature (177)..(179): Xaa can be any naturally occurring amino acid
LHRGGGRXHKGLPEEVGTEVAIFTRVGVTRIMRYAFQLAQSRPRKFLTVVTKSNAQRHGMVMWDEIAAEVATEFPDVTWDKMLVDAMTVRMTLHPKSLDTIVATNLHADILSDLAGALAGSLGVAPTSNIDPQRRFPSMFEPIHGSAFDITGKGIANPIATFWTGAXMXEHXXXXDXXXR

SEQ ID NO: 64346 - protein, 130 aa, Pseudomonas putida GB-1
MSRIAIHSDQAPKAIGPYSQAVHMGELVFLTGQIALHPEKMELAQGIEAQTIQVFENLQSVAQAAGGSFSDVGKLTIYLTELSHFGVVNEIMGRYFEAPYPARATVGVSALALNALVAIDATLVLPRKTA

SEQ ID NO: 64347 - protein, 527 aa, Aspergillus nidulans FGSC A4
MQQTPNPQVGVWQLLFERQDPSFPESHGIFPVSSHTAFVFLLTLTSGIVAPVNPSLSARELQLQLERSQAKGMVVHPSCLGTALKAAKRAGLASERVLVLGATNPGGAATTTVQFMSSVPSEPVGPVHIEPDDIAFLVYSSGTTGLPKGVMVSHRNVVAAVVLQAAIESPHVHWKKDRTLAVLPTYHIYGTSPSGPSRTSTDPLGLICLVHLPVWLGTTTVFMDKFDLQRFCKLIREHSIAHAYVAPPIVLHLAKNPSIDKRDLSSLRMLTSGGAPLGEALIRETYDRWKVPIRQAYGLSETTSVSHIQRWDSWNTAIGSNGAVLPGLEARIVLNNDPSKKAAVKEEEGELWIRGPTVFTGYMNDRASTDACLTASKWFKTGDIGYEDAMGNLHITDRAKDMIKFKGFQIAPTELEDILIEHPAVRDVAVIGVWNGEMHSEVPLAYLVAKESMAERERETAALSVMAYLRGKVVHYKHLRGGVIWIDQIPKSASGKILKRALRDRVGTLDQGKQILAPEYARYRAKL

SEQ ID NO: 64348 - protein, 206 aa, Oryza sativa
  misc_feature (31)..(31): Xaa can be any naturally occurring amino acid
  misc_feature (118)..(118): Xaa can be any naturally occurring amino acid
  misc_feature (186)..(186): Xaa can be any naturally occurring amino acid
WNQKNLFCGWYDADLSEKGNEEAKQAGKWLXEKGYTFDIAFTSVLKRAIKTLYNIQQELDLHWIPVQRHWRLNERMYGALQGKNKSETAAKYGEDQVKIWRRAYDIPPPELEESSEYXPRTDSKYKNLDPRVLPLTECLKDTVDRALPYWHDAIVPAIRSGQKVLIAAHGNSLRALIKYLDKVPDXEIVETHLPTGIPLVYELDAI

SEQ ID NO: 64349 - protein, 458 aa, Bacillus subtilis subsp. subtilis str. 168
MTDDMTKDNINQQTLQRGLKNRHIQLIAIGGAIGTGLFLGSGKSIHFAGPSILFAYMITGIICFLIMRSLGELLLSNLNYHSFVDFVQDYLGDMAAFITGWTYWFCWISIAMADLTAVGLYTQYWLPGVPQWVPGLIALIILLIMNLATVKLFGELEFWFALIKVIAILALIVIGLVMIFKGFSTSSGVSSFTNLWSHGGLFPNGMHGFILSFQMVVFAFVGIELVGLTAGETENPEKVIPKAINNIPVRVLLFYIGALLVIMSIYPWDIINPSESPFVQVFVAVGIVGAASIINFVVLTSAASACNSAVFSTSRMVYSLAKDHNAPESMAKLTQRKVPRNALFFSAIVILIGVTLNYIMPEGVFTLITSISTVCFIYIWGITVICHMKYRKTRPELAKTNKFKLPLYPFTNYLILAFLAFVLVVLALAQDTRVSLFVTPVWFILLIVIYKVRKAKHQ

SEQ ID NO: 64350 - protein, 386 aa, Prunus mume
MPIVAAAVVVPLGLLFFISGLVVNLIQAICFILIRPVSKNLYRRINRVVAELLWLELVWLIDWWAGVKIQVYTDHETFNLMGKEHALVISNHRSDIDWLVGWVLAQRSGCLGSTLAVMKKSSKFLPVIGWSMWFSEYLFLERSWAKDEGTLKSGVQRLKDFPQPFWLALFVEGTRFTQAKLLAAQEYAAATGLPVPRNVLIPRTKGFVTAVSQMRSFAPAIYDVTVAIPKSSPAPTMLRLFEGRPSVVHVHIKRHVMRDLPETDEAVAQWCKDIFVAKDALLDKHTVEQTFGDQQLKVTGRPLKSLLVVTAWACLLILGALKFLYWSSLLSSWKGIAFSALGLGVVTVLMQILIRFSQSERSTPASVAPANNNNKGESSGKPEKQQ

SEQ ID NO: 64351 - protein, 359 aa, Arabidopsis thaliana
MNSSDVNFSLLQSQPNVPAEFFWPEKDVAPSEGDLDLPIIDLSGFLNGNEAETQLAAKAVKKACMAHGTFLVVNHGFKSGLAEKALEISSLFFGLSKDEKLRAYRIPGNISGYTAGHSQRFSSNLPWNETLTLAFKKGPPHVVEDFLTSRLGNHRQEIGQVFQEFCDAMNGLVMDLMELLGISMGLKDRTYYRRFFEDGSGIFRCNYYPPCKQPEKALGVGPHNDPTAITVLLQDDVVGLEVFAAGSWQTVRPRPGALVVNVGDTFMALSNGNYRSCYHRAVVNKEKVRRSLVFFSCPREDKIIVPPPELVEGEEASRKYPDFTWAQLQKFTQSGYRVDNTTLHNFSSWLVSNSDKKST

SEQ ID NO: 64352 - protein, 265 aa, Helicobacter pylori J99
MVRKQSPYEDVQKQSRQHDPYKIIEPTPKKYLEGSAYEVIYNHLSYKHEVLDKYIETNTAVFWIKKDDIFSVATILKHLGYECLSEMSAIDLCAKKGHFELFYQFVGFSDSCKNRRRVRVKCVLLPNESVDSLSFLYRSANWSEREAYDMLGIVFDKHPYLKRLIMPHDWVGHPLLRSYPLKGDEFAQWYEVDKIFGKEYREVVGKEQRDSARVDEKDTFNFAKIGYEQGKGEELKETEEKHAFKKIPFVKDLHKIAPTILKKRL

SEQ ID NO: 64353 - protein, 409 aa, Helicobacter pylori J99
MAQNFTKLNPQFENIIFEHDDNQMILNFGPQHPSSHGQLRLILELEGEKIIKATPEIGYLHRGCEKLGENMTYNEYMPTTDRLDYTSSTSNNYAYAYAVETLLNLEIPRRAQVIRTILLELNRMISHIFFISVHALDVGAMSVFLYAFKTREYGLDLMEDYCGARLTHNAIRIGGVPLDLPPNWLEGLKKFLGEMRECKKLIQGLLDKNRIWRMRLENVGVVTPKMAQSWGMSGIMLRGTGIAYDIRKEEPYELYKELDFDVPVGNYGDSYDRYCLYMLEIDESIRIIEQLIPMYAKTDTPIMAQNPHYISAPKEDIMTQNYALMQHFVLVAQGMRPPVGEVYAPTESPKGELGFFIHSEGEPYPHRLKIRAPSFYHIGALSDILVGQYLADAVTVIGSTNAVFGEVDR

SEQ ID NO: 64354 - protein, 121 aa, Arabidopsis thaliana
KFQGGWELDESVEEAASRECLEEAGVLGNVEHQLGKWDFLSKSRGTYYEGLMFPMLVTEQLELWPEQHVRQRIWMNVTEAREACRDWWMKEALDVLVERLSSPMNQPKEEKTMSISIETMC

SEQ ID NO: 64355 - protein, 267 aa, Prunus mume
MGTSPGKKVLLTSNGDAISHNIAFSLAQRGCSLVLMGKESCLRSIQQKIKGSLEGVVPVEVVDVDMEDEREGAFDEAVDKACHILGNLDAFVHCYTYEGKMQEHLELAEDEFKKIMKRNFMSAWFLLNAVGRRMRDYKSGGSIIFLTSIIGAERGIYPGAAAYSACSAAVQQLARTSALEIGRYQIRVNAIARGLHLEDEYPMFVGMERAKKLVKEAAPLERWLDVKNDLASTVIYLISDGSKYMTGTTIIVDGAQSLTRPRMRSYM

SEQ ID NO: 64356 - protein, 144 aa, Triticum aestivum
  misc_feature (71)..(71): Xaa can be any naturally occurring amino acid
  misc_feature (74)..(74): Xaa can be any naturally occurring amino acid
  misc_feature (85)..(85): Xaa can be any naturally occurring amino acid
  misc_feature (97)..(97): Xaa can be any naturally occurring amino acid
  misc_feature (99)..(99): Xaa can be any naturally occurring amino acid
MAPAVMASSATTVAPFQGLKSTAGLPISRRSGSAGLSSVSNGGRIRCMQVWPIEGIKKFETLSYLPPLSTXALXLKQVDYLIRSXKWVPCLEFSKVXFXVFRGAKQAPPGYYERVRLGQNGLPCFGLNPQGQVRVQESPTAQFP

SEQ ID NO: 64357 - protein, 429 aa, Shewanella oneidensis MR-1
MATKRIVIVGGGAAGLALASKLGRKLGGSDVVDVCLIDKSPIHIWKPKLHEVAVGVIDQSIEGLLYRDHGLKNGYRYLRGEIEQCDPDTKTIRLAAVYSDSGELLLEPRQIEYDFLVLALGGVSNSFNTLGAEQHCIFLDSLDNANLFHQKLLDALLQLNETQEKVSIGIVGAGATGVELAAELHHVIESVKEYGYLNISKHHLDVHLIEASPKILPQLPERVSARAQAVLDKIGIRLHIGVQVKEVTRDGFITQDGDMIKASLKVWAAGVKGPKAFQNFSKLPITPRNQVEVDACMRVKGQQDIYAIGDCALLILDSGQPVPPRAQAAAQMADTLYENIVNRLQGKVEKPFVYKDYGSLVSLSRFSAVGNLMGNLRSGTFFVEGHIARLMYISLYQRHLASLYGWFSAIIYRIAQKLLKWQRPKLKLH

SEQ ID NO: 64358 - protein, 255 aa, Arabidopsis thaliana
MAEVVLHIYDVTNSGSEKTNNTIVQINRFFKDGIGLGGIFHSAIQVYGNDEWSYGYCEQGTGVFSCPSGKNPMYTYREKIVLGKTDCTIFMVNQILRELSREWPGHTYDLLSKNCNHFCDVLCDRLGVPKIPGWVNRFAHAGDTALEVAGNTAMRVKQAKTELVSASKVAYRFLSNVTSNITNGSNGSNGSPQRPGTLNNSDNGSFRLQGSWLKGILNTAKPSTSTEIGNKEEDTNHTITNQKKQNRDSDVLLFQ

SEQ ID NO: 64359 - protein, 122 aa, Zea mays
MNSRRDFRSHRAALFDGIEEGGVRAPAYSSREIHEHENDQALDSLHDRVSVLKRLTGDIHEEVENHNRMLDRMGNDMDASRGFLSGTVDKFKMVFETKSSRRMATMVASFIAVFLLIYYLTK

SEQ ID NO: 64360 - protein, 227 aa, Ostreococcus tauri
MRDRTSRAPVMGAPAGVDNTQRRRWDRDVYAARAIEREGAATAREGETTRAIGRRASRGGGLMIRDDLRLDNVIARDYERDLASRVGSRQIVNAETGAGMGFQCAETGAILHDSSAYLDHINGKKQMKARGVSMRVERSTVEQVKAKFDEVKKRKAAAAKNEGKGFEERLAIAYEDEDAARARKKAKEAAKKAKKKAEEEAKMAELGGLDPEMAAMMGFAGFGGGKK

SEQ ID NO: 64361 - protein, 185 aa, Polytrichum juniperinum
MSEQSDAAQSYVDAAEETVNRLPASQPAPNSDQYTKPVSQRFLTKDKTVHQLLGGGRAADSALWRDKYLSIGTLVGSTVIWFLLEKSGYTFLTLLCNILMFGVDILFVWANVAALLHRNGPPVPELSLSEEFVTNIARSVRIELNKAMGVARDVALGKDFKLFLKVIALLWVVSTVTSWFNFLTC

SEQ ID NO: 64362 - protein, 484 aa, Arabidopsis thaliana
MQSHQNRSRLSLILRSRFIPSFSSPLSLFVVLAAVPLPIYFSGLLSGRNNKPLSVMRLNSNLASSMVESNISCTTFNILAPIYKRVDQKNHSTRESDFRTLWLARNQRILDLLLHQRSSVICLQEVWVGNEELVNMYHHQLSSSGYTIYQLARTNSRGDGLLTAIHKDHFKVVNYRELLFNDFGDRVAQLLHVKTVIPFPLNGKQDVQQEVIIVNTHLLFPHDSSLSIVRLHQVYKILEYLEAYQKENKLNHMPIILCGDWNGSKRGHVYKFLRSQGFISSYDDAHQYTDSDAHRWVSHRNHRGNICGVDFIWLCNPSDSRKPLRTSWVEAVFSIIKYQLHKASIAEDDAFTFLGAKNHSDSLTYSDFCLALQKVNLTGIPHGLSFEETKELWVRADLDGNGVFDYEELKKIWNMTMVNQPGNCKESVMESKKEEGEDEAIGLKVNKAILFPQEAEKGLWPENYNISDHACLTVQFSPVKMLCS

SEQ ID NO: 64363 - protein, 220 aa, Helicobacter pylori J99
MAKQEYKQLPKRAEVHSATEQFKDTIKTSLGLDLFKGLGLTIKEFFSPSVTIHYPMEQLPLSPRYRAVHHLQRLLDSGSERCIGCGLCEKICTSNCIRIITHKGEDNRKKIDSYTINLGRCIYCGLCAEVCPELAIVMGNRFENASTQRSQYGSKSEFLTSEQDAKNCSHAEFLGFGAVSPNYNERMQATPLDYVQEPSKEESKEESPTSPESHKGDENV

SEQ ID NO: 64364 - protein, 1119 aa, Sulfitobacter sp. EE-36
MPKRTDIQSIMIIGAGPIVIGQACEFDYSGAQACKALKEEGYRVILVNSNPATIMTDPGLADATYIEPITPEIVAKIIEKERPDALLPTMGGQTGLNTSLALEEMGVLEKFNVEMIGAKREAIEMAEDRKLFREAMDRLGIENPKATIVTAPVAASGKKDLAAGVQLALDALEYVGLPAIIRPAFTMGGTGGGVAYNRDDYEFYCRSGMDASPMGQILIDESLLGWKEYEMEVVRDTADNAIIVCSIENVDPMGVHTGDSITVAPALTLTDKEYQIMRNHSIAVLREIGVETGGSNVQWAVNPEDGRMVVIEMNPRVSRSSALASKATGFPIAKIAAKLAVGFTLDELDNDITGVTPASFEPTIDYVVTKIPKFAFEKFPGSEPYLTTAMKSVGEAMAIGRTIHESLQKALASMESGLTGFDEIDIPGLDSDLPADAPQNEAALIAAISKQTPDRMRTIAQAMRHGMSDVDIHGVTMFDPWFLARIREIVDAEAQVRKDGLPLTEDGMRKLKMMGFTDARLGTLTGRDEDNVRRARLNLGVKAVFKRIDTCAAEFEAQTPYMYSTYEAPAFDEVECEARPSDRKKVVILGGGPNRIGQGIEFDYCCCHACYALTDAGYETIMVNCNPETVSTDYDTSDRLYFEPVTFEHVMEILRVEQENGTLHGVIVQFGGQTPLKIAQALQEAGIPILGTTPDMIDLAEDRERFQQLVQSLGLKQPHNGIAHSDAEALEIAADIGFPLVIRPSYVLGGRAMEIVRDQASLERYIRDAVVVSGKSPVLLDHYLSGAVELDVDALSDGADVHVAGIMQHIEEAGVHSGDSACSLPPYSLSREIIAEVEKQTKALALALNVVGLMNIQFAVKDGEIYLIEVNPRASRTVPFVAKATDSAIASIAARIMAGEKLSAFPQRAPYRDDAAYDDVLPLGDPMTLADPNMPWFSVKEAVLPFARFPGVDTLLGPEMRSTGEVMGWDRDFPRAFLKAQMGAGNPLPRNGCVFFSIKDMDKSDDMLTAARILLEQGFTLRATRGTAAWLTEHDIACEIVNKVYEGRPNITDMMKDEAIQLVMNTTEGAQAVEDSKSIRSIALYDKIPYFTTAAGAYAAALAIKAQAEDEIGVKSLQG

SEQ ID NO: 64365 - protein, 549 aa, Oryza sativa (japonica cultivar-group)
MFFSRVKTDNRQITLRFPNPVPLYPVSASATGILGKGGGEFARGFWLMANIRALLIGLNYSIVAGLRVNTKFDARLCIAHFLTECLSSRPSYLASLGRHYKVPMEIRWLSSTAIGPARLLWQQLIGLQQQAMGTVSACSSWIRPTARFPPHLVVGMPALSPTMNQGNIAKWRKQEGEKIEVGDVICEIETDKATLEFESLEEGYLAKILAPEGSKDVQVGQPIAVTVEDLEDIKNIPADASFGGEQKEQSIASEAQKVETDAAKESSIITRISPAAKLLIKEHRLDQSVLNASGPRGTLLKGDVLAALKLGASSSSTKQKNAPAAPSSQPTHDFQAQSVTIPQQNDAYEDIPNSQIRKVIAKRLLESKQTTPHLYLSQDVILDPLLAFRNELKEQHGVKVSVNDIVIKAVALALRNVPEANAYWNNDKEQAQKCVSVDISIAVATEKGLMTPIIRNADQKTISAISSEVKQLAEKARAGKLAPNEFQGGTFRHSGILAVGRGNKIIEPVVDSDGTEKATVVTKMSLTLSADHRVFDGQVGGTDILRPVV

SEQ ID NO: 64366 - protein, 1080 aa, Magnaporthe grisea 70-15
MPRPRRPPLTIAQIVEQADQFEFNINIHLKHWVGAAETLYREGEFYKEEGNFAKAYLLLLRHCSLVLKKFPEHPMAHTRDGRKLIKPLQERLTRIISELEDLKRHINEAYNEWERLVRTGQIDDRPVPDSRYDKYAAQDPALSWNNATQAQLLDAGNNQELAVRLAKDDYIRRDAARRSIRQAGVSEYEEQIRRSGGVWEDWDARRGMGPRNTVDDRNDIQRQIQETRRRLDRSNDQDSEVVVRDFSYNDSWSSSAGSRSSRPPIQNPASQHYNYPSVSRPRPLNYNSYEASPAPSRPPKEQYPSYQDRLEPLPPPIPRKAPEAGRAPPTLPPKTLDQPEERNVQNSTSSVDRAVNELSKRKNITFLPAGYTEAGKPLRPIFVPRSLKDKFLEIAGPNTRKGLELCGIICGRPINNALFVAALLIPNQICTSDTCETEDEFQIFEFCEKENMIIIGWIHTHPTQTCFMSSRDLHTHASYQAISPESVAIVCAPKYNDFGVFRLTDPPGLPHVLRCPHTNTFHQHELPESEIYKDALHPLHSYNKSRPSAALIGIVSFGRPLAALMIRVRVRDESATVTNPFDIPQMENPQTDDPWRPGWDPRRLATLTRPDPRYYRYVPDLSGYFVVAHYQTPDWRPGEGDPSSIRWLLEEAPELIVDGRLRVDSEDLDGQTRSCLAGVGGSGAEARVMAQQKSPSSAPPVVRPFGGRPGWSGGESTYDQSCGVARDYPQRGRQDWQTGESKSQALQRHQNPQNHGFQGQQSQFELSMEQGNSKRNGPIHHQQQRPTPQRHSSNESSEDSQRSWIWPENSDIALPGQQMDPRHMRISQDVLAKIHRYPMGHPQSPWGWPETSDGSGVTGLTESESIGMREARRRHNAEIEKRAPHPQRFIRPSSPGTSNWGPRRDSRDGSTWSKNSSSSFRVQMPQWPSAQQYSGSRDSPSYLHGTQRVGIMSMGVSRSEATGVGLSKVQVWRTNSRLCRLGVTMTTAHHEPPGMAITDTASQAMSSHTLKTNRVLTITAVTAASSLRIIHREMSRRGTAGHRKTGDSSNECNNPNTIPSDTRRQTFSPPADVQAIRLRG

SEQ ID NO: 64367 - protein, 397 aa, Streptococcus pyogenes M49 591
MPKLSKRVLEMKESVTLAAGARAKALKAQGRDVLNLTLGEPDFFTPKHIQDKAIESIQNGTASFYTNASGLTELKAAIATYLKNQYGYHLSPDQIVAGTGAKFILYAFFMAVLNPGDQVLIPTPYWVSYSDQVKMAEGQPIFVQGLEENQFKVTVDQLERARTSKTKVVLINSPSNPTGMIYGAEELRAIGEWAVHNDILILADDIYGSLVYNGNQFVPISTLSEAIRRQTITVNGVAKSYAMTGWRVGFAAGEPEIISAMSKIIGQTTSNLTTVSQYAAIEAFCGSQSSLEEMRLAFEERLNITYPLLCQVPGFEVVKPQGAFYFFPNVKKAMEMTGFSDVTSFANAILEEVGLAVVSGAGFGAPENVRLSYATDIETLKEAVRRLHVFMESNEIN

SEQ ID NO: 64368 - protein, 514 aa, Rhodococcus sp. RHA1
MVRSAIPVELPVDSVDHPPEVVDVLVVGAGFGGLGTAIRLKQAGIDDFVVLDRAEDIGGTWRVNTYPGAQCDIPSILYSFSFAPNPNWTRLYPLQQEIHDYLRSCAENFGIVPHLRMGHDVQDAAWDDDSQVWHVTTSRGTWEARILVGAMGPFSEPAVPNLPALESFRGAVFHSAAWDHEHDLAGERVAVIGTGASAVQIIPRIQPIVGSMTVFQRTPTWILPHPDQPMTGWPRKLFARVPVAQRLARSGLDLVQEAMVPGFVYKPALLKGLAALGRAHLRRQVHDPELRTKLTPTYAFGCKRPTFSNSFYPALAQPNVDVITDGIREVRSNGIVTEDGVLHEVDTIVMGTGFRLTDNPAFDVVRGRDGRTLAEAWNGNARAYLGTTISGFPNFFMLLGPNSVVYTSQVVTIEAQIAYILSCLQEMNAQGAASIDVRPEIQQAFVDEVDERLQTSVWNTGGCNSYYLSGEGRNFTFYPGFNRRFRARTRRVDLHHYIISGAGASAKSIVRTAG

SEQ ID NO: 64369 - protein, 188 aa, Pseudotsuga menziesii var. menziesii
DDVIVISIDGAPKEGCQHISVLTEADETQCPSVAIHPDDVVALPYSSGTTGLPKGVMLTHKSLVSSVAQQVDGENPNLYFHSEDVILCVLPLFHIYSLNSVLLCALRAGAATLIMQKFNLTMLLELIQRYKVTVAPIVPPIVLDITKNPIVSQYDVSSVRIIMSGAAPLGKELEDALRERFPKAIFGQ

SEQ ID NO: 64370 - protein, 700 aa, Ostreococcus tauri
MANVRVEPAVETAEVEDGTRDPSTETFSVTTAINYANGAPHMGHAYESVSTDVLARYHRAYGRKVLFQTGSDEHGQKIAEAAEVAGVAPLAFVDGHVEEFRKLNERLSVSNDVYNRTTSEAHKKACAELFRRSRDNGDIYLDTYEGWYNVREETFVTESEAQASGYKDPVSGKDLKKMKEESYFFKQSRYQAQLIAHIESHPEFIQPSSRRNEILARLQNDELRDLSVSRTTFDWGIPVPDAPKHVMYVWFDALTNYLTGTGWPEETDKKDFWPASVHIIGKDIIWFHCVIWPCMLWSAGLQLPKTVFGHGFVTAEDGQKMSKSIGNVVDPNVVLEKFSSDTFRYYLMRCGVYGSDIPFSEAAMVSIHNADLADVIGNLVHRVTNLCNKSCGGVVPDCATEDIFDVLAVRARSEAAMAKFNIQAACEAAIEAVKATNKYLTDAAPWAVKGEGAEERKAVIIRSTIEAVYVSMHFLQPYIPTACEAIWELKPFGENVATGAKVTHGDILFAKFEAEKKEIAKKEEPAPKPKPVPADAPVDVSRLELVVGTVKSVKRHPDADSLYVEEIDLGDEAPRQVVSGLVKHISEEDFTGLRVLCVANMKPSKMRGVESTAMVLCGTNAEGKTEPVSPPEGAANGTRVKCEGFNGEPDPVLNPKKKVFEAVSADFSINGDGVPTYKGVPFTAAEGPCTLPTIRDGVVK

SEQ ID NO: 64371 - protein, 185 aa, Nicotiana benthamiana
RPASVRGRLEPIVAERIDEITAELQTSGFQSVHPVDRIKTGFDYFKKEIYDKNPELIDELKKGQEPKFLVFACSDSRVSPSHVLNFQLGEAFMVRNIANMVPPYDKTKYSGVGAIIEYAVLFLKVENILVIGHSACGGIKALMDLPENGSESTDFIENWVKIGLPAKAKVPARAAARSLLFCQNL

SEQ ID NO: 64372 - protein, 188 aa, Pseudotsuga menziesii var. menziesii
DDVIVISIDGAPKEGCQHISVLTEADETQCPSVEIHPDDVVALPYSSGTTGLPKGVMLTHKSLVSSVAQQVDGENPNLYFHSEDVILCVLPLFHIYSLNSVLLCALRAGAATLIMQKFNLTMLLELIQRYKVTVAPIVPPIVLDITKNHIVSQYDVSSVRIIMSGAAPLGKELEDALRERFPKAIFGQ

SEQ ID NO: 64373 - protein, 177 aa, Nicotiana benthamiana
SLYMVFACSDSRVCPSHILNFQPGEAFVVRNIANMVPAYDKTRYSGVGAAIEYAVLHLKVENIVVIGHSACGGIKGLMSLPADGSESTAFIEDWVKIGLPAKAKVQGDHVDKCFADQCTACEKEAVNVSLGNLLTYPFVREGLVKKTLALKGGHYDFVNGGFELWGLEFGLSPSLSV

SEQ ID NO: 64374 - protein, 1076 aa, Buchnera aphidicola str. Bp (Baizongia pistaciae)
MPKRNDIKSILILGAGPIIIGQACEFDYSGAQACKALKELGYKIILVNSNPATIMTDPDMADSTYIEPIHWSIIKKIIQQEHPDAILPTMGGQTALNCVLDLDNHGILKKHKIEIIGATINSIKKAENRKLFEKSMNKIGLKTAKCEIVHNINMAHNVIDKIGFPAIVRPSFTMGGSGGGIAHNYEEFKNICTEGLKLSPSKELLIDESLIGWKEYEMEVVRDKNNNCIIVCSIENIDPMGIHTGDSITVAPAQTLTDKEYQNMRNASISILKEIGVETGGANVQFAINPDNGDMIVIEMNPRVSRSSALASKATGFPIAKIAAQLAVGLTLDELKNDIIGINSTASFEPSIDYVITKIPRFNFEKFLGCNDRLTTQMKSIGEVMAIGRTFQESLQKAMQSLEIGVSGFNSKIKKYTSKSIKKIKNELKEAGSERLWYIADAFRMSIPMSEIFSLTLIDKWFLFQIKEIIDIEQEIQKIDINKIRYNHFKYFKKKGFSDLRIAQLSNNSEKKIRSIRYNLKLHPVYKRIDTCSAEFANDTAYMYSTWEDECESSPNNNNKKIIILGGGPNRIGQGIEFDYCCVHAAQALREDGFETIMINCNPETVSTDYDISNRLYFEPIILETILEIVRIEKPYGVIIQYGGQTPLKLAKELEQANVPIIGTSPDSIDKSENRKRFQKIVSMLNLKQPKNATVTNLQEAIIQAKSIKYPIMIRPSYVLGGQSMEIVYDEKNLTNFFNNVCINFKKFPILLDHYLENAIEVDVDAICDGTHVFIGGIMEHIEQAGIHSGDSACSLPAYTLNKNIQNEIRSQVKKLALSLSVKGLMNVQFAIQNENIYIIEVNPRAARTIPFVSKATGVALAKIAARVMIGKTLLEQNCIHEIIPSHYSVKEVVLPFNKFFGVIPELGPEMKSTGEVMGIGKNFKDAFSKAMLAAQANMKKSGRVLISVKNSDKKNIVSLAKKLKNIGFKLDATTGTALSLINSGINARLVNKIQEGKPDIQDRLKNNEYVYIINTTDSNKTIKDSKIIYNSALQDKIHYDTTINGARATIMAITSNPKKYITSLQKMHHQIKSTN

SEQ ID NO: 64375 - protein, 178 aa, Nicotiana benthamiana
KAASLVFACSDSRVCPSHILNFQPGEAFVVRNIANMVPAYDKTRYSGVGAAIEYAVLHLKVENIIVIGHSACGGIKGLMSLPADGSESTAFIEDWVKIGLPAKAKVQGEHVDKCFADQCTACGKEAVNVSLGNLLTYPFVREGLVKKTLALKGGHYDFVNGGFELWGLEFGLSPSLSV

SEQ ID NO: 64376 - protein, 145 aa, Acidobacteria bacterium Ellin345
MSILKLCDQSPAFVSINASVADAITMMIDRHAGAVAVVEENHVVAGMFSERDVMRKFALSGRSAESTPVREYMSQYVVMGSPETTPAEALQVMIESRHRHLPIVDSDGKLLGVISIRHVLEAQVDLLTEQLRRSEEDRSASNTIQ

SEQ ID NO: 64377 - protein, 718 aa, Ureaplasma parvum serovar 3 str. ATCC 700970
MNELVKKKLDDLYDFLKQKKYSSQTIELVHKSFDFANYYHGDQTRKSGEPYIIHPIATVRILASWDMDESTLVAGMLHDVLEDTNCPEEVMEKTFGKEVTQLVCFVTKVSLYSKNRRNKVSHTNLEEKYSIQVFMSMTQDIRAMIIKIADRYHNMQTIQYLRLEKAKRIATETLEIYANISGRLGMYRVKTDLLDMSFKILDPQNYQLVNDSINKLVENNQKKWNEILARLKNILIANNIKAEFEWRLKGIYSTYKKITSGYEVKDIHDIYAIRVILDDVYLCYQTLGLVHMNFTYIINTFKDYISTPKWNLYQSIHTTISYEGTLVEIQIRTTKMNLFANNGLAAHWKYKEQKDNKTEILLTVNNVLLRDFLLSTDKGIKTIKDVTTGTIFDVLILNSNKWITVSNGSTLLDVAYKYDINNFFNILAIYRNGERSHFDTHVETGDTIKISYSNGIETIRPNWITLANNDVVKLHINNHLKKYELNKQITKEQFLANAEFFLEGKIMSEEHAIKRLEKEFQVNSINTFLDNIANTDIDLQTKYKVFSENKQVSREAINTIKNQAWKWLADSSYFSGLENLYFTDFEISPCCSKIPGINCVAKIVRNKVEIHRNDCSKVKNSRSKTIVIEWSKEKLENRPRYFKVNLTLKGNWSESVGNVLCNTLIRMKANISKVDISKNKTARTHDTFLKIYVKNLDHLQKIILELQAKNVINEWRLI

SEQ ID NO: 64378 - protein, 412 aa, Petunia x hybrida
MSSCKEEDTQQKWLWVNGPIIIGAGPSGLAVSACLKENGVPSLILERSDCIASLWQHKTYDRLKLHLPKQFCQLPLFGFPDNFPKYPTKRQFISYLESYAKHFSINPKYKQAVQVAEFDHVSGFWKVQTQNFQYFSKWLIVATGENAEPVIPNIQGMDKFKGPVMHTSLYKSGTEFNNQRVLVIGCGNFGMEVSLDLCRHNAIPHMVARNSVHILPREMLGISTFSMAMALLKCLPLRIVDKFLLLVANLTLGNTDKLGLRRPKTGPIELKNATGKTPVLDVGALSQIKAGKIQIVHAVKEITKIGAKFVDGKEGEFDSIILATGYKSNVPSWLKGTEFFTEQGMPKTPFPNGWKGENGLYTVGFTRRGLLGTACDAKNIARDIGDEWRKYKGFCKNFCISRNLSDSQGICF

SEQ ID NO: 64379 - protein, 452 aa, Arabidopsis thaliana
MKKIELVFIPSPGIGHLRPTVKLAKQLIGSEEHFFNHQSQDRLRYEPISVEKQPPTANLEPSQVYIEKQKPQVRDTVSRIINPTRKLAGFVVDMFCSSMIDIANEFGVPCYMIYTSNATFLGITLHVQEMYDDKKYDVSDLDESVNELEFPCLTRPYPVKCLPHILSSKDWLPFFAAQGRSFRKMKGILVNTVAELEPHALKMFNNVDLPQAYPVGPVLHLDNGDDDDEKRLEVLRWLDDQPPKSVLFLCFGSMGGFTEEQTREVAVALNRSGHRFLWSLRRASPNIMMERPGDYKNLEEVLPDGFLERTLDRGKVIGWAPQVAVLEKPAIGGFVTHCGWNSMLESLWFGVPMVTWPLYAEQKVNAFEMVEELGLAVEIRKCISGDLLLIGEMEIVTAEDIERAIRCVMEQDSDVRSRVKEMAEKCHVALMDGGSSKTALQKFIQDVIENVA

SEQ ID NO: 64380 - protein, 381 aa, Silicibacter sp. TM1040
MRNSSRSKVDPFIVMDVMEAARKAEEQGRHIIHMEVGQPSTGAPEAARRALADALERDSMGYTVALGLPALRKRIAALYGEWYNVDLNPERVVITPGSSGAFILSFTALFDSGDRVGIGAPGYPSYRQILSALGMQPVDIQTAPEHRLQPVAADIRDQNLAGLMVASPANPTGTMLDKPALSALMEAAQAEGASFISDEIYHGIEYEAKAVTALEISDECYVINSFSKYFSMTGWRVGWMVVPEDHIRTVERIAQNMFICAPHASQVAALAAMDCRDELEANLAVYARNRALMLEGLPKAGFSKIAPPDGAFYVYADVSDLTQDSRAFAAEILEKAGVAVTPGLDFDPVRGATTLRFSYARSTADIEEGLARLRAFMEARG

SEQ ID NO: 64381 - protein, 337 aa, Magnetospirillum magnetotacticum MS-1
MPYKRITLTHFLLQEQRRLGGSGSFTALMTDIIFACKMISHEVNRGALAGNLGVAGSENVQGEEQKKLDVLANDIFLHMNALGGSYAGMASEELEDVHAVHGAADGKYLLLFDPLDGSSNIDVNISVGSIFSILKLPEGADAGSKDAFLQPGVKQVAAGYALYGSSTMMVLTTGNGVNGFTLDNNVGMFLLTHPNMTIPADTKEFAINASRERFWEPPVKRYIDECRQGKEGPRGKDFNMRWVASMVAEVHRILCRGGVFLYPADTENMKKGGKLRLMYEANPMAFIVEQAGGAATTGRGRMMEVQPTGLHQRVPVILGSKTEVERIGAYHTEYDAK

SEQ ID NO: 64382 - protein, 307 aa, Zea mays
  misc_feature (175)..(175): Xaa can be any naturally occurring amino acid
SDVGGDDALGIWKIDDIDNSFHTQPFRIKYARQDIYLSVMVSFNIFNSEEEGPAASDVMMKFELIYAPTLDNGSELHASSATSSATVHEFRIPHRALLGLHSYCPVHFDAFHSVLVDLTLHIVYLKAGAAKSSLKPLEQSFGSKSYGIVKASLISREILLEEVKKISNAVGSTLXDLDRTDLTLGKYETVQPSKSASPSYSYGQGTPTKCSPQMTGILRDFLESSGVVVGSTDDILLYTLSEEELFELFQIVSSQLSFIWNEFLKFHRWQESCHNSLIRGRSKANKKAPITGVLTTTSTTTTTYTKI

SEQ ID NO: 64383 - protein, 379 aa, Sorghum bicolor
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCRSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFTEINKAFDLMAKGEGIRCIIRMEN

SEQ ID NO: 64384 - protein, 358 aa, Cryphonectria parasitica
MAEFVRAQIFGTTFEITSRYSDLQPVGMGAFGLVCSARDQLTNQNVAIKKIMKPFSTPVLAKRTYRELKLLKHLRHENIISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKSLPKRERQPLASKFKNADEQAVDLLERMLVFDPKKRITASDALAHEYLAPYHDPTDEPVAEEKFDWSFNDADLPVDTWKIMMYSEILDYHNVDASGASAAMGEFNGQ

SEQ ID NO: 64385 - protein, 664 aa, Magnaporthe grisea 70-15
MCPESIQVSDAGSATTDSVGLYIPMPNPFLEKLFSLDGRLAVVTGGTRGIGQAMAVALAEAGADIILIQRDESNLDTKSQIEALGRKATVYTCDLSSQESVERLAPRILADGHDVSVLVTCAGIQRRHPAHIFPMGDWDEVLQVNLKTVWTLDRDFGAYMLTRPADPATGHRGSIINVASLVSFQGGITVPAYAAAKGGIAQLTKALSNEWASKGVNVNAIAPGYVATDMNEALLKDEARAASILARIPAGRWGNADDFKGATVFLAGRGSFTSDAIVTLLQDLDSGQKNRGELQLLYGPKDLRVEERTIPAPAAGEVQVSIRATGICGSDMHYYVHGANGDFKVREPLSLGHESAGVVEAVGPDVTDLKVGDRVAVEVGIACDDCALCKSGRYNLCKGMKFRSSAKIFPHFQGTLQDRINHPARLTYKLPDSASLAEGALLEPLGVAIHGVKRAGEQKGKTALVLGAGAVGLLTAAVLRVEGIESIAIADIVPERVQFAVAHGFADKAVVVPSKRLPPTASADEKLALARETAALLTREGNGGDEYDTTFECTGVESCVQAAIYATGPGGRVMMIGMGTPVQTLPLGAAALREVDLLGVFRYANTYPRGIELLAGRESNGMPDIGLLATQNVKGLDRAEDAFAIAAKPVDADGKLVLKVIIET

SEQ ID NO: 64386 - protein, 229 aa, Alkalilimnicola ehrlichei MLHE-1
MKADLSRIRAVLYDLDGTLVDSAPDLAVAVNRVLADLGQQPREENEIRRWVGNGARRLIMRALTGEHEGDPGDEHTDPALEQFFEYYGERVAERSRLYPGVAEGIAGVAELGIAQAVVTNKPRRFAEPLLETLGIRRYMATVVGGECAPVKKPDPAPLRLALERLGVEPAQALMVGDSAVDVGAARNTGMKVICVPYGYNAGNAIEDAFPDAMVKSLAEIPAMLRSRAA

SEQ ID NO: 64387 - protein, 226 aa, Haloarcula marismortui
MRILGIEGTAWAASASVFETPDPARVTDDDHVFIETDAYAPDSGGIHPREAAEHMGEAIPTVVETAIEHTHGRAGRDGDDSAPIDAVAFARGPGLGPCLRIVATAARAVAQRFDVPLVGVNHMVAHLEVGRHRSGFDSPVCLNASGANAHILGYRNGRYRVLGETMDTGVGNAIDKFTRHIGWSHPGGPKVEQHARDGEYHELPYVVKGMDFSFSGIMSAAKQAVD

SEQ ID NO: 64388 - protein, 337 aa, Alkalilimnicola ehrlichei MLHE-1
MAIKVAINGYGRIGRGVLRALYESGRSDELRIVAVNDLCELRTAAHLTRHDTTHGRFPGDVQTGEGELVVNGDRIRYTSERDPDRLPWEALGVDLVMECTGRFASREQAERHLRAGARKVLISAPGGPEVDATVCYGVNHDILRAEHTVVSNASCTTNCLAPIVQPLHRALGIEQGLLTTIHAYTNDQVLTDSPHADLRRARSATLSQVPTKTGATRALGLVLPEMAGRLDGYAMRVPTLNVSLVDLTFDAGRATSVEEVHEIIRAAAAGPMAGVLAVNDDPLVSIDFNHHPASAVFDATLTKVKGRLVKICAWYDNEWGFANRMLDTAVAMMRAAG

SEQ ID NO: 64389 - protein, 383 aa, Buchnera aphidicola str. Bp (Baizongia pistaciae)
MSKQDYYKTLGVTQSSDEREIKRAYKKLAMKYHPDRNPGNKNSEEKFKTIKEAYEILIDPKKRTAYDQYGHSAFEQGNSTGNNNTFTHSFSSNSDFSDIFGDVFGDIFGGTRKQKSERQGSDLRYDMTLTLEEAVRGTIKEIKIPTLQKCPTCYGYGTKTGTKPQFCPTCRGNGQIQMRKGFFTVQQTCPQCHGEGNFIRDPCRRCHGNGRIEISKTLSVKVPPGVDTNDKIRLNNEGEAGENGAMAGNLYVQINVKKHPIFEREENNLYCEVPISFSMAALGGEIEVPTLDGKVKLKIPCETQSGKLLRIRGRGVKSIRNNNRQGDLLCRIIVETPVNLNDLQKDLLYKLGESFNGFKGEKNSPKSKRFFEGVKRFFDDLTR

SEQ ID NO: 64390 - protein, 136 aa, Ustilago maydis 521
MARTKQTARKSTGGKAPRKQLATKAARKSAPSAGGVKKPHRYRPGTVALREIRRYQKSTELLIRKLPFQRLVREIAQDFKTDLRFQSSAVMALQESAEAYLVSLFEDTNLAAIHAKRVTIQPKDIALARRLRGERT

SEQ ID NO: 64391 - protein, 995 aa, Listeria monocytogenes str. 4b F2365
MGAKVSVQINGVARDVVEGTRILDYLNAEGIQHPHICYSEQIGPIQSCDTCMCEVDGELVRACSTNLTDGMEIKTNSELAKDAQLEAMDRILENHLLYCTVCDNNNGNCKVHNTTELLGVEKQERPYREKGYLNDFSHPFYRYDPDQCILCGRCVEACQQVQVNETLSIDWERSQPRVIWDDDRPANLSSCVSCGLCATVCPCNALMEKSMLGQAGFMTGLDEDMLEPMIDMVKKVEPNYQTVFAVSEMEAAMRETRTKKTKTVCTFCGVGCTFEVWTKDRKILKVEPTGEGPVNKFATCVKGKFGWDFVNSEKRITTPLIREGNEFVPASWEDAIHLVATKLREIQAKYGNDSIGFISSSKTTNEENYLMQKLARQVFETNNIDNCSRYCQAPASDGLTRTVGIGADSGTVEDIETAGLVIIVGASPADGHPVLASRIKRAQKTRGQKLIVSDLRKHEMAERSDLFMHPKQGTDFVWLTAVAKYMIDQGWHDEAFMENRISNVADYLSFLEPFTLEYAEKETGLSVEILKKVAQMVYEADGTAVCWGMGVTQNIAGSHTSSAIANLLLVTGNFGRHGAGAYPLRGHNNVQGACDMGSLPNVLPGIQPLGNDEVRARFEEAYGVSISPEPGLKNNEMLDAIEAGTLHSMYVIGEEMAWVDSNSNHVQEILASLDFFVVQDVFLSKTAQFADVVFPAAPSLEKEGTFTNTERRVQRLYEVLEPLGDSKPDWWIIQEVAKACGRTDWNYDHPSEIMDEIASLAPFFAGVRYDRMQGFNSLVWPVSADGKDMPLLYEERFNFPDGKAQFSTLPYIAPITFPEEYNLTLNNGRLLEQFHEGNLTDKSKGLDYKLPEVFVEVSHELAKERDLESGSLVRLSSPYGRIKLRAVVTERMKGNEVYVPMHSVSSETAVNLLTSSAGDVRTKTPAYKQTKVNLTVLEKTGKNPLPDHNPRNRKRFPQNGAEVARKWSREDYQPISKVNCACGGNCGCGGKRRNH

SEQ ID NO: 64392 - protein, 305 aa, Methanosarcina barkeri str. Fusaro
MVKPEKFIPKAVEKISKEIKDGRAIIALSGGVDSSVCAELAHRAIGGRLQPIYIDTGLMRKGETERIKHIFSHMNLDIVYAKDRFLAALKGITDPEEKRKAIGETFIRVFEEEARKLEADYLIQGTIYPDRIESEGGIKSHHNVGGLPSVMDFKKIVEPIEDLYKDEVREVAWALKLPDEICERMPFPGPGLAVRILGEVTEEKLEVAREANSIVEEELLDRFCPWQTFAAVIGKGTGVKGDIRAYGWIIAVRAVGSRDGMTAEALELPWDVLKKLESRITSEIPKVARVVYDITPKPPATIEFE

SEQ ID NO: 64393 - protein, 597 aa, Buchnera aphidicola str. Bp (Baizongia pistaciae)
MKKEIKRDDVNVIEKDFGNNNSIILKLFKKFGEDSFFIQTTVTDIIVLWIDGSLLLALAKFLLTINNPYNMLFDLYGIDERMRLYKHNLPLSHFSVVYHFISINRNSDIILKIALLEEKLSLPTLTKLYPNANWYEREIWDMFGISFENHPNLIRILMPKTWVGHPLRKDHPARATEFDPYVLNKYKEDIEMEALKFKPEEWGMKKNKQSKYMFLNLGPNHPSAHGAFRIILQLDGEEIVDCVPDIGYHHRGAEKMGERQTWHNYIPYTDRVEYLGGCINEMPYVLAVERLAGIEVSQRIEVIRIMLSELFRINSHLLFISTFIQDVGAMTPVFLAFTDRQKIYDLIELITGSRMHPAWFRIGGLAHDLPKGWNALLKEFLLWMPKRLLKYINVALKNSILISRSKGIAEYNKHDALLWGVTGAGLRATGINFDVRKKRPYSGYQNFDFEVPIGAGISDCYSRVMLKLEEIWQSLAILKQCLENMPEGPFKMDHPNTTPPHKVRTLQHIETMISHFLKVSWGPVLSSNESFKMVEATKGINSYYLISDGNTMSYRTRIRTPSFPHLQQIPSVIRGNLISDLIAYLGSIDFVMSDVDR

SEQ ID NO: 64394 - protein, 77 aa, Triticum aestivum
GVKECVGHDRVKSYTDKGITIWSGNDHECHDSRCKYGGTGVISVASNPVPGLMHSLMFEGENAALNEKMLPLMKWMF

SEQ ID NO: 64395 - protein, 245 aa, Zea mays
SSWPAAERSHPRWILCNRTSQDEYGGHRRKGMDPTVERLKSGFQKFKTEVYDKKPELFEPLKSGQSPRYMVFACSDSRVCPSVTLGLQPGEAFTVRNIASMVPPYDKIKYAGTGSAIEYAVCALKVQVIVVIGHSCRGGIRALLSLKDGAPDNFHFVEDWVRIGSPAKNKVKKEHASVPFDDQCSILEKEAVNVSLQNLKSYPFVKEGLAGGTLKLVGAHYDFVKGQFVTWEPPQDAIERLTSGF

SEQ ID NO: 64396 - protein, 465 aa, Bacillus subtilis subsp. subtilis str. 168
MAHTEQYRFPKDFWWGSSASATQMEGAADRDGKGQNIWDYWFEKEPHRFFDHVGPADTSQFYDNYKEDIRLMKELGHNSFRMSISWSRLIPNGTGEINDKAADFYNNVIDELIANGIEPFVNLFHFDMPMALQKIGGWVNRETVDAYENYARTCFRLFGGRVKKWFTHNEPIVPVEGGYLYDFHYPNKVDFKEAVQVGFHTMLSSARAIQAYREMKQDGKIGIILNLTPSYPRSSHPADVKAGEIADAFFNRSFLDPSVKGEFPKELVDILKHEGFMPDYNAEDLDIIKKNTVDLLGVNYYQPRRVKAKEHLPNPDAPFLPDRYFDPYVMPGRKMNPHRGWEIYEKGVYDILINLKENYGNIECFISENGMGVEGEERFRDEQGIIQDDYRIEFIKEHLKWIHRAIQEGSNVKGYHLWTFMDNWSWTNAYKNRYGFVSVNLEKDGERTVKKSGKWFKEVAEHSGF

SEQ ID NO: 64397 - protein, 583 aa, Oryza sativa (japonica cultivar-group)
MSVFTDAEPPWHCTGVVDAVEAAAGDSGSSCSSPATSASPCALPLGTWEWDRLAKTSVVSDWALNCSGGGPALVSLPASSFFTGNLVVVLPYRQVFMSVFTDAEPPWHCTGVVDAAAAAAADSGSSCSPPAASASPCALPPGTWEWDRPAETSVVSDWALNCGPALVSLPASSFFAGNLAGGFLLATLADTHLGRRKMLLLSLVTMSVAAALTAFSPNVWVYSALRFVSGFGRSMVGTSAMVLSTELDGKRWRNTVSAAGFVFFSVGFVSLPALAYTFREASWRNMYVWTSLPSLCYAVLLYLLVQESPRWLLVRGRKQEAIEAVRQIASLNGGGGGITTSSFSMLDACAVELGDGGEGMFATLHSIWERRRALRRLAAITAASFGVGMVYYGMPLNVGSLSPSNLYLSVAYNAVAELPSSILAWLLMGRWFNRRGSVVALTTASGLCSLAACVPAVVLPDGARMAAEVASFFASCTAYDMMLMYTIELFPTSVRNSAVGLVRQAVALGGVVAPVLVALGRETTSYWSSSFGVFGLAVGCLGLLVTCLPETRGRRLSDTMEEEEAAVLSSSGASDMDNNGELV

SEQ ID NO: 64398 - protein, 339 aa, Pseudomonas putida GB-1
MNIVHKALTASLLALSVSSAFAAGSPGVEQHTQAFLEALEKGGGKPLEQLSPTDARAVLTGAQASVKVDLSGIEVKERTIQANGESIKLQVVRPANAKGDLPVFMFFHGGGWVLGDFPTHQRLIRDLVVGSGAVAVYVDYTPSPEAHYPTAINQAYAATRWVAEHGKAIGVDGKRLAVAGNSVGGNMAAVVALKAKEAGTPALRFQLLLWPVTDASFETASYKQFAEGHFLTTGMMKWFWDSYTSDTSARAQVYASPLRASTEQLKGLPPALVQTAEFDVLRDEGEAYARKLNAAGVTVTSVRYNGMIHDYGLLNPLSQVPAVKAAMRQAAGELKVHLQ

SEQ ID NO: 64399 - protein, 356 aa, Marinobacter sp. ELB17
MSGSTMKIAVIPGDGIGKEVMPEGVRVLEAAALKYGFDMVFTDFEFASCEYYQTHGKMLPDDWKNQIAGHDAIFFGAVGWPDTVPDHVSLWGSLIQFRREFDQYVSLRPARLMRGVPSPLAGRKPGDIDMMIVRENTEGEYSSIGGKMFPGTDREIVMQETVMTRTGVDRILRYAFDLAERRGGRLTSATKSNGISITMPYWDERVAEMAKAYPAVTVDKYHIDILTALFVLHPDRFDVVVASNLFGDILSDLGPACTGTIGIAPSGNINPERKFPSLFEPVHGSAPDIAGQGIANPVGQIWAGAMMLDHLGHPEAAADIVRAIEKVLAEPGMRTRDLGGTAGTTDCGKSIANALN

SEQ ID NO: 64400 - protein, 356 aa, Marinobacter sp. ELB17
MKTYKIAAIPGDGIGIEVIDAGLRALTALAESDGGFKLDVTNFDWGSDRYKREGKFMPADGPDQLRAFDAILFGAVGAPDVPDHLTLWGLRLAICQPLDQYANVRPTRILPGIKSPLEGVCPGDLDWVIVRENSEGEYAGQGGRSHRGQSHETATEVSIFTRVGVERIMRYAFKLAQSRPRKLLTVVTKSNAQRYGMVLWDEVAAEVAGDYPDVKWDKMLVDAMTVRMTMKPKSIDTVVATNLQADILSDLAAALAGSIGIAPTANFNPEGVTPSMFEPIHGSAFDITGQGIANPVGTFWSASMMLEHLGETAAARRMMNAVEMVTADRDLHTPDLGGSATTDQITEAVIAAIRNN

SEQ ID NO: 64401 - protein, 455 aa, Triticum aestivum
  misc_feature (211)..(211): Xaa can be any naturally occurring amino acid
  misc_feature (276)..(276): Xaa can be any naturally occurring amino acid
  misc_feature (295)..(295): Xaa can be any naturally occurring amino acid
  misc_feature (311)..(311): Xaa can be any naturally occurring amino acid
MSRPDDGHRSFFPVGNPFRVILPGGPHLPRKLQALLKSYEDALALSLRKLKPENALEVLTLSWMRLAVDCLSELHANIGTLITELELPVSDWDEKWVDIYLNSSVKLLDICIALSSELARLDQGQLLVKYVLHVLDTKSGVPSLEQLKRAEVSLKEWMDKVDTARPRLDSCSTALQELAGSLCLMKVKNSAKGKVLMRALYGIESVTVFTXSVFVAALSGSPKPLVELHVPQKFGWSQAFNDLHAHISGGDEGRLSRGSVSAVKELEEVEAFAQEXCHALTRTAQLEEENDNLAXAVSLSKQMVMPDITLXQKEKPECNLKSADDSSQECEVIMTEIGTEEGTQEAEIMQDTHCESKLSTLESISEDDKMISGANGFIDENMTIVPERTSISEGREELLDCISSMSKSAEGLRLGLDSLSKRVGDFFQIVLTGRDALLCNLRMSDAASKVTEVRS

SEQ ID NO: 64402 - protein, 423 aa, Oenococcus oeni PSU-1
MEEKRSNGAIYDVYERPPFPMLFGLSLQHLFSMFGATVLVPLVVGLNPGVAIFSSGVGTLLHMLITRGKIPAYMGSSFAFVIPMTSLMKSFGYPAVAQGVFSVGIIYLIVALIVAKAGSAWIDKIFPPAVVGPIVMVIGLSLAGSAATNATINSATNKYEIKIFIVALLTLAATIFYNMYFKGFLGMIPVLLGIITGYIFAIIFGLVDFQSVAQAHWFALPNFNSLFASKKLYPSAILDMAPLALVTISEHLGHIMVLNKITGRNFFRDPGLNKTLAGDGTASIAASLVGGPSVTSYGENIGVMQMSKVYSVWVIGGAAVLAVLLSFVGKLSALIQTIPGAVIGGVGFMLYGVIAAAGLQIIVDNKVDYSKKRNLMIAAPILVIGIGNFDLQLGNLEFTGVAMATVIGIVLNLVLPKVAASEK

SEQ ID NO: 64403 - protein, 666 aa, Alkalilimnicola ehrlichei MLHE-1
MPTRRDLANAIRALSMDAVQRAHSGHPGAPMGMADIAEVLWNDYLRHNPANPHWWDRDRFVLSNGHGSMLLYSLLHLSGYELGIDDLKAFRQLHSRTPGHPEYGYTAGVETTTGPLGQGLANAVGLALAERTLAAQFNRPGHELVDHWTYCFLGDGCLMEGVSHEACSLAGTWKLGKLIGFYDDNGISIDGKVEGWFTDDTPGRFEAYGWHVVREVDGHDSEAIKRAIDEARAVTDRPSLICCKTVIGFGAPNVCGTHGVHGAPLGDEEIQATREFLKWEHGPFEIPREIYSGWDARARGKQLEAAWHERLAAYRKAHPEMAAEFERRMKGALPERFAQHAEEALAEAVDESAKVATRKASEQALNRLGPYLPELLGGSADLSGSNNTKWEDCAVIGGAKADADGNYLHYGVREFGMSAIANGLALHGGFIPYTGTFLVFSDYARNAIRMAALMGIQQIFVHTHDSIGLGEDGPTHQPVEHLGSLRMIPGLDVWRPCDAIETQAAWQAALERRDGPSLLALSRQGLVAQQRTDEQVALIRRGGYVLAEPKQGEAELILMATGSEVAIMVEAAERLADRGRRVRVVSMPCLEVFQSQPADYREAVLPAGVPVIAMEAAHPMPWQALLGDRGRVIGIDTFGESAPGPALYEHFGINVDAVVKASTTVI

SEQ ID NO: 64404 - protein, 510 aa, Vibrio vulnificus
MSAKKPLALVILDGYGYREDTASNAIANAKTPVMDALIANQPNTLISASGMDVGLPDGQMGNSEVGHTNIGAGRVVYQDLTRITKSILDGEFQQTAALVEAIDTAVKAEKAVHIMGLMSPGGVHSHEDHILAAVEMAAERGAEKIYLHCFLDGRDTPPRSAEGSLQRFQDLFAKLGKGRVASLVGRYYAMDRDNNWDRVQVAYDLLTQAKADFTYDSAVAGLAAAYERGENDEFVKATEIKAEGQESAAMQDGDAVIFMNYRADRARQITRTFVADFAGFERAVFPAVNFVMLTQYAADIPLAIAFPPASLENTYGEWLSKQGQTQLRISETEKYAHVTFFFNGGVETEFAGEERQLVASPKVATYDLQPEMSSTELTEKMVAAIKSGKYDTIICNYPNADMVGHTGVYEAAEKAIEALDASVGQVVEAIKEVGGQLLITADHGNAEMMVDPETGGIHTAHTSLPVPLIYVGDKAVEFKEGGKLSDLAPTMLSLAGLEIPAEMTGQVLVK

SEQ ID NO: 64405 - protein, 261 aa, Solanum berthaultii
MASSKERENLVYIARLAEQAERYDEMVDAMKNVANLDVELTVEERNLLSVGYKNVVGSRRASWRILSSIEQKEEGRGNEQNVKRIQNYRQKVEAELTDICNNIMTVIDEHLIPSCTAGESTVFYYKMKGDYYRYLAEFKTGDDKKEVSDLSLKAYQTATTTAEAELPITHPIRLGLALNFSVFYYEIMNSPERACQLAKQVFDEAISELDSLNEDNYKDGTLILQLLRDNLTLWTSDIPEDGEEALKGDAANKVGAGEDAE

SEQ ID NO: 64406 - protein, 1065 aa, Geobacillus kaustophilus HTA426
MPKRRDIETILVIGSGPIVIGQAAEFDYAGTQACLALKEEGYKVILVNSNPATIMTDTEIADKVYMEPLTLDFVARIIRKERPDAILPTLGGQTGLNLAVELAKAGVLEECGVEILGTKLEAIEKAEDREQFRALMNELGEPVPESAIIHSLEEAYAFVEQIGYPVIVRPAFTLGGTGGGICTNEEELVEIVSTGLKMSPVHQCLLERSIAGYKEIEYEVMRDANDNAIVVCNMENIDPVGIHTGDSIVVAPSQTLSDREYQLLRNASLKIIRALGIEGGCNVQLALDPDSFRYYVIEVNPRVSRSSALASKATGYPIAKLAAKIAVGLTLDEMINPVTGKTYACFEPALDYVVTKIPRFPFDKFESANRRLGTQMKATGEVMAIGRTFEESLLKAVRSLEIGVHHLELNEAKTAADDVMEKRIRKAGDERLFYIAEALRRGVTVETLHEWSQIDRFFLHKIQNIIEMETVLKNHPGDLDVLKKAKGLGFSDAAIAALWNKTERDIYALRRQRGIMPVYKMVDTCAAEFTSETPYYYSTYEEENESIVTEKPSVIVLGSGPIRIGQGIEFDYATVHCVWAIKQAGYEAIIINNNPETVSTDFSTSDKLYFEPLTAEDVMHVIDLEQPIGVIVQFGGQTAINLAAELEARGVRLLGTTLEDLDRAEDRDKFEQALSELGIPKPAGKTAVSVEEAVAIAEEIGYPVLVRPSYVLGGRAMEIVYNRGELLHYMEHAVRVNPQHPVLVDRYITGKEVEVDAIADGETVVIPGIMEHIERAGVHSGDSIAVYPPQTLSAEVIDKIADYTIRLARGLHIVGLLNIQFVVSGSDVYVLEVNPRSSRTVPFLSKITGVPMANLATKAILGTKLAEMGYETGVCPVRPGVYVKVPVFSFAKLRNVDISLGPEMKSTGEVIGKDVTFEKALYKGLVASGIHIQPHGAVLLTVADKDKEEAVDLARRFADIGYQLLATNGTAETLKAAGIPVTVVNKIHSASPNILDVIRQGKAQVVINTLTKGKQPESDGFRIRREAVENGIPCLTSLDTARAMLQVLESMTFSTTAMTEGLVRS

SEQ ID NO: 64407 - protein, 574 aa, Zea mays
MGLPLSHYFIYTGHNSYLTGNQLSSGCSERPIVKALHDGVRVIELDLWPNAAKDDVEVLHGRTWTSPVELIRCLEAIKEHAFATSPYPVILTLEDHLNRDLQAKMLKETFGEMLYVSESEHMAEFPSPDELKGKIVISTKAPKECFQTKSSKDAAATEEEEGVWGEEISDDKATARQARPRSPPTATLCLHLHACCSTKAPKEYFQTKSSKDAAATEEEEGVWGEEITDDKATARQAPSKVVLSEHTDRMHDGTKQMSEQSSGKYTADEETAGAGAEDEMEVEAEAEAEKKSRQGTEDNEYRRLIAIQLTRRKHDIEQDLRVDPDKVTRVSLGEKAFEKAIVSHGDHVVRFTQRNLLRIFPRSTRITSSNYNPLMGWRYGVQMVAANMQGHGRKLWLTQGMFRANGGCGYVKKPDALMRSKPLDFDPRAELPVKTRLRVTVYMGDGWRFDFRKTHFDRCSPPDFYARVGVAGVPADTRMEQTRVAMDSWVPAWDHEFGPFPLAMPELALLRVEVHESDNHQKDEFGGQTCLPVWELRPGIRSVRLSDHKGQPLPSVKLLMRFDFFPASDSNSTQ

SEQ ID NO: 64408 - protein, 471 aa, Bacillus cereus ATCC 14579
MKQIFQKKPIAKLMQESKQKTLARTLGALDLTMLGIGAIVGTGIFVLTGVVAAKHSGPAIILSFAIAALACAFAAFCYAEFASSVPVSGSVYTYTYATMGEVFAFLIGWDLMLEYLLATSAVANGWSAYFQSLLNGFGIHIPTILSSAPGTGKGGIIDLPAVLIILVMTVLLSRGVRESARVNNIMVFIKIAVVLIFIFAGFNYVKPENWTPFMPFGLNGVMAGAATVFFAFIGFDAVSTAAEEVKRPQRDLPIGIIASLLICTVLYIVVSLILTGIVPYGQLNISDPVAFALQFIGQDGLAGVISVGAITGITTVMLVMMYGQVRVSYAMSRDGLLPKRLAKVHPKFKTPFLNTWTTGIIAALISGLIDLNVLAHLVNMGTLSAFALVAVAVIVMRRTHPDLPRAFKAPLVPFLPALTVIFCLYLMLQLSGTAWISFGIWMVIGIAVYFLYSRKHSALNNSKKEEDVANL

SEQ ID NO: 64409 - protein, 103 aa, Ustilago maydis 521
MSGRGKGGKGLGKGGAKRHRKILRDNIQGITKPAIRRLARRGGVKRISGLIYDETRGVLKLFLESVIRDSVTYTEHAKRKTVTSLDVVYALKRQGRTLYGFGA

SEQ ID NO: 64410 - protein, 318 aa, Shewanella oneidensis MR-1
MANTLEQLKSYTTIVADTGDIEAIKRYQPEDATTNPSLILKAAQIPEYSALIDNAIAWAKLQSTDIEQQIDDASDKLAVNIGVEILKLVPGRISTEVDARLSFDKEKSIAKAHKLVRLYQEAGVDKSRILIKLASTWEGICAAKELEQEGINCNLTLLFSFSQARACAEAGVYLISPFVGRILDWYKKDTGKDYDAVNDPGVVSVTEIYNYYKQHGYNTVVMGASFRNIGEIIELAGCDRLTIGPSLLEELANSQLAIQPKLVPTSTTVAVAEPLTEAQFRWEFNQDAMAVDKLAEGIRNFAIDQGKLEVMLKAKLAN

SEQ ID NO: 64411 - protein, 545 aa, Shewanella oneidensis MR-1
MTILTQSTTWQALSAHSQDIPHMRELFAADPARFTKMSLSSCGLFLDYSKNRATPETLNLLFALAQEAKLDAKIKAMFAGDIINTTEKRAVLHTALRNTAEQCIIAEGQDIVPEVQQTLNKMQQFVTSVTSGQWKGYTGKAITDIVSIGIGGSFLGPKIVSQALRPYWITGLNCHFVANVDGTSISEKLKLLDPETTLFIMSSKSFGTQETLTNTLTAKAWFLAKGGSQSDVAKHFAAVTSNVVKATGFGIDANNIFPMWDWVGGRYSLWSAIGLPIALLIGMDNFRALLKGAHQMDTHFANAPLTENMPVIMGLLSLWYGNFFNAQSHVVLTYDHYLRGLPAYFQQLDMESNGKSVTLNGTHVDYSTGPVIWGGEGTNGQHAYHQLLHQGTALIPADFIMPLQSHNPIGEHHDQLASNCFGQTQALMQGRTLDEALAELSKSALSNEEKLLIAKHKVMSGNKPSNTLLMDKLTPETLGALIALYEHRTFVQGAIWDINSFDQWGVELGKTLGNDVLTRIGADQEATVLDASSNGLINLYRRGKI

SEQ ID NO: 64412 - protein, 180 aa, Buchnera aphidicola str. Bp (Baizongia pistaciae)
MILFKFFLACFSQIKSVWLTFINIFSKRETRMYPEESLSLSSRYRGRIILSRNSFGKERCVACGLCSVVCPVSCISLKKSTLKNNKWYPKFFRINLSRCIFCGLCEEACPTLAIQLISDVELSEYKRQDLVYEKDDLLISGQGKYLDYDFYKFSGVEVGTKNKGELDFESHPIDVKTLLP

SEQ ID NO: 64413 - protein, 275 aa, Rhodococcus sp. RHA1
MDDEVVTARKAAVLGSPIAHSRSPQLHLAAYRALGLTGWTYDRIECDGERLPGLVSGLGPEWVGLSVTMPGKIAALEFASERTERAVVIGSANTLVRIEGGWRADCTDVDGVSGALIAGGVGTIAGTEAVVVGAGGTARPALVALADMGVKSVTVVARDAGRAAGALGCAESVGLDVRLLGFDSPELGARCASAAALVSTVPSAAITEYADILGRAPFVLDAIYDPWPTPLAAAVEAAGGTVVGGLSMLLHQAFGQVEQFTGRPAPREAMAAALG

SEQ ID NO: 64414 - protein, 247 aa, Saccharophagus degradans 2-40
MSFENKVAIVTGASRGIGEAIATALAEAGATVIGTATSDAGAAKITARIAEAGHKGEGMTLNVSDADSVAAVIKAVTDKYGAAQILVNNAGITKDNLLMRMSDEEWFDVVNTNLSAIFRMSKGCLRGMMKARWGRIVNISSIVGQMGNAGQTNYSATKAGVMGFARSLAKEVGSRNITVNSVSPGFIDTDMTKVLPEEQKQAMQTAIALGRLGQPEEIAKVVKFLCSEDASYITGENIHVNGGMYMC

SEQ ID NO: 64415 - protein, 550 aa, Desulfovibrio vulgaris subsp. vulgaris str. Hildenborough
MDTFAIREMTLGRILDETAAKFPDNDAVVYVDRDYRQTYREFVSVVDDLARGLMALGVKRGDKVALWATNVPYWVALQFATAKIGAVLLTVNTNYRESELRYLLEQSECENLFIMDGFRDHDFVQTIYQVIPELRMQPRGQLRCEGLPHLKRVMFLGAEKHRGMYSVPEIVSLGVMVSDEEFRQRQDELDPYDVVNMQYTSGTTGFPKGVMLTHVGIGNNGYWIGRNQGFTEKDRVCLPVPLFHCFGCVLGVMAAINHGAALVILENFNPMHVMASVDQEKCTALYGVPTMFLAVLEHKLFDRFDFSSLRTGIMAGSVCPEPLMRRVIEKMNMREITICYGLTEGSPVMTQTLVDDSLERRVQTVGRAMPGIEVRIVDPETNEEVPHGTPGEVVCRGYNVMKGYYNMPEATAKAVDGDGWLHSGDLGIMDEHGYVRITGRIKDMIIRGGENIYPREIEEFLYGMEGVQDVQVVGVPSRKYGEEVGAFIIPKEGYDLAPEDVRDHCRGRISWYKVPRHIAFVSEFPMTASAKIQKYKLREMAAELFPDAMK

SEQ ID NO: 64416 - protein, 450 aa, Oenococcus oeni PSU-1
MNNLEKASRLIDEENNYYARSARINYYDLVINHAHGATLIDVDGNEYIDLLASASAINVGHTNERVVKAISRQAQKLIHYTPAYFHHVPGIELSKRLAELAPGNSPKMVSFGNSGSDANDAIIKFSRAYTSRQYIVSYMGSYHGSNYGSQSLSGTSLNMTRKIGPMLPGVVHVPYPDLYRRYAGETEHDVAIRYFNAFKAPFESFLPADETACVLVEPIQGDGGIVKAPEEYMQLVYKFCHDNGILFAVDEVNQGLGRTGKMWGIQQYKDIEPDLMSVGKSLASGMPLSAVVGKKDIMQSLDAPAHIFTTSGNPVCAAASLATLNVIRDDHLVEKSAKDGEYAKQRFLEMQRHHPIIGDVRMWGLNGGIELVKDPKTKEAENDAATKVIYYAFAHGVVIITLAGNILRFQPPLVISHKQLDKALQVLDDAFTAVEQNKVEVPKDTGKIGW

SEQ ID NO: 64417 - protein, 483 aa, Oenococcus oeni PSU-1
MSSIFQKMFRKEDPLVYQDKDSHLIRSLTTKDFLALGVGTIVSTSIFTLPGVVAAQHAGPAVSLSFLCAAIVAGIVAFAYAEMAAAMPFAGSAYSWINVVFGEFWGWIAGWALLAEYFIAVAFVASGLSANFQGLISPLGFKLPTTLSTASTGSNGGLMDLFAIIIILLVATLLSRGASQTARVENTLVILKVIAILVFIFVGVTAIKGQNYVPFIPKYHANTDGSAFGGWQGIYAGVSEIFLAYIGFDSIAANSAEAKNPQKTMPRGILGSLFIAVFLFISVALVLVGMFRYSDYANNAEPVGWALRQSGHEIIATIVQAVAVIGMFTALIGMMLAGSRLLYSFGRDGLLPKTLGKLSNNLPSHALIVLTVIGIALGAFFPFTFLAQLISAGTLIAFMFVSIGIYALRPREGKDIPEPSFKMPFYPVLPALGFLGALAIFWGLDIQAKIYALGWFIFGMIVYFGYWIKHSTAGSSKKTEKSN

SEQ ID NO: 64418 - protein, 214 aa, Physcomitrella patens
LSDIHCTQCLPIRLSLVLSSALSKFRESVAMASAVVSTVVAPVALGGASSCVGAPSESSSVKAFSGLKSATLFSGKTQKLSSVQNGSRVQCMQVWNPIGQPKFETFSYLPPLTDDQIAKQVDYMIQQNLIPCIEFDTVGSVSRTNFSGAGSSGYYDGRYWTMWKLPMFGCTDSSQVLREIQECKSQFPSCWVRVLGFDSKKQVQICGFLVSRPN

SEQ ID NO: 64419 - protein, 366 aa, Xanthomonas oryzae pv. oryzae KACC10331
MLTTLSTPFAVRRTTGDDARRRHRSGECVSASSPMEAVAFPRPETFVAADVGGTHVRLALVCESNDAGKPVTVLDYRKYRCAEYPGLAEIMAAFFAEVGCAPVRRGVIASAGYALDDGSVITANLPWVLAPEQIRRQLGMQALYLVNDFEAVAYAANYMSGNQVMQLSGPAQGAAGPALVLGPGTGLGAALWIPHGAHPVVLPTEAGHAALAPASDLEVELLQELRRTRTHVCTETLLSGPGLLNLYTALGALRGDAVLHANPAEITAAALAGNDALAHDALQAFCGFMGSVVGDLMLLYGVRSGVYLAGGFLPQIAGFIAESDFVARLLDKGALRPALEQVPVSIVEHGQLGVIGAASWFLLHGR

SEQ ID NO: 64420 - protein, 74 aa, Brassica napus
MAALKGYGLCSLDSVLHFPCPRPPFEAYKRRSSRWVSPKAAVVPNFHLPMRSLEVKNRTNTDDIKALRVITAIK

SEQ ID NO: 64421 - protein, 266 aa, Oryza sativa
  misc_feature (30)..(30): Xaa can be any naturally occurring amino acid
AAADLGGVRSCVIPRPSEGSKQLLDQEDVXKVPQADSDRGITPEEFRLVKIHMSCRVRPSAHLAVVRQRVIATAVTYFRRVYTRKSMTEYDPRLVAPTCLYLASKVEESTVQARLLVFYIKKMCASDEKYRFEIKDILEMEMKLLEALDYYLVVYHPYRPLLQLLQDAGITDLTQFAWGIVNDTYKMDLILIHPPYMIALACIYIASVLKDKDITLWFEELRVDMNIVKNISMEILDFYDTYKIDPQRGLPEDKIAPVMNKLPSKA

SEQ ID NO: 64422 - protein, 168 aa, Ostreococcus tauri
MSLIANALADDPDRPRYPTVFKTYQMYRADAVDELTKDIEMSRELGFELGAKLVRGAYLRLDRNSGALLPNKPMVDKSYERGLEIALQKGNGHVSTLIATRNIDNIEQALEHENNHRVLYAQLLGMDDDVTNRLVEKKMKVLKYVPFGRLSELSPYLYRRLLERLHWS

SEQ ID NO: 64423 - protein, 175 aa, Brassica napus
MGNTSSMLTQYDIEEVQSHCQDLFEQQEILSLYQRFCQLDRNAKGFISSDEFLSVPEFAMNPLSQRLLKMVDGLNFKDFVAFLSAFSAKASLKQKVKLIFQVYDSDGNGKVSFKDIMEVLRDLSGTFMSDEQREQVLSQVLKEAGYTNDSFLTLEDFIKVFGSCKPEMDVEIPVD

SEQ ID NO: 64424 - protein, 248 aa, Oryza sativa (japonica cultivar-group)
MSGNIAFGRFDDSFSAASLKAYVAEFISTLVFVFAGVGSAIAYTKLTGGAPLDPAGLVAVAVCHGFGLFVAVAIGANISGGHVNPAVTFGLALGGQITILTGVFYWIAQLLGAIVGAVLVQFCTGVATPTHGLSGVGAFEGVVMEIIVTFGLVYTVYATAADPKKGSLGTIAPIAIGFIVGANILVAGPFSGGSMNPARSFGPAVASGDYTNIWIYWVGPLVGGGLAGLVYRYVYMCGDHAPVASSEF

SEQ ID NO: 64425 - protein, 486 aa, Clostridium difficile 630
MFNELKTKENVYKNLINGKWVESNSRKPIEIYSPIDNSLVGKVQSMTKHEVDEVIKNTKESIKVWAEMPVYKRANIFHKAADLLLENIDEIANILVLEIAKDIKSARAEVERTADFLRYTADVGKNMEGEAISGDNFPGGTRNKMSYVSRVPLGTVLAISPFNYPVNLSMSKIAPALIGGNAVVLKPATQGAISALHVVEIMRKAGIPDGVLNTITGRGSEIGDYVVTHKGINFINFTGSTEVGQHISKISGMVPLLLELGGKDAAIVLEDADLDFAAKNIVSGAYSYSGQRCTAVKRILVQESVADKLVGKIKPLVEKLTIGNPMDEVVITPLIDNKATDFVQGLVDDALHKGAKLITGNVRKNNLFYPTLLDNVNVDMKIAWEEPFGPVLPIIRVKDINQAIEIANQSEYGLQSSVFTSDIDKAFYIADKLEVGTVQINNKTERGPDHFPFLGVKASGMGTQGVKYSIEAMTRPKAVVVNVREL

SEQ ID NO: 64426 - protein, 683 aa, Ustilago maydis 521
MLSNSPDRPTTASPPGPPSSQSSSVGSCYTSDSSRASFQARPTLSDPSSSSTSLASACDRTVALTKRTAQTIITSPILITHHGAIEHHPEELFPGKTSHSGLASRASPLADYSRTRTMQPLASDSSGTGHLDVFRHAGSSNNITFDPSPHATREAQHFDSPDNHAPAPKARRTSPGGSRTSGNFDPLHNAAPTDHSANSHPLAGASAYAHISSDASPFMPSTSSSNTTQETGSSTGVSWNSTVASDKPPDSVPGPQPRWPSSDALQSHVTQTLHASTTPSPRTQDGGTVSVPHDSHAAISKKSASPQASSVSLTDRSEGAIRSKHPTLPKMDLAAFSPQELLKILAMLLHEIATANDEFQPDGGKEESSRSRRAGRSRDRSAPPTPVGSSEANDASAVRGYAAPPGSHLSFSDSRRPSVTTAALGALATPSSTLCFHARNVPSISIESYLLRILKYCPTTNEVFLSLLVYFDRMSRMGTGAKPGANGEGEVAGEAAGLPRAIERATGQQDLGLEMSTRQSDGSSTKDEPSYTHPGIRGFAIDSYNVHRLVIAGVTVASKFFSDVFYTNSRYAKVGGLPPHELNQLELQFLLLNDFRLTIPLEEMQRYADQLLMYASGRPEMAKITKTVSSSVTSSSSTSSANVTCDTDSAVPAAANSERTTAVTTVIPSEVHENEGDVQMSDA

SEQ ID NO: 64427 - protein, 504 aa, Cynodon dactylon
MAAAMPSLYRRVLPSPPAVDFNSPEGKRLFSEALAAGTMEGFFSLISCFQTQSEPAFCGLASLAAVLNALAIDPVRRWKGPWRWFDESMLDCCEPLDKVKAQGITFGKVALLAHCAGADVQTFRANRITLEDLRRHLVRCASSQDCHLIASYHRKAFKQTGTGHFSPIGGYHAGQDMALILDVARFKYPPHWVPLSLLWEAMNTTDESTRLLRGFMLISRHTAAPAMLYTVSCRDESWKSMAKYCVEDLPNLLKAENLENVPTLLSCLIETLPANAGALIKWVVEVRRKEESGSSLSIEEKERLSMKEIVLQQVRDTRLFTILHDLKIGNIQCCKCSLSSGRRFYCLKLQVAVCCQEAAMLSGSIASNNGFCCRETCFSSVQANGNGVKTVISGTVVSEGKEQGVDMLLPMSPRCASSCNSEAGDEIIKYPSKTDVLTVLLLALHPSTWLGIKDESLKAEFQALVSTDNLPEVLKQEILHLRRQLCYLKSCKEEECEDPVPPSH

SEQ ID NO: 64428 - protein, 352 aa, Zea mays
MMASQAMVPLRQLFVDGEWRPPAQGRRLPVVNPTTEAHIGEIPAGTAEDVDAAVAAARAALKRNPGGAPANVACAIAKLGGSSAFVGKFGDDEFGHMLVNILKQNNVNSEGCLFDKHARTALAFVTLKHDGEREFMFYRNPSADMLLTEAELDLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAKAN

SEQ ID NO: 64429 - protein, 201 aa, Oryza sativa
  misc_feature (160)..(160): Xaa can be any naturally occurring amino acid
MDMIGMASPAESPGGGGTARPSRYESQKRRDWQTFGQYLRNHRPPLELSRCSGAHVLEFLRYLDQFGKTKVHAHGCPFFGHPSPPAPCPCPLRQAWGSLDALVGRLRAAFEEHGGRPESNPFGARAVRLYLRDIRDTQSKARGIAYEKKRRKRAAASHTXAEAAAAAAGGTGGGGRRGARRRLHDATVGVQLAPPSISINP

SEQ ID NO: 64430 - protein, 472 aa, Xanthomonas oryzae pv. oryzae KACC10331
MHRHVHEPEILADPAAAQTAEHWRQRDLAVVWHPCTQMREHPHTLPLVPIARGEGAWLVGHDGRRYLDAVSSWWTNLFGHTEPRIGAAIARQAGELEQVMLAGFTHTPAVQLAEQLLEIAPRQAGRAPLSKVFYADNGSAGVEVALKMAFHSFHNRGEHRRTRFIALENGYHGETIGALSVGDIPLYRRVYAPLLLESMFTPSPDAYLAEPGQSAEDYALQAADALQALFEQSPGEICALILEPRVQCAGGMRMHHPAYLRRARALCDAHGAFLIADEIAVGFGRTGTLFACEQAGVMPDLLCLSKGLTGGFLPLSAVLATQQLYDAFLDDSRERAFLHSHSYTGNPLACAAALATLKIFADDDVIARNQPIAARMSELAAQIGEHPAVADVRQAGMIVAFELTRGGDKRTPFASAARVGLKAYRAALDKGVVLRPLGDVLYWMPPYCVDEAQLALLADTTRHAIAEAVACA

SEQ ID NO: 64431 - protein, 689 aa, Oryza sativa (japonica cultivar-group)
MAASRLVAAAAIVVVVLVLAGAGAAGAAGAGEVRALLDLAAGLDPTGRLLPSWAPGRDPCGREGGGGFEGVACDGATGAVANVSLQGKGLAGTLPPAVAGLTALTGLYLHYNRLTGALPRELAALSRLTDLYLNVNNFSGPIPPEIAAMPSLQVVQLCYNQLTGGVPTQLGLLKRLTVLELQSNHLSGAIPASLGDLPQLVRLDLSFNNLFGSIPVRLALLPRLLALDVRNNTLTGSVPSELAKLQGGFQYANNTDLCGTGLPALRPCTPADLISPDMPQPFSAGISPQITPGSSSDGHGHCTGTHCPPSTKALAAVVVVAVILLAVTGAGMFALSWYRWRKQRVVAGSPAAVGGRCSTDAAGKDSFRKSASSTLVSLEYSNGWDPLADGRGGIGFSQEVAQSFRFNMEDVESATQYFSELNILGKNGNFAATYRGTLRDGTSVVVKRLGKTCCKQEEAEFLKGLKLLAELQHENIVGLRGFCCSRARGECFLVYDFVPNGSLSQFLDIDADDVARSNGRVLEWSTRISIIRGIAKGIEYLHSTRANKPPLVHQNISADKVLVDYTYRPLISGSGLHKLLVDDLVFSTLKASAAMGYLAPEYTTTGRFSEKSDVYAFGVIVFQILTGKSKIMQLPLESSNDEDLIDGNLRGCYSAAEAAKLAKIASACTSENPDHRPTMEELIQELCTF

SEQ ID NO: 64432 - protein, 176 aa, Brassica napus
  misc_feature (169)..(169): Xaa can be any naturally occurring amino acid
VISSHGEEFMADVVLFATGRNPNTKRLNLEAVGVELDQAGAVKVDEYSRTNIPSIWAVGDATNRINLTPVALMEATCFANTVFGGKPTKADYSNVACAVFCIPPLAVVGLSEEEAVEKATGDILVFTSGFNPMKNTISGRQEKSLMKLIVDEQTDKVIGASMCGPDAAXIMQGIAI

SEQ ID NO: 64433 - protein, 495 aa, Shigella flexneri 2a str. 301
MNFHHLAYWQDKALSLAIENRLFINGEYTAAAENETFETVDPVTQAPLAKIARGKSVDIDRAVSAARGVFERGDWSLSSPAKRKAVLNKLADLMEAHAEELALLETLDTGKPIRHSLRDDIPGAARAIRWYAEAIDKVYGEVATTSSHELAMIVREPVGVIAAIVPWNFPLLLTCWKLGPALAAGNSVILKPSEKSPLSAIRLAGLAKEAGLPDGVLNVVTGFGHEAGQALSRHNDIDAIAFTGSTRTGKQLLKDAGDSNMKRVWLEAGGKSANIVFADCPDLQKAASATAAGIFYNQGQVRIAGTRLLLEESIADEFLALLKQQAQNWQPGHPLDPATTMGTLIDSAHADSVHTFIREGEGKGQLLLDGRNAGLAAAIGPTIFVDVDPNASLSREEIFGPVLVVTRFTSEDQALQLANDSQYGLGAAVWTRDLSRAHRMSRRLKAGSVFVNNYNDGDMTVPFGGYKQSGNGRDKSLHALEKFTELKTIWISLEA

SEQ ID NO: 64434 - protein, 525 aa, Zea mays
  misc_feature (96)..(96): Xaa can be any naturally occurring amino acid
MAEVKPEDMVHHLPMDQLQGLEYCIDSNPSWGEGIALGFQHYILSLGTAVMIPTLLVPLMGGNDDDKAKVVQTLLFVTGIKTLLQTLFGTRLPTIXGGSYAYVVPILSIVRDPSFARIADGHTRFLQTMRAVQGSLIVSSSIQIILGYSQLWAICSRFFSPLGMVPVVALVGLGLFERGFPVVGKCVEIGLPMLILFVALSQYLKHVHIRHVPVFERFSLLMCITLVWLYAHILTASGAYKHTALVTQINCRTDRANLISSSQWISIPYPLQWGAPTFSADHAFGMMAAVMVSLIETTGAFKAAARLASATPPPAYVLSRGIGWQGIGTLLDGLFGTGTGSTVSVENVGLLGSTRVGSRRVIQISAGFMIFFSILGKFGALFASIPFTIFAAIYCVMFGIVAAVGLSFMQFTNMNSMRNLFIIGVSLFLGLSIPEYFSRYSTSSQQGPAHTKAGWFNDYINTSFSSPPAVALIVAVLLDNTLDVRDAARDRGMPWWARFRTFRGDSRNEEFYTLPFNLNRFFPPT

SEQ ID NO: 64435 - protein, 91 aa, Nostoc punctiforme PCC 73102
MPAMAADIVNGEQIFSLHCAGCHINGSNIVRRGKNLKKQALKKYGMDSIEAVTSIVTNGKNNMSAYKDRLTEQQITDVAAYVLEQAEKDWR

SEQ ID NO: 64436 - protein, 198 aa, Triticum aestivum
MLGVARRRLGSGCALGQLMQALRPAAAAAAARTYSAAAKEMTVREALNSALDEEMSADPSVFLMGEEVGEYQGAYKISKGLLDKYGPDRVLDTPITEAGFTGIGVGAAYQGLRPVVEFMTFNFSMQAIDHIINSAAKSNYMSAGQINVPIVFRGPNGAAAGVGAQHSQCYAAWYAHVPGLKVLTPYSAEDARGLLKAA

SEQ ID NO: 64437 - protein, 448 aa, Bacillus subtilis
MTHDLIEKSKKHLWLPFTQMKDYDENPLIIESGTGIKVQDINGKEYYDGFSSVWLNVHGHRKKELDNAIKKQLGKIAHSTLLGMTNVPATQLAETLIDISPKKLTRVFYSDSGAEAMEIALKMAFQYWKNIGKPEKQKFIAMKNGYHGDTIGAVSVGSIELFHHVYGPLMFESYKAPIPYVYRSESGDPDECCDQCLRELEQLLKEHHEEIAALSIESIVQGASGMIVMPEGYLAGVRELCTTYDVLMIVDEVATGFGRTGKMFACEHENVQPDLMAAGKGITGGYLPIAVTFATEDIYKAFYDDYENLKTFFHGHSYTGNQLGCAVALENLALFESENIVEQVAEKSKKLHFLLQDLHALPHVGDIRQLGFMCGAELVRSKETKEPYPADRRIGYKVSLKMRELGMLTRPLGDVIAFLPPLASTAEELTEMVAIMKQAIHEVTSLEN

SEQ ID NO: 64438 - protein, 1076 aa, Vibrio cholerae O1 biovar eltor str. N16961
MPKRTDIQSILILGAGPIVIGQACEFDYSGAQACKALREEGYRVILVNSNPATIMTDPEMADATYIEPIHWEVVRKIIEKERPDAILPTMGGQTALNCALALEKHGVLAEFGVEMIGATADAIDKAEDRSRFDKAMKSIGLECPRADTAKSMEEAYKVLDMVGFPCIIRPSFTMGGSGGGIAYNREEFEEICTRGLDLSPTNELLIDESLIGWKEYEMEVVRDKNDNCIIVCAIENFDPMGIHTGDSITVAPAQTLTDKEYQIMRNASLAVLREIGVETGGSNVQFGINPKDGRMVIIEMNPRVSRSSALASKATGFPIAKVAAKLAVGFTLDELMNDITGGATPASFEPTIDYVVTKIPRFNFEKFAGANDRLTTQMKSVGEVMAIGRNQQESLQKALRGLEVGAAGLDEKVDLDAPDALTKIRYELKEAGAERIWYIADAFRAGMSVDGVFNLTNIDRWFLVQIEELVKLEAEVKAGGFAGLNQDVLRKMKRKGFSDARLSKLLGVSENEIRRLRDQYNIHPVYKRVDTCAAEFKSDTAYMYSTYDEECEANPTDKDKIMVLGGGPNRIGQGIEFDYCCVHAALALREDGYETIMVNCNPETVSTDYDTSDRLYFEPVTLEDVLAIVRVEKPKGVIVQYGGQTPLKLARALEAAGVPVIGTSPDAIDRAEDRERFQQAVQRLGLKQPDNATVTAIEQAIEKSREIGFPLVVRPSYVLGGRAMEIVYDEQDLRRYFNEAVSVSNESPVLLDRFLDDATEVDVDAICDGERVVIGGIMEHIEQAGVHSGDSACSLPAYTLSQEIQDKMREQVEKLAFELGVRGLMNIQFAVKDNEVYLIEVNPRAARTVPFVSKATGAPLAKIAARVMVGQTLEQQGFTKEIIPPYYSVKEVVLPFNKFPGVDPLLGPEMRSTGEVMGVGATFAEAYAKAELGCGSVYPEGGRALLSVREGDKQRVVDLASKLVKLGYQLDATHGTAVILGEAGINPRLVNKVHEGRPHILDRIKNHEYTYIVNTASGRQAIEDSKVLRRGALAHKVNYTTTLNAAFATCMSHTADAKASVTSVQELHARVKANQA

SEQ ID NO: 64439 - protein, 101 aa, Bartonella henselae str. Houston-1
MIARIYSPAKTAMQSGRGNTGFWILQYEPIKAKMLEPLMGYTATSDMNNQVKIRFNKKEEAVAFARKNAIPYRVEKMHKPIRRVVSYSDNFRSDRQQSWTH

SEQ ID NO: 64440 - protein, 108 aa, Buchnera aphidicola str. Bp (Baizongia pistaciae)
MNDIIKKIQNQIQNNPIIIYMKGSPDAPSCGFSAQAVHAISSCGKKFAYIDVLKNPDIRLELPKYANWPTFPQLWVNGELIGGCNIILELFQKGELKKTISICDKLNS

SEQ ID NO: 64441 - protein, 353 aa, Bacillus subtilis subsp. subtilis str. 168; identical to SEQ ID NO: 1181

SEQ ID NO: 64442 - protein, 320 aa, Bacillus subtilis subsp. subtilis str. 168
MRSHSVVCIGELLIDFFCTDVDVDLMEGRQFLKSAGGAPANVSAAIAKLGGDAAFSGKVGKDPFGYFLKRTLDAVHVDTSMLVMDEKAPTTLAFVSLKQNGERDFVFNRGADALFTLEDIDQEKLNEAKILHFGSATALLSDPFCSAYLRLMSIAKDNGQFISFDPNYREDLWRGRVSEFVSVAKKAIAVSDFVKVSDEELEIISGVKDHEKGVAILHEIGANIVAVTLGKSGTLLSNGKDREIIPSIPVTSIDSTGAGDAFVGAALYQLANTDQIQSVDADFVKLREIVAFANKVGALVCTKIGAIDALPSLDEIGVSL

SEQ ID NO: 64443 - protein, 128 aa, Oryza sativa
MAARRGRGRGREWEDDDLGVGGGQPPHLAAPVVCLARSAGDLAAGAFVGSLVGYGQGLLTNKGMKGSLSSAGSSAKTFAALSGVQSFILCLLRRLRGKDDMINAGVAGCYTGLALSFPGNLHRIVFIQ

SEQ ID NO: 64444 - protein, 190 aa, Glomerella cingulata
MVVATIKCVVVGDGAVGKTCLLISYTTNKFPSEYVPTVFDNYAVTVMIGDEPYTLGLFDTAGQEDYDRLRPLSYPQTDVFLVCFSVTSPASFENVARSGSRGTSPLPGVLLIVAPVTERGSSVREKLSKQKMSPVRKEDGERMAKDLGAVKYVECSALTQFKLKDVFDEAIVAALEPPAPKKKSHKCLVL

SEQ ID NO: 64445 - protein, 452 aa, Arabidopsis thaliana
MGSRDYISSLPDEILGKILSLFCTNRAACTSVLSKRWRNLLELVDNLDLNDAYGNHQYFCDFVDRTLALLSNSTTVKRFSLNCAFHNDASRVNSWIRTVFDRGFLDLHLETAHMHRIDTEFFTSNTLLELTICGGFYAEGRLPPGRVFFPALKSLSLVSVEFTDTLMYQNFISGCPVLEELFLHYDNETQCPAWKGLVSSPSIKRLNIYDNPSELRYEAYKCCFQIPSLVYLDYSSYVAKQYAVDLVSLEEARLNIRYPERLVDQNEDIFGDVTDLLKGISNVKTLHLSSDSLEVFHLCCDTMPVFHNLLTLSFESDEEIGWQVVPLLLNKSPNLETLVIKSLVHQVTDMCGNACACISKRRKKKKKTTEDDECCLSTCQVKVLNISGYRGTCKELKQMRHFLENLKCLETVNVGVDVKRREYKNGNNKYQRITNAVMELPRFSSNCQIQFF

SEQ ID NO: 64446 - protein, 468 aa, Lactococcus lactis
MTKTLPKDFIFGGATAAYQAEGATHTDGKGPVAWDKYLEDNYWYTAEPASDFYHKYPVDLELAEEYGVNGIRISIAWSRIFPTGYGEVNEKGVEFYHKLFAECHKRHVEPFVTLHHFDTPEALHSNGDFLNRENIEHFIDYAAFCFEEFPEVNYWTTFNEIGPIGDGQYLVGKFPPGIKYDLAKVFQSHHNMMVSHARAVKLYKDKGYKGEIGVVHALPTKYPYDPENPADVRAAELEDIIHNKFILDATYLGHYCDKTMEGVNHILAENGGELDLRDEDFQALDAAKDLNDFLGINYYMSDWMQAFDGETEIIHNGKGEKGSSKYQIKGVGRRVAPDYVPRTDWDWIIYPEGLYDQIMRVKNDYPNYKKIYITENGLGYKDEFVDNTVYDDGRIDYVKQHLEVLSDAIADGANVKGYFIWSLMDVFSWSNGYEKRYGLFYVDFDTQERYPKKSAHWYKKLAETQVIE

SEQ ID NO: 64447 - protein, 2160 aa, Magnaporthe grisea
MTRNDALSRFSSITSSSTDSAHSTATVKPLPSTPIASDTRRHSSGSRPAIPSRLRIDDDLNRITASPLRDDTQVSPTNTFGTRVALSPSSPTSNVFPREQRLSDFGNYRRDLAVLDPGGSRVPQIQQPPPNTGPSLSSQVAPWMTSNGTGGAPAAINTSFYNDSSDNLSVASQLSPGFRIPGGRPSISQPSGVGADNNEASYFGDERRPSIASITTTASSQGSKASGNRGGFRKLQGFFGEEFPGRDSSDTSLPPAVPGKEHRSHSYSHGRPYRDRNYSNATDHTRDGSPSSSRPRTPVPAPEVVPFLYQEADDIAKYGEAPVRDILSGPDRERYVTGDSLQNPPKTSSSSRSGHSLAHLSGQHRHQKSNDDPRTLRPTMSRDDSAVPTYKDRSGSATTMMTTSRDRAHSPAPSGHSIGGYFSSKNGTYDGQTSPPGHQKKSLLGRFKRNKDKEDTGSLKKTSLSSTSLNLKPSRSEFGGDGASTMGQDWPSRLAEPSQYNSNSNSASARPPQARHGTFKSPFAKRGRTHHRHDDRDEAIGPTDKHDGMQAGGTMFHLDTDLNDMSGILSRPLPLTPMDADFVGTIKGEKSTVTSNGRNGAWDAPDSWAVKRTGDDLAYHGPENDEAGPSPRPEEKMTSYCIRVFKSDGTFATLQMSIDSSVQDLIGQLSKKSYVSGGLEYHIALRKHGLIRVLGSAEKPLFIQKRLLRQVGFEERDRIEDIGREDNSYLCRFLFMSSRELEQQARTQDLGLGRTQKFNHVDLSARNIIRIPIYLYSKVQDIISLNLSKNLSLDLPRDFISSCQNLRDIKFNNNEARKLPASLGRASRLTYLDVSNNRIDHLENAELNGLVGLLKLNLANNRLKHLPPYFGAYRSLRTLNVSSNFLDKFPSFLCELESLVDLDLSFNLIGAFPPAIENLRNLEKLVITNNRLAGTLPDSFSRLQSLRELDIKYNAISGIDVISLLPKLEILAADHNAISQFVGSFERVRSLKLKDNPITRFELTSTVPTLKLLNLSNAKLASIAESFNHMLNLERLVLDRNHFVSLPSQIGRLRRLEHFSIAHNALAELPPEVGCLQELKFLDVRGNNLKKLPLEIWWANKLETLNASSNVMTDFPKPASRPPQPPESSPGSMQGSNGKVAMVGSLSTPPSIEDLDPDDSRRPSQASSSTLLSVGPSPVPAGPDRKSSVVSVYGKGGRKTSIISRSANSSGNAPAPPNTRKDSGLSARITNTFSGSLRNLFLADNLLDDDVFDQIMLLCELRVLNLSFNQISDMPQRCIKSWPQLSELYLSGNELTTIPVDDLEEYSLLQVLHINCNKFTNLPADISRAKKLAVLDCGSNFLKYNISNVPYDWNWNLNPNLRYLNLSGNRRLEIKQPAYGSGAGNREQYTDFSRLQNLRVLGLMDVTLTQPSIPEQSEDCRVRTSGSSAGYLPYAMADTLGKNEHLSTVDLVVPRFNASETETLLGLFDGQALSSGGSKIAKYLHENFGQILATELRALKTGLKETPEDALRRAFLALNKELVTIAIQHSEDRPSVPHRSGSQAHVILNKEDLNSGGVATVVYLQGQDLYVANVGDAQAMIILSDQTHKMLTRKHDPAEPTERSRIREAGGWVSRNGKLNDQLGVSRAFGYVDLMPAVQAAPHVSHVAIREQDEMILLATSELWEHLAPELIVDIARQERGDLMRATQKLRDLAIAYGSTNKIMIMMISVADLKRRTERTRINRGQSMSIHNLSLHGEQYKFPTRGRRKKDQVMDSTLQRLEAEVPAPTGMIAIVFTDIKNSTNLWETYPAAMRSAIRLHNEMMRRQLRRIGGFEVKTEGDAFMVSFPTATSALLWCFAVQLQLLEVNWPSEMLNSLSCKPTVDKNNQVIFKGLSVRMGIHWGEPLCEPDPITRRMDYYGPMVNKASRISAVADGGQITVSSDFISEIQRCLETYQGANAAALVNESFDEDPFSMAIRKELRSLSSQGFEVKELGERKLKGLENPEVVYSLYPHQLAGRIETHQAHDKGVTAAAPELIENTPAVLKEGSELDFDPKIIWGLWKLSLRLEMLCSSLEYVGGRGLQAPETELLERMKQRGGEVTESFLVNFMEHQISRIETCVSTLSIRHLNMGGGTIKELDDLRGPISSVLANFSKQMAELQRYKALYGPLDAIEDGQQAS

SEQ ID NO: 64448 - protein, 385 aa, Oenococcus oeni PSU-1
MALNNTELDEILAIHSKNVGVLDVKADMDVESRQDLGKAYTPGVAALSKIIERNPGLKDKYTISGKLVAVVTDGSAVLGLGNIGTAAGLPIVEGKSLLYKDLANVNAIPVAIDQVPVDEFVQTVKNFSNTFAGIHLEDIAAPRCFEIEEKLKQTLDIPVYHDDQEGTAIVVLAGLINAAKVVGKNLKDLRIVINGIGAAGVATARLLFSIGIKKLTLVDIHGVVKADDSDYNKYQRKLAKDINLNISGQTLDNVIDQQDVFIGLSDGDVLSADQVKRMSSKPIVFALANPLPEINPEIAQTAGAQVIATGSAQYLNQVNNVLVFPGLYKGLLTYGIKQVDYKIEEVVAKALASMVENPTSDKIVPGVFEAGVVVTVANALKTFAG

SEQ ID NO: 64449 - protein, 511 aa, Brassica napus
MGSASKEYEFLSEIGLSSSHNLGNYVGGKWLGNGPLVSTLNPANNQVLPIAQVVEASLEDYETGLKACEEAAKTWMQVPAPKRGDIVRQIGDALRSKLDYLGRLLSLEMGKILAEGIGEVQEVIDMCDFAVGLSRQLNGSVIPSERPNHMMLEMWNPLGIVGVITAFNFPCAVLGWNACIALVCGNCVVWKGAPTTPLITIAMTKLVAEVLEKNHLPGAIFTAMCGGAEIGEAIAKDTRIPLVSFTGSSKVGLTVQQTVSARSGKTLLELSGNNAIIVMDDADIQLAARSVLFAAVGTAGQRCTTCRRLLLHESVYDKVLEQLLTSYKQVKIGDPLEKGTLLGPLHTPESKKNFEKGIEVIKSQGGKVLTGGKAVEGEGNFVEPTIIEISSDAAVVKEELFAPVLYALKFKTFEEAVAINNSVPQGLSSSIFTRSPDNIFKWIGPMGSDCGIVNVNIPTNGAEIGGAFGGEKATGGGREAGSDSWKQYMRRSTCTINYGNELPLAQGINFG

SEQ ID NO: 64450 - protein, 522 aa, Haloarcula marismortui ATCC 43049
MDGGTYWWGTRTVPIMSTDDSRRHYIDGEWTTGTGDETFTSQNPATGEALASFHRGTEDDVDHALAAAEDAYDEWRSLSHIDRAEYLWDIYHELRDRHEELGEIVTMECGKEISEGLADVTESWHMVEWAAGNARHPHGDVVPSEIASKDAYMRRKPKGVVGCITPWNFPVAIPFWHLAVTLVEGNTVVWKPAEQTPWCAHIIAEMFEDSGIPDGVFNLVQGYGDAGNAIVEDDRVETVLFTGSAEVGHKIASKVGGEPGKIAACEMGGKNAVVVTDEADLDVAVHSAVMSSFKTTGQRCVSSERLIVHEDLYDEFKERFVDIAEDIAVGDPLEEDTFMGPLIEEDQVEKFKRYNDLAREEGANVLVDRADLGAEEIPDGHEEGHWVGPFVYEVDYDEDLRCINEEVFGPHVALLEYSGDFDEALEMHNSVDYGLAGAIISEDYRQINQFRDEAEIGLAYGNLPCIGAEVHLPFGGVKKSGNGLPSGREVIEAVTERTAWTLNNSKDIEMAQGLSADIITDE

SEQ ID NO: 64451 - protein, 277 aa, Zea mays
  misc_feature (31)..(31): Xaa can be any naturally occurring amino acid
MSMFYTAGLTFLTRWRNRMIKSRAAVAFEAXRNPLEIVEVDVAMPKAGEVLLRVVASGVCHTDAYTLSGADPEGIFPSILGHEGGAVVEAIGEGVTSVAVGDHVIPLYTPECGKCKFCLSGKTNLCQAIRATQGKGLMPDGTSRFSYKGQPIFHYMGTSTFSEYTVLPEISVAKIPKEAPLEKVCLLGCGVTTGIGAVINTAKVKPGDTVAIFGLGGIGLSAVIGAVKAKAGRIIAIDINPAKFEIAKQLGATDCINPKDYDRPIQDVIVDLTDGGV

SEQ ID NO: 64452 - protein, 517 aa, Methanosarcina barkeri str. Fusaro
MLHMTQAKKPLMLIILDGWGYREAREGNAILAARTPNLDHLIEEYPWCFLEASGEAVGLPEGQMGNSEVGHLNIGAGRIVYQDLTRINFSIRKGDFFKNPAFLGAISNAKANDSSLHLMGLVSYGGVHSYMAHIHALIKLAQQEGVKKVYIHAFLDGRDVPPKAALKDIEELDAFCKENGNAKIATISGRYYAMDRDKRWDRTKLAYDALTMGVAPYKTPDAETAVSEAYKRGETDEFVKPTVITDSEGKPEAVIKDNDSIIFFNFRPDRARQLTWAFVNKDFENFPREKHPKVYYVCMAQYDETLDLPIAFPPEELENVLGEVLSKQGLAQLRIAETEKYAHVTFFLNGGQEKCYEGEDRCLIPSPKIATYDLKPEMSAYEVTEEVIGRIRSGKYDVIVLNFANMDMVGHTGIFEAAVKAVEAVDSCVGKIATVLKEVGGVAIITADHGNAEQMENPTTEEPHTAHTSNPVKCIYFGNDEVKGLKNGKLCDLAPTLLELLKIRKPEEMTGESLIIK

SEQ ID NO: 64453 - protein, 473 aa, Bacillus subtilis subsp. subtilis str. 168
MNKQGNQMSFLRTIILVSTFGGLLFGYDTGVLNGALPYMGEPDQLNLNAFTEGLVTSSLLFGAALGAVFGGRMSDFNGRRKNILFLAVIFFISTIGCTFAPNVTVMIISRFVLGIAVGGASVTVPAYLAEMSPVESRGRMVTQNELMIVSGQLLAFVFNAILGTTMGDNSHVWRFMLVIASLPALFLFFGMIRMPESPRWLVSKGRKEDALRVLKKIRDEKRAAAELQEIEFAFKKEDQLEKATFKDLSVPWVRRIVFIGLGIAIVQQITGVNSIMYYGTEILRNSGFQTEAALIGNIANGVISVLATFVGIWLLGRVGRRPMLMTGLIGTTTALLLIGIFSLVLEGSPALPYVVLSLTVTFLAFQQGAISPVTWLMLSEIFPLRLRGLGMGVTVFCLWMVNFAVSFTFPILLAAIGLSTTFFIFVGLGICSVLFVKRFLPETKGLSLEQLEENFRAYDHSGAKKDSGAEVIG

SEQ ID NO: 64454 - protein, 155 aa, Streptococcus mutans
MIASQVKSHKRFGGVVPKLASRHHVEVITLCIQDALQEAGITAGDLSAVAVTYGPGLVGALLVGMAAAKAFAWANHLPLIPVNHMAGHLMAAQSIADLQYPLLALLVSGGHTELVYVAAPGDYRIVGETRDNAVGEAYDKVGRVMGLTYPAGKEI

SEQ ID NO: 64455 - protein, 204 aa, Zea mays
MADSGSIVVTEARKQHPLSQIAASGTHRLLLKQWVKEEDLLARRVALREARLDGARKEIAFLYCAFFAFHAASVLLLFLSSSTAGPASACRRSWIPCLVSLLSSLAMLWALRYKSDTEAVLERLLAREREDALLLARCVSELKRKGLHFDLLKEVDALRRAKSLRVEAKGADRPRRWQARDLAVFALFAVACGVLVLTRFLLCN

SEQ ID NO: 64456 - protein, 469 aa, Bacillus subtilis subsp. subtilis str. 168
MNQSQSGLKKELKTRHMTMISIAGVIGAGLFVGSGPVIHSTGPGAVVSYALAGLLVIFIMRMLGEMSAVNPTSGSFSQYAHDAIGPWAGFTIGWLYWFFWVIVIAIEAIAGAGIIQYWFHDIPLWLTSLILTIVLTLTNVYSVKSFGEFEYWFSLIKVVTIIAFLIVGFAFIFGFAPGSEPVGFSNLTGKGGFFPEGISSVLLGIVVVIFSFMGTEIVAIAAGETSNPIESVTKATRSVVWRIIVFYVGSIAIVVALLPWNSANILESPFVAVLEHIGVPAAAQIMNFIVLTAVLSCLNSGLYTTSRMLYSLAERNEAPRRFMKLSKKGVPVQAIVAGTFFSYIAVVMNYFSPDTVFLFLVNSSGAIALLVYLVIAVSQLKMRKKLEKTNPEALKIKMWLFPFLTYLTIIAICGILVSMAFIDSMRDELLLTGVITGIVLISYLVFRKRKVSEKAAANPVTQQQPDILP

SEQ ID NO: 64457 - protein, 251 aa, Medicago truncatula
MYISGGSSSMGRSFKESLKLLEADIHHANTLASDFPREYDGACLQMRMSYSPAAHLFLFLVQWTDCNLAGALGLLRILIYKVYVDGTTTMSTHERKASIREFYAVIYPSLLQLEKGVTDAEDKKQKVVCMERYRRREDEEHKQFSDIDFEREEECGICMEMNSKIVLPNCNHVMCLKCYHEWRARSQSCPFCRDSLKRVNSGDLWIFTDSRDIVDMETVTRENLRRLFMYIDKLPLIIPESLFDPYDSHLR

SEQ ID NO: 64458 - protein, 298 aa, Oryza sativa
YDDEQEPVVNENVAVRPNQKRSKNFSLEEDNLLVSAWINVSFDPVQGTDQSHGTYWGRIHDYFHQNKEFESDRSQSSLVHRWSTIQEHVNKYCGFLSQIQNRNQSGVNHEDMHVQASLMYKKKEEKKFQFMHCYNILKNLPKWDDKRNQLAASKTSSKKQKKTANDSPAISTPACNVDENRAADPENTVGEGRPMGRKKAKQQMRERSDLSRKESLDYLWDKKKEADAEKERKFEERYQIAFALEQKRIDLERDKFEFKRMTKEDKLLRTDTSAMSIEEQEYYKNVKNQILSRRSAQA

SEQ ID NO: 64459 - protein, 104 aa, Xanthomonas oryzae pv. oryzae KACC10331
MLVMDGPRLVGIVSERHYARKVVLRDRSSSTTSVAEIMSAEVVTVSPSDTVERCMQLMTDGRFRHLPVVENGRVQGVISIGDLVKAVIEAQQQDIDQLQRYIAS

SEQ ID NO: 64460 - protein, 252 aa, Pyrus communis
MPIRNIAVGRPEETYHPDALRAALAEFISTLIFVFAGEGSGMAFAKLTDDAANTPAGLVAAALAHAFGLFVAVSISANISGGHVNPAVTFGAFIGGNISLLRGILYWIAQLLGATVACGLLKFVTNGQTTAAFSLSSGVGVWNAFVFEIVMTFGLVYTVYATAIDPKNGSVGTIAPIAIGFIVGANILAGGAFDGASMNPAVSFGPALVSWSWENHWVYWAGPLIGAGLAGLIYEFVFIGNSGHEQLPSTDY

SEQ ID NO: 64461 - protein, 290 aa, Streptococcus pyogenes M49 591
MDKLARIDEAIRRYYKTTSNGVSEELIDAILYSVDSGGKRIRPLILLEMIEGFGVSLQNAHFDLAAALEMIHTGSLIHDDLPAMDNDDYRRGRLTNHKQFGEATAILAGDSLFLDPFGLIAQAELNSEVKVALIQELSLASGTFGMVGGQMLDMKGENQALSLPQLSLIHLNKTGKLLTFPFKAAALVTEQAITVRQQLEQAGMLIGHAFQIRDDILDVTASFEDLGKTPKKDLFAEKATYPSLLGLEASCQLLTESLDQALKIFQTLESDVGFKPQIITKLIEGLRLNA

SEQ ID NO: 64462 - protein, 332 aa, Sulfitobacter sp. EE-36
MTSENTQKPHDRMAAYLNADMTAVNDLIRDRMASEHAPRIPEVTAHLVEAGGKRLRPMLTLAAARLCGYDGPYHVHLAATVEFIHTATLLHDDVVDESAQRRGRPTANLLWDNKSSVLVGDYLFARSFQLMTETNNMRVLAILANASATIAEGEVLQLTAAQNLATDEGIYLQVVRGKTAALFSAATQVGGVIATAPDAQVQALYDYGDALGIAFQIVDDLLDYQGDPNATGKNIGDDFRERKLTLPVIKAIAKGDAAERAFWTRTIEKGKQEDGDLEHALSLLNAHGTLDETKAEALAWAEQAKTALNTLPDHDLTQMLRDLADYVVARIS

SEQ ID NO: 64463 - protein, 349 aa, Streptococcus pyogenes MGAS315
MKAATYLSTGNLQLIDKPKPVIIKPTDAIVQLVKTTICGTDLHILGGDVPACKEGTILGHEGIGIVKEVGDAVTNFKIGDKVIISCVTSCHTCYYCKRGLSSHCEDGGWILGHLINGTQAEYVHIPHADGSLYHAPDTIDDEALVMLSDILPTSYEIGVLPSHVKPGDNVCIVGAGPVGLAALLTVQFFSPANIIMVDLSQNRLEAAKTFGATHTICSGSSEEVKTIIDDITNGRGVDISMECVGYPATFDICQKIISVGGHIANVGVHGKPVDFNLDELWIKNITLNTGLVNANTTEMLLNVLKTGKIDATRLITHHFKLSEVEKAYETFKHAGANNALKVIIDNDIS

SEQ ID NO: 64464 - protein, 402 aa, Oryza sativa
SGSPGCRIRHEDYRHEENESSKSHTHTLSATPTTTLLLLHSALLSAPIPCGFYLSLLQFARARAPHWRDLRIVRGFVVELWGELWVLVGPISSLEQEGFQDRFGFLRYGEDGRIEGELERILGPQCLISDSWEVHSPDWCDPGVNFGEFLGSRIWPIVPARNRGNWGPIWCQLGSNLEVEAIDPAGEMIAAVGRGPEGWGEDEMSVLPRHTKVVVTGNNRTKSVLVGLHGVVKKAVGLGGWHWLVLTNGIEVKLQRNALSVIEPPTGNEDDDKFDCENMQWNSSDLASDDAQSPKPQRSRSRQHRGFQTKSFSRSMSCDSHSKASFSSSSRAHTKVDLSKLEMTALWRYWRHFNLDASPNPSREQLVDAVQRHFVSQQLDELQVIVGFVQAAKRLKTNVKVA

SEQ ID NO: 64465 - protein, 229 aa, Candida albicans SC5314
MSRSFTQFHSPTKPQLSMKSLTSIALIASIIVAFYTQLVLGGSSNLPKNPPVTNKVYFDVEEDGKSIGRITIGLFGTVVPKTVENFRVLCTGELGPSYENTVFHRVIKDFMIQSGDFEYGQGYGGYSPTHNNGKFDDENFELKHDRKYRLSMANAGKNTNGSQFFITTALTKWLDGAHVVFGEVLDGKDVVDYIENVKTGRGDRPVKEIKIVASGELKDSETNPSKDEL

SEQ ID NO: 64466 - protein, 887 aa, Buchnera aphidicola str. Bp (Baizongia pistaciae)
MAEFSSNDIDPIETEDWIQAIKSVIREDGLERANFIINTVKKYVPYKNKVVFKKCAISNYVNTIPVEEEPNYPGDLFIEQKIRSVIRWNAIMMVLRASKKNLDLGGHLSSFQSAATIYEVCFNHFFHATNENNGGDLVYFQGHISPGIYSRAFIEDRLTQKQLDNFRQEIDGIGLSSYPHPKLMPNFWQFPTVSMGLGPICAIYQAKFLKYLEHRNLKCTNNQKVYAFLGDGEMDEPESKGAISIAAREKLDNLIFIVNCNLQRLDGPVIGNGKVIDELESVFKGCGWKVIKVIWGSKWDSLLKKDVSGKLIKLMNETLDGDYQTFKSKNGAYIRKYFFGKYLETQELVKDMSDDQIWNLDRGGHDPKKIYAALSKANSIVGKPVIILMHTVKGYGMGDIAEGKNIAHQIKKIDIKGITYIKNRFKVPVEENELKYLPYVSFDANSIEYKYLHARRKKLGGYLPIRLSNFTNFFTLPKLDEFSTLLTEQKKEISTTIVFIRILNILLRNSFIKDRIVPIIADEARTFGMEGLFRKIGIYNFIGQKYTPQDKELLAYYKEDKKGQILQEGINELGAAASWLAAATSYSTNNFPMIPFYIFYSMFGFQRIGDLFWAAGDQQARGFLIGGTSGKTTLNGEGLQHGDGHSHIQALTIPNCISYNPAYAYELAVIVHDGLQRMYGPSQENIYYYITTMNENYVMPGISKNMYEGICKGIYKLKHVGKKNVKVQIMGSGSILQCVCRAAEILLEEYDIGSDVYSVTSFTELARNGQDCDRWNLLHPTQEKKVPFVTKIMNKLPAIAVTDYMKLFSEQVRAYIPAVTYRVLGTDGFGRSDSRKNLRRYFEIDEYHIVIAVLGELEKIGDVDKNTIVNAISKFKIDINKVNPRLA

SEQ ID NO: 64467 - protein, 442 aa, Escherichia coli B
MAMFGLPHWQLKSTSTESGVVAPDERLPFAQTAIMGVQHAVAMFGATVLMPILMGLDPNLSILMSGIGTLLFFFITGGRVPSYLGSSAAFVGVVIAATGFNGQGINPNISIALGGIIACGLVYTVIGLVVMKIGTRWIERLMPPVVTGAVVMAIGLNLAPIAVKSVSASAFDSWMAVMTVLCIGLVAVFTRGMIQRLLILVGLIVACLLYGVMTNVLGLGKAVDFTLVSHAAWFGLPHFSTPAFNGQAMMLIAPVAVILVAENLGHLKAVAGMTGRNMDPYMGRAFVGDGLATMLSGSVGGSGVTTYAENIGVMAVTKVYSTLVFVAAAVIAMLLGFSPKFGALIHTIPAAVIGGASIVVFGLIAVAGARIWVQNRVDLSQNGNLIMVAVTLVLGAGDFALTLGGFTLGGIGTATFGAILLNALLSRKLVDVPPPEVVHQEP

SEQ ID NO: 64468 - protein, 110 aa, Bartonella henselae str. Houston-1
MTTIRDFIDSEIKENDVILFMKGTPDAPQCGFSGQVAHILNYLGVPYKGINILTSDELRQGIKDYSNWPTIPQLYVKGEFIGGCDIIKEMFQNNELQELLKEKDIPCNKA

SEQ ID NO: 64469 - protein, 399 aa, Oryza sativa
  misc_feature (215)..(215): Xaa can be any naturally occurring amino acid
MALSISTPPTSSSLLPASLQVGRWSSSAAMSARPVAFSLRRPVLAARVAAGGNAPSSSVDEVVTELDAVASFSEIVPDTVVFDDFEKFAPTAATVSSSLLLGIAGLPDTKFKSAIDTALADGECNTMEKPEDRMSCFLTKALANVGAEMAHLVPGRVSTEIDARLAYDTQGIIQRVHELLKLYSDHDVLSERLLFKIPATWQGIPGLQVLESEGXQTHLTFVYSFAQAAAAAQAGASVVQIFVGRVRDWARTHSGDPEIDEALKKGEDAGLALAKKVYAYIHKNGYKTKLMAAAIRNKQDVFSLLGIDYIIAPLKILQSLEESVTDTDVKYGYVPRLTPALGKTYNFTEEELVKWDQLSLAAAMGPAAEELLASGLEGYVNQARRVEELFGKIWPPPNV

SEQ ID NO: 64470 - protein, 261 aa, Zea mays
VDPRVRIKPFHNMRNPNGTGRSLFPQLSHHSPAQVLRNFTHIRNLRIELPSGDVGTEEGVLLKWRAEYGSTLQSCVILGGTRVDRKPVGGEHEQSLEDNGSMPESFYTNGGLKLRVVWTISSLIAASTRHYLLRSIINDHSTLLSLVLTDADGQGTLCMGAEQLKEFRENQLSASACSNRTQVPACNMKLKYAPYLELPGGMALQGATLVAIKPSPDGSNGSHPNRKEADAFVFGAFDGPFKAAVKALMKRRTYLLEMNGF

SEQ ID NO: 64471 - protein, 299 aa, Triticum aestivum
  misc_feature (171)..(171): Xaa can be any naturally occurring amino acid
  misc_feature (178)..(178): Xaa can be any naturally occurring amino acid
  misc_feature (201)..(201): Xaa can be any naturally occurring amino acid
MAGGSGEGAAMSPPSSSGVGGGGGGGKRGRDPEEDVYVDNLHSHKRYLSEIMASSLNGLSVGDSLADNIMESPARSESSSCIRDEIISQYSPMSEDSDDYRYFDTQLNPNGSQGDAMVSPSTSPMSSPHRFQKPQASFLPSSPYPLPSCSLSSVACSHPRRGSENEGRFPXSPNDMCXHGADLRRTALLRSVQMRVHGSPXAYDPSFGSRQEQEHVHEHDDEHGHEHLEDLGGPERPSCRKSIDNEASGYQGAENSYGRQEHDIDYIDGCTADDVLSGPKFKQEDDNQGNSDASMDKTR

SEQ ID NO: 64472 - protein, 445 aa, Silicibacter sp. TM1040
MTEFSSMDLPKHLHTRMEAMGFNTPTPIQARAIPHALNGQDVLGLAQTGTGKTAAFGVPLVAQMLEYGRKPAAGTVRGLILAPTRELANQIAETLRGLTEGSPLKTGLVVGGVSINPQIHRLSKGTDILVATPGRLLDILDRKALDLGSCDFLVLDEADQMLDLGFIHALRKIAALLPEERQTMLFSATMPKQMNEIANAYLKSPVRIEVTPPGKPAAKVTQSVHFIAKAEKLSLLKELLSAHDGERTLVFGRTKHGMEKLMKVLDKAGFKAAAIHGNKSQGQRERALKAFKSGEITVLVATDVAARGLDIPDVKYVYNYELPNVPDAYVHRIGRTARAGKDGQAVAFCAPDEIGDLKAIQKTMGITIPVASGRAWEELPDPAAKPARGGGRGRPGGGGGGRGKGGGKPGGGRRRFGGGKSAAPSGGAGESRGAAGAGGRQRRKS

SEQ ID NO: 64473 - protein, 510 aa, Streptococcus pyogenes MGAS315
MENHKNEFTFSNKSIIAYVWRGVVVGIIAGVIVSLFRLLIEVTADWVIEWYRYAHINSLLLLPILSVSLLAVLFVGFLVKSDSDIKGSGIPHVEGELKGLMSPDWWSVLWKKFLGGIMAISMGFMLGREGPSIQLGAMSAKGLAKFLKSSRLEKRVLIASGAAAGLSAAFNAPIAGLLFVVEEIYHHFSRLIWITALVASLVANFISLNIFGLKPVLAMSEAMPFLGLNQYWLLLLLGLFLGCLGYLYEIVILNFNKLYVILGSWLHLPAYFYGIIMVFLILPIGYYLPQLLGGGHGLILSLSNQQLPLMTIFFYFIIRFIVSMFSYGSGLPGGIFLPILTLGALAGLLFGQIASQLGLLNQSFLSLFLILGMAGYFAAISKAPLTGMILVTEMVGDLKPLMAIAVVTFVSYLVMDLLNGQPIYEAMLDKMAMKHPTNLVEPTLIELTVGDKIAGKYVKELKLPENVLITTQIHHQKSQVVSGNTRLLSGATIFLVVNEADTGFVREVLM

SEQ ID NO: 64474 - protein, 248 aa, Spinacia oleracea
EGGKRLTYDEIQSKTYLEVKGTGTANQCPTVEGGVDSFAFKPGKYTAKKFCLEPTKFAVKAEGISKNSGPDFQNTKLMTRLTYTLDEIEGPFEVSSDGTVKFEEKDGIDYAAVTVQLPGGERVPFLFTIKQLVASGKPESFSGDFLVPSYRGSSFLDPKGRGGSTGYDNAVALPAGGRGDEEELQKENNKNVASSKGTITLSVTSSKPETGEVIGVFQSLQPSDTDLGAKVPKDVKIEGVWYAQLEQQ

SEQ ID NO: 64475 - protein, 297 aa, Solanum lycopersicum
MGEKPKSGGVWPTVKPFVNGGVSGMLATCVIQPIDMIKVRIQLGQGSAAEVTKTMLKNEGFGAFYKGLSAGLLRQATHTTARLGSFRILTNKAIEANEGNPLPLYQKALCGLTAGAIGATVGSPADLALIRMQADATLPLAQRRNYTNAFHALSRIAADEGVLALWKGAGPTVVRAMALNMGMLASYDQSVEFFRDNLGMGEAATVVGASSVSGFFAAACSLPFDYVKTQIQKMQPDAEGKLPYTGSFDCAMKTLKTGGPFKFYTGFPVYCVRIAPHVMMTWIFLNQIQKVEKKIGL

SEQ ID NO: 64476 - protein, 167 aa, Oryza sativa
  misc_feature (62)..(62): Xaa can be any naturally occurring amino acid
MGDDGGGDGGASSAGFSYFAVFHNYPLVAALLGFAVAQSIKFFVTRYKENRWDPKQLIGSGXPSSHSATVTALAVAIGFQDGFGCALFATAAIFASVVMYDASGIRLHAGKQAEVLNQIVCELPSEHPLSETRPLRELLGHTPTQVCSNAIFTNHFIILHQSKAMSY

SEQ ID NO: 64477 - protein, 159 aa, Glycine max
MVTELINANPIIYEKKERRAPSAPSAPHDEYAVEPIDQQEVFDHIRDIKDPEHPYSLEELKVITEEAVEVDDQRNYVRVTFTPTVEHCSMATVIGLCLRVKLMRSLPSRYKVDIRVAPGSHATEAAVNKQLNDKERVAAALENPNLLNMVDDCLASSYD

SEQ ID NO: 64478 - protein, 358 aa, Brassica napus
MGTYLSSPKTDKLSEDGENDKLRYGLSSMQGWRATMEDAHAAILDLDDKTSFFGVYDGHGGKVVAKFCAKYLHQQVLSNEAYGAGDIETSLQRAFFRMDDMMQGQRGWRELAVLGDKMNKFSGMIEGFIWSPRSGDANNQPDNWPLEDGPHSDFAGPTSGCTACVALIKDKKLFVANAGDSRCVISRKGQAYNLSKDHKPDLEVEKERILKAGGFIHAGRINGSLNLTRAIGDMEFKQNKFLPSEKQMVTADPDINTLDLCDDDDFLVVACDGIWDCMSSQQLVDFIHEQLKSETKLSTVCEKVVDRCLAPDTASGEGCDNMTIILVQVKKSNNNPSEPEPEEETKPQPSQDEPSSSS

SEQ ID NO: 64479 - protein, 135 aa, Zea mays
MASRKCLGGEGSAPAPHVLAVDDSSVDRAVIAGILRSSQFRVTAVDSGKRALELLGTEPNVSMIITDYWMPEMTGYELLKKIKESSRLKEIPVVIMSSENVPTRINRCLEEGAEDFLLKPVRPSDVSRLCSRVLR

SEQ ID NO: 64480 - protein, 139 aa, Triticum aestivum
  misc_feature (101)..(101): Xaa can be any naturally occurring amino acid
MMLLGKRQRSEIKRTTSLSKIKFDLNLPCEPEEPSDHQHVQTLSPRKSKLVAVDEHRQVHHGLLDQRLLPMVSPRGTQRRHSEDYSTHAGDFLRCCSLCKXHLVSGRSVYMWLGRGPFSSLECRQRQNYAGRGRTLRWS

SEQ ID NO: 64481 - protein, 455 aa, Blumeria graminis
MPGQSTPRARPSPQLKLSTPKKSSHTPLELQQTHHLVDRHGISISNIQSAGGGSESSEAHSRSGSFGLLDGRGSVPVSAGSQYSALSFAQNGLRHLQGTPDPSSAVGSLYSERSEIGVGVERDGSLNELDSFARLSLERARTLDVEELDDEGWRIASTENRIQELSSLGEGAGGAVTKCILRGGKTIFALKIITTNPDPDVKKQIVRELGFNKDCANEHICRYYGAFVEPSTATISIAMEFCEGGSLDSIYREVRKLGGRTGEKVLGKIAEGVLNGLTYLHGKKIIHRDIKPSNILLCRDGQVKLCDFGVSGEFGTKGDANTFIGTSYYMAPERITGQSYTITSDVWSTGVTLLEVAQHRFPFPADGTEVQPRAGLIDLLTYIVRQPVPKLKDEPEAGIKWSDNFKYFIECCLEKTPSRRASPWRMLEHPWMIEMQSKRVHMAHFLATVWGWEEK

SEQ ID NO: 64482 - protein, 2155 aa, Blumeria graminis
MTRKDLATRNSSATSSAPDGGRTRDILNLSASWTICPIQQGTRVCVNTNQNKLLATKTQVYCKEHQPVFSPTTFNAYLREREHCSSVLGNCSRNFAALETGKKECLPPNQHNISTPTAASLHHFEATWMASTRGPLTLPGSASFGTSFFSDANDQKPENSPLSPGPRLSTGLSTTSTVGDLTGETYFGEERRPSIASVHTASSQSSISSVSRPGIHKKLQTFFGDDFPGRNRADSSLPSQRNQGRSQSFVRKQRDRATSSGAETTRKREASPADSRPRTPVPSRDVVPFLYQDSQDISKYGEAPVRDKLSGLDRDRYAGDSVITSKLSSSFTGQSHVVSSGRFTKGTEDLRPSHPSLVREEFGSASRSRDRAPKAMGTALGSSSNSGQAKRSVSPTIIAAVIKNSTSNNINSNSNINSGNHDGSTSPTLPSKRGILGRFLKHKEKDSVPLRLKEVPNTSRTFSSPGSRNDTTRGPTSPETAMSSWSREGSITGLDSSSSKAETGRPNNGSYRQGAFSKLQLRKGKPKITDEQDSLAESTENNDIISGLMFSLDTNLNNMEGILAKPPPLTPLDNSLINSLEDEAKDEAENIGSLGWNAPDSWAVKKSNDDTMSRLSDINEAYVPPMEDEKSNPYCIRIFRLDGTFATLSTPLNATVAELMGQLGRKTYMTDSLANYQIVMKKHDLQRILGPGERPVVIQKRLLEQAGYEERDRIEDVGREDNSYLCRFSFIPARESGYASFATDPLAGRVQKYSHIDLSRRNLVTIPIALYSKASEIISLNLSRNLSLDLPKDFIQSCQNLRDIKFTNNEAWKLPLSLSHGTRLSILDVSNNRLEQLERSELDRLQNLASLKLANNRLGSLPSYFGNFKLLRTLNVSSNFLESFPTFLCDLESLVDIDMSFNGISSLPDEIGQLTNLERFIITNNRLNGSLPLTFGDLVNLKEVDIRYNALSSIDVIARLPKVEQISADHNSVSVCESEFTKIRILRLNSNPVTKFEILNSVPTLKTLNLSNAKLAHVPDAIFDRMPNLVKLILDINHFVSLPMHIGKLRKLEHFSIARNALNSLPQEIGCMTELRFLDVRQNNLKKLPIELWYASKLETLNVSSNVLDSFPMPASRPPQIPGEIFPMVPQNTSNGSLGPNSTASSFEEIGALEAFGQRRSSQASYSLLGVGGSPGSGVTERKTSVVSSYSKGGRQTSIVTRTGSEMTAGNITPLRKDSGISTRLISTFSRSLKNLYLADNQLDDDVFDKLILLGELRILNLSYNDLNDIPHRSIKSWPQLSELYLSGNELTSLPSDDFEEFSLLQVLHINGNKFQTLPAELGKAHRLAVLDCGSNSLKYNVSNWPYDWNWNWNTNLKYLNLSGNKRLEIKPSAPGGAGNRDGRDLTNFNALQNLRILGLMDVTLTISSIPDQTEDRRVRTSGSVAGHLSYGMADTLGKNDHLSIIDMVVPRFNSSEAETLMGMFDGQALSGSGSKIARYLHENFGHIFSEELKKLNSELGETPADALRRAFLSLNKDLAIAATQCAEERPLLTHRSTTASTALSHTDLQSGGVATVVFLQNSELYVANVGDAQAMLIHSEGGHRILTRKHDPAEPNERQRIRDAGGWVSRQGKLNDILEVSRAFGYVQIMPAVQAAPHITQVTVKEQDEMILIASRELWEYLSPELVVDVARYERGDLMRASQRLRDLAIAFGATNKLMVMMIGVSDLKKRAQIRPHRVQSLLFNPGTIIDETYAPTRRPRKKGETVEDSGLRRLQAEVDAPVGDVSIAFTDIKSSTLLWETYPSAMRSAIKLHNEVMRRQLRIIGGYEVKTEGDAFMVSFPTATSALLWCFAVQQALLEVQWPSEVLSSVLGQEVYDNDQTLIFKGLSVRMGVHWGHPVCETDPVTRRMDYFGPMVNRAARISAVADGGQITVSADFISEIQRCLETYSESARSDSMGSEEAFESDIYRQAIRRELRSLSSQGFEVKDMGERKLKGLENPEYIYLMYPHALSGRIHYQQRLAEGDKLVAVEGPARFSDTTQLNIDIDSLWGLWHVSLRLEMLCSSLEVENGIGMPLQAPETTILEKIRSRGGEITDRVLINSLAHQVTRIESCISSLVTRHLAVGQCPLYNFDQLRAPMTEVLGSIAVQLRELRILKAGYIDQDFSNLSKRRT

SEQ ID NO: 64483 - protein, 375 aa, Prunus mume
MTFTLGKKEILIDILVRLPAKSLVRFLCTCKSWSDLIGSSSFVRTHLDRNVTKHAHVYLLCLHHPNFECAIDPNDPYIEEEVQWSLFSNETFEQCSKLSHPLGSTEHYVIYGSSNGLVCISDEILNFDSPIHIWNPSARKLKTPPISTNINIKFSCVVLQFGFHPGVNDYKAVRMMRTNKNALAVEVYSLRTNSWKMIEAIPPWLKCTWQHHKGIFFNGVAYHIIEKGPIFSIMSFDSGSEEFEEFIAPDAICSSLGLCIHVYKEQICLLSGFYGSEEEDMDKIDLWVLQEKRWKQLCPFIFPLDHCHRTIGFSADNELLMERRDFIKGITHLCLCNYESKQVLETGIRLAVMKYGDIEFLFAITYIESLVLSNY

SEQ ID NO: 64484 - protein, 377 aa, Prunus mume
MTFSLRKKEILIDILVRLPAKSLVRFLCTCKSWGDLIGSSSFVSIHLNRNVTKHAHVYLLCLHHPNFERQVDPDDPYVEQKFHWSIFSNETFEECSKLSHPLGSTERYGIYGSSNGLVCISDEILNFDSPIHIWNPSVRKLRTPPMSANINVKFSHVALQFGFHPGPNDYKVVRMMRTNKNALAVEVYSLRTDFWKMIETIPPWLKCTWQHHKGTFFNGVAYHIIEKGPLFSIMSFDSGSEEFEEFLAPDAICNSWGLCIDVYKEQICLLFTFYDCEEEDMEKSDFWVLQEKRWKQLSPFIYPSNCYSTMGISIDNELLMQRRDHIKGGADLYLCNYESKQVLETGLRLGTVTYGEIEFLFSVTYIETLVLLNSLQY

SEQ ID NO: 64485 - protein, 548 aa, Haloarcula marismortui ATCC 43049
MRILGIEGTAWAASASVFETPDPARVTDDDHVFIETDAYAPDSGGIHPREAAEHMGEAIPTVVETAIEHTHGRAGRDGDDSAPIDAVAFARGPGLGPCLRIVATAARAVAQRFDVPLVGVNHMVAHLEVGRHRSGFDSPVCLNASGANAHILGYRNGRYRVLGETMDTGVGNAIDKFTRHIGWSHPGGPKVEQHARDGEYHELPYVVKGMDFSFSGIMSAAKQAVDDGVPVENVCRGMEETIFAMLTEVSERALSLTGADELVLGGGVGQNARLQRMLGEMCEQREAEFYAPENRFLRDNAGMIAMLGAKMYAAGDTIAIEDSRIDSNFRPDEVAVTWRGPEESVDSYRMGGDEVQGAEATVHFDGDRVIKVRVPRSYRHPTLDERLRTERTRQEARLTSEARRNGVPTPLVRDVDPQESRIVFQRVGDTDLREGLSEGRVADVGRWLARIHDAGFVHGDPTTRNVRVGGRDEQADRTTLIDFGLGYYTQEAEDHAMDLHVLAQSLAGTADDPETLLSAAEDAYRTESDHADAVFASLDDIEGRGRYQ

SEQ ID NO: 64486 - protein, 425 aa, Silicibacter sp. TM1040
MSTIIDIHAREILDSRGNPTVEVDVVLEDGTMGRAAVPSGASTGAYEAVEKRDGDKSRYMGKGVLEAVAAVNGEIADELVGFDATEQVSIDRAMIELDGTENKGRLGANAILGVSMAVAKAAADFTTQPLYRYVGGAAARILPVPMMNIINGGEHADNPIDIQEFMIMPVAAENIRDAVRMGSEVFHTLKKELSAAGLSTGIGDEGGFAPNIASSREALDFILKSIEKAGYKPGEEIYLALDCAATEYYKDGKYVLSGEGKTLTSEENAAYLAALVNDYPIISIEDGMSEDDWDGWKALTDQIGDKVQLVGDDLFVTNPVRLAEGIERGCANSMLVKVNQIGSLTETLQAVDMAHRARYTNVMSHRSGETEDATIADLAVATNCGQIKTGSLARSDRLAKYNQLIRIEETLGEIAEYAGRSILKG

SEQ ID NO: 64487 - protein, 94 aa, Brassica napus
MGFIMEFAENLVLRLMEDPEVRDRKAREHIYEMHERCKKIKEMWALPIRPYGFWTFERHNAQLRWDPQISQVAGRRDPYDDLLQDHPSSSSSSN

SEQ ID NO: 64488 - protein, 242 aa, Brassica napus
  misc_feature (213)..(213): Xaa can be any naturally occurring amino acid
  misc_feature (238)..(238): Xaa can be any naturally occurring amino acid
MGFMVDTQQEGGEQHQWSCIRNLVRRKQVDSSNGKAEHQLAKALTFPHLIAVGVGSTIGAGVYILVGTVAREHSGPALAFSFLIAGVSAALSAFCYAELSSRFPSAGSAYHYSYICIGEGVAWLIGWALILEYTIGGSTVARGISPNLAMIFGGEDCLPAILARHQIPGLDIVVDPCAAVLVFIVTGLLCIGVKESTFAQGIITTVNVFVMIXVIVAGTYLCFKTGWAGYQLPSGYFXYGVD

SEQ ID NO: 64489 - protein, 577 aa, Zea mays
MDMDVRRRVPPPHGSVPRRQQATGAEGERVRVQAGDALPLPIRHTNLIFSALFAASLVYLMRRWRGKIRASTPLHVVSPAEIFAICGLVASLIYLLSFFGIAFVQSVVSSSDDDEDFIVDSRHARARAPPTPAQTPCALLGSPAAAPEKMPEEDEEIVAAVVAGKIPSYVLETRLGDCRRAAGIRREALRRITGREMDGLPLDGFDYASILGQCCELPVGFVQLPVGVAGPLLLDGRRLYVPMATTEGCLVASTNRGCKAIAESGGASSVVLKDGMTRAPAVRFPSARRAAELKAFLEDPANFDTLAMVFNRSSRFGRLQGVKCAIAGRNLYMRFSCSTGDAMGMNMVSKGVQNVLDYLQADFPDMDVISISGNFCSDKKSAAVNWIDGRGKSVVCEAVIKEEVVKKVLKTNVQALVELNVIKNLAGSAVAGALGGFNAHASNIVAAIFIATGQDPAQNVESSQCITMLEAINDGKDLHISVTMPSIEVGTVGGGTQLASQSACLDLLGVKGANRESPGSNARLLATVVAGAVLAGELSLISAQAAGHLVKSHMKYNRSSKDMSKTLAEETDKAKKC

SEQ ID NO: 64490 - protein, 120 aa, Nostoc punctiforme PCC 73102
MSAQEIIRSIEAEQLKSNLPDIYVGDTVKVGVKIKEGEKYRVQPYEGVVIAKRNGGINETITVRKVFQGVGVERVFLLHSPRIDSIKVLRRGKVRRAKLYYLRDRVGKATRIKQRFDRPL

SEQ ID NO: 64491 - protein, 131 aa, Flaveria ramosissima
SNGGRVQCMKVWPPLGKKKYETLSYLPDLTEAQLAKEVDYLLRNKWVPCLEFELEHGFVYRENARSPGYYDGRYWTMWKLPMFGCTDSAQVMKELQECKKEYPQAWIRIIGFDNVRQVQCISFIASKPDGF

SEQ ID NO: 64492 - protein, 315 aa, Glycine max
MYSLAQHKYTPNFHHQVCKNHPPRHPSRVHCSTTTTTTTTSRSKSNAKSLVIETRLVPVPPMPTVVTTEIHRPMNNDPSLQSTWSHRAWVAAGCSTLVISLGESIKGAIDLNMWVEPIVAGWVGYILADLGSGVYHWAIDNYGDGSTPIVGAQIEAFQGHHKWPWTITRRQFANNLHALARAVTLAVLPVVLLCHDPIVEGFVVVCSGCIMFSQQFHAWSHGTKSRLPPLVVALQEAGVLVSRWQHAAHHRAPYNNNYCIVSGVWNEFLDKHKVFEAMEMVLYFKTGVRPRSWSEPAPEWVEEIETPSQIQIQTQ

SEQ ID NO: 64493 - protein, 334 aa, Geobacillus stearothermophilus
AVKVGINGFGRIGRNVFRAALKNPDIEVVAVNDTGGANTLAHLLKYDSVHGRLDAEVSVNGNNLVVNGKEIIVKAERDPENLAWGEIGVDIVVESTGRFTKREDAAKHLEAGAKKVIISAPAKNEDITIVMGVNQDKYDPKAHHVISNASCTTNCLAPFAKVLHEQFGIVRGMMTTVHSYTNDQRILDASHKDLRRARAAAESIIPTTTGAAKAVALVLPELKGKLNGMAMRVPTPNVSVVDLVAELEKEVTVEEVNAALKAAAEGELKGILAYSEEPLVSRDYNGSTVSSTIDALSTMVIDGKMVKVVSWYDNETGYSHRVVDLAAYIASKGL

SEQ ID NO: 64494 - protein, 396 aa, Triticum aestivum
  misc_feature (115)..(115): Xaa can be any naturally occurring amino acid
  misc_feature (205)..(205): Xaa can be any naturally occurring amino acid
  misc_feature (367)..(367): Xaa can be any naturally occurring amino acid
  misc_feature (380)..(380): Xaa can be any naturally occurring amino acid
METVAAAGYARGAATRSPACCAAMSFSQSYRPKAARPATSFYGESLRANTARTSFPAGRQSKAASRAALTTRCAIGDSLEEFLTKATPDKNLIRLLICMGEAMRTIAFKVRTASXGGTACVNSFGDEQLAVDMLADKLLFEALEYSHVCKYACSEEVPELQDMGGPVEGGFSVAFDPLDGSSIVDTNFTVGTIFGVWPGDKLTGXVTGGDQVAAAMGIYGPRTTFVVALKDCPGTHEFLLLDEGKWQHVKDTTTIGEGKMFSPGNLRATFDNPDYDKLVNYYVKEKYTLRYTGGMVPDVNQIIVKEKGIFTNVTSPTAKAKLRLLFEVAPLGFLIEKAGGHSSDGKQSVLDKVISVLDERTQVAYGXSKNEIIRFEETLXYGSSRLAASATVGATA

SEQ ID NO: 64495 - protein, 131 aa, Flaveria palmeri
SNGGRVQCMKVWPPVGKKKYETLSYLPELTEAQLAKEVDYLIRNKWVPCLEFELEHGFVYRENASSPGYYDGRYWTMWKLPMFGCTDSAQVMKELQECKKEYPQAWIRIIGFDNVRQVQCVSFISPKPTGF

SEQ ID NO: 64496 - protein, 354 aa, Arabidopsis thaliana
  misc_feature (153)..(153): Xaa can be any naturally occurring amino acid
  misc_feature (171)..(171): Xaa can be any naturally occurring amino acid
MKNSIPMMIPDNPSSTTDVNIIEPRNIRISFVIDHTFRAAKVYLKTRLAGLSTGEILVGSSDLKNPTAEPNLGIPPNTKIVDEFEGIHLEWTLHSLETKSYPYEKKYFHLTYSSWESAIFEHHTTFETLAIEPQLKTTMIDDLDAFSKGKDFXKSVGRAWKRGYLLYGPPXQSVKDDAELRRVLTATNNRSILLIEDIDCGTDSSRRRQTKNEEDDKISLSGLLNFVDGLWSSCGEERIIIFTTNYKEKLDPALLRPGRMDVHILMDYCTPFVLKKLVAMYLKIDDHVLFDPIEKLVLEVSVTPAEVAQQLMVSKNTDIALKGLIEFIEKKKIEKEEVTKVEEEGEIEDAETNE

SEQ ID NO: 64497 - protein, 131 aa, Flaveria palmeri
SNGGRVQCMKVWPPVGKKKYETLSYLPELTEAQLAKEVDYLIRNKWVPCLEFELEHGFVYRENASSPGYYDGRYWTMWKLPMFGCTDSAQVMKELQECKKEYPQAWIRIIGFDNVRQVQCVSFIASKPTGF

SEQ ID NO: 64498 - protein, 368 aa, Bartonella henselae str. Houston-1
MKSPTSSIPFKIEKHPSPLSDEEREHILKNPGFGQFFTDHMVIIKWTKDKGWHNAVISQYKSLEINPASTVLHYGQEIFEGLKAYRAKDGRILLFRPDANAQRFIESARRLAMPELPKDIFLDAVHKLVRIDQNWISGNPNASLYIRPFMFGNENFLGVRPSEKYIFCIIASPVESYFKGEEKPVSVWLETDYSRAGPGGTGVAKCGGNYAASLLAQKNAEQNNCSQVLFLDMVEHKWIEELGGMNVCFIMENNTLVTPALNGTILAGITRHSILKLAQKMGLKIEERPYSFESLQEDARSNHLKEVFACGTAAVVTSIGRFKYKGGEFVIGNGMIGEVTKKLRTQLVDLQKGNREDKNGWVHSVQLS

SEQ ID NO: 64499 - protein, 487 aa, Brassica napus
MGETAAANNHHHHHGHQVFDASVPPQPAFKCFDDDGRLKRTGTVWTASAHIITAVIGSGVLSLAWAIAQLGWVAGPAVMLVFSLVTLYSSTLLSDCYRTGDAVSGKRNYTYMGAVRSILGGFKFKICGLIQYLNLFGIAVGYTIAASISMMAIKRSNCFHKSGGKDPCHMSSNPYMIIFGVTEILLSQVPDFDHIWWISIVAAVMSFTYSAIGLALGIVQVAANGVFKGSLTGISIGTVTQTQKIWRTFQALGDIAFAYSYSVVLIEIQDTVRSPPSESTTMKKATKISIAVTTIFYMLCGSMGYAAFGDAAPGNLLTGFGFYNPFWLLDIANAAIVVHLIGAYQVFSQPIFAFVEKSVSERFPDSDLLTKELQIKIPGFRSPYKTNVFRVVFRCCFVVLTTVISMLMPFFNDVVGILGALGFWPLTVYFPVEMYIKQRKVEKWSTRWVCLQMLSVACLVISVVAGVGSIAGVMLDLKVYKPFQSTY

SEQ ID NO: 64500 - protein, 558 aa, Arabidopsis thaliana
MASSVTGDAETAISADSSTKRRGGGWITFPFMIATLLGLTIAAWGWLLNLIVYLIEEFNVKSIAAAQIANIVSGCICMVPAVAAIASDSFFGTIPVISVSAFISLMGVALLTLTASLDTLRPRPCETASILCQSPSKTQLGVLYTAITLASIGTGGTRFTLATAGANQYEKTKDQGSFFNWFFFTTYLAGAISATAIVYTEDNISWTLGFGLSVAANFFSFLVFVSGKRFYKHDKPLGSPFTSLLCVIFAALRKRKAVVSTNEKDYHNESITMPTKSFRFFNRAALKQEDEVKPDGTIRNPWRLCSVQQVEDFKAVIRIIPLALATIFLSTPIAMQLSLTVLQGLVMDRRLGPSFKIPAGSLQVITLLSTCLFIIVNDRVLYPFYQKLTGKHLTPLQRVGIGHAFNILSMAVTAIVEAKRLKIVQKGHFLGSSSVADMSVLWLFPPLVIVGIGEAFHFPGNVALCYQEFPESMRSTATSITSVVIGICFYTSTALIDLIQRTTAWLPDDINHGRVDNVYWILVIGGVLNLGYFLVCSWLYRYRNLKDDDHKQAANVSH

SEQ ID NO: 64501 - protein, 305 aa, Magnaporthe grisea 70-15
MSSKPPSRVVFVGNIPYGLSEEQITDIFSRAGKVLNFRLVYDRETGKPKGFGFAEYPDNDSAASAVRNLNDTEIMGRKLRVDFSNEKPSTNDPDDGPPGGANGSGAPSYQQQQEVPSLPPLPPGKDIPAGVSATDAISRTLRTLPPAQLLDILQQMKTMSGADPARATELLTQAPQLSYAIFQALLLMDLVSPDAIHSVVDPGAAVPPPAAAPAHAPAPYGAPPAAAAVYQQHPVANTPPVPMPYAPPAAPTAATPTPAPAAAPQDTDALMQQVLALPQATIDQLPEAERAQIMALRASLMGQAR

SEQ ID NO: 64502 - protein, 446 aa, Debaryomyces hansenii CBS767
MSPKREEEESDSLTAVDYIKTRDKLEKEARELMPFDPSECTYGKGELRQPIFACITCSDENNEEIGVCYSCSIQCHSSHELVELFTKRNFVCDCGTTKMSKTIDGGCKLRLKREENERRPSIQKTGYSSTASSKSHDIKMPAEDIPSLSNMYNQNFHGLFCSCEKPYNPLEETGNMIQCYFGFTCGEDWFHDECILGYNPGTIRKQHETKQNETGKNFLHKLSPPGEDAKADIEDKQTTQKTYSVPYFPELEDFDLFVCWKCVKEFRHIFKEIENDKKIILTKLPHFNEVESISDWKEKFEHLVEQDEDAPKTKRIKIDPDHEVLYSVFLQPDFRDRLLELKNTLPQDSKLHEFLCNHDYLYLDDPIYECPEDNDGENSTTGSLYDLGTDALLSMPRDQAIEGLQAYETISSKLKEFFKPFAEQGKVVTEEEVRDFFSEIQKKKDK

SEQ ID NO: 64503 - protein, 526 aa, Zea mays
MASSSTCVLKKNYRCDRSLQQFYTGGPFAVGLAPGGDGEGGAEAEAFLACACGGEVRVVSSADASAIGEPVDGDSEAITALALSPDSRLLFAAGHSRLIRAWDLASRACIRSWKGHDGPIMAMACHASGGLLATAGADKKVCVWDVDGGFCTHFLRGHTGVVTTVMFHKDPKRLLLFSGSEDGTVRVWNLETKKCVAVLKEHFSAVTSLALSDDGQTLLSAGRDKIVSAWDIRKYSSNMPMPTYEMLEAISFIGSGSELLACLGIQLANIKEKYAGYFLTVGERAVVRIWCLESCVCVFEQQTSDVTVNSENEETRRGFTSAVMLPNDQGLLCVTADQQFLFYCPKRTDDGDFELSLYRRLIGYNDEILDLKFIGEEEQYLAVATNLEQVRVYDVASMSCSYVLAGHTEIVVCIDTCVSASGKTLVVTGSKDHTVRLWDAERKSCIGIGKGHLGAVGSVAFSKKTKDFFVSGSSDRTIKVWTWDNTLGDAEDEVPLKAKAVVAAHDKDINYLTVSPNDGLVCSGSE

SEQ ID NO: 64504 - protein, 303 aa, Magnaporthe grisea 70-15
MSQNPFQEYMRQLQRIQQRAGGGGGMPPRGTIGLGAAAALGAAGIWVVSNSLFNVDGGHRAIKYRRISGVSKEIFGEGTHFAIPWFETPIVYDVRAKPRNVSSLTGTKDLQMVNITCRVLSRPEVKALPQIYRTLGSDYDERVLPSIVNEVLKSVVAQFNASQLITQRENVARLIRENLSRRAALFNIVLDDVSLTHLAFSPEFTAAVEAKQVAQQEAQRAAFVVDKARQEKQAMVVKAQGEARSAELIGEAIKKSKSYVELKKLENARAIAQTLQEAGGRNRLLLDAEGLGLNVFEKTDRKD

SEQ ID NO: 64505 - protein, 335 aa, Oryza sativa
  misc_feature (73)..(73): Xaa can be any naturally occurring amino acid
  misc_feature (137)..(137): Xaa can be any naturally occurring amino acid
  misc_feature (169)..(169): Xaa can be any naturally occurring amino acid
  misc_feature (205)..(205): Xaa can be any naturally occurring amino acid
  misc_feature (243)..(243): Xaa can be any naturally occurring amino acid
NYLHSNWIIHRDLKPSNILVMGEGEEHGIIKIADFGLARIYQAPLKPLSDNGVVVTIWYRAPELLLGAKHCTXASCRICRHEVGCIFAELLTLKPLFQGVEAKATPNPFQLDQLDKIFKVLGHPTVEKWPTLANLPXWQNDQQHIQGHKYENTGLHNIVHLPQKSPAFXDLLSKMLEYDPRKRITAAQALEHEYFRMDPLPGRKXALLPSQAGEKIVQYPVRPVDTTTDFEGTTSLQPTQAPXSGNPPPGNQSVVPRPVPRQMQQPMVGMSRMGGTNMAAFGAAPQGGIAGMNPGNIPMQRGAGAQSHPHQLRRKADQGMGMQNPGYPTQQKRRF

SEQ ID NO: 64506 - protein, 427 aa, Streptococcus pyogenes MGAS315
MTHSTKQEHSHSQSAVLGLQHVLSMYAGSILVPIMIAGALGYSARELTYLISTDIFMCGVATFLQLKLTKHTGVGLPVVLGCAFQSVAPLSIIGAQQGSSAMFGALIASGIYVILVAGIFSKIARFFPPIVTGSVITVIGLSLVGVAMGNMGDNVKEPTAQSMMLSLLTIVIILLVQKFTKGFVKSISILIGLVAGTLVSAMMGLVDTTPVVEASWIHVPTPFYFGMPTFEITSIVMMCIIATVSMVESTGVYLALSDLTNDQLDEKRLRNGYRSEGIAVFLGGLFNTFPYTGFSQNVGLVQISGIKTRRPIYYAAGILVVIGLLPKFGAMAQMIPSPVLGGAMLVLFGMVALQGMQMLNRVDFQKNEYNFIIAAVSISAGLGFNGTNLFTSLPETAQMFLTNGIVIATLTSVVLNLVLNGKDKQDE

SEQ ID NO: 64507 - protein, 247 aa, Arabidopsis thaliana
MLEAVDSSGVVNGGFPQIQSFYGDCSSEEELSVLPRHTKVVVTGNNRTKSVLVGLQGVVKKAVGLGGWHWLVLTNGIEVKLQRNALSVLEPPTGNEEDDDLDFENTQRNGSDMIVSFPASEDTLKPHKSKLRGQRSSRSSHKTMSRSLSSDSQSKSSGFTPPENMKVDLSKLEMPALLNYWRHFNLVDAIPNPSKEQLIDIVQRHFMSQQMDELQVIVGFVQAAKRMKKACKFQSKESRNTDLNCIS

SEQ ID NO: 64508 - protein, 131 aa, Flaveria palmeri
SNGGRVQCMKVWPPVGKKKYETLSYLPELTEAQLAKEVDYLHRNKWVPCLEFELEHGFVYRENASSPGYYDGRYWTMWKLPMFGCTDSAQVMKELQECKKEYPQAWIRIIGFDNVRQVQCVSFIASKPTGF

SEQ ID NO: 64509 - protein, 165 aa, Psilotum nudum
MFSMMNGLQHYGQQALRAARYIGQSFMVTLEHMNRLPITVQYPYEKIIPSERFRGRIHFEFDKCIACEVCVRVCPINLPVVDWELIKSMRKKQLKSYSIDFGVCIFCGNCVEYCPTNCLSMTEEYELATYDRHELNYDQIALSRLPFSIVQDSTIQAHSSLGYLS

SEQ ID NO: 64510 - protein, 467 aa, Streptomyces aureofaciens
MPTPEAGSASGREAVRFPVVDPATGETFDEAPDQQPGELDDVVARAQRAWHGWRADPAARTAALRGAADAVETAGDDLARLLTREQGKPLAESYAEIARTAARLRYFADLAPRTRRIDDGRPVHSEVRWRPLGPVAAIVPWNFPLQLAAAKFAPALAAGNTVVLKPSPFTPLATRMLGSVLATALPEDVLTVVTGREPLGARLASHPGIRHVTFTGSVPTGRAVAGAAAASLARVTLELGGNDAALLLDDVDVDRIADRLFWAAFRNCGQVCMAVKRVYVPARLHAEVVEALAQRAKTVAVGPGLDPGTRLGPVNNARQLARVEQVTEQALADGARAAWGGHRLDGPGYFFAPTILTDVLPGSPVVTEEQFGPVLPVLPYRSLDEAVDAANSTGFGLGGSVWGTDLDQAETVADRLECGTAWINHHAELSLAQPFAGVKDSGVGVAGGPWGLYGNLRPFVVHRPQEV

SEQ ID NO: 64511 - protein, 393 aa, Psilotum nudum
MAMLLKNKDQMIVSMGPHHPSMHGVLRLIVTLDGENVADCEPVLGYLHRGMEKIAENRTIIQYLPYVTRWDYLATMFTEAITVNAPEKLANIRIPKRASYIRVIMLELSRIASHLLWLGPFMADIGAQTPFFYILREREMIYDLFEAATGMRMMHNYFRIGGVAVDLPYGWIDKCLDFCDYFSPKISEYEKLIVHNPIFLERVKGVGFISREEAINWGLSGPMLRASGVQWDLRKVDHYECYDEVDWQIQWQKEGDSLARYLVRIGEMRESVKILQQALRIIPGGPYENLEARRLHQSQNLEWNDFDYQFMGKKSSPTFKLLKQEHYVRIEAPKGELGIFLIGNDSVFPWRWKIRPPGFINLQILPQLVRGMKLADIMPILGSIDIIMGEIDR

SEQ ID NO: 64512 - protein, 639 aa, Alkalilimnicola ehrlichei MLHE-1
MCGITGFWGGPAVDEGIAGRMAARIASRGPDDAGAWRDVKAGVALAHRRLSVIELSPAGHQPMRSPCGRYTLVYNGEIYNHLDLRVALETAGGAPDWRGYSDTETLLAALAHWGVPETLTRLNGMFAFALWDNREATLFLARDRMGEKPLYYGRNGGTFLFGSELKALTAYPGWQGQVDRDALALYLRYNHVPAPRSIYRGIGKLPPAHYVAVRDGGRNVGEPQCYWSLGEIAEQGVMQAGGSAHELADELDGLLRDAVGRRMAADVPLGSFLSGGFDSSMVAAQMQAQSERPVKTFSIGFHEAGYNEADHARAVATHLGTDHTELYITPEEAMAVIPELPAIFDEPFGDSSQIPTYLVSRMAREHVTVSLSGDGGDELFGGYNRHVVGPALWGRLARLPAPLRRGLGRAVGVAARIDRLPGAGRVPQLGEKLDKLASAMRASGGTAFYKDLLSHWKTPATVVRGASEPASLPDRIEAMPNLPGLRERMLYLDMMTYLPDDILTKVDRASMAVSLEARVPLLDHRLVAFAWRVPTDYKVRDGQGKWLFRRVLDRYVPRALMERPKMGFAVPIEHWLRGPLRDWAEVLLDERRLEREGFFHPAPIRRMWAEHLSGRRRHHAPLWNVLMFQAWSERQERIG

SEQ ID NO: 64513 - protein, 155 aa, Triticum aestivum
  misc_feature (31)..(31): Xaa can be any naturally occurring amino acid
  misc_feature (144)..(144): Xaa can be any naturally occurring amino acid
  misc_feature (147)..(147): Xaa can be any naturally occurring amino acid
MAAAHHRPLHALLGGGAVADLLLWRRRNASXAAAVAGATLVWFLFERAGYSLASVLSNALLLLVVILFFWAKSASLLNRPLPPLPNLEVSDGVVEKVVGRALVWINKVLAVAHDIAIKRDRTVFIQVIMALWVVSCIGMLFNFXTLXYIGVLLAL

SEQ ID NO: 64514 - protein, 127 aa, Betula pubescens
IRVDQYGNTVRTDEYGNPIRTDEYGNPIHHTAGTTAGYGAGGFDTTTPQGMRHDVTGTRGVSGKLHRSSEDDGHGGRRKKKGLAEKIKEKIPGVGNKDHRSNTSATTTQAYDEGELRQHEKKGVMEK

SEQ ID NO: 64515 - protein, 171 aa, Colwellia psychrerythraea 34H
MGVSGTGKSSLAKQISDEFSLVFIDADDFHSAEAKKHMAANKPLTDEMRSPWLSSITDHLVLLSQQGQSIALAYSGLKSVHRNLFRDLPFYCHFFYLIANKNVIANRISQRKNHFFSSDLLDSQFEAMEPPLLSELDVSTINIERPFVLVADEINKLTKQITRKKNNAKIC

SEQ ID NO: 64516 - protein, 164 aa, Magnetococcus sp. MC-1
MGNAMKQLMASLALRELWQGMAVTLRYMFRPNITIQYPEERTPYSPRFRGIHVLRRYEGGEERCVACKLCEAICPAQAIYIEIDTESRADKRLTKVYDIDLFKCIYCGLCEEACPVEAIVMGPYLDMAYEDRNARFYKKDQLLANGESWRAEIDARLNADAKYR

SEQ ID NO: 64517 - protein, 220 aa, Pseudomonas aeruginosa UCBPP-PA14
MRDIIDGFLRFQRDAYPARSQLFKSLATRQAPKALFIACSDSRVVPELLTQREPGELFVIRNAGNIVPGYGPQPGGVSASVEYAVAVLGVGDIVVCGHSDCGAMGAIASCACLDQLPAVAGWLHHAEAARAMNSAHEHASEAARLDALVRHNVIAQLANLRTHPCVARALEQGRLNLHGWVYDIESGRIDALDGASRRFVSLAEHPEVRAVGGDPGQAVA

SEQ ID NO: 64518 - protein, 397 aa, Magnetococcus sp. MC-1
MPATITDHKEFQNYAINFGPQHPAAHGVLRLLLELDGEVVERADPHVGLLHRGTEKLLEQKTYIQGTPYFDRLDYMSMMSEEHAWVIAVERLGQIEVPERAQYIRTIYAEITRFINHLLFFAAHGLDVGAMTMFLYCFREREELMDIYEAACGARMHANYFRPGGVARDLPDGLEQRIRDFCNHFPSKLDEYETLLTNNRIWKQRLVDIGKVSQEDAFSWGFTGPMLRGSGVAFDLRKAEPYDAYDRVEFDIPVGKNGDSYDRYLVRIEECREGVKIIQQCLDQMQPGPVRNDNFKISMPYRQDMQQDMESMIHHFKLCTEGFNLPAGEVYAAVETPKGELGVYLVSDGGNKPYRARIRAAGFNHLQAVKEMARGHMIADVTTIIGSIDIVFGEIDR

SEQ ID NO: 64519 - protein, 140 aa, Silicibacter sp. TM1040
MALERTFSIIKPDATRRNLTGAINAKFEEAGLRIVAQKRIHMTKAQAGKFYAVHAERPFYDELCEFMSSAPVVVQVLEGEGAIAKNREIMGATNPADAAPGTIRAEFAESVGENSVHGSDAPETAAEEIAYFFSGLELVG

SEQ ID NO: 64520 - protein, 168 aa, Bradyrhizobium japonicum USDA 110
MRAVMGININATARSLLLSEFVSAFFLAMRYFFQPKPTLNYPFEKGPISPRFRGEHALRRYPNGEERCIACKLCEAVCPAQAITIEAGPRRNDGTRRTVRYDIDMVKCIYCGLCQEACPVDAIVEGPNFEFATETREELFYDKAKLLANGDRWEREIAKAIELDAPYR

SEQ ID NO: 64521 - protein, 476 aa, Lactobacillus sakei subsp. sakei 23K
MAENEMKRELKTRHLSMIALGGSIGTGLFVTSGSAIAKAGPGGALLAYCGIGIMVFFLMTSLGEMATYLPVSGSFSTYATRFVDPALGFALGWNYWFNWAITLAVDVSTAALVMQFWLPDMPGWIFSLVALLLIFLINITSVKSFGETEYWFALIKVITVIIFLGVGVLTIFGIMGGHRTGLSNFTIKKAPFVGGLPMMLSVFVVAGFSFQGTELIGITAGESKTPEKSIPKAIKQVFWRILLFYILSIFVIACLIPYTSPSLLGASETNIAVSPFTLVFKRAGLASAASIMNAVILTSVLSAANSGMYASSRMLWSMAEDGYAAKIFAKTNKRGIPVMALIGTTIIGALTFMTSVFGTRIYLFLVAASGLTGFIAWLGIAISHYRFRRAFKVQGHQLSELKYHARWFPFGPIFAFLLCVIVIIGQDIQAFAHFDWTAIGISYMSIPLFIILYSYYKIRYKTKVIPLEKVDLSKHR

SEQ ID NO: 64522 - protein, 398 aa, Bradyrhizobium japonicum USDA 110
MNEQPENLRNFTINFGPQHPAAHGVLRLVLELDGEIVARVDPHIGLLHRGTEKLIEQKTYLQAIPYFDRLDYVAPMNQEHAFCLAAEKLLGIEVPRRGQLIRVLYCEIGRILSHLLNVTTQAMDVGALTPPLWGFEEREKLMVFYERASGSRMHAAFFRVGGVHQDLPQKLVDDIEAWCDPFLKVVDDLDRLLTANRIFKQRNVDIGVVPLKEAWEWGFSGVMVRGSGAAWDLRKSQPYECYAEMDFDIPIGKNGDCYDRYLIRMEEMRQSVRIMRQCIQKLNAPEGKGPVVVEDNKVAPPRRGEMKRSMEALIHHFKLYTEGVHVPAGEVYAAVEAPKGEFGVYLVADGTNKPYKCKIRAPGFAHLQAMDHICRGHLLADVSAILGSLDIVFGEVDR

SEQ ID NO: 64523 - protein, 490 aa, Schizosaccharomyces pombe
MSPKQEEYEVERIVDEKLGRNGAVKLYRIRWLNYSSRSDTWEPPENLSGCSAVLAEWKRRKRRLKGSNSDSDSPHHASNPHPNSRQKHQHQTSKSVPRSQRFSRELNVKKENKKVFSSQTTKRQSRKQSTALTTNDTSIILDDSLHTNSKKLGKTRNEVKEESQKRELVSNSIKEATSPKTSSILTKPRNPSKLDSYTHLSFYEKRELFRKKLREIEGPEVTLVNEVDDEPCPSLDFQFISQYRLTQGVIPPDPNFQSGCNCSSLGGCDLNNPSRCECLDDLDEPTHFAYDAQGRVRADTGAVIYECNSFCSCSMECPNRVVQRGRTLPLEIFKTKEKGWGVRSLRFAPAGTFITCYLGEVITSAEAAKRDKNYDDDGITYLFDLDMFDDASEYTVDAQNYGDVSRFFNHSCSPNIAIYSAVRNHGFRTIYDLAFFGIKDIQPLEELTFDYAGAKDFSPVQSQKSQQNRISKLRRQCKCGSANCRGWLFG

SEQ ID NO: 64524 - protein, 203 aa, Bradyrhizobium japonicum USDA 110
MDDGKLDALGQTIVSALPGAATGHSVAFNQLTVDVEAARIVEVVKYLRDDPNCRFVNFTDITAVDYPSREKRFDVVYHLMSPTLNTRIRLKAQADETTQVPSLIDVFPGADWFEREAYDLYGVFFVGHPDMRRILTDYGFEGHPLRKDFPTTGFVEVRYDDQEKRVVYEPVRLNQEFRKFDFLSPWEGADYPLPGDEKAGPKA

SEQ ID NO: 64525 - protein, 515 aa, Bacillus anthracis str. Sterne
MVVAYKHEPFTDFSVEANKLAFEEGLKKVESYLGQDYPLIIGGEKITTEDKIVSVNPANKEELVGRVSKASRELAEKAMQVADETFQTWRKSKPEMRADILFRAAAIVRRRKHEFSAILVKEAGKPWNEADADTAEAIDFMEYYGRQMLKLKDGIPVESRPIEYNRFFYIPLGVGVIISPWNFPFAIMAGMTTAALVSGNTVLLKPASTTPVVAAKFMEVLEEAGLPAGVVNFVPGNGSEVGDYLVDHPRTRFISFTGSRDVGIRIYERAAKVNPGQIWLKRVIAEMGGKDTIVVDKEADLELAAKSIVASAFGFSGQKCSACSRAVIHEDVYDHVLNRAVELTKELTVANPAVLGTNMGPVNDQAAFDKVMSYVAIGKEEGRILAGGEGDDSKGWFIQPTIVADVAEDARLMKEEIFGPVVAFCKAKDFDHALAIANNTEYGLTGAVISNNRDHIEKAREDFHVGNLYFNRGCTGAIVGYQPFGGFNMSGTDSKAGGPDYLALHMQAKTTSETL

SEQ ID NO: 64526 - protein, 101 aa, Phaseolus vulgaris
MASSMISSPAVTTVNRAGAGAGMVAPFTGLKSLGGFPSRKMNNDITSVANNGGRVQCIQVWPTVGKKKFETLSYLPPLTKQQLAKEVDYLLRKGWVPCLEF

SEQ ID NO: 64527 - protein, 95 aa, Triticum aestivum
  misc_feature (71)..(71): Xaa can be any naturally occurring amino acid
MTMTEDHTVGHTSSVRNASATREEMSQARLPIQYRDGCAGLLIPLNRCRFKEYYLPWKCENERHSYEKCQXYDEFLMRVAKMDELRAAKGGKRSN

SEQ ID NO: 64528 - protein, 456 aa, Salmonella enterica subsp. enterica serovar Paratyphi A str.
MDSQQHSEQLKRGLKNRHIQLIALGGAIGTGLFLGSASVIQSAGPGIILGYAIAGFIAFLIMRQLGEMVVEEPVAGSFSHFAYKYWGGFAGFASGWNYWVLYVLVAMAELTAVGKYIQFWYPEIPTWASAAAFFVIINAINLTNVKVFGEMEFWFAIIKVIAVIAMILFGAWLLFSDTAGPQATVRNLWEQGGFLPHGWTGLVMMMAIIMFSFGGLELVGITAAEADNPEQSIPKATNQVIYRILIFYIGSLAVLLSLLPWTRVTADTSPFVLIFHELGDTFVANALNIVVLTAALSVYNSCVYCNSRMLFGLAQQGNAPKALLNVDKRGVPVSSILVSAVVTALCVLLNYLAPESAFGLLMALVVSALVINWAMISLAHMMFRRAKQQQGVKTRFPALFYPFGNVLCLLFMAAVLIIMLMTPGMAISVWLIPVWLLILGVGYLCKEKTAKTVKAH

SEQ ID NO: 64529 - protein, 452 aa, Arabidopsis thaliana
VPLGMSSVSTASLNCLPDELLVHVLSSLETKQAASTSVLSKRWRTLFAVRRNLDFDDSIISHPEVGEQNMDDVQESFRDFVDKRLAFQGSVPINKFSLIYGDKHDDVRVDRWINTALEHGVSELHLCLTSVTRRLHRFPSNVFRSTTLVKLTLGTNLFIVYFPSDTCLPVLKILVLDSIWFDRIKFSNVLLAGCPALEDLTIDQKSFPGLPNVVSSKTVKSLSIVYKYSADFDWFRTVALDTPNLVTLLYSTYARHRYRHCNLESLVNATLDLHFLENCDEAFEPNVTDLMIAVRNVQMLHLTSSATEVISQCCKGGLPMFKNLLVLVFLGNTERVWKVFLPLLLEHSPNLTKLCLESLFLILQGLYHGTDEDEFDEIHIPRSNKVNMLRIIQCQGTENELKHISHFLLKMECLQLVQVNFSETIVDSKKVQLTEDLMKLPSASSRLTMQVI

SEQ ID NO: 64530 - protein, 265 aa, Oryza sativa
  misc_feature (155)..(155): Xaa can be any naturally occurring amino acid
  misc_feature (168)..(168): Xaa can be any naturally occurring amino acid
MASPAESPGGGGTARPSRYESQKRRDWQTFGQYLRNHRPPLELSRCSGAHVLEFLRYLDQFGKTKVHAHGCPFFGHPSPPAPCPCPLRQAWGSLDALVGRLRAAFEEHGGRPESNPFGARAVRLYLRDIRDTQSKARGIAYEKKRRKRAAASHTXAEAAAAAAGGTGXAPPAAAAAAAALPDMETTTTTTTVPHFLFPAHFLHGHYFLAPAGEQPGGGDVAASTGGAAGAPSGGGGEDLVLAMAAAAAAAEAHAAGCMMPLSVFN

SEQ ID NO: 64531 - protein, 396 aa, Arabidopsis thaliana
MADLIPFYLNIVAFLCTVGAIALAIFHIYRHLLNYTEPTYQRYIVRIIFMVPVTWVIYNFLSLCLAWVGGPGSVVLSLSGRSLKPSWSLMTCCFPPLTLDGRFIRRCKQGCLQFVILKPILVAVTLVLYAKGKYKDGNFNPDQAYLYLTIIYTISYTVALYALVLFYMACRDLLQPFNPVPKFVIIKSVVFLTYWQGVLVFLAAKSGFIKSAEAAAHFQNFIICVEMLIAAACHFYAFPYKEYAGANVGGSGSFSGSLSHAVKLNDFYHDTVHQFAPTYHDYVLYNHQDGGDEGTKKYRSRTFVPTGQEMDAMRKNKPVYANKIDGVSVSSSLSSEASSPKSSSVTSDPARSDAVKSSLLVDASDSLETMYDMSLIDIDLSSFPSNVPSASESGPR

SEQ ID NO: 64532 - protein, 521 aa, Candidatus Pelagibacter ubique HTCC1002
MSLSNNLSKILIIDFGSQFTQLIARRVRELGVFSEIVSHKKIKIAQITKDNIAGIILSGGPLNVYENDKFKFDKKILKLGIPILGICFGHQILSKLLGGKVKKSKHREFGLATINKVSNSTLTKNFFNKNNRSDVWMSHADQVSKMPKNFKIIASTKNSKLTIIENIKENFYGVQFHPEVTHTNKGKILLRNFVFLICKIKKNWSSKDQKLKLINEIKEQVGDNKVICGLSGGVDSSVVAQLLSKAIGKNLTCIFVNNGLLRKNEEIQVVNTFKKKLKINLIYVNAEKEFIRKLTNVSDPEKKRKIIGNLFIKIFERYANRIKNVKFLAQGTLYPDLIESKSVTGSQTSKIKSHHNVGGLPKRMKLKLVEPLKFLFKDEVRKLGLELNLSNDIISRHPFPGPGLAIRMPGIITNEKIKILKEADFYFIKALREHGLYDKIWQAYAALLPVKTVGVMGDNRTYEHICLLRAITSEDGMTADFFDFPKGFMQSISNQIINNIRGINRVVYDVTSKPPSTIELE

SEQ ID NO: 64533 - protein, 887 aa, Salmonella enterica subsp. enterica serovar Paratyphi A str.
MSERFQNDVDPIETRDWLQAIESVIREEGVERAQYLIDQLLSEVRKGGVKVAAGAGASNYINTIAVEDEPEYPGNLELERRIRSAIRWNAIMTVLRASKKDLELGGHMASFQSSATIYDVCFNHFFRARNEQDGGDLVYFQGHISPGIYARAFLEGRLTQEQMDNFRQEVHGNGLSSYPHPKLMPEFWQFPTVSMGLGPIGAIYQAKFLKYLEHRGLKDTSKQTVYAFLGDGEMDEPESKGAITIATREKLDNLVFVINCNLQRLDGPVTGNGKIVNELEGIFAGAGWNVIKVMWGGRWDELLRKDTSGKLIQLMNETVDGDYQTFKSKDGAYVREHFFGKYPETAALVADWTDEQIWALNRGGHDPKKVYAALKKAQETKGKATVILAHTIKGYGMGDTAEGKNIAHQVKKMNMDGVRYVRDRFNVPVADADLEKLPYITFPEGSEEHKYLHERRQALHGYLPSRQPNFTEKLELPQLSDFGALLEEQSKEISTTIAFVRALNVMLKNKSIKDRLVPIIADEARTFGMEGLFRQIGIYSPNGQQYTPQDREQVAYYKEDEKGQILQEGINELGAGASWLAAATSYSTNDLPMIPFYIYYSMFGFQRIGDLCWQAGDQQARGFLIGGTSGRTTLNGEGLQHEDGHSHIQSLTIPNCISYDPAYAYEVAVIMHDGLERMYGEKQENVYYYITTLNENYHMPAMPAGAEEGIRKGIYKLETLEGSKGKVQLLGSGSILRHVREAAQILAKDYGVGSDVYSVTSFTELARDGQDCERWNMLHPLETPRVPYIAQVMNDAPAVASTDYMKLFAEQVRTYVPADDYRVLGTDGFGRSDSRENLRHHFEVDASYVVVAALGELAKRGEIDKKVVADAITKFNIDADKVNPRLA

SEQ ID NO: 64534 - protein, 389 aa, Arabidopsis thaliana
DFSVSFHQDFCFSSYSSVLSCGEDYCSRIFCSCYGSPHHHDHTSTAVMPFMRAIFVTIMPVRAPILPQWLCLSDNIGTLIDDFAADHKLFEPALLIRIRKEKRWADTWFGVETRASISVTTNADFEVERTIHAIFLRSISSIFSLSIETETWFDQNVVLSGNRHMISLTKLNAKKGGFLVNNEVKIVVEVDVLQVIGKLDVSEGSQEVTQPLKRIRLNDDGVSVKQSIDVNGFQVLPSQVESVKRIFERHPNMALEFRAKNQHVRTSCMNVLLSLIDTLCQSLQDISIDDLGQAEKALRYLKDSDFKVDWLERKLEEVKEKKMEEQIGKSRMQELEEELKIFKQKCSDIEAQLEKEKQKCSDIEALLEKEKAKSLAAARAPPLTLDDVV

SEQ ID NO: 64535 - protein, 328 aa, Pisum sativum
MSTSSINGFSLSSLSPAKTSTKRTTLRPFVSASLNTSSSSSSSTFPSLIQDKPVFASSSPIITPVLREEMGKGYDEAIEELQKLLREKTELKATAAEKVEQITAQLGTTSSSDGIPKSEASERIKTGFLHFKKEKYDKNPALYGELAKGQSPPFMVFACSDSRVCPSHVLDFQPGEAFVVRNVANLVPPYDQAKYAGTGAAIEYAVLHLKVSNIVVIGHSACGGIKGLLSFPFDGTYSTDFIEEWVKIGLPAKAKVKAQHGDAPFAELCTHCEKEAVNASLGNLLTYPFVREGLVNKTLALKGGYYDFVKGSFELWGLEFGLSSTFSV

SEQ ID NO: 64536 - protein, 469 aa, Bartonella henselae str. Houston-1
MTTASDILKQIADNDIRFVDLRFTDPRGKLHHITIDIAEISEDTFNDGVMFDGSSISGWKTIHESDMVLMPDPETAHIDPFFAQSTLVIFCDVLDPVSGEFYRRDPRSIAKRAEVYMKSLGIGDTINVGPEAEFFIFDDVRYKVAPYNTGFKLDSSELPSNDDTEYETGNLGHRPRMKGGYLPVPPIDPCQDMRSEMLTVLKDMGIRVEKHHHEVAAGQHELGIRFDTLVREADKMQIFKYVVHQIANSYGKTATFMPKPVFGDNGSGMHVHMSIWKDGKPIFAGNEYAGLSETCLFFIGGIIKHAKAINAFTNPSTNSYKRLVPGYEAPVLLAYSVRNRSASCRIPMTPSPNSKRVEVRFPDPTANPYLAFAALLMAGLDGIKNKIHPGHAMDKDLYDLPLKELKDIPTVSGSLREALEALDKDRSFLKAGDVFDDDQINSFIQVKMQEVLRYETTPHPIEFDMYYSV

SEQ ID NO: 64537 - protein, 474 aa, Salmonella enterica subsp. enterica serovar Paratyphi A str.
MSTEIKTQVVVLGAGPAGYSAAFRCADLGLETVIVERYNSLGGVCLNVGCIPSKALLHVAKVIEEAKALAEHGIVFGEPKTDIDKIRTWKEKVITQLTGGLAGMAKGRKVKVVNGLGKFTGANTLEVEGENGKTVINFDNAIIAAGSRPIQLPFIPHEDPRVWDSTDALELKEVPKRMLVMGGGIIGLEMGTVYHALGSEIDVVEMFDQVIPAADKDIVKVFTKRISKKFNLMLETKVTAVEAKEDGIYVSMEGKKAPAEAQRYDAVLVAIGRVPNGKNLDAGKAGVEVDDRGFIRVDKQLRTNVPHIFAIGDIVGQPMLAHKGVHEGHVAAEVIAGKKHYFDPKVIPSIAYTEPEVAWVGLTEKEAKEKGISYETATFPWAASGRAIASDCADGMTKLIFDKESHRVIGGAIVGTNGGELLGEIGLAIEMGCDTEDIALTIHAHPTLHESVGLAAEVFEGSITDLPNPKAKKK

SEQ ID NO: 64538 - protein, 319 aa, Spinacia oleracea
MSTINGCLTSISPSRTQLKNTSTLRPTFIANSRVNPSSSVPPSLIRNQPVFAAPAPIITPTLKEDMAYEEAIAALKKLLSEKGELENEAASKVAQITSELADGGTPSASYPVQRIKEGFIKFKKEKYEKNPALYGELSKGQAPKFMVFACSDSRVCPSHVLDFQPGEAFMVRNIANMVPVFDKDKYAGVGAAIEYAVLHLKVENIVVIGHSACGGIKGLMSFPDAGPTTTDFIEDWVKICLPAKHKVLAEHGNATFAEQCTHCEKEAVNVSLGNLLTYPFVRDGLVKKTLALQGGYYDFVNGSFELWGLEYGLSPSQSV

SEQ ID NO: 64539 - protein, 355 aa, Arabidopsis thaliana
  misc_feature (96)..(96): Xaa can be any naturally occurring amino acid
MDEWPEPIVRVQSLAESNLSSLPDRYIKPASLRPTTTEDAPTATNIPIIDLEGLFSEEGLSDDVIMARISEACRGWGFFQVVNHGVKPELMDAARXNWREFFHMPVNAKETYSNSPRTYEGYGSRLGVEKGASLDWSDYYFLHLLPHHLKDFNKWPSFPPTIREVIDEYGEELVKLSGRIMRVLSTNLGLKEDKFQEAFGGENIGACLRVNYYPKCPRPVLALGLSPHSDPGGMTILLPDDQVFGLQVRKDDTWITVKPHPHAFIVNIGDQIQILSNSTYKSVEHRVIVNSDKERVSLAFFYNPKSDIPIQPLQELVSTHNPPLYPPMTFDQYRLFIRTQGPQGKSHVESHISPR

SEQ ID NO: 64540 - protein, 321 aa, Nicotiana tabacum
MSTASINSCLTISPAQASLKKPTRPVAFARLSNSSSSTSVPSLIRNEPVFAAPTPIINPILREEMAKESYEQAIAALEKLLSEKGELGPIAAARVDQITAELQSSDGSKPFDPVEHMKAGFIHFKTEKYEKNPALYGELSKGQSPKFMVFACSDSRVCPSHVLNFQPGEAFVVRNIANMVPAYDKTRYSGVGAAIEYAVLHLKVENIVVIGHSACGGIKGLMSLPADGSESTAFIEDWVKIGLPAKAKVQGEHVDKCFADQCTACEKEAVNVSLGNLLTYPFVREGLVKKTLALKGGHYDFVNGGFELWGLEFGLSPSLSV

SEQ ID NO: 64541 - protein, 371 aa, Bradyrhizobium japonicum USDA 110
MNAGRNEPWRSTSAWHAMEKVMTIADAHDQDPQETREWLDALSAVRGHRGNERAEFVVNAMLDAARHSGLQIEQSLTTPYCNTIQPDQQPALPGDRAIEHKLRSIIRWNALAIILRANKESSELGGHIASFQSAATLYDIGFGHFWHAPTDAHGGDLIFVQGHCSPGIYARAFLEGRLSEEQLLSFRQETSGKGLSSYPHPWLMPDFWQFPTVSMGLGPLMAIYQARFLKYLENRKLAETSNRKVWAFMGDGETDEPESLGAISLAGRENLDNLIFVINCNLQRLDGPVRGNGKIVQELESVFRGAGWNVIKVLWAPGGTACWKRTRAGGCSGSWKNASTANTRTSKARAAPTFANTSSASTRKRSNSYLI

SEQ ID NO: 64542 - protein, 545 aa, Bradyrhizobium japonicum USDA 110
MSDDEIWQLARGGHDPEKVFAAYTAAVNHKGQPTVILPKTVKGYGMGESGEGQMIAHQAKKMTQDALRGFRDRFQVPVADADLAKVPFLRLPEDSPEMKYFRAQREKLGGYLPQRRRKSASLQIPPLSTFQRLLENTGDREISTTMAFVQLLGTLVRDKVIGKHIVPIVPDESRTFGMEGMFRQLGIYSSVGQLYRPQDADQLMYYREDKSGQVFQEGINEGGAMSSWIVAATSYSTNNVPMIPFYIYYSMFGLQRVGDLAWLAGDMRARGFLLGGTAGRTTLNGEGLQHEDGHSHVLAATIPNCISYDPTFAYEVVTIVREGMRRMYEAQEDVYYYLTLMNENYPHPALADAGEGAEEGILKGLYLLKNGGETAKKGLRVQLVGSGTILREVIAAAHLLKADFGVAADVWSATSFNELRRDGMAAERWNLLHPTEPRRESWVESQLKGHPGPVVASTDYMRNYPDQIREYVQAAGHRYVVLGTDGFGRSDYRVKLRKFFEVDRHYVAVAALKALADEGAIKPAVVAEAIAKYQIDAGRAAPWTV

SEQ ID NO: 64543 - protein, 1397 aa, Schizosaccharomyces pombe
MFNDQSKTTSSVKGICATTDNNHGNLKKTNSTPFRKNYLLNGRTKLKLENFAYNASTEISSPKISEKKHSSLPIKRKNTFNESSTSFSPFTKAHKEITDDLKPDKSFTRKSDLNSQDMPVCFQETSKDLCRSSSTQHLLDHQTTDSTIIDMKPVSTNSKSDVFTLYTDETVLLRRCASDNKPLINNNLSSSNVSENQSRSFGSYDEVKNQGNNLHKVPSLVSIIRNARSSEQSRIAANSSCLLKGSDTEIDEDDFALEAEDLAALDSLERQYSQLPNSTVTASAKDIEKTAKVNHVGGDLQSYCSATKASDATINEEPVNLALDKACNSLPDINSDFIDDWDDSCDGCTPGELCEFSSEYTVLEVHEDFIFHEGNHFRQLKLILEANDILHQLFLRGDWTETSIFVGDSIRVEATFDKDNTAIVDNDKGLIIIHPKILMSATAVASSFPCLRKAVISDRVGIYGPPTKAMVTGNILHDFFQHALYRGIDALENVDINLETSIKTYISDIYFADLSLDEIREELDARLPLLKSIVERYLISKKNDNNNESIHISRLLDIEESIWSPRFGLKGNIDATVEVVLTEKPESSSTLTLPLELKTGRYVDNISHFAQSLLYTLLISDRYGINTNQALLCYLENSTIKNLVASNSQLRGLIMTRNSLAQHNFRRSLPEMISNRKICDHCSLVSECLFFQKMSDKGVANSNGLTESWNEWMREVKDEDLEFYKKWEKLLNQEERLLLLKRGDVLTFDTEELEAYGKTLYPLYITKEDIVCLEIDDRVFHYKFAFLNDNGYPRNFLHSGFSVGERVFISDEHGHWSLAKGHIVHIQDSCIEVRTRHRLHIPWLKMPNFDFKKNQVFFGNYEDSKLSFIGSNHTRYRIDKDEFSSGIASIRGTLMSSVLPDAPLIIRDMIIRLKPPKFCNSALIDPEFLKCLNEDQITALKKCHAAEHYSLILGMPGTGKTTTISSLIRSLLAKKKKILLTSFTHLAVDNILIKLKGCDSTIVRLGSPHKIHPLVKEFCLTEGTTFDDLASLKHFYEDPQIVACSSLGVYHSIFNKRKFDYCIIDEASQIPLPICLGPLQLAEKFVLVGDHYQLPPLVKNSRTSKDGLSLSLFKLLSEKHPEAVTTLRLQYRMNEDINSLSSELIYGGNLVCGSKTISQKKLILPKAHLSDGLPDSSSSLHWVNKLINPSHSVIFFNTDDILGVESKTNNILENHTEAFLIEQAVSSFLERGVKQSSIGIISIYKSQVELLSKNLKSFTEIEINTVDRYQGRDKDIILISFVRSNSKNLVGELLRDWHRLNVALSRAKVKCIMFGSLSTLSSSNIVSHLLKLLEKNKWIFTLNENDIATKFDENSSPIKDCSQVATTNNAKVIIRKNQRFFNSDNLCEKAILPQLEF

SEQ ID NO: 64544 - protein, 581 aa, Bradyrhizobium japonicum USDA 110
MAQQIEVKVPDIGDFKDVAVIEVMVKPGETVAVDTSLIMVESDKASMEIPSSHAGIVKEVKVRVGDKVSEGSIILVLETAGAAAAPPPAPASKPAATSSAAAPVPASHSGKADIECEMLVLGAGPGGYSAAFRAADLGMKTVLVERYDTLGGVCLNVGCIPSKALLHTASVVDEVKHLPDHGISFGAPQIDLDKLRGFKDGVIKKLTGGLAGMAKARKVEVVTGVGAFLDPHHLEVVTAGGKKTIKFAKAIIAAGSQAVKLPFLPEDPRIVDSTGALLLKSIPKRMLVIGGGIIGLEMATVYSALGARIDVVEMLDGLMQGADRDLVKVWEKMNAKRFDKAMLKTKTVGAKATEAGIEVSFEGEQAPSGSQVYDLVLVAVGRSPNGKKIGAEKAGVAVTDRGFIDVDKQMRTNVAHIFAIGDIVGQPMLAHKAVHEGHVAAEVAHGEKSYFDARQIPSVAYTDPEVAWAGKTEDECKAEGIKFGKSVFPWAASGRAIANGRDEGFTKLLFDTATHRVIGGGIVGTHAGDLISEVCLAIEMGCEPADIGKTIHPHPTLGESIGMAAEVFEGHCTDLPPQKKK

SEQ ID NO: 64545 - protein, 193 aa, Oryza sativa (indica cultivar-group)
MGSGSFLKLLANNFDVLAGPLVSLAYPLYASVRAIETKSPVDDQQWLTYWVLYSFITLFELTFAPVIEWLPFWSYAKLFFNCWLVLPCFHGAAYVYDHFVRPMFVNRQIVNVWYVPRKENLSKPDDVLSAAERYIEQNGPEAFEKLISKSTRPSTSKRSTKRSILEEVESEHMARAERESWGENPFYDKNYRC

SEQ ID NO: 64546 - protein, 120 aa, Haloarcula marismortui ATCC 43049
MTDVDLAFDEQEYIPAVAQDADSGDVLMLAYVTEEALRKTRETGEAHYYSRSRDELWHKGGTSGHTQAVKEVRVDCDGDALLYIVDQTGGACHTGYESCFHRTVDGETVGEQVFDPDDVY

SEQ ID NO: 64547 - protein, 440 aa, Bradyrhizobium japonicum USDA 110
MSEAQAGKPRVVIVGGGAGGLELATRLGDKYGRKGRLDVTLIERNRTHVWKPKLHEIAAGSMDIAAHEVDYLAQSYWHGFRYRIGEMIGIDRERRQVLVAPYLDAEGREVTPKRSFDYDVLVIAVGSQNNDFGTPGVAEHAIKLESQADAKRFHERMVNACIRAHAQSSPLGEHQLKVAIIGAGATGVELAAELHRTTREVVAHGLDQVDPQKDIRITLIEAADRVLPALPERVSKETEKLLVRLGVNVLVGAKVSVVGSDHVSLTDGRTIPAELIVWAAGVKAPDSLKEIAGLETNRINQLVVRPTLQATRDDNIFAIGDCSACSWGDRGNVPPRAQAAHQQASHLYSQIPRHLRGEALKDYRYRDFGSLVSLGEFSTVGSMMGALVGGSLVFEGLFARMMYLSLYKMHEHALHGSVKVALDTLARLITRRTEPHVKLH

SEQ ID NO: 64548 - protein, 359 aa, Pasteurella multocida subsp. multocida str. Pm70
MQTFNIAVLSGDGIGPEIIAEAIKVLDVVQQKYAFKLNYRTFDVGGIAIDNHGTPLPEATLKGCEESDAILFGSVGGPKWEHLPPAQQPERGALLPLRKHFALFCNLRPATLYKGLEKFCPLRADISAKGFDMVTVRELTGGIYFGQPKGREGEGANEKAFDTEVYHRYEIERIARVAFETAMKRSKHVTSVDKANVLISSVLWREVVCDVAKDYPEVTLDHIYIDNATMQLIKQPEFFDVLLCSNIFGDIISDECAMITGSMGMLPSASLNEKGFGLYEPAGGSAPDIAGKGIANPIAQILSAAMMLRHSFNLNDAATAIENAVKNVLAEGHRTADLADESQPLSTKQMGDLIAQAVE

SEQ ID NO: 64549 - protein, 326 aa, Oryza sativa (japonica cultivar-group)
MSDTSKGIPQEQLPSQELHPPPMPVINLGHLSLDDPTVRSRVVNDIAKACRDLGYFQVISHGISQSVMDGAIEAASEFFKLPNEIKKEYASDDIRQPVRYDTSSKDGISMSRAFLKHYAHPLCDWLQYWPQQPPIYREYMAKYAVEVRVVALKLMEAILEGLGIGKEYMQEKFEEGLQLLSVNCYPKVSQSDTSIGLAAHSDYGLLTILLTSCQGLEVVDRSSNSWKVVQQLPHALHVHVGDHMEVLSNGRIKTVVHRAVLNPQEARISLASIHGFALHEKVSSAKELVDEENPQKYKENSFNDFLEHLTANMDNRQRNFLESLRM

SEQ ID NO: 64550 - protein, 392 aa, Glycine max
MALSSPHIQRFLLCKLHSRSTAKNRHRNSFTATTTTRSSCCSAIAIDAPSSLTEVPGIRWGSIALQGLREEMEDDIIVRPEGLQGFTFAAVFDGHGGFSSVEFLSANYRDELYKECVEALQGGLLLVEKDFKAIKRALQEAFLKADARLLKRLEMNGEEDESGATSTAVFIGDDELLISHIGDSTVVLCRSGKAEVLTSPHRPIGSSKTSLHEIRRVREAGGWINNGRICGDIAVSRAFGDVRFKTKKNEMLQKGVQEGRWSAKFISRVQLNNDLVVAYPDIYQVTLGSDAEFVVLASDGLWDYMSSSEAVSLVRDQLRKHGNIQQACEALAEAALDRRTQDNVSIIIADLGRTDWKNAPLERQNTILELVQALATIGIVSIGIWFSSQLSL

SEQ ID NO: 64551 - protein, 151 aa, Arabidopsis thaliana
MSQSRAVQRSSSPNEDRGENQLVVYDLKGNDDTEEEVLPVQSQPLSSRTQCPSIGAFTVQCASCFKWRLMPSMQKYEEIREQLLENPFFCDTAREWKPDISCDVPADIYQDGTRLWAIDKPNISRPPAGWQRLLRIRGEGGTRFADVYVVR

SEQ ID NO: 64552 - protein, 83 aa, Glycine max
  misc_feature (53)..(53): Xaa can be any naturally occurring amino acid
  misc_feature (66)..(66): Xaa can be any naturally occurring amino acid
MTAVVLHIFHATNTVSEKTNNTIVQIIKILMDGIVLGGLFHSAVHVFADDEWXHLLFCEQGTAVFXCPCPWNPLFTYMESIVL

SEQ ID NO: 64553 - protein, 677 aa, Oryza sativa
MATAGPARRSRRRCRRRPAPDPEWSRGRRSAAEQERLTAGMQPRVCRLWEEGSVGAGRSRRVAVEVIGAGQEAVDLTVNPFLSLMFSLPALLIGACAFAAAAVAASGDGCRAGCSLAIAAYYFSEGSNLTFIATIFAIGGGGYQALLPYNPAITNPDYVVTGDRVLVPFPCSCLGLPAAPASTFLAGAIPYPLPLPRGGGDTYDAVAANYADLTTAAWLEATNAYPPGRIPGGDGRVNVTINCSCGDERVSPRYGLFLTYPLWDGETLESVAAQYGFSSPAEMELIRRYNPGMGGVSGKGIVFIPVKDPNGSYHPLKSGVGIVLLFCELLCIYAKVAKVQEGHIASISRRNQPPCCYYLCDDASQAEGIKVERSIEFSYEEIFNATQGFSMEHKIGQGGFGSVYYAELRGEKTAIKKMGMQATQEFLAELKVLTHVHHLNLVRLIGYCVENCLFLVYEFIDNGNLSQHLQRTGYAPLSWATRVQIALDSARGLEYLHEHVVPVYVHRDIKSANILLDKDFRAKIADFGLAKLTEVGSMSQSLSTRVAGTFGYMPPEARYGEVSPKVDVYAFGVVLYELLSAKQAIVRSSESVSESKGLVFLFEEALSAPNPTEALDELIDPSLQGDYPVDSALKIASLAKSCTHEEPGMRPTMRSVVVALMALTANTDLRDMDYHPF

SEQ ID NO: 64554 - protein, 308 aa, Candidatus Pelagibacter ubique HTCC1002
MQAVNDCFKKVKKDCFKFISSQETKKDKFKNKDKMIKSFLIPVSFWIAKKVNKKKPLMIGLAGGQGSGKTTISSILTLILKKYFKLNVFKVSIDDFYKTRKDRILLSKNKHPLLMTRGVPGTHDVDLMLNFFKQIKDKNFKSLQIPTFNKAIDDRCQKSLWYKIKTKPDVVIFEGWCVGARAQSSSQLKKPINSLEKVYDQGTKWRTHVNNQLKTKYKTLFKQLDGLLYLKAKNFNLLREWRLKQERKLWVQTKNKKNLKIMSSGDVINFMQTYQRITQQMFKDAIKSSSVIMNLNSNHQIEKIKFKK

SEQ ID NO: 64555 - protein, 219 aa, Zea mays
MAGPGDKVDYVFKVVLIGDSAVGKSQILARFARNEFSLDSKATIGVEFQTRTLVIDHRSVKAQIWDTAGQERYRAVTSAYYRGALGALLVYDITRRQSFDHIPRWLDELRAHADKNIVIMLVGNKSDLEEQRAVSTEDAKEFAEKENLFFLETSALQATNVESAFQTVLTEIFKIHSKKNMVSEPKSGRNGAAQAMPGTKVLVPGPAQEIPKSKCCSSM

SEQ ID NO: 64556 - protein, 444 aa, Candida albicans SC5314
MVKKVLLLGSGFVAKPTVDILSEQPDIEVTVACRTLSKAKELAGDKAQAISLDVTDAAQLDEQVAKHDLVISLIPYTFHVNVVKSAIKNKKNVVTTSYINPQLKALEKEIEEAGITVMNEIGLDPGIDHLYAVKTIEEVHKAGGKIVSFLSYCGGLPAPENSDNPLGYKFSWSSRGVLLALRNQAKYWLDGKVIDISSEDLMASAKPYFIYPGYALVCYPNRDSTTYKELYNIPEAQTVIRGTLRFQGFPEFIKVFVDLGFLKDEPMEIFSKPGPWNKALAELVGAKSSSEQDIIDKINQLTKFKSPEDQERILAGFRWLGLFSENQITPRGNPLDTLCATLEELMQYEKGERDLVILQHKFGIEWANGTKETRTSTLVDYGDPNGYSSMAKLVGVPCAVATKQILSGELSKKGLLAPMSSDINDSIMKELKDKYDIYLVEKTI

SEQ ID NO: 64557 - protein, 286 aa, Salmonella enterica subsp. enterica serovar Paratyphi A str.
MAENTMWHETLHDQFGQYFAVDNVLYHEKTDHQDLIIFENAAFGRVMALDGVVQTTERDEFIYHEMMTHVPLLAHGHAKHVLIIGGGDGAMLREVTRHKNVETITMVEIDAGVVSFCRQYLPNHNAGSYDDPRFTLVIDDGVNFVNQTHQTFDVIISDCTDPIGPGESLFTSAFYEGCKRCLNPGGIFVAQNGVCFLQQDEAIDSHRKLSHYFSDVGFYQAAIPTYYGGIMTFAWATDNDALRHLSSEIIQARFHAAGLKCRYYNPAIHAAAFALPQYLHDALSAQ

SEQ ID NO: 64558 - protein, 1498 aa, Aspergillus oryzae
MSFLGTVNPNIPQQQSVVSHNNALRSHGDTDDDTPVYETPSTAATQYGDREKSEEALTLQEDNEEKMEARVGDLARRLTRQSTRVSAKGALENPFFVEDPESTLNPDSPNFKPRDWLKMLLAIRSRDPEQYPDRTAGVAFKNLNVHGFGSPTDYQKDVLNSILEIGTIVRKLMGIKMQKIQILREFDGLVKSGEMLVVLGRPGSGCSTFLKTISGEMNGIQMSDDSTLNYQGIPAKLMHHAFKGEAIYSAETDVHFPQLSVGDTLKFAALARAPRNRLEGVSRQQYAEHMRDVVMTMLGLSHTINTRVGNDYVRGVSGGERKRVSIAEATLSQAPLQCWDNSTRGLDSANALEFCKNLALMSKYAGTAACVAIYQASQNAYDVFDKVTVLYEGRQIYFGRTTEAKQFFVDMGFECPDRQTTADFLTSLTSPSERKVRPGFENRVPRTPDEFAAAWKRSDARAKLIIEIEEFEKQYPIGGASYQSFIDARKAMQAKHQRVKSPYTISIWEQISLCVVRGFQRLKGDSSLTVTALVGNFIIALIVASVFFNLQDNTASFYSRGALLFYAVLLNAFSSALEILTLYAQRPIVEKQARYAFYHPFAEAVASMLCDTPYKLVNSITFNLPLYFMTNLRRDAGAWWTFWLFSVVTTYTMSMIFRTIAATSRSLSQALVPAAILILGMVIYTGFVIPTRNMLGWSRWMNYINPISYAFESFMVNEFHDRHFECSQIVPSGGIYESMPMQNRICSTVGADTGSTIVQGSVYLEQSFQYVKGHLWRNLGIMIGFLVFFAFTYLASTEYISEQKSKGEVLLFRRGHQPKVALDKTDSESPEPGGAPKTDESAPQASAGIQRQTAIFQWKDVCYDIKIKGQPRRILDHVDGWVKPGTCTALMGVSGAGKTTLLDVLATRVTMGVITGEMLVDGRPRDQSFQRKTGYVQQQDLHLATSTVREALRFSAILRQPAHVSHQEKLDYVEEVIRLLGMEAYADAVVGVPGEGLNVEQRKRLTIGVELAAKPQLLLFLDEPTSGLDSQTSWSILDLIDTLTQHGQAILCTIHQPSAMLFQRFDRLLFLAKGGRTIYFGEIGQNSSTLSSYFERNGAQPLSPGENPAEWMLDVIGAAPGSHSDIDWPKVWRESPEHAKVKEHLDELKSTLSVKPAENSDSEAFKEYAAPFYIQLWECLIRVFAQYYRTPSYIWSKTALSILTSIYIGFSFFHAKNSIQGMQNQMFSVFMLMTIFGNLVQQIMPHFVTQRSLYEVRERPSKTYSWQAFMTANILVELPWNTLMAALMFFCWYYPIGLYNNAKPTDAVTERGGLMFLLIWVFLLFTSTFAHMVIAGIELAETGGNIATLLFSLCLIFCGVLATPENMPGFWIFMYRVSPFTYLISAMLSTGLSGTDVQCEAVELLHFNPPANQSCQQYMAAYIQGAQGYLQNPEATTGCAFCTISKTDTYLAAISSNFDDAWRNFGLMWVYIAFNIGAAVFIYWLARVPKGKRASGAT

SEQ ID NO: 64559 - protein, 363 aa, Pisum sativum
CINSGINKVYILTQFNSASLNRHIARAYNSGTGVTFGDGYVEVLAATQTPGEQGKKWFQGSADAVRQFHWLFEDARSKDIEDVLILSGDHLYRMDYMDFVKDHRESGADITLSCLPMDDSRASDFGLMKIDNKGRILSFSEKPKGADPKAMQVDTTVLGLSKDEALEKPYIASMGVYVFKKEILLNLLRWRFPTANDFGSEVIPASAKEFYMKAYLFNDYWEDIGTIRSFFEANLALTEHPSKFSFYDAAKPMYTSRRNLPPSTIDNSKVVDSIISHGSFVNNAFIEHSVVGIRSRINSNVHLKDTVMLGADLYETEEEVAALLAEGRVPVGIGENTKIKDCIIDKNARIGKNVTIANSEGVP

SEQ ID NO: 64560 - protein, 208 aa, Brassica napus
MSADDSSNATDIDGKLGSDSNLNSDGDDAADNDSSKTLTIPAPAVCLVRFAGDAAGGAVMGSIFGYGSGLFKKKGFKGSFADAGQSAKTFAVLSGVHSLVVCLLKQLRGKDDAINVGVAGCCTGLALSFPGAPQALLQSCLTFGAFSFILEGLNKRQTALAHSVSLRHQTGNFGDHQRPLQLSLALPIHEEIKGFSSFCKSLTKPKKI

SEQ ID NO: 64561 - protein, 470 aa, Oryza sativa (japonica cultivar-group)
MEFTEAYKQTGPCCFSPDGRYLAVAVDYRLVVRDVVSLKVVQLFSCVDKISFLDWAPDSEYILCGLYKRPMVQAWSLSQPDWTCKIDEGPAGIAYARWSPDSRHILTTSEFQLRLTVWSLVNTACIHVQWPKHASRGVSFTKDGKFAAICTRRDCKDYVNLLSCHSWEIMSVFAVDTVDLAGVEWSPDDSAIVVWDSLLEYKVLIYSPDGRCLFKYLAYESGLGVKTVAWSPCGQFLAVGSYDQAVRTLNHLTWKTFAEFSHAASIRNPTNAAIFKEVDDPWQLDMSELCLSEGFSRNMQGNGAENGTEGGSRVKYAVMDAPITLPSQKPVTDKPNPKQGIGMLSWSSDSHYFFTRNDNMPTALWIWDICRLDLAAVLVQKDPIRAAAWDPNCPRLVFCTESPHLYMWTPSGACCVNVPLPNFRVVDLKWNSDGTCLLLKDRDSFCCAAIVSPLPEEEEADQSDVTSEDE

SEQ ID NO: 64562 - protein, 119 aa, Brassica napus
MSPPPSWFMENQGEVYEGRRRGSESDEELKGLSYQEYRRLKRIKMRNTGRFCIWNNTPSPPRDPNEDENADDDDDDNLTKAKGESDSGTYRSCCSALLLMLHPTSLSLSYLWLCFFVTP

SEQ ID NO: 64563 - protein, 392 aa, Oryza sativa (indica cultivar-group)
MGVSASCLWGGSESRGNQNGSAAVTSPRSGQVISRAGSNVRVFSLKELKLATRNFHMMNCIGRGGFGAVYKGNLKDGTQIAIKKLSAESKQGANEFLTEINVISNVRHPNLVKLIGYCDEGTNRLLVYEYAENNSLAHVLLGPRSRCIPLNWQKRAAICIGTASGLAFLHEEAQPHIVHRDIKASNILLDKKLLPKIGDFGLAKLFPDTITHISTRVAGTMGYLAPEYALLGQLTKKADIYSFGVLVLEVISGESSSKSTWGQDMNVLVEWTWKLREQGRLLEIVDPELEEYPEEEMLRFIKVALVCTQATSQQRPSMKQVVDMLSNPTEISLENLVAPGVLKEPRHHSSSSGLTPDTTSNRSTKANPADSYSTQTRDMNSYQLSTIEVSPR

SEQ ID NO: 64564 - protein, 338 aa, Medicago truncatula
MDTKVLSSGIHYSKLPESYIRPESDRPCLSQVSEFENVPIIDLGSHNRTQIVQQIGEACSSYGFFQVVNHGVPLEELKKTAEVAYDFFKLPVEEKMKLYSDDPTKTMRLSTSFNVNKEEVHNWRDYLRLHCYPLDNYVPEWPSNPPSFKETVANYCKEVRELGLRIEEYISESLGLEKDYLRNALGEQGQHMAVNYYPPCPQPELTYGLPGHTDPNALTILLQDLHVAGLQVLKDGKWLAINPIPDAFVINIGDQLQALSNGLYKSVWHRAIVNAEKPRLSVASFLCPDNEALICPAKPLTEDGSGAVYRGFTYPEYYSKFWSRDLEKEHCLEFFKNN

SEQ ID NO: 64565 - protein, 471 aa, Glycine max
  misc_feature (217)..(218): Xaa can be any naturally occurring amino acid
MAIKEDVEDRTQKGIREPLVVGEQNHHANKGHPWMVYFSTFIAVCGSYEFGACAGYSSPTQDAIRKDLSLSLAEYSLFGSILTFGAMVGAITSGPLADFIGRKGAMRVSSAFCVAGWLVIYFSEGPVPLDIGRLATGYGMGVFSYVVPVFVAEIAPKELRGALTTLNQFMIVTAVSVSFIIGNVLSWRALAIIGLVPTAVLLLGLFFIPESPRWLAXXGHKKDFVAALQILRGKDADISEEAEEIQDYITSLEQLPKSSLLGLFHRRYLRSVTIGIGLMVCQQFGGINGICFYASSIFEQAGFSPTIGTITYACLQIVITGLGAAFIDKAGRKPLLLLSGSGLVAGCIFAAVAFYLKVHEVGVEAVPALAVTGILVYIGSFSIGMGAIPWVVMSEIFPVNVKGLAESVATLTNWFGAWLCSYTFNFLMSWSSYGTFILYAAINALAILFIIVAVPETKGKSLEQLQADINS

SEQ ID NO: 64566 - protein, 369 aa, Arabidopsis thaliana
MIENDDSPQHPSLFFTDFTRANSHVRVLHHKFLGKGVYGSVDLIRYTKTDGSSLQAAVKTSYAEDLEEYDALKREIQILSELKGYPNIVICYGDDLEEDFNEHGHKVYKLLLEYANEGSLSSFMENYPDRKLPDPMIRDFTRMILEGLVSMHSHGYVHCDLKSDNLLIFSRKDSASCELKIFDFGNCRQVGEVPDHWKSDYPYVGTPESFFDGVAKKTLDLWSLGCLVLKIYTGEQPWERVTSVDFVNFLSDGEAPNIPEYVPCDAREFIETCFAREHEKRGTASELLLHPFLCQKQPLLVKLKLRIKQASKITMGIREKPLTLKMFLSKPPQLKKLLSKLLRLKKMIHPKPLELDSSFVSYSSDLCLL

SEQ ID NO: 64567 - protein, 220 aa, Salmonella enterica subsp. enterica serovar Paratyphi A str.
MKDIDTLISNNALWSKMLVEEDPGFFEKLAQAQKPRFLWIGCSDSRVPAERLTGLEPGELFVHRNVANLVIHTDLNCLSVVQYAVDVLEVEHIIICGHSGCGGIKAAVENPELGLINNWLLHIRDIWLKHSSLLGKMPEEQRLDALYELNVMEQVYNLGHSTIMQSAWKRGQNVTIHGWAYSINDGLLRDLDVTATNKKTLENGYHKGISALSLKYIPHQ

SEQ ID NO: 64568 - protein, 685 aa, Arabidopsis thaliana
MNPATDPVSAAAAALAPPPQPPQPHRLSTSCNRHPEERFTGFCPSCLCERLSVLDQTNNGGSSSSSKKPPTISAAALKALFKPSGNNGVGGVNTNGNGRVKPGFFPELRRTKSFSASKNNEGFSGVFEPQRRSCDVRLRSSLWNLFSQDEQRNLPSNVTGGEIDVEPRKSSVAEPVLEVNDEGEAESDDEELEEEEEEDYVEAGDFEILNDSGELMREKSDEIVEVREEIEEAVKPTKGLSEEELKPIKDYIDLDSQTKKPSVRRSFWSAASVFSKKLQKWRQNQKMKKRRNGGDHRPGSARLPVEKPIGRQLRDTQSEIADYGYGRRSCDTDPRFSLDAGRFSLDAGRFSVDIGRISLDDPRYSFDEPRASWDGSLIGRTMFPPAARAPPPPSMLSVVEDAPPPVHRHVTRADMQFPVEEPAPPPPVVNQTNGVSDPVIIPGGSIQTRDYYTDSSSRRRKSLDRSSSSMRKTAAAVVADMDEPKLSVSSAISIDAYSGSLRDNNNYAVETADNGSFREPAMMIGDRKVNSNDNNKKSRRWGKWSILGLIYRKSVNKYEEEEEEEEDRYRRLNGGMVERSLSESWPELRNGGGGGGGPRMVRSNSNVSWRSSGGGSARKVNGLDRRNKSSRYSPKNGENGMLKFYLPHMKASRRMSGTGGAGGGGGGGWANSHGHSIARSVMRLY

SEQ ID NO: 64569 - protein, 304 aa, Zea mays
MAAAPSSLVSSHLSRLADLRRAAAPATPTVPQQLRVGFSRRRAQRVVAMAGSGKFFVGGNWKCNGTKDSVSKLVSELNAATLETDVDVVVAPPFIYIDQVKNSLTGRIEVSAQNVWIGKGGAYTGEISAEQLVDIGCQWVILGHSERRHIIGENDEFIGKKAAYALSQNVKVIACIGELLEEREAGKTFEVCFEQMKAFADSISNWADVVIAYEPVWAIGTGKVATPEQAQEVHAAVRDWLTTNISPDVASSTRIIYGGSVNAANCAELAKKEDIDGFLVGGASLKAPDFATIINSVTAKKVAA

SEQ ID NO: 64570 - protein, 513 aa, Nostoc punctiforme PCC 73102
MMNIAQNLELSCYLFPNKPAIIFEEESFTYKDLDEMVNRVANGLRSLDIRRRDRVALFLPNIPEFVISYLGILKIGAVAVSINIMLKTDEVRYILNDCAAKAIITTESQTEYIQEPDLPQLQHILIAEGRANKGISLKQLMAKSSPEARAVEMSRDDPASILYTSGTTGFPKGATLSHGNVIFNSYCANCCYRIQKSDRLLLFLPLSHCFGQNAILNAGISACTTIILQRRFDPDQVLETITTHQVTMLFGVPTVFIKLLNMDTSNYNLENIRYYFSAAAPMPLQVAENWYKKFGFVIHEGYGLTETSPFAAYNHNLNYKLGSVGTPIANVEMKIVDGDGNQVEIGELGEITIKGANVMLGYWNRPFETAEVIKNGWLHTGDIGRMDEDGFFYVIDRSKDMIVVSGFKVYPTEVENVIYQHPAVAEVAIYGVPDPLKGEIVKANIILKASQTITEQQIIDFCYERMAAYKVPRVINFVNSIPKNSTGKVLKRFLRQESISQVVEKRQELGVRS

SEQ ID NO: 64571 - protein, 778 aa, Thermoanaerobacter tengcongensis MB4
MKGIIMAGGEGSRLRPLTFDIPKPLVPVANKPAIKHIVEHLHKYGVGELAVTLFYLPHKIKDYLLEEYGNEIKFYTEEKPLGTAGSVKNAKDFLKETFIVMSGDVITDVNIKEVYDFHRKKGSKVTLVLKKVEIPLEYGVVIVDETGKIVKFLEKPSWGEVFSDTVNTGIYIIEPEILEFIPEDRPFDFSKDLFPLLLKENIPMYGYITEGYWCDIGNTAQYLSSHFDVLEGKLDLGYRKILLEEGKVIGKKVLMSSGAKLILPLIIGNEVVIEENAVVGPNVVIGRGTIIKKGSHVKNSVLWEDVYVGENSELNGAVVCNKVRIDSNARILENAVIGEGVRIKAFAEIRPDVKVWPFKVIEEEAVVSKDVVWGNGRKNLSFGYRGIRGIFNEEIGPYQAVEIGEAFGDLMKGKVIVGSDEELASSLIADLIAYGLAFSGCEVLKSNSFLLPALRVGIRLRSAKGGVYVERIGEEIRILFLDGEGMDIDRNLEKKIENKLKIHDISRRKIEDIKPIKEVDVEGDYKDYLVKNRADSFKIKVKPHDEWTKKVLLQIKGEQILDDQNYHLKVKLKKNGEEIELYDEKDRKFDEDEVNYLKMLIAREKGLKKVVLPFNSSKYLAEFAEELAVETVVGKISPRDLMRSMTNLEEGRQVYFDLSFDGINFLLEVIEYVRLKNKRLSEIKDSFPLRYKTVKRIRCDWKDKGRIIRELFETRKNNVTFLDGLRFEEDEGWVLVVPDSELPFCNVYVEALTPEKAERLFTIYEKKIQDILLKNDGK

SEQ ID NO: 64572 - protein, 243 aa, Mycoplasma hyorhinis
MSKTIIIGNWKMNKTFTQTKEFFSAFNQLYIENKNKINQNLDFAVALPAINVAAFSKNTTKLELAVQNMSQFEKGAYTGEISAQMLLDLNVKYAIIGHSERRQYFKETDLDVNAKTQQAIKNNIIPVVCVGETLEEYEAQKTSQVIEYQLKNSLKDVDLSKVIVAYEPIWAIGTGKTATPEQAQQVCKFIRKQTNKNLTILYGGSVSQENIEQLLNQADINGALVGGASLKVDSFIKLLTLNK

SEQ ID NO: 64573 - protein, 907 aa, Burkholderia pseudomallei K96243
MNDLSNGIHPVLATARRHDDTDPQETAEWLDALDGVVAHAGAERAQYLLAQLAEHAARRRLAPPHAGATPYVNTIPVDEEPPYPGDLQFEERLAAVLRWNALAMVVRANRAYGELGGHIASYASAADLFEVGFNHFFRAAGDASGGDLVYFQPHSSPGVYARAFLEGFLSDAQLEHYRREIAGPGLCSYPHPWLMPDFWQFPTGSMGIGPINAIYQARFMRYLQNRGLLRTEGRKVWGFFGDGEMDEPESIGALSLAAREGLDNLVFVINCNLQRLDGPVRGNGRIVDELESQFAGAGWNVIKVLWGSDWDALFARDATGALARAFAQTVDGQFQTFSANDGAYNRARFFGQDDALAALVAHLRDEDIDRLRRGGHDARKLYAAYDRAVRHEGRPTVILAKTMKGFGLGAIGQGRMTTHQQKKLDVEHLLAFRDRFRLPLTDEDVAQLRFYRPEKDSPEMRYLHARRAALGGCLPRRRAAATAALTVPSLPSWGQFALDGGREMSTTMAIVRMLGGLLKDAALGPRIVPIVADEARTFGMANLFRQVGIYSPLGQRYEPEDLGSMLYYREDTRGQILEEGISEAGAISSWIAAATSYSVHDLPMLPFYIYYSMFGFQRIGDLIWAAADQRARGFLIGATSGKTTLGGEGLQHQDGTSHLAASTVPNCRAWDPAFAYEIAVIVDEGMREMVERQRDTFYYLTVTNENHAQPTLPADRLDAVRGGILKGMYPLDAAALPAARVQLLGSGAILGEVQAAARLLRDDWRIDAAVWSVTSFTELQRDGIAAERAQRLFDADDANERSPTPHVTSALAATQGPVIAATDYARALPELIRAYVPRRYVTLGTDGFGRSDTREALRAFFEVDRGSIVIAALRALADDGEVTRTVVRDAIARYGKRDASRTPPWER

SEQ ID NO: 64574 - protein, 256 aa, Moritella marina
MRHPVVMGNWKLNGSKEMVVDLLNGLNAELEGVTGVDVAVAPPALFVDLAERTLTEAGSAIILGAQNTDLNNSGAFTGDMSPAMLKEFGATHIIIGHSERREYHAESDEFVAKKFAFLKENGLTPVLCIGESDAQNEAGETMAVCARQLDAVINTQGVEALEGAIIAYEPIWAIGTGKAATAEDAQRIHAQIRAHIAEKSEAVAKNVVIQYGGSVKPENAAAYFAQPDIDGALVGGAALDAKSFAAIAKAAAEAKA

SEQ ID NO: 64575 - protein, 610 aa, Pseudomonas aeruginosa UCBPP-PA14
MCGITGWTDWSRDLGEQRSILERMTRTLAPRGPDAEGLWLSRHALLGHRRLAIIDLENGAQPMLAEAGGRVALTYSGEVYNFRELRAELETLGQVFRTRSDTEVVLRAYLQWGEASFARLRGIYGFALWDEREQSLWLVRDRFGVKPLYYYPTAGGVLFASEPKAIFANPEANPVLDASGIAELFALTTAPTPGHGLYKGLRQVRPGQALRFDRNGVRELVYWALRAERHEEGAEDSAERAGQLLREAVAEQLVADVPLGSLLSGGLDSSAISAFAVAALDGDARRLPTFSVDFPGEGRGFVPTPWQSSWDEPYAQLAANFLGTPHRTVLVAPEEVLEQDEAVLQARDLPGWGELDASLYLLFRQVREHTTVALSGESADEVFGGYPFFHDPSALAHDGFPWLAGKSGPWQLLRREVAERVAAPEYIRARYREALAEVPRLDGEDAAQRRQREVAYLALSRWLPAMLERKDRMSMAVGLEVRVPFCDHRLVEYVWNLPWALKSVAGESKSLLRRALRGHLPQAILERRKSGFPANPDPRYLALLRERVGRLLADGRSPLFELVDAGRVRQALEQGTPLPSPRASASPTAGLAYLLNLDRWLTRHGVDISL

SEQ ID NO: 64576 - protein, 524 aa, Oceanobacter sp. RED65
MTDIHSQKILILDFGSQYTQLIARRVRELGVFSEIRPWDMSFDEIKEFDPKAIILAGGPESVHEANSPRATEEVFDMGLPILGICYGMQTMAEQLGGKVQGSDIREFGYAQIKVESAGPFFKDISDHIDNKGSTYLDVWMSHGDKVSEMPAGFELMASTPSCPIAAMYHEEKQFFGVQFHPEVTHTLQGGRMLEHFVRDIAGCEALWTPANIIEDQIARVREQVGERKVLLGLSGGVDSSVVAALLHKAIGDQLTCVFVDNGLLRKNEGDMVMDMFAKNMGVKVIRADAEDLFLGKLNGIDDPEKKRKVIGNTFIDVFDEEAGKIKEVDFLAQGTIYPDVIESAASKTGKAHVIKSHHNVGGLPDDMKMELVEPLRELFKDEVRKIGLELGLPYDMVYRHPFPGPGLGVRILGEVKKEYADVLREADAIFIEELHNFDWYHKTSQAFAVFLPVKSVGVVGDQRRYEWVIALRAVETIDFMTARWAHLPYELLEKVSNRIINEIEHVSRVTYDVSSKPPATIEWE

SEQ ID NO: 64577 - protein, 445 aa, Colwellia psychrerythraea 34H
MSDRKYFGTDGIRGLVGQYPITPEFVMKLGYAAGKVLAGQGTKKVLIGKDTRISGYMLESALEAGFSAAGIDVGLLGPMPTPGIAYLTKTFRAEAGIVISASHNPFYDNGIKFFSNTGEKLPDAVELAIEAELDNPMGCVESAKLGKASRVNDAAGRYIEFCKSNFPSKISLKDLTIVVDCAHGATYHIAPNVFRELGATVIEIGTAPNGTNINQGCGATSMAAISKAVVEHKADLGIALDGDGDRIMMVDHTGYVIDGDEIIYIIACNDLKTGRKEGGVVGTLMSNMGLELALKELDIEFARSNVGDRHVMELLREKGWQLGAENSGHVINLNHTSTGDGIIAALNVLTAVTKQEKSLFELRQGLTMLPQLLVNVRFSGQNNPLNDADVLAAVDEVNETLTGRGRVLLRKSGTEPLIRVMVEGPDMDEVTLLANKIADLVKLVK

SEQ ID NO: 64578 - protein, 442 aa, Oryza sativa
MSSHHRYAHLLDDPFFPFPPPSSSSCPFLSPPAASSTCPFFALDSPFAADPFHLHPFLPTPPTSSLLDPFLLHTLTDRVSQLELALAARAPHPRPTSRKCTYVTESTGRKVKWTTEDKPRAGERVLKWEAELDSPYDDGFDRKWKWEAKAKTASAAATKLKWATHLKGKGCLEPWSHSYTWEEDFSATDDDDDEEIEDQLHHKALQDHSKLKTKAKDDKKKKKKDNNTVVVNKEQKKCPFSVKIEEIPPEEDNTAGCVAIRKAFALGNGKAKKKELSPQDAALLIQLNYRAHLAHRSQVLRCLRDLAVAKAKLKEIRSLFYNISYRHRMAHDHEERQRFTEKIIVLLLTVDALEGPDYMVRTAKKSMLDELEGMLEIVDPQPPGKQRSLTRRKFDLPEGGPITDEKMAGVNNAVKVIQKGKNLLRNTLCTMHGSLIVLASKH

SEQ ID NO: 64579 - protein, 491 aa, Colwellia psychrerythraea 34H
MNNKHYINGTWVSPATSETFSVINPATEAVIAEIPAGNSVDIDAAVKAARTAFDQGPWPRLSGAERAVYLRKIAAIIIRRLDELAKLEVLDNGKPYPEAKWDIEDTAATFEFYAGLAEQLDNTSEQVIELPEPGFSSKAIKEPLGVAGAIIPWNFPMLMAAWKVAPALAAGCSIILKPSEITPLTALALAEIADEAKLPAGVLNIVTGLGKDAGQALVEHPDVDKLAFTGSIPTGSKIMATAARDIKNISLELGGKSPFVIFEDSDIEKAVEWIMFGIFWNQGQVCSATSRVLVAKEIYPALLERLVEETKKITIGPGDQDGVLLGPLVNSDQYKKVLAAIERGVSDGATIATGGQRPPGLDVGYYLEPTILTDIDENSWVWNEEIFGPVVCIKPFQSESEAIRLANDSRFGLAAAVMSKDEDRCDRVSRAFRAGIVWVNCSQPTFVEAPWGGYKQSGIGRELGQWGLNNYLETKQITRFNSSEPWGWYLK

SEQ ID NO: 64580 - protein, 447 aa, Escherichia coli CFT073
MDQTYSLESFLNHVQKRDPNQTEFAQAVREVMTTLWPFLEQNPKYRQMSLLERLVEPERVIQFRVVWVDDRNQVQVNRAWRVQFSSAIGPYKGGMRFHPSVNLSILKFLGFEQTFKNALTTLPMGGGKGGSDFDPKGKSEGEVMRFCQALMTELYRHLGADTDVPAGDIGVGGREVGFMAGMMKKLSNNTACVFTGKGLSFGGSLIRPEATGYGLVYFTEAMLKRHGMGFEGMRVSVSGSGNVAQYAIEKAMEFGARVITASDSSGTVVDESGFTKEKLARLIEIKASRDGRVADYAKEFGLVYLEGQQPWSVPVDIALPCATQNELDVDAAHQLIANGVKAVAEGANMPTTIEATELFQQAGVLFAPGKAANAGGVATSGLEMAQNAARLGWKAEKVDARLHHIMLDIHHACVEHGGEGEQTNYVQGANIAGFVKVADAMLSQGVI

SEQ ID NO: 64581 - protein, 512 aa, Medicago truncatula
MAGGYIAQGSGKEYPGKFTIRVFIICMTAACGGLIFGYDLGISGGVTAMDPFLMKFFPDVYAKQLNIKPADNQYCKFDSQTLTLFTSSLYLAALVASLGASTVTRIFGRRLTMLSGGVLFLAGAAMNGFAEKVWMLYVGRMLLGFGIGCANQSVPIYMSEVAPYKYRGALNMMFQLAITIGIFVANILNYFFAKMKNGEGWRYSLGCAGVPAIMIIIGAIFLPDSPSSLIERGLDDKAKKELIKIRGTSDVDDEFNDLLAASQASKAIKHPWSILLTRQYRPQLTMATAIPFFQQLTGMNVITFYAPVLFKTIGFGANASLMSAMITGGCNALATFASIATVDKFGRRTLFLEGGAQMFICQIIVAVAIASKFGVDGNPGELPKWYALLVVIGICVYVMGFAWSWGPLGWLVPSEIFPLEVRSAAQSVNVSVNMIFTFAIAQVFTAMLCHMKFGLFIFFAFFVVVMSLFIYKFLPETKGVPIEEMSKVWQNHSYWKKFVKPTDDHNSGGGQA

SEQ ID NO: 64582 - protein, 284 aa, Medicago truncatula
MGEVKQEPPKEESKPEETPVEEKKEEQSEEKPKPPSPCVLFVDLHCVGCAKKIEKYIIKIRGVEGVVIDMAKNEVVIKGIVDPQGICNIITKKTKRMAKVISPLPEAEGEPIPEVVNSQVSEPVTVELNVNMHCEACAEQLKGKILKMKGVQTVETEHSTGKVIVTGTMDGNKLVDFVYRRTKKQAKIVPQPEPEPAPESKEGEKPAEEEAKPEEKKQEGGEDNKNESKEEKDGEEINGVHDEEDMMKRMMYYNYYNQPLYVVERMPPPPQLFSDENPNACCIS

SEQ ID NO: 64583 - protein, 503 aa, Hordeum vulgare subsp. vulgare
MDLRVAAPASVAAAARRGALGCARVRPLQGRRQCRPSVRVSVATTESAAAAAAVSASADEDAETTNPRTVVAVILGGGAGTRLFPLTKRRAKPAVPIGGAYRLIDVPMSNCINSGINKVYVLTQFNSASLNRHLFRAYNFSNGVGFGDGFVEVLAATQRPGSEGKRWFQGTADAVRQFAWLFDDAKSKDIEDVLILSGDHLYRMDYMDFVQSHRQRDAGISICCLPIDDSRASDFGLMKIDDTGRVISFSEKPKGADLKAMQVDTTLLGLPKEEAEKKPYIASMGVYIFKKEILLNLLRWRFPTANDFGSEIIPAAAREINVKAYLFNDYWEDIGTIKSFFEANLALAEQPSKFSFYDASKPMYTSRRNLPPSMISGSKITDSIISHGCFLDKCRVEHSVVGIRSRIGSNVHLKDTVMLGADFYETDAERGDQLAEGKVPIGIGENTSIQNCIIDKNARIGKNVTIANTEGVQESDRTSEGFHIRSGITVVLKNSVIADGLVI

SEQ ID NO: 64584 - protein, 325 aa, Gibberella zeae PH-1
MGSISTKGKSFPPGIHVPSLTWFKNDAEQEVDWDQQSRHIEFLVNSGLDGIVIAGTNGEAVTLSAAEKSRLVRTTREIATSCGRPDITITMGTSSQTTRDAINETKLAKEAGADFVLVLTPSYFHFAMTQDAIVAFFEELADASPVPVVIYNFPGVVAGLDVNSEMLERLAKHPNIVGVKLTCGGIAKVARVAAQYKPEEFTALAGQSDWLVPALSVGATGAVTGVANLYPKTCLQIFDLYMAGKTKEAEAAQLELAKMEWGFAKGGINGTKWIVAKLLGYPADSCHCRKPYPQYVDESKQEWIHSVVEPLSAVEKSLGKRGAGI

SEQ ID NO: 64585 - protein, 650 aa, Oryza sativa
MPDYKVPGIEIVSNVISMTSSGLPVESRRLKVWAFVSDVRGHWASASPAQSWSRGWRCPLLPAAATSPAAHLAPAAAGGASLLRDSPAGAEREAPLAAAAAAAGRGVGRVGRRRGESTAMVFGELFSRASLPPPWSLLAYGLVGPVLLWQAGRLLDRLWWRPRRLERALRAQGLRGTAYRFLLGDLREFGRLNEEAWSSAPLPLGCHDIVPRVTPFVHRNVRDNGRPCCFSWFGPIPSVTITDPAQVRDVLSNKLGHFEKPKLPALTKLLADGLTSHDGEKWVKHRRIMNPAFHLEKLKLMLPAFSTCCEELVGKWMDSLGPDGSCELDVWPEMQSLTGDVISRTAFGSSYSEGRRIFQLQTEQAELFIGAIQKFVIPGYMYLPTKKNRRMRRINSEVESILRGIIGKRMQAIAEGESTNDDLLGLLLESNMRHADENGRSSPGMTTEDVIEECKLFYFAGMETTSVLLTWTMVVLSMHPEWQDRAREEVLGLFGRDKPEYEGLSRLKTVTMVLYEVLRLYPPAIVFSRKTYKEMEIGGVVYPRGVILELPVLFIHHDREIWGRDVHEFRPERFAEGISRASNDRGAFLPFGWGPRVCIGQNFALLEAKMALCMILQRFEFELAASYTHAPHTVMTLHPMHGAQMKLRMI

SEQ ID NO: 64586 - protein, 511 aa, Bradyrhizobium japonicum USDA 110
MPVEEAFVQGSGMEVLTNAEMQRADQLSIAAGTPGFKLMLSAGQAVAEAANALVEEGPILIVAGPGNNGGDGFVAAAELAAQGREVSVILMCERDQLQGDAASAARGWKHPVLPFNPQAIGKPALIIDALFGAGLSRPVDGEARAMIEAVNANGALVLAVDLPSGINGTSAAVLGAAVNATETVTFFRKKPAHLLLPGRMHCGRVRVADIGIDAQVLDEIRPQTFENDPDFWGAAFPVPRIDGHKYARGHVLAVSGDAAATGAARLAARGALRAGAGLVTLASPRDALAINAAALTAVMVRPVDTAIEFGELLGDKRYNTCIIGPGTGVGDRTCDFVHTALGAQRHLVLDADALTSFAANPERLFESIKASHDNAVVLTPHEGEFPRLFSDLSNKHPGRSKLERVRAAAERSGAVVLLKGPDTTIAAPDGRATIAANAPPWLATAGAGDVLSGIIAGLLAQGVPAFEAASIGVWMHGEAASEAGPGLIAEDLTETLPAVHRRIYNALGIEY

SEQ ID NO: 64587 - protein, 480 aa, Xylella fastidiosa Ann-1
MSFLPSFLKRKSIDLITVHEEGRRLVPTLSWPHLIAFGIGAIVGTGIYTLIGVGAEKAGPAVLLSFVIAGVICACAALAYAEMATMMPVAGSTYTYSYVALGEGIAWIVGWSLILEYSLVVSTVAVGWSGYMTGFLKSVGVDMPLALTAGPYAGGIINLPAAVITCVVAGLLIVGTKESTTVNAVLVVVKIIALSVFVVIALPHFDMAHLKPFMPYGFTKSIDTGGVERGVMAAAAIIFFAFYGFDAISTAAEETKNPSRDLSIGIIGSMIGCTLIYVLVALAAIGAMHYTVFGPSTEPLALILRQLDQGNTARLIGAAAIIALPTVLLAFLYGQSRILFVMSRDGLLPRVLSTVNERTGTPIATTLFTAILVATAAGLVPLGEIAALANAGTLTAFIAVALCLLVLRVREPQRVRAFRTPLAWVVGPIAIAGCLYLFWSLPKMTQSLFLLWNALGLCVYLVYGRHTSLLSKAVSIDTPR

SEQ ID NO: 64588 - protein, 456 aa, Oryza sativa
MATPPPPPAPTPEVFDVVIFGASGFTGRYVIREALKFLPPSSSPLRSLALAGRSRDRVAAALRWAAGPGGAAPDLPILVADASDPASLAALAARARVVLSCAGPFRLHGRQVAAACAAAGADCLDISGEPEFMERVEAEFHEAAAKNGSLIISACGFDSIPAELGFLFHSRQWAPPSVPVTVQAYLSLESDKRIVGNFGTYESAVLGVANAGELQALRRSRPRRPRPNIPGPPPPKGSLVEHDKALGLWTIKLPSADTVVVKRTLSTVTQHPEGLPGVEESTDFAEHRKSFWSSVKPAHFGVKLTSKSLLGIAQFIFTGLCIGLLGGFSFGRSLLLKFPSFFSAGWFRKSGPTEEQVSSASFKMWFVGRGYSDAARASDRGSKPDKEIITRVSGPEIGYITTPIVLVQCALVLLSQRGNLPKGGVYTPGAVFGPTDIQQRLQENGLSFDLVSTRTL

SEQ ID NO: 64589 - protein, 229 aa, Triticum aestivum
  misc_feature (156)..(157): Xaa can be any naturally occurring amino acid
MTAFPPPPVNTIDWSNVGFKVREVNGHVESTYSKITGKWTPLRFVADPFMRIHGMAPALNYGQQAYEGLKAFRTPNDEAITVFRPDRNAKRLQHSAEVVSMPPVPEDLFLSAVRAAVALNAEYVPPHDTGAALYIRPQLYGSSAQLGLSPPDEYIXXVFVIPTGVYHGAHPVKALILEDFDRAAPHGTGNAKVGGNYAPVLRWSDKARDEGYGITLHLDSVRHEEIDEF

SEQ ID NO: 64590 - protein, 468 aa, Lactococcus lactis
MTKTLPKDFIFGGATAAYQAEGATHTDGKGPVAWDKYLEDNYWYTAEPASDFYHKYPVDLELAEEYGVNGIRISIAWSRIFPTGYGEVNEKGVEFYHKLFAECHKRHVEPFVTLHHFDTPEALHSNGDFLNRENIEHFIDYAAFCFEEFPEVNYWTTFNEIGPIGDGQYLVGKFPPGIKYDLAKVFQSHHNMMVSHARAVKLYKDKGYKGEIGVVHALPTKYPYDPENPADVRAAELEDIIHNKFILDATYLGHYSDKTMEGVNHILAENGGELDLRDEDFQALDAAKDLNDFLGINYYMSDWMQAFDGETEIIHNGKGEKGSSKYQIKGVGRRVAPDYVPRTDWDWIIYPEGLYDQIMRVKNDYPNYKKIYITCNGLGYKDEFVDNTVYDDGRIDYVKQHLEVLSDAIADGANVKGYFIWSLMDVFSWSNGYEKRYGLFYVDFDTQERYPKKSAHWYKKLAETQVIE

SEQ ID NO: 64591 - protein, 887 aa, Candidatus Pelagibacter ubique HTCC1002
MNKLILNFKSKDSKKIKNPKNFLGGKGANLSEMGRMGLPVPPGFTISTKVCELFYKDKKKLNSKIVNIIKKELKIIEKDVGKKFGDLKNPLLLSVRSGARVSMPGMMDTILNLGLNDKTVLALSKKTSNSRFAKDSYRRFIQMYGNVVMGVEGYHFEELIENYKLTKGVLLDTDLDADDWEGLINDFKKVIKDQTKKEFPQNVYNQLLGAISSVFLSWESNRAKVYRKLNQIPAEWGTAVNVQSMVFGNMGNDCATGVVFTRNPSDGVNEVYGEYLINAQGEDVVAGTRTPQYITKKARKDAKAKEASMEEAMPKVFKQLDKILKILEKHYKDMQDVEFTVENNKLWMLQTRSGKRTSKSAVRIAVDMVKEKLISKKEAVMRIDPASLDTLLHPTLDEKNTLNVIANGLPASPGAASGKVVFTSEEAERLNNVMQDTILVRVETSPEDIHGMHAAKGILTARGGMTSHAAVVARGMGRPCVSGSSEIDINYEAKTFKTSSIEIKEGDIITIDGSTGRIILGEVPTVKPEISGDFSKLMSWADNFRKLKVRTNSETPLDTKTARDFGAEGIGLCRTEHMFFDEERILSVREMILSKTVEDRNRALAKLLPHQKKDFVQIFKIMNGLPVTVRLLDPPLHEFLPKTEKEINDVAKVVGLPLKEIESRINELHEQNPMLGHRGCRLGISFPEIYEMQCRAIFEALSELKIKKIKSAFPEIMIPLVSTEAEIRIMKDLVVRVAKEVQKDKKIKIDYLVGTMIELPRAAIKADDIAKHAEFFSFGTNDLTQTTFGLSRDDSGKFLNDYLENKIFSIDPFISIDDGVGDLIEIAVEKGRKTNKKIKLGICGEHGGDPKSIHFCANAGLDYVSCSPYRVPVARLAAAQAELSKKN

SEQ ID NO: 64592 - protein, 311 aa, Prunus spinosa
HHPNVERLDDPDDPYVKQEFQWSLFSNQTFEECSKLIHPLGSTEHYGIYGSSNGLVCISDEILNFDSPIHIWNPSVRKLRTPPISNNIKFSYIALQFGFHPGVDDYKAVRMMRTNKNALAVEVYSLRTDSWKMIAAIPPWLKCTWQHYKGTFFDGVAYHVIQKGPIFSVMSFDSGSEEFEEFIAPDAISGTFGLCIDIYKEQICLLFRCYGCEEGMNKVDLWVLQKKRWKQLCPFIFPLDEDSVAVGISIDDELLMEITDFDKGVADLYLCNYESKEVLETGIKLAVMKYDEIEFLFAITYLQSLVLLNNY

SEQ ID NO: 64593 - protein, 491 aa, Pseudomonas aeruginosa UCBPP-PA14
MHNESRPEAPLRVLVVGAGFAGLGLAIRLRQAGIDDYLVLEKAADVGGCWRENRYPGAACDVPSHLYSFSFEPKADWSRKFAPQAEILDYLRHCADKYRLRGKIRFHCEVEEARFDAGSGEWQVRCADGQTLRARALVCATGQLSRPLLPRLPGLERFQGPAFHSANWDAEVELAGKRVAVIGTGASAIQFVPRIAPQVQRLSLFQRSAPYVIAKPDRAYADWERRLKARWPWLQRLDRGLKYLHHESRMLAFATFPALMKVMRLSFHRHLHRQIADPQLRARLVPDYPLGCKRILISNDYYPALARSNVELVDTGIREVTEDAVVGRDGRRHEVDAIIFGTGFAATEFLAPMRILGLDGRDLRQAWADGAEAYKGISVSGFPNLFILYGPNTNLGHNSIVYMLESQFPYVLGCLRQLQAQGLRYLDVKPEVQRRFNLEVQQGLRHTVWERGCDSWYKTAAGKNTNNWPGYTFVYRWRTRRPELADYDLAR

SEQ ID NO: 64594 - protein, 218 aa, Magnetococcus sp. MC-1
MDKSKLDTGFNAEFVVGAVKPEQYPDDGLPEVAFAGRSNVGKSSLLNKLLNRRQLARVSNTPGRTRELNFFRINQAYYYVDLPGYGYAKVGRGQREVWDRGIGLYFNSRRDLRAVILLLDIRRGMTEQDQAMLDFIFKMGLPVLPVLTKSDKLNANPRREAIKAMRLMVAEKVPLAVAPLLVTSSSKGDGILELRQTLATLLQRELGVGDPPPPDPCP

SEQ ID NO: 64595 - protein, 241 aa, Bradyrhizobium japonicum USDA 110
MNMDQLKRQAAARALEEVRDGMQLGLGTGSTAKHFVELLGERVAAGLKVIGVPTSEATRLDATRCGVPLTTLDEIDHLDITVDGADEIDPELNLIKGGGGALLREKIVAAASDRMIVIADDTKWVPTLGRFPLPIEVIPFGLGATRRAIETAFAQCGVSGQMAVRKAKGGDKDGHVFVTDGGHWILDAQLGRIVDPPSLAKALSAIPGVVEHGLFIGLASSAVLAGGEGIRVIERRKPKGD

SEQ ID NO: 64596 - protein, 249 aa, Prochlorococcus marinus subsp. pastoris str. CCMP1986
MSNTESLTGKVALITGASRGIGKEIALELSNLGAKVIINYSSSDEKAEEVVNLIKESGGKVHKLKFDVSKEESVSKAFEEIIKINGAIDILVNNAGITRDGLLMRMKSEQWDDVLNTNLKGVFLCTKYASKFMIKKRSGKIINISSIVGIIGNPGQANYSAAKAGVIGFTKTCAKEFASRGINVNAIAPGFIETEMTEKLNNEEIIKAIPLGKLGSCSQIANLVSFLVSSNAGSYITGQTISIDGGMSI

SEQ ID NO: 64597 - protein, 462 aa, Bradyrhizobium japonicum USDA 110
MAEFDVDLFVIGGGSGGVRAARIAAGHGARVMIAEEYRMGGTCVIRGCVPKKLFVIGSHVRHEIEDAAGFGWTIPSMSFDWATLIANKDKEIARLEAAYTTNVEKSGAQIVKSRAVIEDKHTVRLLENDRKITARYILIATGGAPNHGASIPGIEHVISSNEAFHLKTLPKRIVIQGGGYIALEFAGIFAGYGSDVTVIYRGDNILRGFDEDVRTHVRSEMEKQGITILTGCTVAKVDRHGEEFTTHLSNGSSVASDQVMFAIGRHPSVANLGLEKACVAINPKNGGIAVDHFSKSSVDSIYAIGDVTHRHNLTPVAIREGHAFADTVFGKREVRVDHAYIPTAVFSQPEVGTVGLTETEARAQFSHVDIYKTTFRPIKATMSGRDTRVLMKLVVDGTSDRVLGCHIVGDAAAEITQAVAIAVKMKATKADFDATIALHPTAAEELVTMRTPTARHVRQAAE

SEQ ID NO: 64598 - protein, 621 aa, Listeria innocua Clip11262
MCGFVGCVHDRITEITGADKETFRQMNSMITHRGPDDEGYFTDDHVQFGFRRLSIIDVENGHQPLTYENERYWIIFNGEVYNYVELREQLVAEGMTFETESDTEVIIATYAKYKEKTAERLRGMFGFVIWDKQEELVYGARDPFGIKPFFYAEEDGKLFMGSEKKSILHALKEKELDEVSLQNYMTYQFVPEPDSLTKNVKRLEPGHQFTKKIGQPMEITTYWKASFAPVTKSEDAWIKEVRDVMYDSVKMHMRSDVPVGSFLSGGIDSSIIAAIAKEYHPAIKTFSVGFERDGFSEIDVAKETADKLGVENISYVISPEEYMKELPKIVWHMDDPLADPAAIPLYFLSREARKQVTVALSGEGADELFGGYNIYNEPNSLAMFNKMPGVFKSMLNSVARIMPEGMRGKSFLERGTTPMEERYIGNAKMFTEKEKQILLPKYQSGHDYTNITDPFYAETKNYHPVERMQYIDIHTWLRGDILLKADRMTMANSLEVRVPFLDKEVYNVARNIPDTMKTTNGTTKYILRKAAATFVPEHVLNRRKLGFPVPIRHWLKDEMNAWVKNIIKESPTDHLINKQYVLGLLDDHCAGKFDYSRKIWTVVIFMIWYDVYVADKYDFGK

SEQ ID NO: 64599 - protein, 445 aa, Clostridium perfringens str. 13
MFGFFSPAPAIPRLPKDKVSSAYKAYRIRMFLMIFIGYTGYYLVRKNFAVASPYLIDNYGFSKTQIGLISMGLAVSYGLSKFILGNLSDKSNVKKFICFGLIASSVLSVLMGFARTVPIFLILMVFNGFFQGMGAPPCSIVLGKWFSQKERGLKMGIWNTSHNIGGGLIAPIATLCLLVFGQNHFQSIFFVPAIICTIVALFCYVIGADTPASVGLPPVEEYRNDYPEVKAEVNPTTLSSKEIMVKYVLKNKYVWYLALANIFVYLIRQGVVNWIPIYLKESKGFSAANANWAMFLFEYAAIPASILLGWLSDVVFKGKRAPLSILCMIGVIFATVAYWQTSSTLVTMISVAFIGCFIYGPQLLIGMNLIDVVPNFAVGSATGFSGLCGYLLGEFMADFVLGMIADSFGWNGAFIFIIVGAFIALLLLALTLKIKKNPQVEDKIA

SEQ ID NO: 64600 - protein, 469 aa, Bradyrhizobium japonicum USDA 110
MKTAKDVLKSIKDNDVKYVDLRFTDPRGKWQHVTFDVSMIDEDIFAEGTMFDGSSIAGWKAINESDMCLMPDPVTATIDPFFAETTMVITCDVLEPTTGEPYNRDPRGIAKKAEAMVKSMGVGDTVFVGPEAEFFVFDDVRFSSSPYNTGFRLDSSELPTNTDTEYEGGNLGHRVRTKGGYFPVPPQDSVQDMRSEMLGAMAKMGVKVEKHHHEVASAQHELGMKFDTLTLMADHLQIYKYCIHQVAHIYGKTATFMPKPVYGDNGSGMHVHQSIWKDGKPVFAGNKYADLSETCLHYIGGIIKHAKAINAFTNPSTNSYKRLVPGYEAPVLLAYSARNRSASCRIPYTASPKAKRVEVRFPDPLANPYLGFAAMLMAGLDGIKNKIDPGPAMDKDLYDLPKEELKQIPTVCGSLREALENLDKDRAFLKAGGVFDDDFIDSYIELKMTEVERFEMTPHPVEFDMYYSG

SEQ ID NO: 64601 - protein, 525 aa, Medicago truncatula
MSLGHDIIFNSGSLRRNSDDIIINSGSLRKNYSGKLTFRVFITCFTATFGGLIFGYDIGISGGVISMNPFLHKFFPHVYEQNVTTIKPSTNQYCRFDSQTLTLFTSSLYLAALVASLGASTVTRSFGRRLTMISGGVLFLAGAALNGFAQEVWMLILGRMLLGFGIGCAIQSVPIYVSEVAPYNYRGALNMMFQLAITIGIFVANILNFMFAKMKNGEGWRYSLSFASIPGIMFTLGAMFLPDSPSSLIERGQNDKAKQELINMRGTTDVDEEFQDLVVASDVSKTVKHPWVSLLKRQYRPHLTMAIAIPFFQQLTGMNVITFYAPVLFKTIGFSNTASLVSALIIGGCNALATLVSIATVDKFGRRTLFIEGGIQMFICQIVIAIAIACKFGVDGDPDTLSKWYAIVVVMCICVYVVGFAWSWGPLSWLVPSEIFPLEIRSAAQSINVSVNMICTFVIAQIFTTMLCYMKFGLFIFFAFFLFLMTAFIYKFLPETKEVPIEEMSIVWETHPYWGKFACVLLIPT

SEQ ID NO: 64602 - protein, 123 aa, Zea mays
  misc_feature (100)..(100): Xaa can be any naturally occurring amino acid
LKSNHPFRTIVVNPKGLGDTINLFGERHTDQRITLVADVKTIGFILGPTITLAIGAKFAPLRKPKKLPRDVIYEEYSMEYGTDNIEMYVATVQANHRTLXLNDLIATAQTLCSTVKLIERILT

SEQ ID NO: 64603 - protein, 452 aa, Escherichia coli
DSRFGAKSISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 64604 - protein, 470 aa, Pseudomonas putida KT2440
MSCIPFQELAMHTTTSTAHSPAPHAPSQPGTSTGRFRKSMSMTALVLFGLAYMVPLAVFTTYGLVTQMTKGHLPTAYLLTLAAMLLTAYSYGRMVQAHPYSGSVYTYTRKAFGSHIGFITGWTLLLDYIFLPLLSYLLIGIYMSEYFPTIHAWVWVAGSIALVTFLNLIGIESITRVNWILVVVQLVFIIVFVALSILKLSGQAEPVSLLAPLHHDGFSVPLIMTGAAVLCLSFLGFDAVSTMAEETSNPTYRIPVAILAVSLIGGLLFLVVSYCAQMVFPDWGSFADPDSASVDVMRRVGGELLVTAFTATYVAGCFASAMVSQASVSRVLFAMGRDGALPRAFGQLVTKKRVPATAILVVSLLSLIALVITLDTVANMISFGALFAFSAVNLAVVKHYLVDQKLRGCRNCLLYGAIPGLGFLSTLWLWSSLTSLSFTIGLCWMGLGLLVLLGLTRALRVKLPELQMAE

SEQ ID NO: 64605 - protein, 443 aa, Medicago truncatula
MGRISRIGSFAIASSLNDTNPPQPCITCTTFNILAPIYKRINDEDPTCRESDYRAYWLARNHRILDWLLNEKSSIICLQEFWVGNEELVNLYEKRLGDAGYVSFKLGRTNNRGDGLLIAVQTEYFNIFNYKELHFNDIGDRVAQLLHVELVFPFSKWRNGEIRQEILIVNTHLLFPHDATLSLVRLKQVYKILQYVESYQNDFQLKPMPIMLCGDWNGSKRGHVYKFLRSQGFVSSYDTAHQYTDADADKWVSHRNHRGNICAVDFIWLLNPDKYRKLLKASWSEAVFGMFKDLLRRASLTESDAFAFLRADNEDCITYSGFCEALRQLNLIGHSHELNEEEIKELWVQADIDGNGVLDYKEFLQQIWISSGLDQRDDNKNKEQDDGSNDVQEQTIGFSVKNAVLFPPEVEKGRWPEDYSLSDHARLTVVFSPIRMPCSQMIC

SEQ ID NO: 64606 - protein, 460 aa, Pseudomonas putida KT2440
MNAPFAPQRQTRDYQAADAAHHIHAFLDQKALNAEGPRVIVGGERLHLWDSEGKRYLDGMSGLWCTQLGYGRRDLTAAAATQMDQLAYYNMFFHTTHPAVIELSELLFSLLPGHYSHAIYTNSGSEANEVLIRTVRRYWQVVGQPGKKIMIGRWNGYHGSTLAATALGGMKFMHDMGGLIPDVAHIDEPYWYAEGGELTPAEFGRRCALQLEEKILELGAENVAGFIAEPFQGAGGMIFPPESYWPEIQRICRQYDVLLCADEVIGGFGRTGEWFAHEYFGFEPDTLSIAKGLTSGYVPMGGLVLSKRIAEALVERGGVFAHGLTYSGHPVAAAVAIANLKALRDEGIVRQVKDDTGPYLQRILREVFADHPLIGQVQGAGLVAALQFAEHKPTRKRFANENDLAWQCRTFGFEEGVIIRSTLGRMIMAPALIANHSELDELVEKTRIAVDRTARLVGKL

SEQ ID NO: 64607 - protein, 520 aa, Streptococcus pyogenes MGAS315
MTEISILNDVQKIIVLDYGSQYNQLIARRIREFGVFSELKSHKITAQELHEINPIGIVLSGGPNSVYADNAFGIDPEIFELGIPILGICYGMQLITHKLGGKVVPAGQAGNREYGQSTLHLRETSKLFSGTPQEQLVLMSHGDAVTEIPEGFHLVGDSNDCPYAAIENTEKNLYGIQFHPEVRHSVYGNDILKNFAISICGARGDWSMDNFIDMEITKIRETVGDRKVLLGLSGGVDSSVVGVLLQKAIGDQLTCIFVDHGLLRKDEGDQVMGMLGGKFGLNIIRVDASKRFLDLLADVEDPEKKRKIIGNEFVYVFDDEASKLKGVDFLAQGTLYTDIIESGTETAQTIKSHHNVGGLPEDMQFELIEPLNTLFKDEVRALGIALGMPEEIVWRQPFPGPGLAIRVMGAITEEKLETVRESDAILREEIAKAGLDRDVWQYFTVNTGVRSVGVMGDGRTYDYTIAIRAITSIDGMTADFAQLPWDVLKKISTRIVNEVDHVNRIVYDITSKPPATVEWE

SEQ ID NO: 64608 - protein, 497 aa, Pseudomonas putida KT2440
MYTLEFWQQRASDLYLPAHALIDGKPVNAQDGATFAAINPATNNVLAQVAACGHAEVDLAVASARRAFEQGPWPRMAPGERKKVLLRLAELIMAHREELALLDSLNMGKPVMDAYNIDVPGSAHVFAWYGEALDKLYDQVAPTAANALATITREALGVVAAVVPWNFPLDMAAWKLAPALAAGNSVVLKPAEQSPFSALRLAQLALEAGVPEGVLNVVPGLGEQAGQALGLHPDVDCLVFTGSTQVGKYFMQYSAQSNLKQVWLECGGKSPNLVFDNCQDLDLAAEKAAFGIFFNQGEVCSANSRLYVQRAIHDEFIERLQAKARQWLPGNPLDPASRAGAIVDAGQTGRIEAAIVRAGQEGARLVCGGRRLTIEGSDNYIEPTIFAGVEGRMSLAREEVFGPVLAVSAFDTEEEAVRLANDSIYGLVASVWSDDFNQVHRVARALKAGTVSVNTVDALDVTVPFGGGKQSGFGRDLSLHSFDKYSQLKTTWYQLRG

SEQ ID NO: 64609 - protein, 242 aa, Medicago truncatula
MDPTNNQFNTQNSSDYHFSYQNPNNYQHPNQFPNQHPQNPNQFPNQNPQNMSNFCFSSNFNHPSSVPNNFNLYFRSMMGYPYQTPPFNGYMPMVNENFQSVGEYPEFSSQINRGGMTRDNEVAPTPEDTTPKSKRNQQPSWNTEQNLVLISGWIKYGTCSVVGRNQTSEAYWGKIAEYCNEHCSFDSPRDVVACRNRFNYMNKLINKWVGAYDSAKRMQGSGWSEDDVLKKAQELYGCGKNV

SEQ ID NO: 64610 - protein, 335 aa, Prunus spinosa
SFVSTHLYRNVTKHAHVYLLCLHHPNFECVVDPDDPYLEEEIQWSLFSNETFKLCSKLSHPLGSTNRYGIYGSSNGLVCISDEILNFDSPIHIWNPSVKKFTTPPMSTNINVKFTYVALQFGFHPRLNDYKIVRMMRTNKGALAVEVYTLRTDSWKMIEAIPPWLKCTWQHHKGMFFKGVAYNIIVKGPIFSIMSFDSGSEEFEEFIAPDSICSPSELCIDVYKEQICLLFSFYSCEEEGMVPNDLWVLQEKQWKQLRPFIYPAGSYGTIGISIDNELLKVRRDFLRGVGNLCLCNYESKQLLETGIELAIITYGEIEFLFAITYIESLVLLNNN

SEQ ID NO: 64611 - protein, 311 aa, Prunus spinosa
HPNFECVIDPDDPYLEEELQWSLFSNETFEQCSKLSHPLESTKHYAIYGSSNGLVCISDEILNFDSPIHIWNPSVRKLRTPPISTNINIKFSCVALQFGFHPGVNDYKAVRMMRTNKGALAVEVYSFRTDSWKMIEVIPPWLKCSWQHHKGTFFNGVAYHIIEKGPIFSVMSFDSASEEFQEFIAPDAICRRSALCIDVYKKHICLLCRFYSCEEEGVGKNDLWVLQEKRWKQLCPFRYPLGSYGTMGISIDNELLMERRDFLRGVGHLCLCNYESKKVSETGIELGVMKYGEIEVLFAITYIESLVLLNN

SEQ ID NO: 64612 - protein, 499 aa, Arabidopsis thaliana
MSKYHMSCMLKTNLISSPKHLQPSPGDGHLRPLVEVAKLLVDRDDHLSITIIIIPQMHGFSSSNSSSYIASLSSDSEERLSYNVLSVPDKPDSDDTKPHFFDYIDNFKPQVKATVEKLTDPGPPDSPSRLAGFVVDMFCMMMIDVANEFGVPSYMFYTSNATFLGLQVHVEYLYDVKNYDVSDLKDSDTTELEVPCLTRPLPVKCFPSVLLTKEWLPVMFRQTRRFRETKGILVNTFAELEPQAMKFFSGVDSPLPTVYTVGPVMNLKINGPNSSDDKQSEILRWLDEQPRKSVVFLCFGSMGGFREGQAKEIAIALERSGHRFVWSLRRAQPKGSMGPPEEFTNLEEILPEGFLERTAEIGKIVGWAPQSAILANPAIGGFVSHCGWNSTLESLWFGVPMATWPLYAEQQVNAFEMVEELGLAVEVRNSFRGDFMAADDELMTAEEIERGIRCLMEQDSDVRSRVKEMSEKSHLALMDGGSSHVALLKFIQDVTKNIS

SEQ ID NO: 64613 - protein, 65 aa, Brassica napus
LKNKRAIAEGGANCSLYREADKYCTLISKSLSRGSGGFKLTPITAVVLAAAGAAAGAAAALVVLA

SEQ ID NO: 64614 - protein, 314 aa, Prunus spinosa
HHPNFECHVDPDDPFVKKEFQWSLFPNQTFEECYKLSHPLGNTEHYGIYGSSNGLVCISDEILNFDSPIHIWNPLVRKLRTTPISTNINIKFSYVALQFGFHPRVNDYKAVRMMRTNKSAMVVQVYSLRTDTWKMIEVIPPWLKCTWQHHKGTICNGVAYHIIQKGHILSIMSFDSGSEEFQEFIAPDAICTPSDLFIDVYKEQICLLFGFYGCEEEGMDKIDLWVLRDKRWKQLCPFMFPLDHCHRTIGINADNELLMERRDFIKGITYLCLCNYELKQVLETGIQLAVMKYGEIEYLFAITYIESLVLLNIY

SEQ ID NO: 64615 - protein, 394 aa, Ralstonia solanacearum GMI1000
MDAHRLHTAARLANIRAFHVMELAKQARELELAGRSIIHMGIGEPDFTAAEPVVRAAEAAMRRGVTQYTGALGIRPLREAIARYYHTVYGLDIAPERIIVTAGASAALLLACAVLVEIGGEVLMPDPSYPCNRHFVPAFDGVARLVPSGPQTRFQLSAEQVEANWTDRTQGVLLASPSNPTGTSILPDELRRIVETVRGRGGFSIVDEIYQGLSYDQAPVSALSFGDDVVTINSFSKYFNMTGWRLGWLVAPTELVPQFEKVAQNLFICASAVAQHAALACFEPEALAIYEGRKAEFHRRRDFIVPALESLGFQVPVKPDGAFYVYADCRGVNHPHAGDADALTQSMLNDAGVVLVPGLDFGPYTAHHYIRLSYATAMDHLEEAVARLARLFRR

SEQ ID NO: 64616 - protein, 322 aa, Escherichia coli CFT073
MAKRNNNMDNLDVICIGAAIVDIPLQPVSKNIFDVDSYPLERIAMTTGGDAINEATIISRLGHRTALMSRIGKDAAGQFILDHCRKENIDIQSLKQDVSIDTSINVGLVTEDGERTFVTNRNGSLWKLNIDDVDFARFSQAKLLSLASIFNSPLLDGRALTEIFTQAKARQMIICADMIKPRLNETLNDICEALSYVDYLFPNFAEAKLLTGKETLDEIADCFLACGVKTVVIKTGKDGCFIKRGDMTMKVPAVAGITAIDTIGAGDNFASGFIAALLEGKNLRECARFANATAAISVLSIGATTGVKNRKLVEQLLEEYEG

SEQ ID NO: 64617 - protein, 317 aa, Azoarcus sp. BH72
MRILAADIGGSQSRLLLAELEGEAWRTLRRHTFPSPDFASVEALLDGFLAGGETVAAACLAVAGPVASQRVALTNLPWIVDAAALATRFGLRQVRIVNDFAAQAHGLPALDADGICTLQAGAPVADGLRALMGAGTGLGVALLAGPDAHPRALPSEGGHADFAPRNAEEMALVQDLLPRHGRISLETLLCGRGLERLYRRAAGLADDAPASARAIGEAALAGEPAARDAVALFGRLLGAAAGNLALTSLALGGVYLSGGITPKLLPLLRDGGLREAFCDKPPMRALMERIPLHVVTDELLGLKGAAQLAARLARGLD

SEQ ID NO: 64618 - protein, 347 aa, Escherichia coli CFT073
MKNSKAILQVPGTMKIISAEIPVPKEDEVLIKVEYVGICGSDVHGFESGPFIPPKDPNQEIGLGHECAGTVVAVGSRVRKFKPGDRVNIEPGVPCGHCRYCLEGKYNICPDVDFMATQPNYRGALTHYLCHPESFTYKLPDNMDTMEGALVEPAAVGMHAAMLADVKPGKKIIILGAGCIGLMTLQACKCLGATEIAVVDVLEKRLTMAEQLGATVVINGAKEDTIARCQQFTEDMGADIVFETAGSAVTVKQAPYLVMRGGKIMIVGTVPGDSAINFLKINREVTIQTVFRYANRYPVTIEAISSGRFDVKSMVTHIYDYRDVQQAFEESVNNKRDIIKGVIKISD

SEQ ID NO: 64619 - protein, 361 aa, Gibberella zeae PH-1
MATTTVQITAPAEYTTVQLLTPNGPVSRRVRCGKPRTPTLEEMPIIDLSSIDGDESARKALSTQIKAAAENTGFFYVSNHGIPQDLIEEALQQCKNFFDQSQDDKDRVAFTKAGKFCGYHGVGSTQINNKETKDNKETFSMRYDTRIDPSHDCVDDINSNFDSIDFVWNGTSHLTKFRPVLTEFYQRRLTLARKLIRLFALALELPEDYFDSIITTPGADAVHLHYPGTEETDDIDVGIGSHTDIQCVTLLWQDMSGGLQVLSADDEWLDARPIEGTLVINIGDFLQRLSNNRFKSTVHRVYNRQKASRYAMPFFLGFNPDAVCEVVPTCTDAEHPPLYEPISCGEWRSSRLRLAETGKLN

SEQ ID NO: 64620 - protein, 460 aa, Lactobacillus sakei subsp. sakei 23K
MTQAKKIPSSFIYFFGSFGGILFGYDIGVMTGALPFLQHDWHLENNAGVVGWITSAVMFGAIFGGALAGQLSDKWGRRKMILLSSLIFAIGSLLSAFSPNDGQVYLIAVRVFLGLAVGAASALVPAYMSEMAPARLRGRLTGINQTMIVSGMLLSYIVDYLLKGLPEQLAWRLMLGLAAVPAIILYFGVLRLPESPRFLVKHNRLDEARQVLGYIRSKDEVETELTNIQTTAGMESNVQQSTSMKTLLSGKYRYLVIAGIGVAGFQQFQGANAIFYYIPLIVEKATGKAASSALMWPIIQGVILVLGSLLFLVIADKFKRRTLLTLGGTVMGLSFILPAIMNALIPNFNPMMIVVFLCLYVAFYAFTWAPLTWVLVGEIFPLAIRGKASGLASSFNWIGSFLVGLLFPMMIASMPQEGVFAIFGVICLLGVLFIRTCVPETMGHTLEEIEAQGTNKAHKA

SEQ ID NO: 64621 - protein, 334 aa, Escherichia coli CFT073
MEYMTIKVGINGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDNETGYSNKVLDLIAHISK

SEQ ID NO: 64622 - protein, 301 aa, Escherichia coli CFT073
MKLKDCVMIKKIFALPVIEQISPVLSRRKLDELDLIVVDHPQVKASFALQGAHLLSWKPAGEEEVLWLSNNTPFKNGVAIRGGIPLCWPWFGPAAQQGLPAHGFARNLPWTLKSHREDADGVVLTFELTQSEETKKFWPHDFTLLAHFHVGKTCEIDLEAHGEFETTSALHTYFNVGDIAKVSVSGLGDRFIDKVNDAKEDVLTDGIQTFPDRTDRVYLNPQDCSVINDEALNRIIAVGHQHHLNVVGWNPGPALSVSMGDMPDDGYKTFVCVETAYASETQKVTKEKPAHLAQSIRVAKR

SEQ ID NO: 64623 - protein, 354 aa, Arabidopsis thaliana
MMITRGGAKAAKSLLVAAGPRLFSTVRTVSSHEALSASHILKPGVTSAWIWTRAPTIGGMRFASTITLGEKTPMKEEDANQKKTENESTGGDAAGGNNKGDKGIASYWGVEPNKITKEDGSEWKWNCFRPWETYKADITIDLKKHHVPTTFLDRIAYWTVKSLRWPTDLFFQRRYGCRAMMLETVAAVPGMVGGMLLHCKSLRRFEQSGGWIKALLEEAENERMHLMTFMEVAKPKWYERALVITVQGVFFNAYFLGYLISPKFAHRMVGYLEEEAIHSYTEFLKELDKGNIENVPAPAIAIDYWRLPADATLRDVVMVVRADEAHHRDVNHFASDIHYQGRELKEAPAPIGYH

SEQ ID NO: 64624 - protein, 60 aa, Nicotiana tabacum
TVVSIPNGPSALAVKEAAWGLARYAAISQDSGLVPIVEPEILLDGEHGIDRTFEVAQKVW

SEQ ID NO: 64625 - protein, 327 aa, Zea mays
MAPPHSHRSFRGWQNASHVALVLVLVSVLFLSKARPSAGARSLLELYKPPASALLTYHNGAVLQGRIPVTILWYGRFAPAQKAVVTDFLQSLTTTASPPSPSVSQWWGTIDQLYLSKARSGGGGSAQVALVGQAADEGCSLGKRLALSQLPQLAARAGPAPKGGVALVLTAQDVAVDGFCTSRCGLHGSDAGAGAAYVWVGNAETQCPGQCAWPFHQPLYGPQAPALVPPSGDVGMDGMVVNIASMVAGAVTNPFRDGFYQGDKDAPLEAATACTGVYGSGAYPGFAGNLAVDGTTGASYNANGANGRKYLLPALFDPATSTCSTLV

SEQ ID NO: 64626 - protein, 355 aa, Blastopirellula marina DSM 3645
MVVAPQTAALVQGEMTVAVRVAINGFGRIGRLTFRNLIARGKEFEVVAINDLTDNKMLANLLKYDSTHRRFPGTVEYDSEGLTVNGVKIRVFEERNPAALPWGDMGVDVVVESTGVFTSRKTDAKAGYDSHLDAGAKKVVLSAPAKDAPDLTCVLGVNDHELTADMKTVSNASCTTNCLAPVAKILNDSFGLKNGLMTTIHAYTNDQQVLDLPHADPYRARAAALNIIPTSTGAAKAVGLVIPALKGKLTGISMRVPVPTGSVVDLVANLDKSVTKEEINAAMKAAADGPMKGILCYTEDPIVSSDIIGDPHSSIFAAPQTEVIDGSLVKIVSWYDNEAGYSARTADLVSKLGNM

SEQ ID NO: 64627 - protein, 270 aa, Mycobacterium smegmatis str. MC2 155
MTDPTGRTRLLGVVGDPVAQVRAPELWGTVFRELGVDAVCVPFHVRPTDLEAFLDGARRWRNLDGLLITVPHKAAAMRFATELSDRARQVGAVNCLKVGESGGWVADMLDGVGFVTAFEGGIGPVGGRRALVVGCGGAGSAIALALADAGASAVDVSDVDGARANELADRVSATGVLSRPVAALGRGYDLIVNASPAGMRSTDPLPVDLDGVGGDAAVADVITEPAVTPLIKEATQRGCAVQVGSQMTDAQVGGMADFFGYTAAFADPLR

SEQ ID NO: 64628 - protein, 471 aa, Zea mays
  misc_feature (228)..(228): Xaa can be any naturally occurring amino acid
MGCCGAAMSARPRGIHEETLLRVPGASVHLLAGSSDGPVELARGDLAVVRLTKDDVAVATAVRVGRDLGWPLARDEPVVRLDPLHYLFTLPAADKDGTFLNYGVSFNAGAGADASALASLDGLLRSNACFSAPSSGAVVPPSKGSSRARPQPGPVVASGDGYWNEFAPRVEGYNGVLAKAIAAGTGQLVKGIFMCSEAYASQVLLFLYAAQCPSRALWQVTSPSSGEXLCCASCLTSRTIVGCLQVQRGADLFRPQAAGSARSRFGDAAGGANRNTKPGAVNKSLKRVRKLSEMTEKMSQSLLDTVISVTGSMAAPLIRSKQGRAFLATVPGEVILASLDAINKVMDAVENAEKKSLAATSNVVAGAVSRRYGENAGEATQDAFATAGHAVGTAWNLFKIRKAVTPVRLERRRGNPRRVRDGRPRRGDGVEPLQDPEGRHAIVLHAREHGQERHQEQELTSAPDSCSLCSS

SEQ ID NO: 64629 - protein, 426 aa, Salmonella enterica subsp. enterica serovar Paratyphi A str.
MSKSENLYSAARELIPGGVNSPVRAFTGVGGTPLFIEKADGAYLYDVDGKAYIDYVGSWGPMVLGHNHPAIRNAVIEAAERGLSFGAPTEMEVKMAELVTNLVPTMDMVRMVNSGTEATMSAIRLARGFTGRDKIIKFEGCYHGHADCLLVKAGSGALTLGQPNSPGVPADFAKHTLTCTYNDLTSVRAAFEQYPQEIACIIVEPVAGNMNCVPPLPEFLPGLRALCDEFGALLIIDEVMTGFRVALAGAQDYYGVVPDLTCLGKIIGGGMPVGAFGGRRDVMDALAPTGPVYQAGTLSGNPIAMAAGFACLNEVAQPGIHETLDELTTRLAEGLCEAAQEAGIPLVVNHVGGMFGIFFTDAETVTCYQDVMACDVERFKRFFHLMLEEGVYLAPSAFEAGFMSVAHSEEDINNTIDAARRVFAKL

SEQ ID NO: 64630 - protein, 436 aa, Bacillus anthracis str. Sterne
MNTMQPSAPPHLESTKTIFSNSITKLVVFICWLAILADGYDLGIYGAVLPKLLEDNSWALSPAHAGTIASYALFGMFIGAILVGTITDLIGRKWTLICCLALFSITMGLAALAPSPELFGLWRFIGGIGLGGVIPTASALTVEYSPKKRQSFIYALMFTGYPLGIVLGAILSMFMLEDFGWRIMFGIGMIPLLLIPFIIRYLPESIQFLLSRNRQEEVDKILNRFQIEFYAKDETHQAPSNIRKKNGFLTLFSKEYIKATLLFWITYIMGMFLIYGLNTWLPQMMRQAGYPLGSSLSFLLMLNITAAIGALFAGAIADRIGAKIVISISYLMAAICIGLLTIKPSVSIIYLLIGLAGIGSVGITQILNAYVTQYFPSHIRATSLGWGLGLGRVGAIAGPILVGIIMTMQYDLAWNFYLFSFAGLLAAISVFFIPTK

SEQ ID NO: 64631 - protein, 189 aa, Oryza sativa
MASLTIVVATIFLLSLTSASVAVHGRSSRRRFVRSYDEPCMEMRLYLHDILYDYSNSTSNSTAAAATKPTALANAVPSTGGTFFGEGRALPPSLEETAVRAQGLYLYNSKEAFNAWLAFSIVFNSTGRRGTLNLMGADIIAEKTRDISVVGGTGDFFMSRGVATLRTDAFEGFTYFRLQMDIKLYECYV

SEQ ID NO: 64632 - protein, 352 aa, Zea mays
MQAAASNWTMVASRQSENNAQEEASPLTTPNANIARIIPSLPLETRWPPFPLRRYANFWLPEVTLKEGVPGVHSCFEPRPTDVFLASFPKSGTTWLKALAFATLKRSTHPPFDDDHPLRHCNPHDCVRFLELDFNQQKDELEALPSPRVLATHLPYSLLPGSITGDGERSGCRIVYVCREPKDVLVSSWLFTRKAAPACGVDARSFTIQEALELFCDGRCLGGPQWNHVLHYWKESVRRPDRVLFLRYEEVLIEPEAHVRKLANFMGCGFSEEEEERGVVSAIVELCSLGKLRDMEVNRNGSTLLGIKNESFFRKGVVGDWSKHMTQEMAQRLDKVVEDALQGTGFTFASTA

SEQ ID NO: 64633 - protein, 495 aa, Bradyrhizobium japonicum USDA 110
MMSVAYDFAHSPASEFMARPQHLLIDGRRVPASSGRTFKSLNPATGQVIATVAEGNEADVDHAVAAARRAFEGPWRTMRASERGQILLRWAELLKANAEEIIELESIDAGKPISATLRQDFPAAVDTLIYYAGWADKISGDVVPVRDDALTYTVREPVGVVAAIVPWNFPLMIGMWKLAPALACGCTIVMKPAELTSLSALRIAELALQAGLPAGVFNVVTGPGRVVGDALVNHPDVDKVTFTGSPGVGRGIMKGAAGNFKRVSLELGGKSANVIFDDADLEAASKAAASGIFFNAGQVCSAGSRVLVQEKAYDEVVERLAARAKSLKIGDPLDRKTALGPVISEKQMKSILDYVDIGQKEGASLVTGGTRVGERGYFISPAVFANVEHEMRISQEEIFGPVVSIIKFRDEADALRIANGTAYSLAAGVWSRDIGKLQRFAKRARAGTVWMNTYGYTDVRLPWGGERDSGLGREHGTAALDNFTEPKAVWMNLAV

SEQ ID NO: 64634 - protein, 667 aa, Magnetococcus sp. MC-1
MMELCPKILIVDDRPENLFALHSILKVLRVEIIQAPSGNDALALANEHDFALIYLDIDMPGMDGYEVARHLKSYDKTMNIPILFLTSAYHDEFHSLIAYHAGGIDYIEKPICHEILLAKAKLFLELYINRKKVERTNIILQSEVLRRQATETAYRECESRHEAKRVFIAKMSHEFRTPMNSMIGMLDMLEGTPLSEEQFEYIDSMRQATDHLTSMVGNLLDITQLEAGIIKIKEKPFSLIALVKNVINIIRPLAFKKKILFIPYISPDIAPWFIGDANRLQQILVNLLGNAIKYTHWGSVALLISAKPVNSRYNVEFKVVDTGDGIDLENQEKIFQAFVRGAYNNAETTEGTGLGLSICKNLVDLMQGTIELKSTPQHGSTFSVSIPLTRYTAPVQTGKEKKLQGVNLSILTDHLVQGMLFEEQLTRHGAHSHLCFNGQSIAACFAEEKDTDLLIVHHDNTSKKKLLQGFEKFKQEVTDCKAKILICGRCYQRDDMEALADRGVSIFPDFHDEDELIDKIQSVLGLHKNRKKPDPLDAKKRVLIVDDSEDNRVLLSHYLRDYACEIIQAVDGHEAIDTYIASRHSLDLVLMDLQMPGLDGLSATQKIRAWEKAHRVAKVPIVIISAHATESHRDASLNAGSDAFLNKPIRKKTLKRIAAQFLLHAEP

SEQ ID NO: 64635 - protein, 160 aa, Prochlorococcus marinus subsp. pastoris str. CCMP1986
MIIEHKMAKEKQETELEITNETDTTTELTVEKQGKELIAQTNLSSSNLIKEFEREQLKKQLPEIYVGDTVKVGVKITEGNKERVQPYEGVVIAKRHGGLHQTITVRRIFQGIGVERVFMLHSPQVASLKVERRGKVRRAKLFYLRDRVGKATRVKQRFDR

SEQ ID NO: 64636 - protein, 432 aa, Listeria innocua Clip11262
MDHSMSKKLHDEALLHIVGGVNSPSRSNKGVGGGIPVTMERANGAYFYDVDGNKYIDYLAAFGPIITGHAHPHITEAITKAAQNGVLYGTPTKHEITFAKMLKEAIPSLEKVRFTNSGTEAVMTTIRVARAYTGRDKIIKFAGCYHGHFDLVLVEAGSGPSTLGIPDSAGVTRSTAEEVITVPFNDLTSFKEALAVWGDQVAAVLVEPIVGNFGMVAPAEGFLEAVNELAHENGSLVIYDEVITAFRFMYGGAQNYLGVIPDLTAMGKIIGGGLPIGAYGGRVDIMEKVAPLGPAYQAGTHAGNPASILSGIACLEVLQEEGLYDRFEKYGSMLKEGIEKAAIKHGIAVTVNQIVGALTVYFTDEPVTNYAEAGATNGDLFGRFFKGMLEEGINLAPSKYEAWFITSAHSEADILETIQAVDTVFGKLVQGK

SEQ ID NO: 64637 - protein, 244 aa, Clostridium perfringens str. 13
MDDKINKLKEIIKNSNNIVFFGGAGVSTESGIPDFRSANGLFNEKLNITFTPEQLVSHSFFERYPEEFFNFYKAKLIYPNSKPNDAHIALAKLEEMGKLKAIVTQNIDGLHQMAGSKNVFELHGSVLRNYCVDCHTFYDEKFILESKGVPKCTKCGGIVKPDVVLYEEPLDDNVIRGAIDAISKADTLIIGGTSLVVYPAAGLINYYFRGKNLVLINKSSTQADSKADLVINDSIGKVLGKVID

SEQ ID NO: 64638 - protein, 675 aa, Bradyrhizobium sp. BTAi1
MTATALQKPAAKADPAHAEMANAIRFLAIDAVEKAKSGHPGMPMGMADVATVLFSRFMKFDPADPAWPDRDRFVLSAGHGSMLLYALLHLTGYEAVTIDEIKRFRQWGAKTPGHPEYGHTPGVETTTGPLGQGIATAVGMALAERLMNARYGDELIDHYTYVIAGDGCLMEGISHEAISLAGHLRLNRLIVLFDDNGISIDGSTGLACSDDQLGRFAASGWATSRIDGHDPEAIAAAIAAARQSDRPTMIACRTTIGFGSPGRQGSEKAHGAPLGPEEVEKTRAALHWPHRPFEIPADVLVSWREIGARGHSVRQAWKERARKLCTADRSPCHDALNKKLPAAYTERMAQFIAQLTAERPKIATRQASQNVIDVIATVLPNLLGGSADLTHSNLTKAKTHKSVTPATMDGNYVHYGVREHAMAAAMNGIALHGGFIPYGGTFLAFADYSRPAIRLAALMGIRVIHVMTHDSIGLGEDGPTHQPVEHVASLRAIPNLLVFRPADAVETAEAWDCALRAETSPSVLCLSRQALPAFRTEASDHNKVALGAYVVVEPETRRDVTLIATGSEVAIALEAAKLLAAEGVHAAVVSAPCFELFRQQTAEYRAQVLGNAPRIGVEAAIEGDWARWLGDSGEFVGMQGFGASAPADVLYREFGITPAAVADAAMRNIIRARAS

SEQ ID NO: 64639 - protein, 1437 aa, Ustilago maydis 521
MAVFRQRFRRIRLTTVYECDMLFVGTFAVGKCVSCFLRMSLSACLGCPASKPVGASTITSALLIASVFRAPALSATLHDTAGQSDSVRATTISDSGSLEALRHPFDLSVEACFLIALIITALSIVACARLSSCAYWLPEAFFYPLLVTDDELAWEPTSRQLRGLRPSLEASHTFLPRSHTIQLSRRRHNFFVMRPQHNGRRPTWLATTSLFTALVVIMLVPGTMATHGGIGGTQMLYTSSAVYCSPPEAILISALDLKFYRENRTLEFDISAASVQDDLRVSVSVDVNAYGLGLFSLAIDLCDTIAALCPLPNYQFAGAGVFDVPEQFVREIPSIAFTVPNLEAVATVELTDSNNTVVGCVQATLSNGKTTYQPAAKWAVLGVFGLAVASSVLHTSLASSLGAAQWRVVDVFTTIQHIPMSALLTLNYPKVFLEFARNFAWSIGLINIPAVQRSILSTREKTGGAKDGTFGALLQAESGKQFNPFTSQRLRTSSAATTPSPFSFLTLPAGAQQPNANTSTSTSTYAAYSRLSEPLSFRITNLGKRQIYAPYTGAGGQIAQNVGSNSLPVISSNTPPPNGLGYFAELNNISPASAFLTVLVSLAMLFAALVVIFMVVYVLAAISRLATLRRNGRVAAWSSRLTGRSFWGMFCRPLFGRAVAATLQIYLVFAFWQWLRGDSWVPDMLAAILLVIYLVGIALIYVPVFVASRRLGKDQLFYGSTPPANASAIAQRWGAIAHPFRPKFFWFGLVFLLVYFVRACFISFAQGRGNGLRQSIGLAATDLLFLLVLCICRPGRDKTSDFVMIFLLVFRVLSWGICIALTPLANIETIPRVVLGFALIVFTGIPIVFLFFLTVWDLFSPFIRKRQWSATRIGDSELNGKRDTAYSFGAVGAAAAGAGAEAAAGPGPALRATSNGPSEVDSAVDGVNSDSASSEDGAMTSGRTGLRDGAVPVMSSSLSGQTSKDASNPPPAAVTAESVEHSALAAESHLTAAPPAPQQQPHLSPRPPGPWHANSSVSAASGQTVYYDARTQSTAPRRRRRPICGCGSDVWQSTAQGMQPALFEWALTFSHEWAVVCWAGLGWANSKVTVLYQAKPVALPYVDTDASLTHTLVFVPGLTDTLGTLPYLPRLAALLHSRSWSLVQPQLTCNLGGYGQCTLEGDARELAACISHLHNTKPGGKVVLMGHSTGCQNAIAYLLSSKRAKSARIHGAILQAPVSDREFYEMQRDAAEPCERERMDEQLQLATNLVLQGKGSTLMPRDSIDLATDPDDADDADDADDADDADAQSGVASTPPNGNVSAVLTPAITAYRTWSLKARGGHDDFFSSDLADSAITDTRAGARSIARALHNLRTATPTARMLALIGEKEPSYLNVGRSCSNPQAASKQKSSNRQTTKLPAKSPQTTYCNSSPNSLRNSASSYRLWRPRTSLHTSQRK

SEQ ID NO: 64640 - protein, 480 aa, Pseudomonas putida KT2440
MTLPSSLLTMHRPCVPPCLGNGHAPVAPQLNTISRNEQSMNHSKIPPAAPRMSQGSIGDKLRGAFGVGKTRWGMLALVFFATTLNYIDRAALGIMQPVLAKEMSWTAMDYANINFWFQVGYAIGFLLQGRLIDKVGVKRAFFFAVLLWSLATGAHGLATSAAGFMVCRFILGLTEAANYPACVKTVRLWFPAGERAIATGLFNAGTNVGAMVTPALLPLILAVWGWQAAFIAMGSLGLVWVVFWVLKYYNPEDHPRVRQSEVQYIQQDDEPEPTRVPFSRILRLRGTWAFAVAYAITAPVFWFYLYWLPPFLNQQYSLGINVTQMGIPLIIIWLTADFGSIGGGILSSWLIGRGVRATTARLVSMLIFACTMLSVIFAANASGLWVAVAAISIAVGAHQAWTANIWSLVMDYTPKHLVSTVFGFGSMCAAIGGMFMTQIVGSVLTATNNNYAVLFTMIPAMYFLALVWMYFMAPRKVESA

SEQ ID NO: 64641 - protein, 347 aa, Bradyrhizobium sp. BTAi1
MAREWPMEQSPTLQAHLALQNADADCAAVIEALADAARELARQIAIAPLAGFDEGAATVNADGDVQKALDIVADNLMRDALRKAPVAGILSEEVDRPETVNAAAPLCVAIDPLDGSSNLQNNISVGTIFSIRPRGRDVLSSFFEPGTAQRAAGFFVYGPQTCLVLAIDHRVDLYVLHPTLREFVLARSGLRIPQDTPEFAINASNRRHWSGTVRNYVDECLAGAAGPRGRDFNMRWIASLVAEAYRILMRGGVFLYPADSRPGYREGRLRLVYEAHPMALIMEWAGGSASSGRSRILELSARSPHQRAPLIMGDVRLVRDVDQLHEGVEPLFETSDAPLFARRGLFR

SEQ ID NO: 64642 - protein, 268 aa, Prochlorococcus marinus subsp. pastoris str. CCMP1986
MSTSFKNVTPTGPGGTATLLIVLSFTGFLLLTQSLFVVPSGQVAVVTTLGKVSGGSRRAGLNFKVPFVQSVFPFDIKTQVQPEKFETLTKDLQVIRATATVKYSVKPNEAGRIFATIASRNSDVYQKIVQPSLLKALKSVFSQYELETIATEFNVISEKVASTVAEELNSFDYVDVKSLDLTGLEIAEEYRAAIEQKQIAGQLLLRAKTEVEIAGQEALRYETLNKGLNDQVLFKLFLDKWDGSTQVVPGLPGTSGSMPPVIVGGQSR

SEQ ID NO: 64643 - protein, 168 aa, Avena clauda
VMASSATSVAPFQGLKSTAGLAVSRRSNAGLGSVSNGGRIRCMQVWPIEGIKKFETLSYLPPLSEEALLKQIDFLIRSKWVPCLEFSKVGFIFRVHGSTPGYYDGRYWTMWKLPMFGCTDASQVIKEVEEVKKEYPDAYVRIIGFDNIRQVQCVSFIAFKPPGCEESG

SEQ ID NO: 64644 - protein, 269 aa, Pseudomonas putida KT2440
MIRGSTELVAIVGSPIAQVKSPQNFNTWFNHNNCNLAMLPIDLHEAALDSFADTLRGWQNLRGCVVTVPYKQALANRVDGLSERAAALGSINVIRRERDGRLLGDNVDGAGFLGAAHKHGFEPAGKRALVIGCGGVGSAIAYALAEAGIASITLCDPSTARMGAVCELLGNGFPGLTVSTQFSGLEDFDLVANASPVGMGTRAELPLSAALLATLQPDTLVADVVTSPEITPLLNRARQVGCRIQTGPEMAFAQLGHLGAFMGVTPLEI

SEQ ID NO: 64645 - protein, 392 aa, Bradyrhizobium japonicum USDA 110
MSSAKFDIVVYGATGFTGQLVAEYLAAHYKDDKALKWAMAGRSLDKLKSVREAIGAPADTPLIVADASDAASLKAMVAQTKSVITTVGPYQIYGEELLAACVAGGTDYFDLCGEPVWMRQMIDKYEAAAKASGARIVFSCGYDSVPFELGTFFVQEEAKRVFGAAAARVKGRVRDMRGTLSGGTAASAKATFDAVAKDLSLVAILNDHFALTPGFAGPKQPKGNKAAFEEDLQSWAAPFMMALINTRNVHRSNMLMGFPYGQEFVYDEMVLTGPGEKGEANAKRVMAVNAEKTGPKAPKPGEGPSKEERENGLFNLLYVAIAPDGRMVRAGVTGDRDPGYGSTSKMISECAICMLRDTPDVAAGFWTPGAAMQHRLIKRLQDHAGLTFEVEG

SEQ ID NO: 64646 - protein, 213 aa, Cryptococcus neoformans var. neoformans B-3501A
MTDGSNYDYLFKVVLIGDSGVGKSNLLSRFTRNEFNLESKSTIGVEFATRSINVDGKTVKAQIWDTAGQERYRAITSAYYRGAVGALLVYDIAKHQTYENVTRWLKELRDHADANIVIMLVGNKSDLKHLRAVSTDEAKQFATENGLSFIETSALDASNVESAFQNILTDIYRIVSSKSLESSGDVIKPSGGETILVAPTADDGGAKSGSKCC

SEQ ID NO: 64647 - protein, 652 aa, Candidatus Pelagibacter ubique HTCC1002
MNKLHKDLSNAIRFLSIDAVQKANSGHPGMPMGMADVATVLFKNFLRFNPKNPNWINRDRFVLSAGHGSMLLYSLLHLTGYKSISLNDVKNFRQLKSICAGHPEYHPGTGIETTTGPLGQGIANSVGFAIAEEILKKKLGKEIINHKTYVLAGDGCLMEGISHEAMSLAGHLKLKNLVMLFDNNSISIDGPTSLAVSDNFKKRFESYGWDYILINGHNEREIFSALKKVQNAKRPTVISCKTKIGYGSPNKSGKASSHGSPIGLDEIKLVRKVLDWKHKPFEIPKSILNEWKKIGNKGAKLDSAWSKIYKRKKNLVDKVFKNNFSKALKSEKQNSLRENKSLASRKASELTLNALTRENNTLIGGSADLAGSNNTKTKYHNAINSVNFNGDYIHYGVREHAMAGIMNGLALHSKFIPYGGTFLIFSDYCKPSIRLSALMQQRVIYVMTHDSIGLGEDGPTHQPIEQLSGLRSIPNLNVFRPADRMETIECWELALKNSKTPSVLSLTRQNLEPIRKKYSNMNKCSLGAYEVSRTNKKINLTIFASGSEVNLAIETSHKLAKDKIYSKVISVPCQDIFDLQSKAYKKKILNEAKFKISIEAASTDCWKKYIGTEGLAFGIDTFGKSAPYKEIYKYFGLTVQNISQKAKKLIKS

SEQ ID NO: 64648 - protein, 439 aa, Oryza sativa (indica cultivar-group)
MAVEYHCCGAAFFEHVVIIVVLVLFAGLMSGLTLGLMSLSLVDLEVLAKSGTDQDRKHAAKILPVVKNQHLLLCTLLICNAAAMEALPIFLDSLVTAWGAILISVTLILLFGEILPQSICSRYGLAIGASVAPLVRVLVWVCFPVAYPISKLLDHLLGKGHTALFRRAELKTLVTLHGNEAGKGGELTHDETTIIAGALELTEKKAKDAMTPLCQTFAIDINAKLDRDLMQKVLDKGHSRVPVYYEKKTNIIGLILVKNLLSINPDDEIPIKSVTIRKIPRVSEDMPLYDILNEFQKGHSHMAVVIRQTNANYAAEPPANDGGTLAFYLTIFSLFSFFLSMWNKEVAISIDDKHGEKVVKNLPPLRRWKSCPNSQNSNRGNRNRKWSKDQSDVLQIHEEPLPTLNEDEEAVGIITMEDVIEELLQEEIYDETDVHVEEQ

SEQ ID NO: 64649 - protein, 335 aa, Candidatus Pelagibacter ubique HTCC1002
MTIKVGINGMGRIGRMVIRAIIESQNKNIEIKHINNRSNSEASCSLIKYDSIHGKFNADLNYDEKHLIINNDKITFSQESNIKDINWKKFDVDYVFECTGKFNSKEKLLTHIKNGAKKVIVSAPCKNADKTIVYGVNENILTKDDQIVSAASCTTNCLAPVANILNETFEIEKGFMTTIHAFTSDQRILDNSHKDPRRARSASQSIVPTSTGASKAIGEIIPSLKGKLEGIAMRVPTPNVSLIELVFCTKKEMSKETINEAFTIASKEQSKKVLEVTLEKLVSIDFNHNSASAIVDLSLTNVVGKNMGKISAWYDNEWGFSNRMCDIAEHLHQVS

SEQ ID NO: 64650 - protein, 173 aa, Arabidopsis thaliana
MANQGAKKRKEENAKHMAKLRRIIIASNAVYFVVRMLIFYSSFTWKHWIGLVITSLAYAFPYKQLDQMAKPSVTDDGELIDGGFDMTTGGICGYLHDVIYITCFVQLASIISGKFWYTYLVIPAFGVYKASGLIRGFMSQGSEGGVEDEKSRKKREKMERKASRGQVVKTRTR

SEQ ID NO: 64651 - protein, 566 aa, Kluyveromyces lactis
MSELETGTAAHGTPVENKSVSSSQASTPTNVGSRDDLKVDDDNHSVDAIELPKKPRSAYITVSILCLMVAFGGFVFGWDTGTISGFVNQTDFIRRFGQEKADGSHYLSNVRTGLIVSIFNIGCAIGGIILSKLGDMYGRRIGLMIVVLIYVVGIIIQIASIDKWYQYFIGRIISGLGVGGISVLSPMLISETAPKHIRGTLVSFYQLMITFGIFLGYCTNYGTKTYSNSVQWRVPLGLCFAWAIFMITGMLFVPESPRFLVEKDRIDEAKRSIAKSNKVSYEDPAVQAEVDLICAGVEAERLAGSASIKELFSTKTKVFQRLIMGMLIQSFQQLTGNNYFFYYGTTIFNSVGMDDSFETSIVLGIVNFASTFVAIYVVDKFGRRKCLLWGAAAMTACMVVFASVGVTRLWPDGANHPETASKGAGNCMIVFACFYIFCFATSWAPIAYVVVAESYPLRVKAKCMAIATASNWIWGFLNGFFTPFITSAIHFYYGYVFMGCLVAMFFYVFFFVPETKGLTLEEVQEMWEEGVLPWKSSSWVPSSRRNAGYDVDALQHDEKPWYKAML

SEQ ID NO: 64652 - protein, 390 aa, Zea mays
MPPLRGAKRRRKAALEKKAAAVAMASAAAGDPPGDWWEAFCIRMSGTLSSIEDAQRFESIFKMPRRAFDYVCNLVRDEMMVRSCSYTFLDGTVLCLEDRVAIALRRLNSGGSLVTVGSSVGVNHSTVSLITWRFIEAMEERASHHLRWPDSIEMEKIKSKFEKIHGLPNCCGVVDTTHITMCLSSAEPNCKVWLDQEKNYSMVLQAVVDLDTKFTDIVTGWPGSMKESSILHSSGLFKLCEKGERLNGSKLKVSDGSEIGEYLIGDSGYPLLPWLLTPYQEKDLTESSAEFNIRHSSARTVAPRTLAKFKDTWKFLQGEMWRPDKHKLPRIIHVCCLLHNIIIDLQETAVDEAQAWPSDHDAKYRQQVCQLADENGVRVRDKLSQHLISK

SEQ ID NO: 64653 - protein, 433 aa, Prochlorococcus marinus subsp. pastoris str. CCMP1986
MTDILKTTYSEEVFSSALELMPGGVSSPVRAFKSVGGQPIVFDRVKGPYAWDIDGNRYIDYIGSWGPAICGHAHPEVITALQEAIEKGTSFGAPCVLENKLAEMVIDAVPSVEMVRFVNSGTEACMAVLRLMRAFTGRDKVIKFDGCYHGHADMFLVKAGSGVATLGLPDSPGVPRTTTANTLTAPYNDLEAVKKLFSENPDAISGVILEPIVGNAGFITPEPGFLEGLRELTTENGSLLVFDEVMTGFRISYGGAQEKFGVTPDLTTLGKVIGGGLPVGAYGGKKEIMSMVAPSGPVYQAGTLSGNPLAMTAGIKTLELLKQEGTYEKLESTTSRLIEGIIQSAENNGIAINGGSVSAMFGFFLCEGPVRNFEEAKTNNSELFGKLHREMLKRGVYLAPSPFEAGFTSLAHSEEEIDRTLEAFDQSFSVIKN

SEQ ID NO: 64654 - protein, 1444 aa, Aspergillus oryzae
MEFHLHDEALPASTAPTEYGDQSGEEFEAYSGKPTLGVPDNNVREATSAETLAVHGSPHITPPPGRDAEWSMTDQVIRNKERSEAAGYKKRELGVTWQNLTVEVLAAEAAVKENQFTQYNIIQLIQDWRRKPPLKAILQDSHGCVKPGEMLLVLGRPGSGCTTLLKMLANRREGYHSVHGDVSFGNMNSEEAAHYRGQIVMNTEEELFYPRLTVGQTMDFATKLKVPAHLPAETKSVHDYVAETKQFLLESMKIAHTADTKVGNEFVRGVSGGERKRVSIIECMATNGSIFTWDNSTRGLDASTALEWAKALRAMTNVMGITTIVTLYQAGNGIYNLFDKVLVLDEGKQIYYGPAASAKPFMEDLGFVYSDGANVGDYLTGVTVPTERKIRPGFENRFPKNAEAILAEYQRSTLYQTMTREYDYPSSDAARQRTEEFKESVAWEKAKHLPNSSTLTVGFWDQLIACTIRQYQILWGEKSTFLIKQVLSVAMALIAGSCFYNSPDTTAGLFTKGGAVFFALLYNCIVAMSEVTESFKGRPVLIKHKSFAMYHPSAFCLAQITADLPVLLVQCTLFAVVIYWMTGLKHTAAAFFTFWAILFTTTLCITALFRCIGAGFSTFEAASKISGTAVKGIVMYAGYMIPKGHIKNWFLELYYTNPFAYAFQAALSNEFHGQTIPCVGNNLVPSGPGYENVSSANKACTGVGGALPGADYVTGDQYLLSLHYKHSQMWRNYGVLWGWWGFFAVLTVICTCFWKGGAAAGASLLIPREKLKAHRAHLDAEAQKEKDPAREKGSGDALTSADEGNLTHNTSIFTWKNLTYTVNTPTGERVLLDNIHGWVKPGMLGALMGSSGAGKTTLLDVLAQRKTEGTIKGSILVDGRELPVSFQRMAGYCEQLDVHEPYATVREALEFSALLRQSRDTPREEKLKYVDTIIDLLELHDLADTLIGTVGNGLSVEQRKRVTIGVELVSKPSILIFLDEPTSGLDGQSAYNTVRFLRKLADVGQAVLVTIHQPSAQLFAQFDTLLLLARGGKTVYFGDIGDNGAAIKQYFGKYGASCPIEANPAEFMIDVVTGGIEEVKDKDWHQIWLESPEHEHMMVELDQLISDAAAKPPGTHDDGYEFSMPLWDQVKIVTHRMNVALFRNTNYVNNKFSLHIISALLNGFSFWHTGPSVSALNLKMFTIFNFVFVAPGVINQLQPLFIQRRDIYDAREKKSKMYSWVAFVTGLIVSEFPYLCVCAVLYFACWYYCVRLPHDSNRSGATFFIMLIYEFIYTGIGQFVAAYAPNPTFAALVNPLIISTLTLMCGIFVPYSQLTVFWRYWMYYLNPFNYVTSGMLVFGMWGAKVTCNEDEFAIFDPVNGTCGDYLADYMAGSGSRINLTNPDATSGCRVCEYRSGSDFLTTLNINHYYYGWRDAGICVIFAISGYALVFALMKLRTKASKKAE

SEQ ID NO: 64655 - protein, 277 aa, Oryza sativa (indica cultivar-group)
MAAAAETSAKVGAPRRWSLQGKTALVTGGTRGIGRAVVEELAALGATVHTCSRKEEELSERLKEWEARGFRVTTSVCDLSVRDQRERLLRQVADLFGGKLDILVNNVGTNIRKPTTEFSAEEYSFMMATNLESAYHLCQLSHPLLKASGSGSIVFISSVCGLVAVFSGSLYAMTKGAINQLTKNLACEWARDNIRSNSIAPWYIRTSLTEGLLANKDFEGAVVSRTPLRRVGEPEEVSSLVAFLCMPGSSYITGQTISVDGGNRYKSSVRMMVLAEQ

SEQ ID NO: 64656 - protein, 308 aa, Oryza sativa (indica cultivar-group)
MAEAVASGAAGRWTLRGKTALVTGGTRGIGYSPQHPSLVLPSRYPVRSETSTAEPLLLFHDQRGEFMRRHAVVDELAALGAAVHTCSRKEAELGERLREWEGKGFRVTGSVCDVSVREQRERMLREVAGLYGGKLDILVNNVGTNFSKQTTEYSADDYSFIMATNLESAYHLCQLAHPLLKSSGSGSVVFISSVSGVVAVSSGSVYAMTKGAMNQLAKNLACEWAKDNIRTNSVAPWYMKTSLVEDELARKDFADSVVRRTALKRVGEPEEVSSLVAFLCMPGASYITGQTISVDGGMTINGLYPTQD

SEQ ID NO: 64657 - protein, 199 aa, Triticum aestivum
  misc_feature (56)..(56): Xaa can be any naturally occurring amino acid
  misc_feature (91)..(91): Xaa can be any naturally occurring amino acid
MSASRFIKCVTVGDGAVGKTCMLISYTSNTFPTDYVPTVFDNFSANVVVDGNTVNXLGLWDTAGQEDYNRLRPLSYRGADVFLLAFSLISXKASYENVSKKWIPELKHYAPGVPIILVGTKLDLRDDKQFFVDHPGAVPITTAQGEELKKLIGAPYYIECSSKTQLNVKGVFDAAIKVVLAPPKAKKKKKAQRGACSIL

SEQ ID NO: 64658 - protein, 723 aa, delta proteobacterium MLMS-1
MKATNIKKSALALTIIALAGAFFWFDLHHWLTLENIRGFQEQARDFYGQRPLSAVAAFAGVYLLVVALNLPGGALLGLLAGAVFGVLVGTVVVSFASTIAATVACALSRYLFRDLVRARFPQVLASVDKGMAREGPFYLFSLRLIPAVPFFVINMVMGLTAIPLRTFYWVSQLGMLPGTLVFVNAGGELGRLTSTGDIFSFRLLLAFALLGILPWAANRLLGWYRKRVNKQPHPIFGQAARLTEGTDFKSVPDYAVPGCKTSPGARLFVYSPLNQQVIAPGERLRKRSGQGGKNEGDGARQPTAPPPLVEQAASLASHCTRCGACAARCAFLQEYGLPGDIAAAWAAGSGKVDPFACSLCNLCAAVCPEQLEPGIFLLELRRRAATAANFDLRPYRPLLSYERLGGSWLFATRRLPAGCRTVFFPGCSLPGTRPQSTRRLIHRLREQVPNLGLVLDCCHKPSHDLGRQEYFNERFAALRQSLQQKGVEEILVACPNCYKVFTQYGGRLRVKSVWELLAAELPGADRQPAERRPEAGGPQTNRGERARSNVHRPLNQHPAGPGEWLANSRGARPVETGPVETGPVETAAARVTIHDPCPLRHLPELQQAVRRLALSHGLEVMEMKSSGRRTICCGEGGAVARVRPELAADWGRLRQKQADGLPVLTYCAGCAGFLKRAGMTTIHLADLLADPAAALNGTAPVASGPRTYLNRLLLRWRKDPAGS

SEQ ID NO: 64659 - protein, 448 aa, Mesorhizobium sp. BNC1
MTDSTSDVANGWKGRSSAPSMSDVHRSVPVQGMHSSWRRAAAFIGPGYLVAVGYMDPGNWATSIAGGSRFGYTLLVVALISNIMAIILQSLCARLAIASGRDLAQACKDAYPKSVSRTLWVLAEIAIIATDIAEVIGTAIGLNLLFGIPLEIGVVITALDVFLILYLQRLGFRWVEALVIALLAVIAVCFVLQIVLADPNWGDVIRGFAPTTEIVTNPEMLYLALGILGATVMPHNLYLHSGIVQTRNYGDSLPEKREALKFATIDSTVALMFALCVNASILILAAATFNTTGRTEIAELGEAHSLLAPMLGAAIAPTLFGIALLCCGINSTVTATLAGQIVMEGFLDIKLPPWLRRLITRAIAIIPAAAITIWYGESGTAQLLILTQVILSLQLSFAVFPLVMFTADRKKMGELVAPRALVAVAFFIAFAIAALNVTLLFDFLAPPA

SEQ ID NO: 64660 - protein, 483 aa, Triticum aestivum
MEEEQHRQDSEAPLLAASKPDGAASSSPPRNRFPFFCAVLASMTSVLMGYNVAVMSGAQIFMAEDLGVSDTQIELLSGAINIYSLVGALLAGWTSDRLGRRLTIVLTNGFFLVGPLIMTLAGGYTALMAGRFISGIGVGYALVIAPIYAAEIAPASSRGLLSSLPEIFINTGVMLSYVSNFAFSALPAHLAWRLMFAAGVVPTVFLAAGVLTMPESPRWLAMKGRLDEAKAVLDRTSDTLADAEQRLLEIEEVVDAGSNGGGSTWNEVATKAGVSRVLATVLALQFFQQASGIDSVVLYGPRVLATAGVTSNTLLLGLNVLFGVAKAGSILIAMALADRVGRRPLLLVSTGGMTASLLVLGSVFAAFAGAKDDAAVAAVAVAAVVAFVCTFSVGFGPMAWVYSSEILPLRLRGQGAGLGTAMNRVMSGIVTMTFISLYGAITMAGAFYLYAAVAAASFVFIYTCLPETRGRNLEDMEQLFRTK

SEQ ID NO: 64661 - protein, 392 aa, Candidatus Pelagibacter ubique HTCC1002
MRNIQDETNLNQKKVLLRLDLNVPLDNGKITDTTRIDKILPTINFLLKNEAKIIILSHVGRPKGKVVSELSLKPICEDLKNKLNENIRLISKNIKEINSNDLFNEQDEKIVTLENLRFYEEEEKNDNGFAKHLASLADIYVNDAFSCSHRAHASIFEITKFIPSYAGLQLNLEIDALTKITSEIQRPITCIIGGSKISSKINIIKNLITKFDNIVIVGGMANNILKYKECEIGKSIQEDNCDKIIEEIFSLSKKENCKIIYPEDVAVGKSLEGSAEIKELNNISKDELILDIGPKTIKAINLLIEESSTILWNGPAGYFENPNFAKGSIEIAKKIIEKNKNNTIYSVAGGGDTVSLLNGIGAINNFNFVSTAGGAFLEYLEGKELPGIKALN

SEQ ID NO: 64662 - protein, 336 aa, Candidatus Pelagibacter ubique HTCC1002
MSELNKIALKILSNGKGILAADESNGTMTKRLESVNVPSSPGNRLLFRETLFSSSGMKDFIGGVILYDETINQTSNSKQTIPELISKSGAVPGIKVDTGAKILAGSIEEKITEGLDGLRERLKDYYKLGARFTKWRGVFNISDKYPSKLSMHSNAHALARYSALVQECGMVPIVEPEVLMDGDHSAETCFNKTSEVIKRCFEELMINKIDLSGIILKPNMILAGTTADKKISSEEVAKLTLKCLKENVPTDVPGIAFLSGGQTEVEATENLNLINKYNDTNFIMTYSYGRALQQSALKFWSKDINNTSGTQKIFNHRANMCTLAAQGKWSKELEAE

SEQ ID NO: 64663 - protein, 236 aa, Zea mays
  misc_feature (21)..(21): Xaa can be any naturally occurring amino acid
  misc_feature (85)..(85): Xaa can be any naturally occurring amino acid
  misc_feature (98)..(98): Xaa can be any naturally occurring amino acid
  misc_feature (102)..(102): Xaa can be any naturally occurring amino acid
  misc_feature (127)..(127): Xaa can be any naturally occurring amino acid
  misc_feature (135)..(135): Xaa can be any naturally occurring amino acid
  misc_feature (147)..(147): Xaa can be any naturally occurring amino acid
  misc_feature (208)..(208): Xaa can be any naturally occurring amino acid
MATRLLLTALLLDFLLDAPLXQPDLRRTYSEEDAAAADAGGRADLCIVAYDTQVCSDGPLTPAPGVETAMALPTYAGKIGLSGEXTDLLRGLQKEVEXSLNXIAVHSTLHLPWDHNMYGQNLTVQNXLNASTPVXSVQATLPYKFRXSKILLPGAYYLSGIIVDESDQKPYQNVIYTGTIVGILAVSYCTLSIEFLIHAGNRSIELFXTWAYRQCQQLSKKADLALQVELGIWTTD

SEQ ID NO: 64664 - protein, 676 aa, Corynebacterium glutamicum ATCC 13032
MDTKAVDTVRVLAADAVENCGSGHPGTAMSLAPLAYTLYQRVMNVDPQDTNWAGRDRFVLSCGHSSLTQYIQLYLGGFGLEMDDLKALRTWDSLTPGHPEYRHTKGVEITTGPLGQGLASAVGMAMAARRERGLFDPTAAEGESPFDHHIYVIASDGDLQEGVTSEASSIAGTQQLGNLIVFWDDNRISIEDNTEIAFNEDVVARYKAYGWQTIEVEAGEDVAAIEAAVAEAKKDTKRPTFIRVRTIIGFPAPTMMNTGAVHGAALGAAEVAATKTELGFDPEAHFAIDDEVIAHTRSLAERAAQKKAAWQVKFDEWAAANPENKALFDRLNSRELPAGYADELPTWDADEKGVATRKASEAALQALGKTLPELWGGSADLAGSNNTVIKGSPSFGPESISTETWSAEPYGRNLHFGIREHAMGSILNGISLHGGTRPYGGTFLIFSDYMRPAVRLAALMETDAYYVWTHDSIGLGEDGPTHQPVETLAALRAIPGLSVLRPADANETAQAWAAALEYKEGPKGLALTRQNVPVLEGTKEKAAEGVRRGGYVLVEGSKETPDVILMGSGSEVQLAVNAAKALEAEGVAARVVSVPCMDWFQEQDAEYIESVLPAAVTARVSVEAGIAMPWYRFLGTQGRAVSLEHFGASADYQTLFEKFGITTDAVVAAAKDSING

SEQ ID NO: 64665 - protein, 621 aa, Cryptococcus neoformans var. neoformans B-3501A
MDNTVAPSKGKKPGGARPNPGTRPESGGPARPTGAGGVPKLSIPPDNVPGMHVDQAGQGGWHQPSSLPSLALRPMRPSPTPSSSSRPKLSLTPLTPTIPASSSSAPSSASPAPPNRPALLNAHSARGYGERNTPSLKLSIPGASSVGPGFSTEHDYPLELPDDTDALSSELKTPTPGRPAGGGLNLSLSSLSLTSSEDANPTLQARGRDYDEGESSYGYGCVGNGLIGPGGDAISAMTEDIRQALSRNRFETGSDRGGARSRAGSLMSDSSRATAGRDRSDSASLYNAASRRESPSASLSGGSARQSLDLPRAAEEVNEHKESPVFDPEGLVMMRRLGEGTGGSVDMVQDRATGRIMAKKVITRTSNPMVHKQLLRELEILNSCASPFIVEHYGSFLADHDSSIGILMEYCEAGSLDSLLGKMKKKSMRCSEHVLGRVASSVLKGLDYLHQRRIVHRDIKPSNILITRQGAVKLCDFGVSGELVESLAGTFTGTSFYMAPERIQNKPYSIKADVWSLGMTLHEIAHLRFPFPPEGENQSVAPIELLSYIVTAPVPVMIDDLSVGRVWSEPIKDFMGQCLIRSGTDRPYPWQLLQHPFIVASEAKKVNMAKWVAALCNWPLS

SEQ ID NO: 64666 - protein, 450 aa, Trichoderma viride
MLPKDFQWGFATAAYQIEGAVDQDGRGPSIWDTFCAQPGKIADGSSGVTACDSYNRTAEDIALLKSLGAKSYRFSISWSRIIPEGGRGDAVNQAGIDHYVKFVNDLLDAGITPFITLFHWDLPEGLHQRYGGLLNRTEFPLDFENYARVMFRALPKVRNWITFNEPLCSAIPGYGSGTFAPGRQSTSEPWTVGHNILVAHGRAVKAYRDDFKPASGDGQIGIVLNGDFTYPWDAADPADKEAAERRLEFFTAWFADPIYLGDYPASMRKQLGDRLPTFTPEERALVHGSNDFYGMNHYTSNYIRHRSSPASTTPSATSTCSSPTSRATASAPRRSPPLAPVRPAATSWCGSARGTYPPIYVTENGTSIKGESDLPKEKILEDDFRVKYYNEYIRAMVTAVELDGVNVKGYFAWSLMDNFEWADGYVTRFGVTYVDYENGQKRSPRRAQRA

SEQ ID NO: 64667 - protein, 245 aa, Oryza sativa (japonica cultivar-group)
MPPPRLANRYFLVRAGESVYEGQGVVRTNPVSKTSVDSGLSPAGLRQAARAALELQRLGACEDDCWIWPSITQRAYQAAEIIAAANEINRSHIVPEYSFLDARGLGAFEGKSLETLPEVYASDSISPDIKPPPISDGTPNESVADVFVRVTQLMSILETQYSGDTVVIVSPDSDNLSILQAGLIGLDLRSSSYRPMGKGVHCGNPAHLVTLFTIQFTDPLLLVNHAQGYVQYNLHQGVVQSRYKL

SEQ ID NO: 64668 - protein, 286 aa, Pseudomonas aeruginosa UCBPP-PA14
MSEQRQTLPAQHQDQRPGHESEMQPKPEFVSADYRPAAKLEGKVALVTGGDSGIGRAVAVAFAREKADVLLVYLDENEDAAKTREIIESLGRQCLAFAGDVADAGFCRQVVDTLRQKWGRLDVLVNNAGEQHPQARLEDISEEQWEKTFRTNIFGMFQLTKAALPLMGKGGAIINTTSITAYKGNPQLIDYSSTKGAITSFTRSLSMNLVNRGIRVNAVAPGPIWTPLIPSTFSAEKVAHFGADTPMGRPGQPEELAASYVYLACNDSSYVSGQVLHVNGGTVVNG

SEQ ID NO: 64669 - protein, 304 aa, Oryza sativa (japonica cultivar-group)
MEDRDRDHRGGADEDAPGPAAAAVAAVDGEDEVEDDGGGFSFPVPPFAADAFIVPVYPVFGRPMSPPPREAVVEEEEEDEPETATLRVPLGRLLLEEREFRARQRESSGTSPVQPQRRRPDDEGELEGVPPESYCLWAPGGQPSTTPASPRRCRKSGSTGSVLRWRRISERLVRRSHSDGKEKFVFLNAPGGGAPSPHPPKDNDDANGGGSVGKGDAGRHGWSYYSKGGGGGSGGRRRSYLPYKQELVGLFANVRGLASAVGSRRHARRSKARGNKAATRGNAPTSRPTPTPSDGSNLTKSAGL

SEQ ID NO: 64670 - protein, 217 aa, Oryza sativa (japonica cultivar-group)
MDRLQQQRRRHEALTGRRRGGGGGMSRRHGRFRFATGGGDGDGDEECAGVAVVDQADCTAQSCRSCVAVSLADCIALGCCPCAVVSLLGLAFVKLPLAVARRCARRLRRRQGRLRQKKRVRDLDAAKNAAGGGHQEPLPGGAAAASKGEDGDVVVVAAAAAASPGSDDAENVWLELYQVGRWGFGRLSVSAANPPVRPSYVVATARNADCAADGDVS

SEQ ID NO: 64671 - protein, 583 aa, Escherichia coli CFT073
MLTVCLSLGVAMTTNAHFRGEELKKVWLNRYPADVPTEINPDRYQSLVDMFEQSVARYADQPAFVNMGEVMTFRKLEERSRAFAAYLQQGLGLKKGDRVALMMPNLLQYPVALFGILRAGMIVVNVNPLYTPRELEHQLNDSGASAIVIVSNFAHTLEKVVDKTAVQHVILTRMGDQLSTAKGTVVNFVVKYIKRLVPKYHLPDAISFRSALHNGYRMQYVKPELVPEDLAFLQYTGGTTGVAKGAMLTHRNMLANLEQVNATYGPLLHPGKELVVTALPLYHIFALTINCLLFIELGGQNLLITNPRDIPGLVKELAKYPFTAITGVNTLFNALLNNKEFQQLDFSSLHLSAGGGMPVQQVVAERWVKLTGQYLLEGYGLTECAPLVSVNPYDIDYHSGSIGLPVPSTEAKLVDDDDNEVPPGQPGELCVKGPQVMLGYWQRPDATDEIIKNGWLHTGDIAVMDEEGFLRIVDRKKDMILVSGFNVYPNEIEDVVMQHPGVQEVAAVGVPSGSSGEAVKIFVVKKDPSLTEESLVTFCRRQLTGYKVPKLVEFRDELPKSNVGKILRRELRDEARGKVDNKA

SEQ ID NO: 64672 - protein, 566 aa, Coccidioides immitis RS
MAWRNQGITGSNNIPLGRRRFGGDEADMSDTTTPASAVADAGMKRGRSPVRADPPSDGIKKRKKRNRWGDAQENKAAGLMGLPTLIMANMTNEQLEAYTLHLRIEEISQKLRINDVVPADGDRSPSPAPQYDNFGRRVNTRENRYRKRLEDERHKLIEKAMKVIPNYHPPSDYRRPTKTQEKVYVPVNDYPEINFIGLLIGPRGNTLKKMEAESGAKIAIRGKGSVKEGKGRSDAAHTSNQEEDLHCLIMADTEEKVNKAKKLIHNVIETAASIPEGQNELKRNQLRELAALNGTLRDDENQACQNCGQIGHRKYDCPEQRNFTANIICRVCGNAGHMAKDCPDRQRGTDWRNHGPSMRKGIGDAVDREMEQLMQELSGGAPSGSGEAPRRIEAGPGGYDQGNKYGEQRDLKPWQRGPTGGPAPWQRRDDRRDDQGHRDHGAAPPWAAGGGHGDRGDQVERGDSYGYGSHSAGYGAAPGAAAPWQQQAPPPPPGGQAAYGYGYPGFSGAQTMGAPPGLSGVPPPPPGMGSMYSGYPGANPPPPPPPADGPPPPPPSEQPPPPPPPA

SEQ ID NO: 64673 - protein, 112 aa, Gibberella zeae PH-1
MSTKTPINTTEAPKALPGIYNQAIVANGLVFCSGVVALDSDTMKIKEGDVKAHTHDIIKNLSVILEAAGTTIDRAVKVNVFLSNMEDFAAMNEVYMQYWGDVKPCRTLRSRG

SEQ ID NO: 64674 - protein, 574 aa, Ustilago maydis 521
MAAFSTTDEAVLTAPLELNPLAQSATASSSGRSIYYVYDILSTAAKIHSGGFKRVALQFPDEALVDSVPVYWALKSETRKLYSADAQSANTASVSTSTSALGSNDGLPQLYILADTSYGGCCVDEVAAKHVDADLVVHYGHACLSATARLPVIYVFTKQPLEDVSAAATSLAEETSRNICSGDPSTDIEALVLTYDVSWDHVIDDVFHATQQALKEQGVTLPLVRTHVDFRRNYEDKLYNAESVASGAALSSECGGAVGGSCCNGVQQVAPSSCCNGSTCVSANSTSTEFCATPTSRLTSTCPSSASSVSQLIKEIGSDRSSQLLGPSRSVTLPPGIDLSQCGYLYLGPESLSLTNLLLTLGAATRLISYNPLTGRSRVETGSTNRLLMKRYACVLKARDASVVGLLVGTLGVHSYLPLLKYLRQLLTAKPSRRKVYTISVGKLNPAKLANFQEIDVFVLVACPENTLVDSKEFFRPIVTPFEMELAVKAAQRHELGQEGVDWSGKRKFNAKSTSSTSTLPTPQQDELQMIANQAGGANEDQRPTHHGARDRVDCTSEKAWLEGFRTETGNGRA

SEQ ID NO: 64675 - protein, 674 aa, Synechococcus sp. RS9917
MCGIGGVFSAQAHQRVDPQLLVNMAAIQEHRGPDGFGYRSLDDAGVGFCHARLSIIDLNETRARQPFLSEAAGPGARLLMAHNGEFYDFQRIRADLTARGVRFDSKSDSEILLRLYEQQGLEATLPQLRGEFAFAIYDEADDALHLVRDRFGIKPQYWALTPAGLVFGSELKVLFAHPAVERRFTSEGLFHQLMQTMVPGTTAFAGVHQVPPGHGITVRRRDGQLTVEHWKYWDLDFPRQGERDASITEQEHIDAIRAALLDAVELRMVADVPVGCYLSGGIDSCSILGLAAAVSQNPVKAFTIGFDDARYDESPIAREMAEATGAEQDLMRLSGKELYGWMERTLWHTERTIYNTLAVAKFLMSRHVNAVDYKVVMTGEGSDELFGGYPAFRRDMFLHGFNDLPEAERRSWEDLLQQSNALVQGAMLAADQVDDPDLDAVVGFTPSCLQPWLACAPLVPDLLSEPHRQALEGYAPGKAIAATLDADQLEGRHALDKAQYVWIKTMLEGQILTWGGDRVDMAHSMEARPAFLDHHLAAAAVQVPPELRIKGKTEKYVLREAMAGLLPEVLYKREKFAFMAPPAHTEPDKWNQMRQLADDYLSDAAIAEAGLLSAEGVRDLFARHEDPATTDADRVQMDALINHLLGVQMLHRMFIATDVPAQARQKADALGWHV

SEQ ID NO: 64676 - protein, 494 aa, Bacillus cereus ATCC 10987
MSQLAVNLHEKVEKFLQGTKKLYVNGSFIESASGKTFNTPNPATGETLAVVSEAGREDIHKAVVAARMAFDEGPWSRMSTAERSRLMYKLADLMEEHKEELAQLETLDNGKPIRETMAADIPLAIEHMRYYAGWATKIVGQTIPVSGDYFNYTRHEAVGVVGQIIPWNFPLLMAMWKMGAALATGCTIVLKPAEQTPLSALYLAELIEEAGFPKGVINIVPGFGESAGQALVNHPLVDKIAFTGSTPVGKQIMRQASETLKRVTLELGGKSPNIILPDADLSRAIPGALSGVMFNQGQVCSAGSRLFVPKKMYDNVMADLVLYSKKLNQGAGLSPETTIGPLVSEEQQKRVMGYIEKGIEEGAEVLCGGSNPFDRGYFVSPTVFADVNDEMTIAKEEIFGPVISAIPFNDIDEVIERANKSQFGLAAGVWTENVKTAHYVASKVRAGTVWVNCYNVFDAASPFGGFKQSGLGREMGSYALNNYTEVKSVWLNLN

SEQ ID NO: 64677 - protein, 541 aa, Mesorhizobium loti MAFF303099
MRQHYEAALRDDANCVALSPLSFLKRAELVYGARSAVTYGDVRRTWAQTGARCRSVAAGLAALGVGPGDTVSVLSPNIPELFELHYAVPLLGAVLNTINTRLEPETVAYILAHSDSTLVIADTAFAPLLREAFRLNGNTLPVVDVVDAQAQASAEFGERSYEDLAAHPPMGWELPKDEWQALALNYTSGTSGRPKGVIYHHRGAYLMAMGTIAAWALPQHPTYLSVVPMFHCNGWTHPWSMAIVGANMVFTRDASPGKLLEAMAAHRVTHMGAAPIVLQMLCDGRGASAQPFNPQIRVMTAGAPPPPAVLEKAAQMGLDVMQVYGLTETYGHISQCLWQDEWEALSVSARAEKQAMQGVAFPMVEDIRVVDRDTGTDVPRDGLTQGEIAIRGNTVMKGYYKDATSTAAAFESGWFWSGDAAVVHPDGYIQIRDRLKDVIISGGENISSVEVESVLYRHPAISVAAVVARPHPKWGESPCAFVELREGASATEAEIIAFCRANIAHFKAPKTVVFGPLPKTATGKIQKFILRAAARDLGPQA

SEQ ID NO: 64678 - protein, 377 aa, Phalaenopsis hybrid cultivar
MAEGEEIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPILLTEAPLNPKANREKMTQIMFETFNAPAMYVAIQAVLSLYASGRTTGIVLDSGDGVSHTVPIYEGYALPHAILRLDLAGRDLTDALMKILTERGYSFTTTAEREIVRDMKEKLAYIALDYEQELETAKTTSSVEKSYELPDGQVITIGAERFRCPEVLFQPSMIGMEAAGIHETTYNSIMKCDVDIRKDLYGNIVLSGGSTMFPGIAERMNKEISALAPSSMKIKVVAPPERKYSVWIGGSILASLSTFQQMWIAKAEYDESGPSIVHRKCF

SEQ ID NO: 64679 - protein, 458 aa, Pseudomonas syringae pv. phaseolicola 1448A
MLNNGLLQSTTSQKTNANYLDRQSRFESNVRSYPRKLPLAIAKAHGVWVTDVEGTTYLDCLAGAGTLALGHNHEAIMASLDSFLTSGMPMHTLDLTTAVKDAFSETLLSLLPGQGRDYCLQFCGPSGADAVEAAIKLAKTATGRHNIISFSGAYHGMTHGALALTGNTAPKNAVTNLMPGVQFLPYPHEYRCPLGIGGEAGTEALSYYFTQFIEDVESGVSLPAAVILEAVQGEGGVNPAPAAWLRQIREVTRKHGILLILDEVQAGFGRTGKMFAFEHAGIEPDVIVMSKAVGGGLPLAVLGFKREFDAWAPGNHAGTFRGNQMAMATGLATLEVLQRQNLAAQAAKRGDWLKAQLGLLQQRYPMMGQVRGRGLMLGIEIVDERKPADRLGSLPMDPELAVAIQQHCFKQGLLLERGGRNGNVIRLLPPLIITEEQCQLVIQRFEDALKAALAQLRK

SEQ ID NO: 64680 - protein, 377 aa, Phalaenopsis hybrid cultivar
MADVDDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTTAEREIVRDIKEKLAYVALDYEQELETSKSSSSIEKSYELPDGQVITIGAERFRCPEVLFQPSLIGMEAAGIHETTYNSIMKCDVDIRKDLYGNIVLSGGSTMFPGIADRMSKEISALAPSSMKIKVVAPPERKYSVWIGGSILASLSTFQQMWISKAEYDESGPAIVHRKCF

SEQ ID NO: 64681 - protein, 128 aa, Bordetella parapertussis 12822
MSKQIIHTDAAPAAVGPYSQTVAATGAKTVYLSGQIGLEPGTGDLVSENFDAQVRQAFANMQAVIKEAGGTLDDIVKLTLFLTDLNKFAAANAIMAELIPQPFPARSTVGVASLPKGAQFEVEAVLVL

SEQ ID NO: 64682 - protein, 723 aa, Bradyrhizobium sp. BTAi1
MPVPLTTPAFGHATLANCEREQIHLAGSIQPHGILLAVKEPDNLVIQASTNAAAFLNTNSVVGRPLRDLGGDLALQILPHLNGPLHLAPMTLRCAVGTPPRRVDCTIHRPSNGGLIIELEPATKTTNIAPALDGAFHRITSASSLLGLSDETATIFKEITGYDRVMVYRFDDEGHGEVLSERRRPELEAFLGNRYPASDIPQIARRLYERNRVRLLVDVNYTPVPLQPRISPLNGRDLDMSLSCLRSMSPIHQKYLQNMGVGATLVCSLIVSGRLWGLVACHHYEPRFVPFDIRAACEALAETCAIRIAALESFAQSQSELVVRRLEQRLVEAVSRDGEWQAALFDGSQSLLQPLGATGAALLFEGQVTTAGDVPSTQRIRDLAAWLDRRRKTTEPAPQALTVTAALTLDEPSFMDLRPIASGLIAAPLSASEGEYLLWFRPEQVRTVTWGGDPLKAVIIGDDPSDLSPRRSFAQWHQLVEGKSEPWSPAELASARLISETVADVALQLRSVRMVIAQDQLATISAQVLRSEQPVIIADVEGRILLMNEAFEQQLRASHPHIPHLRDLGSYFAAPAEFRANLDDLMRNKRSWRGELTLSGAASQRPLMVRADPVIAPYDRVLGFVLIFSDLTERKTAEAARARFQEEIDGARRPSLRLDQRASLIYKELAASTVENAQLAALEVTHGAEAGGMPEMLESIRNSTARTLGILEHLVWYRSQSEE

SEQ ID NO: 64683 - protein, 471 aa, Oryza sativa (japonica cultivar-group)
MAKKQRREAAARRRREQQQQGREQRHHHHHRRRPLLLQPRDERCVSCTTFNILAPIYKRMDSENCRESQYRAYWFSRNEKIIDRLLADCSSIICLQEVWLGNDELVDMYEKRLGDANYSLFKLARTNNRGDGLLTAVNKNYFHVLNYRELLFNDFGDRVAQLLHVESAMPFWQNRSSSCIQQQSLIVNTHLLFPHDHSLSIVRLKQVYKILQYIEAYQEEHKLGPMPIILCGDWNGSKRGQVYKFLRSQGFVSSYDTAHQYSDSEEDAHKWVSHRNHRGNICGVDFIWLLNPNKSRKPLKTSWNEAVFGIIKYLLLQVASLSEENAFALLKADSPDDQITYSSFCQALCQLGMVHPDRLNSEEIKDLWSEADHDGDDIVDYKEFQRCIWSPTCCSQEEEDDTEIDISDGSLVTFEANDEAFGFTVKEAVLFPPEVEKGMWPENYSLSDHAPLTVVFSPVRMPCSPRTPRTP

SEQ ID NO: 64684 - protein, 454 aa, Moraxella catarrhalis
MSVHTPVIPPQNATNDYYLTRQNEMESNVRSYPRKLPLAIAKAQGCWVTDVEGNEYLDCLAGAGTLALGHNHPATINAIKDVLDSGLPLHTLDITTPIKDAFTEKLLSFFPKDFVLQFCGPTGADGTEAAIKLAKTYTGRDNVIAFSGGYHGMTHGSLAMTGNLSAKEKVGNLMAGVQFMPYPHEYRCPLGLGGEAGVDALTYYFENFIEDVESGVVKPAAVILEAIQGEGGVVPAPKKWLQKIREVTTKHDIVLILDEVQAGFARSGKMFAFEHAEIIPDVVVMSKAVGGGLPLAVLAINKKFDAWSPAGHTGTFRGNQLAMAAGYNVLTQITENNLADNARIQGEFLRGELRKAAEQYPCIGHVRGRGLMTGVEIVDERQPADHMGSYPADGELAAAIQKACFDNKLLLERGGRGGTVVRLLCPITITQEECIEVITRFKKAVGEAVKAVRG

SEQ ID NO: 64685 - protein, 288 aa, Pseudomonas putida KT2440
MSNFRGIWIALVTPMRANEIDFPGLEKLVKKLLEDGVAGFVVCGTTGEAAALSKAEQLAVLDAVLAWVEPGRMVMGLSGYNLRELLAFQAEIQQRDIGGLLVPAPCYIRPSQAGIEAFFATVADAASVPVIVYDIPYRTGVRIERETLRRIVRHPRIAAVKDCGGDSETTMALIEDGHAQVLAGEDLQIFNNLCLGGAGAISASAHVRADLYVRMVRQVDSGDWAAARGTFYQLLPWIKVAFAEPNPAVVKAALQLQSLIADELREPMQTCTNTTRDKLQSVLCSLGA

SEQ ID NO: 64686 - protein, 196 aa, Brassica napus
  misc_feature (131)..(131): Xaa can be any naturally occurring amino acid
  misc_feature (149)..(149): Xaa can be any naturally occurring amino acid
  misc_feature (178)..(178): Xaa can be any naturally occurring amino acid
MSHCLVLKPSCMGCGSQSDLYGSSCRHMTLCLKCGKTMAENKAKCLDCGTVLTRLIREYNVRAATPTDKNYFIGRFVSGLPNFKKGSSENKWSLRKDIPQGRQFTDAQREKLKNKPWILQDETGKFQYQGXLEGSQSATYYLLVMQNKXFVPIPAGSWYNFNKVAQYKQLTLEEVERXMKNRRKTADGYNRWMMKG

SEQ ID NO: 64687 - protein, 405 aa, Aspergillus nidulans FGSC A4
MLFRTAWARQAAPLRRQAFAPLARRSVTTDAASSHAENIPEDENKPFTVRLSDESFETYEIDPPPYTLEVTKKELKQMYYDMVAMRRMEMAADRLYKEKKIRGFCHLSTGQEAVAVGIEHALTREDKIITAYRCHGYAMMRGGTIRSIIGELLGRREGIAYGKGGSMHMFAPNFYGGNGIVGAQVPVGAGLAFAQQYNEEKSTSVVLYGDGASNQGQVFEAFNMAKLWNLPVLFGCENNKYGMGTSAARSSALTDYYKRGQYIPGIKVNGMDVLATKAAVKYGKDYAISGNGPLVYEYVTYRYGGHSMSDPGTTYRSREEIQRMRSTQDPIQGLKQKILDWGVMSEEDLKGLDKSARAHVDEEVAIAEKMPLPENNSRILFEDIYVRGSEPRWMRGRTVDETFYY

SEQ ID NO: 64688 - protein, 133 aa, Synechococcus sp. RS9917
MRSTPLKIPANNVTNTALSVMRLLLSFALALLCALWAPLSASAADAALGAKVFSSNCAACHAGGGNIVNGERTLRQADLQDYLAQYSNGHESAIVAQVTYGRNAMPAFIDTLTETQISDVAAYVEEQASKGWS

SEQ ID NO: 64689 - protein, 462 aa, Burkholderia sp. 383
MQPASPAQPAAHGADAADSARDLVYGPNDRPAPMVAFVAALQHLLAIIVPIVTPGLLICQALGVSSRDTTLIVSMSLVISGIATFVQCKRFGPLGAGLLIVQGTSFNFVGPLIAGGSLMVKQGTPVETVMAAIFGVVMAGSFVEMGVSRILPFVKRLITPLVTGIVVLLIGLTLIKVGLISMGGGFGAMAKGTFASAENLTLSGLVLGTIILLNRVPIVWVRSTALVIALVIGYLAAAFLGRLDFTGMHQAALFQVPTPLHFGIGFSWSLFVPMLIIYLVTSLEAIGDVTATSKISSEPVEGPVWMQRIKGGVLVNGANSLLAGVFNTFPSSVFAQNNGVIQITGVASRHVGIWIAGMLVVLGLFPVVAGVLQAVPEPVLGGAAMVMFGAVAASGINILSGVHLDRRALLIIAVSLALGLGVSQVPDILNSLPHALKNVLESGVATGGICALVMNWFLPEKK

SEQ ID NO: 64690 - protein, 141 aa, Bacillus cereus ATCC 10987
METILHNDPLMAAVISWFLAQLTKVVFKLFKTGEFDFAKFFASGGMPSSHASTVTALATGVGVVEGVESTLFAIAAIFAIIVMYDASGVRLAVSKQAKILNEFFHGRQTEYKKLNELVGHTPYEVVVGALLGIIVGVGYCL

SEQ ID NO: 64691 - protein, 629 aa, Pseudomonas syringae pv. phaseolicola 1448A
MSTTLKNAAHLSESAQVDSGSVQPFTRSQKIYVQGSRPDIRVPMREITLDVTPTDFGGEINAPVTVYDTSGPYTDPNVIIDVRKGLADVRSPWIDSRNDTERLAGLSSNFGQQRLSDAELTALRFAHVRNPRRANAGANVSQMHYARQGIITAEMEYVAIRENMKLQEARAAGLRTQQNAGHSFGASIPKEITAEFVREEIARGRAIIPANINHVELEPMIIGRNFLVKINGNIGNSALGSSIEEEVAKLTWGIRWGSDTVMDLSTGKHIHETREWIIRNSPVPIGTVPIYQALEKVGGAAEDLTWELFRDTLIEQAEQGVDYFTIHAGVLLRYVPLTAKRVTGIVSRGGSIMAKWCLAHHQENFLYTHFEDICEIMKAYDVSFSLGDGLRPGSIADANDAAQFGELETLGELTKIAWKHDVQTMIEGPGHVPMQLIKENMDKQLECCDEAPFYTLGPLTTDIAPGYDHITSGIGAAMIGWFGCAMLCYVTPKEHLGLPNKDDVKTGIITYKIAAHAADLAKGHPGAQIRDNALSKARFEFRWEDQFNLGLDPDTARSYHDETLPKDSAKVAHFCSMCGPKFCSMKITQEVREYAANQRIEAVDVDVAKGLAEQAERFKQEGSQLYKKV

SEQ ID NO: 64692 - protein, 331 aa, Aspergillus oryzae
MASTLKANVPKIDVSPLFGDNMEEKMKAARAIDAASRDTGFFYAINHGIDVNRLSQKTKEFHMSITDEEKWDLAIRAYNKEHQDQIRAGYYLSIPGKKAVESFCYLNPNFKSDHPRIQSKTPTHEVNVWPDETKHPGFREFAEQYYWDVFGLSTALLRGYALALGKEEDFFSRHFKKDDALSSVVLIRYPFLDPYPPAAIKTAADGTKLSFEWHEDVSLITVLYQSNVQNLQVETPQGYLDIEANDTGYLINCGSYMAHITNNYYPAPIHRVKWVNEERQSLPFFVNLGFDETIQPWDPRSPDGKTDKEPVSYGQYLQNGLVSLINKNGQT

SEQ ID NO: 64693 - protein, 70 aa, Glycine max
  misc_feature (21)..(21): Xaa can be any naturally occurring amino acid
MHISGVVLVEKACPYLQTSRXVRIMEYLDLPFPQLGSLLQFVPLLVRDFADDTDANNLDLIPRCSEWCDI

SEQ ID NO: 64694 - protein, 499 aa, Clostridium perfringens str. 13
MEICSSNSIRNMDKDYIEKFNMPSIVLMENAIIKFLENIDLTKESFTIISGRGNNGGDALGIARHLLNKGKKVYVHILEKEKEGSVDYKTNLTILEKLGCYIKGISNSKDLEILKNNIINSEILIDGILGTGLNKEISGIYFNTIKCINENSKFTVSIDVPSGINSNDGSICGIAVKANETISFQVYKLGFLNYKSFEYLGNLKIVDIGIPKSIVYKNSDNMRFTDREYIRNKFPYRNKYGHKGTYGRSLIFAGHKGFIGAAYMVGQAAIKTGAGLVTVFTHKDVQSELSIKLNEGMTGTYNSKEEYEEFISGANVIAFGPGMGNNDLTFEVLNNIFNLYSGTLVIDADGINVLERKKSILKEFKGDIVLTPHPGEMARLLGIEIKDVERDRIGIAKDFAKQNGITVLLKGYNTIITDGDKVFVNPTGNSAMASGGMGDTLTGIITSLISQGVNSFDAAILGAYIHGYIGDELSKENFTVSAMEIIKNIPNKIKELISF

SEQ ID NO: 64695 - protein, 393 aa, Solanum tuberosum
MTAPTTRKDLMIVNMGPQHPSMHGVLRLIVTLDGEDVVDCEPILGYLHRGMEKIAENRTIIQYLPYVTRWDYLATMFTEAITINGPEQLGNIQVPKRASYIRVIMLELSRIASHLLWLGPFMADIGAQTPFFYIFRERELIYDLFEAATGMRMMHNYFRIGGVAADLPYGWIDKCLDFCDYFLTGVAEYQKLITRNPIFLERVEGVGIIGRDEAVNWGLSGPMLRASGIEWDLRKVDHYESYDEFDWQVQWQREGDSLARYLVRIGEMTESIKIIQQALEGIPGGPYENLEMRRFDRLKDPEWNDFEYRFISKKPSPTFELSKQELYVRVEAPKGELGIFLIGDQSVFPWRWKIRPPGFINLQILPQLVKRMKLADIMTILGSIDIIMGEVDR

SEQ ID NO: 64696 - protein, 505 aa, Cicer arietinum
MGSRNIVQQQNRAEAAVPGAMKQKNIAGEKKNRRALGDIGNLVTVRGVDGKAKAIPQVSRPVTRSFCAQLLANAQTAAADNNKINAKGAIVVDGVLPDRRVAAARVPAQKKAAVVKPRPEEIIVISPDSVAEKKEKPIEKEKAAEKSAKKKASTLTSTLTARSKVASGVKTKTKEQIVDIDAADVTNDLAVVEYVEDMYKFYKSVENESRPHDYMGSQPEINEKMRAILIDWLVQVHHKFELSPETLYLTINIVDRYLASETTIRRELQLVGIGAMLIASKYEEIWAPEVHELVCISDNTYSDKQILVMEKKILGALEWYLTVPTPYVFLVRFIKASMTDSDVENMVYFLAELGMMNYATLIYCPSMIAAASHQVYAARCTLNKAPFWNETLQLHTGFSEPQLMDCAKLLVAFHKMAGDQKLKSIYRKYSNLERGAVALLSPAKSLFVFLIELLMNAIEKMQCSLFFTSEIWCRFLTCFGRNISPGCSLVLLQRNFLIPLILYAL

SEQ ID NO: 64697 - protein, 333 aa, Prochlorococcus marinus subsp. pastoris str. CCMP1986
MKSILEQLSSITVVVADTGDLDAIKKFQPRDATTNPSLILAAAKNPDYIKLIDQALESSRKSLPAGFSESELIKETIDQVSVFFGKEILNLISGRVSTEVDARLSFDTEATVTKARKLINHYKSFGINKERILIKIASTWEGIKAAEILEKEGIKCNLTLLFNFCQAVACANAKITLISPFVGRILDWHKAKTGKDNFAGCEDPGVISVTKIYNYFKEKGFKTEVMGASFRNIDEIKELAGCDLLTIAPKFLDELNREEGELIKKLDEDTQSQSSIDYKFDEKDFRLSMLEDQMASEKLSEGITGFSKAIEELEELLLKRLSEINNQKLISTT

SEQ ID NO: 64698 - protein, 1047 aa, Arabidopsis thaliana
MAFRRPLIVIVIFIYITAGVKIAAADEPVPTPWPHQFHALMFMNYSGDLSMIDLWYDWTNGRNFNIIQEQLGGITYDLEWNNGTSFFYTLDESKSCRSGQLEDSHCVRFEFFILSRKLKYLRRVGEFSVLLKSGRVYILIVTNTLCALHLMGRLKLPNHSGREAHIMTYEVGAVLEDEKWQAPVYCFNKEKKSLSTKGALSEFKGYKEKAALRSTRVNKRDLLLCLFSLFEQVLNLHKTATNHHAFRLVFRKLKKMDLSGCRDIISSLPEAISCHILSFLPTKEAASTSVLSKKWRYLFAFVPNLDLDESVYLNPENETEVSSSFMDFVDRVLALQGNSPLHKFSLKIGDGVEPDRIIPWINNVLERGVSDLDLHVYMETEFVFPSEMFLSKTLVRLKLMLYPLLEFEDVYLPKLKTLYIDSCYFEKYGIGLTKLLSGCPILEDLVLDDIPWCTWDFASVSVPTLKRLTFSTQVRDEFPKSVSIDTPNLVYLKFTDTVAGKYPKGHQGYGENDMVGNATDFIMRICNVKTLYLSSNTLQVLTYSCDAIPIFNNLTHLTIESNPEVGWQSLPGLLKNSPNLETLIFQGLIHKATDKCGDVCLCKPREEIRSCLASSPVKVIKILKFGEISDDMEKQREQIKYFLETMPNLEKMILYYNTTSVEDVTEVSSRLQRLVSKLASSTLLKRMDLSGSRDVISSLPDDISSHILSFLPTKEAASTSVLSKKWRYLFAFVPNLDLDDSVYLNPENETEISTSFMDFVDRVLALQVRIIPWINNVLERGVSDLDLHLNLESEFLLPSQVYLCKTLVWLKLRFGLYPTIDVEDVHLPKLKTLYIEATHFEEHGVGLTKLLSGCPMLEDLVLDDISWFIWDFASVSVPTLKRLRFSWQERDEFPKSVLLDTPNLVYLKFTDTVAGKYPKPLLINYHQGYGENDMVGNATDFIMRICNVKTLYLSANTLQVLTYSCDAIPIFNNLTHLTIESNPRVGWQSVPGLLKNSPNLETLIFQVRNKPLKSILASSTKPHIDVEMCACAKSLGRRFSVANHQVR

SEQ ID NO: 64699 - protein, 142 aa, Glycine max
  misc_feature (80)..(80): Xaa can be any naturally occurring amino acid
APPPPRMATILPPSNAQFVSFNARHRSSSPTLPRWGGRKEQDASIVANRTRGQAFQVLVASGKEGSKDDVVMVDPVEAKXLAAKQMEKIKAKEKLKRRRQIEAINGAWAMIGLTAGLVIEGQTGKSILTQVKFGNASFYMFL

SEQ ID NO: 64700 - protein, 121 aa, Synechococcus sp. RS9917
MNPVFISPMRVLLGAALALLIGLLSPVAAFAADAAHGAQIFSANCAACHIGGGNVVNAERTLKQADLDAYLSGYGEGHEAAIAAQVTKGKNAMPSFLGKLSDTDIADVAAYVEQQAGNGWT

SEQ ID NO: 64701 - protein, 822 aa, Burkholderia sp. 383
MAGLAPTFGRGAMTNHWVDIKNADVILVMGGNAAEAHPCGFKWVTEAKAHRKARLIVVDPRFTRTASVADYYAPIRTGTDIVFLGGVINYLLTNDKIQHEYVKNYTDFSFIVREDFAFNDGIYSGYDAEKHAYPDKSSWDYERGDDGFVKVDPTLQHPRCVYNLLKQHYARYTQDMVQQVCGTPKEKFLKVCEMLATTAVPGRAGTVLYALGWTHHSIGAQIIRTGAMVQLLLGNIGIAGGGMNALRGHSNIQGLTDLGLMSNLLPGYMTLPMQAEQDFDGYIKKRVQLPLRPNQLSYWKNYKAFHVSFMKSWWGDAATAENNWGYDYLPKLDKQYDLLQVIELMNAGKMNGYICQGFNPLAASPSKVKTAAGLAKLKWLVIMDPLATETSEFWKHHGDYNDVDSSKIQTEVFRLPTTCFAEENGSLVSSSRVLQWHWKGAEPPGEARSDLEIMSGLFLRMRKMYQTDGGKYPDPIVNLTWPYANPESPTPEELAMEFNGKALADLPDPKDPAKTLVKKGEQLAAFAQLKDDGTTASGCWIFCGAWTQAGNQMGRRDNSDPTGIGQTLNWAWAWPANRRILYNRASCDVAGKPFDPTRKLIGWNGSAWKGADVPDFKVDESPENGMGPFIMNPEGVARFFARAGMNEGPFPEHYEPFETPLDANPLHPNNPQALNNPAARVFPDDRASFGKVADFPHVATTYRLTEHFHYWTKHARLNSIIQPEQFVEIGEDLAKEVGVAHGERVKVSSKRGYIIAVALVTKRIKPLTVDGKKVQTVGVPLHWGFKGLTKPGYLANTLTPSVGDGNSYTPEFKSFLVKVEKA

SEQ ID NO: 64702 - protein, 196 aa, Burkholderia sp. 383
MLQMSRRQFLKVTATSLAGSSLALMGFSPSEALAEVRQYKLARTVETRNTCPYCSVGCGILMYSLGDGAKNAQPSIIHIEGDPDHPVNRGTLCPKGASLIDFIHSPSRLTHPEYRAPGSDKWEPISWNDALDRIAKLMKADRDANFVETAEDGAKVNRWLTTGMLAASAGSNEVGYLTHKTVRSLGMLAFDNQARV

SEQ ID NO: 64703 - protein, 473 aa, Lactobacillus acidophilus
MTKTLPKDFIFGGATAAYQAEGATKTDGKGRVAWDKFLEENFWYKGDPASDFYHNYVEDLELAEKFGGNVIRISIAWSRIFPNGDGEVKPNGVDFYHKLFAECDARHVEPFVTLHHFDTPEGLHEDGDFLTHEKMDDFVEYADYCFKEFPEVKYWITINEIRSVAVDQYIIGNFPPADTFGFDKMFQTHHNQMVGHARAVKLFKHDGSKGEIGIVHALQTNYPFNESNPADIGAAELEDLLDNKFLVDGTFVGKYPQETMEAVKDILAANHGGEFNIEDEFKAIDAAKDVQDFVGVDYYLSEWMRAYDGKSEITHNGTGDKGTSKVQVKGVGEEKLPDGIETTDWDWLIYPQGLYDKIMRVKNDYPNIHKVYITENGIGFKDTVPDNEETDKTVHDDARIDYVKQHLEVIADAIADGANVKGYFIWSLMDVFTWTNGYTKRYGLFYVDFDTQDRYPSKTADWFKNLAETHIIE

SEQ ID NO: 64704 - protein, 323 aa, Oryza sativa (japonica cultivar-group)
MGEEEKVKEEAAAEKGKEAAVAEEKEAAAAGEEKKEDAPPPPPPPEEVVMRVFMHCEGCARKVKKILRGFDGVEDVVADSKAHKVIVKGKKAAADPMKVVHRVQKKTGRKVELLSPMPPPVEEKKEEEKKEEPEPPKPEEKEPTVIAVVLKVHMHCEACAQVIRKKILKMKGVQSAEPDMKASQVTVKGVFEESKLTDYVHKRIGKNAAVVKSEPAPPPENAGDANAKDDKKAAEGGEEKDESKEEKKEGDDEKEKEKEKDDSNAAEVEEKDKEKDPSALAAANLYMHYPRFSNPGGYGVPGYAYPYAPQLFSDENPNACVVM

SEQ ID NO: 64705 - protein, 1012 aa, Bacillus cereus ATCC 10987
MLINYSTMIITCRNVVRIFSWWSFFYSQKGGKTMNNNMVHITIDGKKYTAEPGSTILGVMNENGIEHPQICYVPEVDPIQTCDTCIVEVDGKLMRSCSTVATEGMNIERNSTRAKEAQTEAMDRLLENHLLYCTVCDNNNGNCKLHNTAELMEIEHQKYPYEPKVDVSEVDMTHPFYRYDPNQCIACGQCVEVCQNLQVNETLSIDWEAERPRVIWDEGVNINDSSCVSCGQCVTICPCNALMEKTMLGEAGFMTGLKPDILEPMVDLIKEVEPGYSGIFAVSEVEAAMRDTRTKKTKTVCTFCGVGCSFEVWTKGRKILKVQPSSDAPVNAISTCVKGKFGWDFVNSKERITKPLIRKNGTFVESTWEEALNVVASKLGAIKEEYGKDAIGFISSSKITNEDNYVIQKLARQVFETNNIDNCSRYCQSPATDGLFRTIGMGGDAGTIKDIAQSGLVIIVGCNPTEGHPVLATRIKRAHKLHGQKLIVADLRKTEMAERSDVFISPKQGTDQVWLMAVTKYMIDQGWHDQRFIDENVNFFEDFKESLTAYTLEYAEEMTGISKETLIQMAEMIRDADGTCILWGMGVTQNTGGSDTSAAISNLLLATGNYRRPGAGAYPLRGHNNVQGACDMGTLPGWLPGYQHVTNDMERAKFEMAYGVKINSEPGLNNIEMLHAIDEGKMKAMYLVGEDMALVDSNANHVHEVLSSLDFFVVQDVFLSKTAQYADVVLPAAPSLEKEGTFTNTERRVQRLYQVLPTLGDAKPDWWIVQEVANKLGANWNYSHPSEIFAEMASLSPLFSQANYEVLEGWNSFLWGSFDGTNTPLLFQDGFNFPDKKARFAIADWVRPAEFPAEFDLHINNGRMLEHFHEGNMTNKSTGIQTKVPGVFVEVSPALAKERGVKTGSLVRLVSPFGALKLRALVTDRVKANELYLPMNSTDNETAINFLTGPAVDTRTNTPAYKQTKVRMEVLEVEGENPMPKANPRNKKRHPQAGIEVHRKWARPGYVHLTDK

SEQ ID NO: 64706 - protein, 384 aa, Bacillus anthracis str. A2012
MHEDLLGLEEIMMKAEEKFSPGLDGIVAAETKISFLDTVKGEIVIQGYDLIELSKTKEYLDIVHLLLEEHLPNEDEKATLEKKLKEEYAVPEGVFNVLKALPKETHPMDGLRTGVSALAGYDNDIENRSLEVNKSRGYKLLSKVPNIVANSYHILNNEEPIEPLKELSYSANFFYMLTGKKPTELEEKIFDRSLVLYSEHEMPNSTFTARVIASTQSDLYGALTGAVASLKGSLHGGANEAVMYMLLEAGNVEKFEELLQKKLYNKEKIMGFGHRVYMKKMDPRALMMKEALKQLCDVKGDYTLYEMCEAGEKIMEKEKGIYPNLDYYAAPVYWMLGIPIQLYTPIFFSSRTVGLCAHVIEQHTNNRLFRPRVNYIGERHVLSK

SEQ ID NO: 64707 - protein, 766 aa, Streptococcus agalactiae 2603V/R
MDNTVIVHYHSRKKNYFNLSLWQWRDGSEGQDAHFSRFDSFGAVAILKYPLPYFLSHYYVIVKDKNWHHKTIDYRIDCTQGGARKEVWIVDGDDNLYYSRQAAVSSHHYSRRQPHAYDMAINSRAFDKKWGFDGWLGFEYSETKTAFRLWAPTAERVELILYHSTDETASVSKVLSMKRGTAVNYKNHKENTHGVWFTELEGNYNYQAYTYRVYYRRRTFKITRDPYSIATTANGKRSIVIAPEALTPEGFKISHGKEAKWRLENPNQAVIYEMHVRDFSISETSGVKTDYHGKFKGLHQKGTVNQHGDKTTFDYVQDLGVNYIQLQPIFDHHQTFDDDGHYAYNWGYDPENYNVPEASFSSNPHEPATRILELKSAIQAYHDAGIGVIMDVVYNHTFSSTDSAFQLTVPDYYYRMNHNGTFQNGSGCGNETASEKEMCRKYILDSVLYWVKEYNIDGFRFDLMGLHDVETMNIIRNELNKIDPRILVYGEGWDMGAGLTPQNKAKKDNAYQMPGIGFFNDDVRDAVKGAEIYGEFKKGLVSGNSTEDIVAKGILGSDELVSYIDPSQVLNYVEAHDNYNLNDLLWELHPNDNEKQHIYRVEVASAMNLLMQGMAFMQLGQEFLRTKCYPTGDKGQLTQADKERAMNSYNAPDQVNQVNWDNVTFHKSTINFIRKIITLKTNSPYFSYSSFEEIRKHVFVESAQYHSGFISFTVEEHKKIKIIFNIKGKRLQNSFIGDIIISNHEEGKAIDSLDDELSVMILDITK

SEQ ID NO: 64708 - protein, 214 aa, Brassica napus
  misc_feature (200)..(200): Xaa can be any naturally occurring amino acid
  misc_feature (208)..(208): Xaa can be any naturally occurring amino acid
MTSFSAFSEMMGSENESPALSGEYCPTLAASCPKKPAGRKKFRETRHPIYRGVRQRHSGKWVCEVREPNKKSRIWLGTFLTAEIAARAHDVAAIALRGKSACLNFADSAWRLRIPETTCPKDIQKAAAEAAVAFQAEINDTTTDHGLDVEETIVEAIFTEENNDGFYMDEEESMFGMPSLLASMAEGMLLPPPSVRFEHXYDFDGDAXVSLWSY

SEQ ID NO: 64709 - protein, 379 aa, Streptococcus agalactiae 2603V/R
MKNEMLALILAGGQGTRLGKLTQSIAKPAVQFGGRYRIIDFALSNCANSGINNVGVITQYQPLELNTHIGNGSSWGLDGIDSGVTVLQPYSATEGNRWFQGTSHAIYQNIDYIDRINPEYVLILSGDHIYKMNYDDMLQTHKDNLASLTVAVLDVPLKEASRFGIMNTDSNDRIVEFEEKPEHPKSTKASMGIYIFDWKRLRTVLIDGEKNGIDMSDFGKNVIPAYLESGERVYTYNFDGYWKDVGTIESLWEANMEYIGEDNKLHSRDRSWKIYSKNLIAPPNFMTEDANVKDSLVVDGCFVAGNVEHSILSTNVQVKPNAIIKDSFVMSGATIGEGAKINRAIIGEDAVIGDGVVIDGSKEVEVIGYKEVAGVPNED

SEQ ID NO: 64710 - protein, 372 aa, Zea mays
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTSAEREIVRDIKEKLAYIALDYEQELETAKNSSSVEKSYELPDGQVITIGAERFRCPEVLFQPSMIGMEAAGIHETTYNSIMKCDVDIRKDLYGNIVLSGGSTMFPGIADRMSKEITSLAPSSMKIKVVAPPERKYSVWIGGSILASLSTFQQVCCIVYITFSCCILFL

SEQ ID NO: 64711 - protein, 214 aa, Brassica napus
  misc_feature (54)..(54): Xaa can be any naturally occurring amino acid
MTSFSTFSEMLGSEYESPVTLGGEYCPKLAASCPKKPAGRKKFRETRHPVYRGXRLRNSGKWVCEVREPNKKSRIWLGTFLTAEIAARAHDVAAIALRGKSACLNFADSAWRLRIPETTCPKEIQKAAAEAALAFQAEINNTTTDHGLDMEETIVEAIFTEENNDVFYMDEESMLEMPALLASMAEGMLLPPPSVHFGHNYDFDGDADVSLWSY

SEQ ID NO: 64712 - protein, 215 aa, Brassica napus
  misc_feature (185)..(185): Xaa can be any naturally occurring amino acid
MTSFSTFSELLGSEHESPVTLGEEYCPKLAASCPKKPAGRKKFRETRHPVYRGVRLRNSGKWVCEVREPNKKSRIWLGTFLTAEIAARAHDVAAIALRGKSACLNFADSAWRLRIPETTCPKEIQKAAAEAAVAFKAEINNTTADHGIDVEETIVEAIFTEENNDGFYMDEEESMFGMPALLASXAEGMLLPPPSVQFGHTYDFDGDADVSLWSY

SEQ ID NO: 64713 - protein, 481 aa, Escherichia coli CFT073
MLVAQHTVYFPDAFLTQMREAMPSTLSFDDFLAACQRPLRRSIRVNTLKTSVADFLQLTAPYGWTLTPIPWCEEGFWIERDNEDALPLGSTAEHLSGLFYIQEASSMLPVAALFADGNAPQRVMDVAAAPGSKTTQIAARMNNEGAILANEFSASRVKVLHANISRCGISNVALTHFDGRVFGAAVPEMFDAILLDAPCSGEGVVRKDPDALKNWSPESNQEIAATQRELIDSAFHALRPGGTLVYSTCTLNREENEAVCLWLKETYHDAVEFLPLGDLFPGANKALTEDGFLHVFPQIYDCEGFFVARLRKTQAIPVLPAPKYKVGNFPFSPVKDREAGQIRQAAASVGLNWDENLRLWQRDKELWLFPVGIEALIGKVRFSRLGIKLAETHNKGYRWQHEAVIALASPDNVNAFELTPQEAEEWYRGRDVYPQAAPVADDVLVTFQHQPIGLAKRIGSRLKNSYPRELVRDGKLFTGNA

SEQ ID NO: 64714 - protein, 887 aa, Zea mays
MFWHGVADRLTGKNKEAWNEGKIRGTVRLVKKEVLDVGDFNASLLDGVHRILGWDDGVAFQLVSATAADPSNGSRGKVGKAAHLEEAVVSLKSTTDGETVYRVSFEWDGSQGVPGAVLVRNLQHAEFFLKSLTLEGVPGRGTVVFVANSWIYPHNLYSQERVFFANDTYLPSKMPAALVPYRQDELKILRGDDNPGPYKEHDRVYRYDYYNDLGEPDKGEDHARPVLGGSQEHPYPRRCRTGRRPTETDPNSESRLFLLNLNIYVPRDERFGHLKMSDFLGYSLKAIIEAVLPTLGTFVDDTPKEFDSFEDILGLYEPGPEAPNNPLVAEVRKRIPSEFLRSILPNGSHDHPLKMPLPNIIRSDVLKKAPEFKFGWRTDEEFARETLAGVNPVLIKRLTEFPAKSTLDPSQYGDHTSKITEAHIQHNMEGLSVQNALKKNRLFILDHHDHFMPYLNKINELEGNFIYASRTLLFLKDDGTLKPLAVELSLPHPDGQQHGAVSKVYTPAHSGAEGHVWQLAKAYACVNDSAWHQLISHWLNTHAVIEPFVIATNRQLSVVHPVHKLLSPHYRDTLNINALARQTLINADGIFERTVFPAKYALGMSSDVYKSWNFNEQALPADLVKRGVAVPDQSSPYGVRLLIKDYPYAVDGLVIWWAIERWVKEYLDVYYPNDGELQRDVELQAWWKEVREEAHGDLKDRDWWPRMDAVQRLARACTTVIWVASALHAAVNFGQYPYAGYLPNRPTVSRRPMPEPGSDDYKKLEAGQKEADAVFIRTITSQFQTILGISLIEILSKHSSDEVYLGQRDEPERWTSDARALDAFRRFGSRLVEIEKRIRTMNDSPTLKNRKGPVEMPYMLLYPNTSDVTGEKGEGLTAMGIPNSISI

SEQ ID NO: 64715 - protein, 334 aa, Kluyveromyces lactis NRRL Y-1140
MSNIVGVEYNRVTNTSSTDFPGFSSDQDNSWDLEKFKETFDVQIESLDEREVNFDLVHVDTSIANAFRRIMISEVPSVAPEYVYFFNNTSVLQDEVLAHRIGLVPLKVDPDMLSWVDTSLPESERFTDENTIVMSLNVKCTRNPDAPKDCEDPKVLYRNAHIYARDLKFEPQGKQVEQFAKCPVVAADPDILLAKLRPGQEISLRAHCILGIGADHAKFSPVSTASYRLLPHIQITQPITGDDAKKFVKCFPKGVADVNEKGEAYIKDPRKDTVSREVLRHDEFQGKVKLGRVRDHFIFNVESSGAMTPEEIFFKSVRILKNKAEYLKNCPISQ

SEQ ID NO: 64716 - protein, 385 aa, Methanothermobacter thermautotrophicus str. Delta H
MFMTSVVVMAGGKGTRIRPLTFSRPKPLVPVANRPILDYIIHRVLDSGYSKVVMTLGYLKDQIRSHVLAEYPEIDFRFSVEKKPLGTAGGVKAAASEINETFIVLSGDVIFDLDLREMVKFHRKKNALVTVALTPVEDPSHYGIAVLDDDGKIKRFHEKPRPEEVFSKIANAGIYVMEPEVIEHIPQGSSDFSADIFPVLIERDAGMYGFLFDGYWNDAGKPNTFLRANHDVLNGTVTPEPDGEIAEEVPGRFGKIWIGRDVVIGDRVRIVGPAVLGDGSRVDDGAYIGKNTVIGSRVNVGENSFIRGSVILDGCVIGRGSQLLNCVVDEDCEIGAGCAIDRCAIIGRGAFIGPSTVIRSHCSVSNRLRILSGSLVDSDYPLVPE

SEQ ID NO: 64717 - protein, 459 aa, Phaseolus lunatus [sequence omitted]

SEQ ID NO: 64718 - protein, 264 aa, Methanothermobacter thermautotrophicus str. Delta H
MPDYLFDFLDELKFLRNGRKTAIITDIDGTISEIAPTPEEAVVDDEMRDVLRDLASRYRVLAFISGRPVREALRMVGVPGAVYVGNHGLEYIINGNYQRFSEVEEYIPLIKKCALELRDKIDEENVIFEDKGICYSIHYRQCTDPELSRKRILKNLQEIPESKGLKVDHGRMLVELKPPLHYNKGFIVRKILEDSDVSSAVYLGDDITDADAFREIRKLESERGMKNVPILVLSKEIPPEVKNSARFFVYGISEVLRFFRWLLK

SEQ ID NO: 64719 - protein, 454 aa, Phaseolus vulgaris
MALNDETKVVVLLLPFPVQGHLNPFLQLSHLIAAQNIAVHYVGTVTHIRQAKLRYHNATSNIHFHAFEVPPYVSPPPNPEDDFPSHLIPSFEASAHLREPVGKLLQSLSSQAKRVVLINDSLMASVAQDAANFSNVERYCFQVFSALNTAGDFWEQMGKPPLADFHFPDIPSLQGCISAQFTDFLTAQNEFRKFNNGDIYNTSRVIEGPYVELLERFNGGKEVWALGPFTPLAVEKKDSIGFSHPCMEWLDKQEPSSVIYVSFGTTTALRDEQIQELATGLEQSKQKFIWVLRDADKGDIFDGSEAKRYELPEGFEERVEGMGLVVRDWAPQMEILSHSSTGGFMSHCGWNSCLESLTRGVPMATWAMHSDQPRNAVLVTDVLKVGLIVKDWEQRKSLVSASVIENAVRRLMETKEGDEIRKRAVKLKDEIHRSMDEGGVSRMEMASFIAHISR

SEQ ID NO: 64720 - protein, 586 aa, Triticum aestivum
MDSTDRFDKSPLLDGGSSSQENSTEYTGDGSVCTSGHPASRKHTGNWKVSSLTIVCSFCCYLAYSSIGKNLVSYLTKVLDETNLDAARHVATWQGTSYLAPLVGAFVADSYLGKYRTALISCTIFIMGMMMLLLSAALPLISAGPHAWTLWADPISSRYIIFLVGLYMVGLGYGAQCPCVTSFGADQFDDTNEMEKTRKSSFFNWHYFSINAGSLIAGTVIVWVQEHEGWLWGFTISTLFVTLGISVFFLGSIVYRFQKPGGSPLARIWQVVVAASRNFDKVLPCDSSALYEFSGQGSAIEGSRKSEHTSGLEFFDKAAILTLPDCESPGQLNKWKICTVTQVEELKILIRMFPIWSAMVLFAAVQEQMFSTFVEQGMTMEKHVGSFEIPTASFQSIDTLTVIMLVPIYERVLVPVIRKFTGRANGISSPQRIGIGLCFSMLSMVLAALVESNRLQIAQSEGLVHSKVTVPMSILWQGPQYFLLGVAEVFSNIGLTEFFCDESPDAMRSLGMAFSLLNISAGNYLSSFILSLVPVFTARGGSPGWIPDNLNEGHLDRFYLMMAGLSLLNIFVFVFYARRYKCKKAS

SEQ ID NO: 64721 - protein, 1041 aa, Photobacterium profundum SS9
MFNAADVLQPSFIERPLNEIWTLISPLYSVDESLWLEQLLPLAEPSDIERKHTTDKAAELIQRVRADKNAIQMIDALLLEYSLDTKEGILLMCLAEALMRIPDAATADALIRDKLSVADWKSHLKNSDSLFVNASTWGLMLTGKVVTMDAKEDGKPSHVINRLVNKMSEPVIRQAMNQAMKIMGHQFVLGRTISEAMKNGKSNRDKGFTYSFDMLGEAALTAQDAQKYFKDYIMAVESVGRDEYASQKGSNQQSPDPTVSIKLSALHPRYDVANEARVLDEMYESVLTLLSRARELNVGITIDAEEADRLELSLKLFEKLYRSDAVKGWGRFGIVVQSYSKRALPVLAWLAALSKAQGDIIPLRLVKGAYWDSELKLSQQSGFSDYPVFTRKESTDSAYLACARFLLSEHLRGVIYPQFASHNAHTISAIVAMTDHRDFEFQRLHGMGDALYNHAMDMYQANVRIYAPVGSHKDLLPYLVRRLLENGANSSFVHRLVDANCPIESLTEHPVDTLRSRPSLNNSLIPLPPQIFGESRKNSASINIDIESEWTPFNAAIQAFSQHQWQAGPIVNGVTLDGEQHAITAPYNRSESVGQVAFSSASQVAQAIDVASEAYPAWSQVAASERGECLQRLADLLELHTGELVALCHREAGKTIQDSIDEIREAVDFCRFYGEQASSELASAKSIKSFDGSTKQLTYQGRGVFACISPWNFPLAIFLGQVSAALAAGNTVVAKPAEQTSLIAYRAIELMLEAGIPAGAIQLLPGTGAEVGATLTTDVRIAGVAFTGSTETAQRINRSLVARDCEAVPFIAETGGQNAMIVDSTALPEQVVRDVVRSAFASAGQRCSALRVLFVQADIADRIITLIKGAMAELSVGRPELHSTDVGPVIDIAAKEKLLTHIESLKNQSTLVAQTQLSDECKLGDFVAPTAFEINSIDILKNENFGPILHIVRFKANEIDQVVDQINHTGFGLTLGVHSRNERTYCRIEQRARVGNCYINRDQVGAVVGVQPFGGQGLSGTGPKAGGPHYLYRFTKDVLSA

SEQ ID NO: 64722 - protein, 591 aa, Oryza sativa
MAMAMAMRRAAALGARHILAASSTSSSGVLLRRHMSVDAGAAMEKVRAAGLLRTQGLIGGKWVDAYDGKTIEVVNMQFALGNPCEQFVELIYFLQDALYLVQNPATGETLANVSCMGSKETSDAIASAHSTFYSWSKLTANERSKALRKWHDLIISHKEELALLMTLEQGKPMKEALVEVTYGASFIEYFAEEAKRIYGDIIPPTLSDRRLLVLKQPVGVVGAVTPWNFPLAMITRKVGPALACGCTVVVKPSEFTPLTALAAADLALQAGIPAGAINVVMGNAPEIGDALLQSTQVRKITFTGSTAVGKKLMAGSANTVKKVSLELGGNAPCIVFDDADIDVAIKGSLAAKFRNSGQTCVCANRILVQEGIYEKFASAFIKAVQSLKVGNGLEESTSQGPLINEAAVQKVEKFINDATSKGANIMLGGKRHSLGMSFYEPTVVGNVSNDMLLFREEVFGPVAPLVPFKTEEDAIRMANDTNAGLAAYIFTKSIPRSWRVSEALEYGLVGVNEGIISTEVAPFGGVKQSGLGREGSKYGMDEYLEVSIAIRHANCKHLSGFTLILFLITLLGLNMDIEKIGGVKCGMVVIR

SEQ ID NO: 64723 - protein, 472 aa, Photobacterium profundum SS9
MISPPDKSEFTTMKYQFPENFWWGSASSATQSEGAAFDGGKGDNIWDLWYQEQPNRFFNNVSATKASTFYQNYQTDIALMKEIGHNTFRTSFSWSRLIPTGRGEVNQEAVAFYGKVIDELIANDIEPFICLFHFDMPVAMQELGGWESREVVEAYADFADVCFKLYGDRVKHWFTFNEPIVPVEGGYLYDFHYPNVVDFKRAATVAFNTMLAHAEAVKRYRAQQLDGQIGIILNLTPSYPRSQNTADVKAANIADLLFNRSFLDPSVKGEYPQELIAFLQEHDQMPACQEGDLATIAAGNVDLLGVNYYQPRRIQAKLHTVNTDGPFLPEWFFDYYEMPGRKMNPHRGWEIYEQGVYDILTNLRENYGNIPCYISENGMGVEGEEKFIENGQVKDDYRIDFIKGHLTWLHKAVQEGANCKGYHLWTFIDNWSWANAYKNRYGFYRLDLETQTRTVKRSGEWFAQASKANGFD

SEQ ID NO: 64724 - protein, 519 aa, Zea mays
MAGGFGSGGAAAGRAELYEGKITGYFILACIVGSFGGSLFGYDLGVSSGVTSMDDFLVKFFPDVYRRKQAHLHETDYCKYDNQVLTLFTSSLYFAGLVSTFGASYVTKRHGRRASIMVGAASFFLGGAINAAAMNIAMLIVGRVLLGVGIGFGNQAVPLYLSEIAPYRIRGAVNQLFQLTTCLGILVADVINYFTDRLHPWGWRLSLGLAMGPATAIFVGALFLPETPNSLVERGHLEEARRVLEKVRGTHKVDAEFEDLKEASQAARAVTGTFRNLLAVRNRPQLIIGALGIPAFQQLSGMNSILFYSPVIFQSLGFGSSAALYSSIITGSMLVVGALISMVTVDRLGRRFLFIEAGIQMVSSMVVVAVILALKFGKGEELSKGVSTVLVVAICLFVVAYGWSWGPLGWLVPSELFPLEMRSAGQSVVVCVNLFWTASVAQCFLAALCHLRWGVFVLFAALIVVMSIFVILLLPETKQVPIEEIWMLFDRHWYWKRIVRRDPKYQGNLHHQQQEMSRI

SEQ ID NO: 64725 - protein, 514 aa, Candida albicans SC5314
MNQQQQQPLLKRVAHSVKKYATFIGPGLVVSVSYMDPGNYSTSVSSGSMYQYKLCFIIFMANLFAIILQALCVKLGTITGLDLAEMCRLHLNPKLNLFMYFCAEIAIIATDLAEVVGTAISLEILFGIPLLYGVVITVLDVLIILMAYHKDGSMKQTKFFEILVSILVAATCVCFILELFKCNFEPGSGWKIFKGFLPVNKEIFKESMALFLSCAIVGSTVMPHSLFLGSALVQPRLKEYDETHGTKANVLPVENEDTTRLVPPHQPVEGSRLRRISDGSLLTNKYKPSYAAIKYCLNYSYVELVSSLFIVAVFVNSAILIVAGSTLYGKPDAADADLLSIYEMLSYYISPAAGLVFALSMLFSGQSAGIVCTMAGQIISEGFINWTLEPWKRRIITRVLAIVPVIVVVGILGREGVSKVMNSSQVVLSFILPIVSAPLIYFTSKKEFMTVIDTSSTDESTPLLEENDLDEQIPVKKISFENGSLLRNASILTWVIITGLNVYLIIAFANGADI

SEQ ID NO: 64726 - protein, 982 aa, Bacillus subtilis
MNMMDVKSISVRVDGTEIQARAGATILDILNENGIEYPQICHVPEVDPIQTCDTCIVEANGKLVRSCATVAENGMSIDLSGNRVKEAQTEAMDRLLENHLLYCTVCDNNNGNCTLHNTAEMMGIEHQKYPYTPKEDPSCAVDMSHPFYRYDPNQCIACGQCVEVCQNLQVNETLSIDWERERPRVIWDEGVPINESSCVSCGQCVTVCPCNALMEKSMLGQAGFMTGIKEDVMEPMIDLVKNVEPGYGSIFAISEVEAAMRETRTKKTKTVCTFCGVGCSFEVWTKGRDILKIQPVSDAPVNAISTCVKGKFGWDFVNSKERITKPLIRKNGAFVESSWEEALDLVASRLGSIKEQYGKGSVGFISSSKITNEENYVIQKLARQVFETNNVDNCSRYCQSPATDGLFRTVGMGGDAGTIKDIAKAGLVIIVGANPAEGHPVLATRVKRAHKLHGQKLIVADLRKNEMAERSDLFISPKQGTDQVWLMAVTKYMIDQGWHDQAFIDENVNYFEDYKETLKTYTLDYAERITGLSKENIIQIAEMIRDADGTCVLWGMGVTQNTGGSDTSAAISNLLLATGNYRRPGAGAYPLRGHNNVQGACDMGTLPGWLPGYQHITDDKARAKFEEAYGVEIDGKPGLDNIQMLHAIEEGKMKAMYLVGEDMALVDSNANHVHDILSSLDFFVVQDIFLSRTAQYADVVLPATPSLEKDGTFTNTERRVQRLYQALPTLGDAKPDWWIIQEVANRLGANWNYSHPSDIFSEMASLSPLFAKASYEVLEGWNSFLWGSFTGESTPLLYEDGFNFPDKKARFALSDWTEPAAFPEEYDLHINNGRMLEHFHEGNMTNKSKGIQAKVPNVFVEISPELAQERGVCDGSLVRLVSPFGAVKLNALITDRVRKNELYLPMNSTDKESAINFLTGPAADKRTNTPAYKQTKVRMEVLGGCETAPLPKTNPRNKKRHPQNGVEAERKWNRPGYVHLTD

SEQ ID NO: 64727 - protein, 177 aa, Zea mays
  misc_feature (119)..(119): Xaa can be any naturally occurring amino acid
NLDPASGPVRMKAVGICRSDVHYLREMRIAHFVVKEPMVIGHECAGVVEDVGAGVTHLFVGDRVALEPGVSCWRCRHCKGGRYNLCEDMKFFATPSVHGSLANHVVHPADLSFKLPDRXSLDEGAMCDPLNVGVHACPRSGVGPETGVLLVGAGPIRLVSLLAARAFRAPPVSVRGC

SEQ ID NO: 64728 - protein, 236 aa, Oryza sativa (japonica cultivar-group)
MVEPVNDLPTFGVGHSLGSVIHLLIGSRYAVQRSGNILMAFNNKEASLAVPLFSPVIVPMAQSFGPIFSQLTSYPTLRFGVKSYYGISRNLLIKFKDDQIDETSILAQVLSSESAISSLLDMSIRSLPGDHGLPLQQVLPDVPPAMADAVNRGGELLTNLATGTPWEAVAKEVGTGGAQYCTVLSANLQFSFTRNVHLVATEDGYFIRLLQQQQQQQLILSHMGSTYPDIKYCMCV

SEQ ID NO: 64729 - protein, 1574 aa, Coccidioides immitis RS
MDGQRQQPYVPGPPPQTIQQTASQGHVMQLPPPPPQPPPPRVTHAASHGGLPPPPPVPPRVSGYGNQPGWQQAWSRQQGMGQSFYLPPPPSMLSSNQVYNQPLAYNPHQPPNSGSLSIQPPPTNDQPLTSATYIPGGSSFGPGVGIPPLDSYDNFSRADRAGYPPDSDTMRYIPQSYADQMNRSHQVPSSFREQSDSGNPLALNQNVHGQSSLQHSQGPTRENSSRHATSAISSGLSIHEADERWPLDRVLQWLVHNGFSTEWQETFKSLDLKGADFIDLGCGGANGMGNLGKMHQDIYPQLAKECVKSGTGWDQSREREEGVRMRKLIRGINSENAPSARFYENLHPSASTDGGVETSPHLRADSFPFDPSSTESGYQEPSSRSELSRNILVNAFGEWRRHSPSASSDHGAGLRASSNSRAGSPATQFASMATAEPAFLTGEFGHAKRNSSDSIISRGLRQAQGSSNPDHSTKQTELSTKDHKGFLNAIRKKIGPSHPSEEPHHDASISPVRNNQSFPYSGKPSLNASETSLVMGMSLPSSESHARKAISNLPPKKFIFVTLDGWNYRLVDVTDVDAADLLRARLCNGVGIKDPSSALIYVTEPGQVDHEEPLSDTMLVVNRRSRSDAQGSLKLYIQSMTPSAFNVSQYAGLGLSFSDRVANGAKPQRNILEDDTRNRTNQPSHTRRVSPSLAHRSSMQNLPSYSPFPEDDRLGENLSEDKERNAAILAAHEEHRRITEQKQQAFLQSRREQLQKKQASTVTTYGIKRGGFIDFDLPRTSPYEDKRTDDLVPRREPPTAPSASSTLTKVNSLNKKPGEKATDNTCHQRRSSKDFLSDNRQRSSSFSPKNASPSMGIAAAIANMGKISGSIAKPLASSTSFGHSPRTPSGSEFGRFSTESVDAGSASPHCGSSSSPRPSAFARSVSANSEIIARKSTPTQAESTPPDKSVHSFSASPSRASAIPPSRLSHGPDFDFQETEVSFVKSPQPAPQDSDEDSDEGLFAIPLANGKNKPQVNKKPPATRSRLAKPALTVNTNSRAAKGLSVTFESPGPCDSFTPLTDHSDSRSGHYSGDPDTDDLSPEDSRSARRRSFVRDDVWASRPPVEGMIEHLDDFFPNIDLDEPYLEAMPLTPPISPTATSSHPDTEPEQSFTLRDRVGQGGPPTTSIPRNASDTLGSDESTLKGKAAPKTVAHRNVGRSTGLSRMKSIREVAKGAHQIRRNQSIAASKNAQSGMLRRKSTKMFGARIMQISPKPGSRLSDLDPLPQHPVPQEKLPQRQATFRIIRGQLIGKGTYGRVYLGMNAETGEILAVKQVEVNQKAAGYDKDRIKEMVQAMDHEIDTMQHLEHPNIVQYLGCHRSELSMSIYLEYIPGGSIGSCLRKHGKFEESVVQSLTIQTLRGLAYLHDKGILHRDLKADNILLDLDGTCKISDFGISKKSDNIYGNDVTNSMQGSVFWMAPEVVQSQGQGYSAKVDIWSLGCVVLEMFAGRRPWSKEEAIGAIFKLGSLNQAPPIPEDVSMNICPAAIAFMYDCFTINTFDRPTAETLLSQHPFCIPDPNFNFLDTELHAKIGHL

SEQ ID NO: 64730 - protein, 97 aa, Oryza sativa
  misc_feature (26)..(26): Xaa can be any naturally occurring amino acid
KVKTLPDLRPGDIIELRMQRPNKRRXSLFKGIIIAKHKSGVHTTIRVRRIIAGVGVEITFPIYSPRIKEIKVIRHKKVRRAKLYYLKHKLPRFSTFK

SEQ ID NO: 64731 - protein, 391 aa, Arabidopsis thaliana
  misc_feature (250)..(250): Xaa can be any naturally occurring amino acid
MVQISDLPRDLTEEVLSRIPVTSMRAVRFTCKKWNTLSKDRSFTKKHLRGARAAAKKKQTKEFQVIMMIQFRVYLYSVNLLNPSIERIGKLISLDVEDHVDISKIFHCGGLLLCITKDISRLVVWNPYSGQTRWIKPRNSYHRLDRYALGYEEKNKSCRCYKILRFMDDYEDDRALRLIREFEIYDLNSDSWKVVNVTPDWDVEFYHRSLSLKGNTYWFAQEKLPPLPRGRVITISDMADFLLCFDFTRXRFGPRLPLPFHSFVEDTVTLSSVRDKKLAVLFQPCSASTVKIWISRKIEPNAVSWRKVFLAVDMKSLTGFQFDINAASFFVDEKKKVAMVLDKDRFSYKFTRNIAYIIGKKGYFEKVDLGESTVSSCASLVCSYVPSSVQI

SEQ ID NO: 64732 - protein, 479 aa, Corynebacterium efficiens YS-314
MLCRTRIVEIVTEHYDVVVLGAGPGGYVSAIRAAQLGKKVAVIEKQYWGGVCLNVGCIPSKALIKNAEIAHIFNHEKKTFGINGEVTFNYEDAHKRSRGVSDKIVGGVHYLMKKNKITEIDGFGTFKDAKTIEVTDGKDAGKTVTFDDCIIATGSVVNSLRGVEFSENVVSYEEQILNPVAPKKMVIVGGGAIGMEFAYVLGNYGVDVTLIEFMDRVLPNEDPEVSKVIAKAYKKMGIKLLPGHATTAVRDNGDSVEVDYQKKGSDKTETITVDRVLISVGFRPRVEGFGLENTGVKLTERGAIDIDEHMRTNVDGIYAIGDVTAKLQLAHVAEAQGIVAAETLAGAETQTLGDYMMMPRATFCNPQVASFGYTEEQAKEKWPDREIKVSSFPFSANGKAVGLAETDGFAKIVADAEFGELLGGHIVGANASELLNELVLAQNWDLTTEEISRSVHIHPTLSEAVKEAAHGVNGHMINF

SEQ ID NO: 64733 - protein, 320 aa, Brassica napus
MGGHQGSSTGRFSSATWFSQLCASARRFKSLAPPSLETAVRSTSGDSLFRRLGLFDPILLGIGPSIGAGVFVVTGTVARDAGPGVTISFLLAGASCVLNALCYAELASRFPAVVGGAYMYSYSAFNEITAFLVFVQLMLDYHIGAASISRSLASYAVALLELFPAFKGCIPLWIGSGQELFGGFLSFNILAPILLALLTLVLCQGVRESSAVNSVMTATKVVIVLVVICAGAFDIDVANWSPFAPNGFKAVLTGATVVFFSYVGFDAVANSAEESNNPQRDLPIGIMGSLLVCISLYIGVCLVLTGMVPFSLLSEDAPLA

SEQ ID NO: 64734 - protein, 227 aa, Populus alba x Populus tremula var. glandulosa
MAEGNKSHEYETKVGEESGAVETKDRGLFDFLGKKEEEKPQEEVIVTEFEEKLQVSEPETKAEEEHKKKEEEEKKPTLFEKLHRSGSSSSSSSDEEEGDDEEKKKKKKEKKSLKEKMKISGEKGEEKEHEDTSVPVEVVHAETPHEPEEKKGFLDKIKEKLPGHKKADEVPPPPPPAPEHVSPEAAVSSEGDAKEKKGILEKIKEKLPGYHPKTEEEKEKEKESASQ

SEQ ID NO: 64735 - protein, 759 aa, Bordetella parapertussis 12822
MAFPGLKYASSGLLAALRLGRRTGKKGRTPPSPSPGAQEAVDAAASPVASLAPLTEIISTYLDPKEVERVREAYRFADQAHLGQFRASGAPYISHPIAVTEICAGWKLDANALSAALLHDVMEDQGVGKHELAEKFSPEVAELVDGLSKLDRLDFATKAEQQAESFRKMLLAMARDVRVILIKLADRLHNMRTLDAVNPEKRRRIARETLEIYAPIAHRLGLNLLFRELQDLCFAAMYPNRYQVLYRAVLAARGNRREVISKIEDAVRAALPAAGIEAEVTGREKTLYGVYRKMTEQKKSFSEVLDIYGFRVIVHTLPECYLALGTLHQLYRPVPGKFKDYIAIPKVNGYQSLHTTLVGPYGTPVEFQFRTRDMHHIAEEGVASHWLYKDADLTLNELQKRTHQWLQSLLDIQSQTGDSGEFLEHVKVDLFPDAVYVFTPRGKIISLPRGATPVDFAYAIHTDIGNQAVAAKVNGEFVPLRTELSSGDTVEIITSPASRPNAQWLNYVRTGRARSEIRHYLRTVKYEESVAFGERLLEQAMIELHLPVPSTDDPQWDKLARSSGASSRDEILADIGLGKRLAAVVARRFAPEHDLIATTAAAVDQITSARAAPILIQGSEGQAVQLAPCCGPLPGDPIIAGMRLGHGLVVHTSDCPVALRARAREPERWINVAWDAQTAKHLPTRLDIVTRNERGVLGRLAAEVTAADANIVHVTMHDDAVSTVSLHLTVQVDSRKHLAQVIRAIRHVPQVQKIVRVKG

SEQ ID NO: 64736 - protein, 437 aa, Oryza sativa (japonica cultivar-group)
MGDHQMMHAAPAAMYNGGGGTTSSHGVWWSNAVGVPAAATCSTTTELAGYTAWSSALAAGYDGMVADNGGKQAKSTTTASSESPGNNSSVTFQEPASIPDPAAVAAVPQPGLAGFTDWTQPFMNNGAGLHEFLQDGHHDMSASSLMNHSSNNLALQQAGHHHELLSSFGSDLLLSPTSPYGGFQSSLLRSLMEPTAKQQQQQPALAGLQQYHQYQQQMGHAPAAAAKFAQAVGARDSLQFTNDAPFWNPSAGFGMPAAVAVAAAAAQDQASVRSAKRSSPAPPRAAATLALKTAMEGVGDSSSVITKKETAFKKPRLETPSPLPTFKVRKEKLGDRITALQQLVSPFGKTDTASVLHETIEYIKFLHDQVGALSAPYLKNGAHQVPHLKNSSPDKSKHGEISLKGRGLCLVPISSTFAVASEVPVELWTPFGANFIR

SEQ ID NO: 64737 - protein, 868 aa, Oryza sativa
MQQPQASSMTAAARRRQLQGSVLAGKMVLVRKALDTNLNSGDVVCQLVSSTVGDPDNGNRGMLGQEACVHINSELHPTPYEASTFSFEFIWDMKKQGVPGAVIVKNYCDEEFFVNTITLDIVPGYGTIVFTAESWVYPDEIYDHLPRVFFSNQPYLPNQMPAPLVPYREEELRNLRGDDNPGPYKDHDRVYRYDVYNDLGEPDSGNPRPVLGGSDEHPYPRRCRTGRRRTNTDPDSESRNVGFPLTNHFYVPRDEVFNDRKKAYFDTNNLKLYIMQKYATFLLHADQQTPFEFDSFADVLSLYDEGSINLPGWLNTFLQPLLGIIPFKLLQQVLTPDSEFILKFPMPAVIREDKTAWQTDEEFAREMLAGTNPVVIRRLGETEFPPKSKLDTSKYHNQNSRITAAHVEKCLEVEGLTVEQVLADGRLFILDHHDHFMPYLLDANHQPDTFVYATRTLLFHRNDGTLQPAAIELSLPRFEAGSTLNSSVGEVYTPASDGVEGHIWQLAKAYVTVNDYSWHQLVSHWLNTHAVMEPFAIATHRQLSVAHPIHKLLHPHYRDNLFINALGRQSLINAGGSSENTVFLGKYGLSMTSEVYRNWNFTEQALPEDFIKRGVAKRRSNGELELLIKDYPYAVDGLAIWSAIETWVRDYCAIYYADDAAVQGDAELQSWWKDVREEGHGDLKDHKWWPEMKTVAELVQSCATIIWIASALHAAVNFGQYMYAGYVPNRPSVSRRPMPKPGTDLYRELELHPEKEFLLTITKQDLSIAGIALVELLSSHSDDEVYLGQRDSPNWTSDLDAMNAFDRFRERLLEVEKNIVAKNDKGSGFKNRTGPVNIPYNLLFPYASGDAEANTGVTGKGIPNSASI

SEQ ID NO: 64738 - protein, 510 aa, Idiomarina baltica OS145
MAHDKKPLVLMILDGWGYRDSAPDNAITAANTPVMDRLWNEYPHCLVDGSGGAVGLPDGQMGNSEVGHVNLGAGRVVYQDFTRISQSIKTGEFFDNPVLTENVEQAVAKNGAVHIMGLLSAGGVHSHEEHLMAMVELAHKKGAQRIYVHGFLDGRDTPPKSAGPSIEKFEALFERLGVGRFASLSGRFYAMDRDNRWERIEGAFNAVYHGRAEHRANNAHNALADAYERGESDEFVSPVVIGEPAAIEDGDAVFFMNFRADRAREMTRAFIDNELDTFERGIRKQLSGFVMLTQYADEFDTPCAFPPVRLDNVLGEWLAKHDKTQLRISETEKYAHVTFFFSGGREQAFDGEQRKLIPSPKVKTYDLQPEMSSKQLTDAIVEAVDNQEYDVIICNYPNGDMVGHTGNFDAAVKACEAVDHSVGRVVEALQKVGGECLITADHGNAEQMSDPSTGQAHTAHTSELVPFIYVGRHATPRNGILSDVAPTMLHLMGLEQPNEMTGKTLMQLDG

SEQ ID NO: 64739 - protein, 894 aa, Oryza sativa
  misc_feature (289)..(289): Xaa can be any naturally occurring amino acid
MPPWWGKSFSKDAKKTTKENLIDTFHRLISPNDQKGSTKSKRSCRRGNDSSVEKSCRSTTVSRPTSPSKEVSRCQSFSADRPHAHPLPIPGVRPPVTRTVSDITESKPILEKRGKPPLLLPLPKPNRPPRRHGNSEVVSEIVVASPSSNCSDSDDHGDSQLQSPVGNDAENATLVTLKNKSSNARKECPGPITAKNMKEIHRPANQVHGSHILSTSPRGVAADSYQSNLQNPRPLVLDSAPNSLMSSPSRSPRRICPDHIPTSAFWAVKPHTDVTFVTRGQCSSPGSGXTSGHNSVGGDMLAQLFWQPSRSSPECSPIPSPRMTSPGPSSRVHSGSVSPLHPRSGGMAPESPTNRHDDGKKKQTHKLPLPPLSISHSSFHPNNSTPTSPISVPRSPGRTENPPSPGSRWKKGKLIGRGTFGHVYVGFNSDSGEMCAMKEVTLFLDDPKSKESAKQLGQEISLLSRLQHPNIVQYYGSETVDDKLYIYLEYVSGGSIHKLLQEYGQLGEQAIRSYTQQILSGLAYLHAKNTVHRDIKGANILVDPSGRVKLADFGMAKHINGQQCPFSFKGSPYWMAPEVIKNSNGCNLAVDIWSLGCTVLEMATSKPPWSQYEGIAAMFKIGNSKELPPIPDHLSEPGKDFIRKCLQRDPSQRPTAMELLQHPFVQKAVSLEKSVLSEPLEHLAVISCRSSAKMAAHTRNISSLGLEGQTIYQRRGAKFSSKHSDIRIRSNISCPVSPCGSPLLKSRSPQHSNGRMSPSPISSPRTTSGTSTPLSGGNGAIPFNHLKQSTYSNEGFAIPSRSPDDLFASRPTDPDLGQFIRVHQVSQGLQERVVSEADILSPQFGKRLGNVFDLRDKLSPSERFTHHAFVDHVKLNPSLDLTSGSPHLGLKHGN

SEQ ID NO: 64740 - protein, 664 aa, marine gamma proteobacterium HTCC2207
MFLKRKLSFMCGILGLSEVLQETLYTRRDRQETISRCFEEGLAILSHRGPDASGAKYFFDEGVFLGHTRLSIQDLSPAGTQPMMSLDEKYAITFNGEIYNFPVLKEKLEFLGYNFSSNTDTEVILNLYQEYGLDCFAMLDGIFALGIFDKEKNQLIISRDGLGIKPLYYYQDESRLVFASEIKAIEIFLKDVVLTLQKSNINKYLTFQWCPGEGTPFAEIKKHIPGETLVVTDGKIVDRKTFYRLPIFRPPAKNLKTSVRSIISGLDANLRIAVHDQMLSDAPVGAFLSGGLDSTSIVAFAKEIDPNITCFTIDAGNAANDGMADDLPYARAAAEHLKVPLEIVKVNPESLVQNLEKMVWMLDEPLGDPAPLNVFYISQLAKDNGIKVLLSGAGGDDILTGYRRHHAIMIDRQIQRLPKVLLSAVELFSGKLDKRVTLFRRLAKLFNGISLAGESRIINYFKWADQGQLLSLYTNDFRNEIKNELAEQPMLDFLAHAHPDSTDLDKMLALEQRFFTTDHNLMYTDKMSMAAGVEVRVPLLANNLIEYAATIPDNLKQNGRQGKWIFKKTMEAYLPKEIIYRPKTGFGAPLRSWLKVELRDYLEDLLSRKSLYSRGLFDPEAVHALISRNDEGQVDASYTIFSLMCIEIWCRQHVDSVKLSTGST

SEQ ID NO: 64741 - protein, 168 aa, Arabidopsis thaliana
MATVKGLLKGLRYITQIFDANNNQIGEGVGLQELLPPTDKPKHKKTRRKSETVSQNGSPPRRNSSASASDMQPKNTRRHHRSRHGSIDSSNDPSVRRRRVVSVTTNDMEGSYPLSDSSTHSRKSTSRHRKPKGSGGGELSMKKTKGKTENPIVESVDTCNDNNISDKE

SEQ ID NO: 64742 - protein, 172 aa, Methanothermobacter thermautotrophicus str. Delta H
MLIGVISDTHIPDRASEIPEAVFDAFRDVELILHAGDLTSPDILTELETLAPVECVQGNMDRHYGIETPRSRLFEIESFRVGLIHGEVYPRGDTQQLRYLGLELGADVLISGHTHQPFIRELEDMVLLNPGSPTVPRLTDPSVMVLRIDGEKLDAEIIRTGAPVCRSLNFRR

SEQ ID NO: 64743 - protein, 351 aa, Arabidopsis thaliana
MTNAEAVTVTNKQIIFPDYVTGFPKESDLKITTTTIDLRLPEGSTSVLVKNLYLSCDPYMRICMGKPDPLSSSLVPPYKTGVPIIGLGVSKVIDSGHPDYKKGDLLWGLVGWEEYSVITLTTYSHFKIEHTDVPLSYYTGLLGMPGMTAYAGFYEVCSPKKGETVFVSAASGAVGQLVGQFAKLMGCYVVGSAGSKEKVDLLKTKFGFDDAFNYKEEKDFSAALKRYFPEGIDIYFENVGGKMLDAVLINMKLHGRVAVCGMISQYNLVDPEGVHNLPTILYKRIQLQGFGVCDFYDKYPKFLDFVLPYIREGKITYVEDIAEGFESGPSALLGLFEGKNVGKQLFVVARE

SEQ ID NO: 64744 - protein, 450 aa, Bradyrhizobium sp. BTAi1
MTTRPRFVWGASTSAFQIEGAAHRDGRADSIWDVYLRAPGRVSHNDTADIACDHYHRYADDVTLMRDLGLDAYRFSIAWPRVLPQGRGAANEAGLAFYDRLIDALLAAGIEPWLCLYHWDLPQALGELGGWQNRDIAGWFADYTALVARRYGDRVKRFATFNEPGVFTLFGYGLGWHAPGVADKAALHQAIHHVNLSHGRAVDVLRRDVVGASIGAIHNRQPCYPCTSSPEDAAAALRLAAYWNDAFPFPQAFACYPPALRDAVTPYVRPDDMAQIGRPVDWFGLNHYSPHYVKADTNLIGASFGPPPQAVPRSAIGWPVVPDAFRETLVDIDQRFRIPIYVMENGTAAADVIDPAGDIQDDDRIGYLKAYITAMEQAIAAGADVRGYFVWSLMDNFEWGAGYSQRFGIVYVDHATQRRIPKASARWYAEMIAARRSPDDPAGPHNRAEE

SEQ ID NO: 64745 - protein, 81 aa, Brassica napus
MPLSATMVGALLGLGTQMYSNALRKLPYMRHPWEHVVGMGLGAVFANQLVKWDVKLKEDLEVMLDKARAANERRYFDEDRD

SEQ ID NO: 64746 - protein, 322 aa, Bradyrhizobium sp. BTAi1
MLLGDIGGTNARFALLDGGTIDHVEHLKVADYPTIDDAITEFLARHAAGGAPGAAVLDIAGPIERNRGMLTNSTWVIDGAELKARFNLRSARLLNDFEAVGWSLPALHPDDLFPLGGDAAVAGAPMLVIGPGTGFGAACYLPGDGRPMVAVTEAGHATLPATTAREAAVLAKMRERFGHVSIERALSGMGLENVYRAVAAVDGVTVPPRDAAAITSAALDGSCTTSRATLDMFCAWLGAVAGNLTLTFCARGGVYIAGGIPPRFPDYFARSDFRRQFESKGRYDSYLRPIPVHLVTKPDISFLGLKSFYESVIPASGGAPTR

SEQ ID NO: 64747 - protein, 320 aa, Lactobacillus plantarum WCFS1
MKRIGILTSGGDAPGMNAAVRAVAGKAMAEGLEAYGINYGFAGLVAGDIHKIEAADLDGVIQRGGTLLYSARYPEFAHEEGQLKGIEQLKRFGIDALVVIGGDGSYHGALRLTEHGYNTIGLPGTIDNDIPYTDFTIGFDTAVNTNVQALDRIYDTAHSHDRTFVVEVMGRGAGDVALWSGVSIGATAIVVPEVDWDMEEIANKIKHNRANGHRSNLIVLAEGVMGAQEFVEKLSEYGDFDARGNTIAHMQRGGNPTAKDRVMASKMGAYAVELLLAGKGGLAVGIQNNQLVNHNILDLFESKHDVEVSLDKLNEEISFK

SEQ ID NO: 64748 - protein, 458 aa, Zea mays
MAAASPPPSPPHAKRPKMSSSSDPEADAEPTSASAAVEGADPAQRRPRYKRRKVAILLGYCGAGYQGMQKNPGARTIEGDLEEALYQAGAVPEADRSAPRRYDWARAARTDKGVSAAAQVVSGRFYVDPPGFIDRLNAQLAPQIRAYGYVRVTNSFNAKKFCDRRRYLYLLPVFALDPSAHPDREAVMASMGSGSELTKCLECSERGRKIPGVMGREGKLPSPGQNGVDAPVEGSSHDESGTLGDAKCDHTSSDGNNPFAHGEVGSNSKEKPDLPVSGDRTEVANAKMGSNGDGAVVSSDFCSDLNSSADADIYIGNEEKKLEPAATENKAQGMESEKINGEEKLPTKSTFSYTDEVKERFNRILKYYIGTHNFHNFTTRTKAEDPAAKRFIISFAADRVVSLDGIDFVRDVNLNVPTAPEVGLYLDECMFTSYNKKWKDSHEAVSMEPYSEEAEEFK

SEQ ID NO: 64749 - protein, 128 aa, Glycine max
NRQHTAASTHTISISTAKKPLHVHTKPSYERAWLTLAADNKKESSTDGHKILPDWGYRHVYTDESVNCTYPEPINAHNFGEKLALFASTDRGGDASFNTTERIEALTEQPCTLETTLCSKKHQNDYLD

SEQ ID NO: 64750 - protein, 326 aa, Bacillus subtilis
MKAVTYQGIKNVVVKDVPDPKIEKSDDMIIKVTSTAICGSDLHLIHGFIPNMQEDYVTGHEPMGIVEEVGSGVTKLKKGDRVIIPFNIACGECFFCKNQLESQCDQSNDNGEMGAYFGYSGQTGGYPGGQAEYLRVPFANFTHFKIPESCEEPDEKLSVIADAMTTGFWSVDNAGVKKGDTVIVLGCGPVGLFAQKFCWLKGAKRVIAVDYVNYRLQHAKRTNKVEIVNFEDHENTGNYLKEITKGGADVVIDAVGMDGKMSDLEFLASGLKLHGGTMSALVIASQAVRKGGTIQITGVYGGRYNGFPLGDIMQRNVNIRSGQAPV

SEQ ID NO: 64751 - protein, 355 aa, Burkholderia sp. 383
MKIAVLPGDGIGPEIVNEAVKVLNALDEKFELEQAPVGGAGYEASGHPLPDATLKLAKEADAILFGAVGDWKYDSLERALRPEQAILGLRKHLELFANFRPAICYPQLVDASPLKPELVAGLDILIVRELNGDIYFGQPRGVRTAPDGLFAGEREGFDTMRYSEPEVRRIAHVAFQAARKRAKKLLSVDKANVLETSQFWRDIMIDVSKEYADVELSHMYVDNAAMQLAKAPKQFDVIVTGNMFGDILSDEASMLTGSIGMLPSASLDKNNKGLYEPSHGSAPDIAGKGIANPLATILSAAMMLRYSLNRAEQADRIERAVKTVLEQGYRTGDIATPGGQQVGTTAMGDAVVAAL

SEQ ID NO: 64752 - protein, 266 aa, Zea mays
MHSQHLYPLPHRRLSNTMIGYLNLVTLVASIPIIGAGLWLAHGSAAVTCESALQTPLLAIGFIVLLISLAGFIGACYHVTWALWLYLLAMLLLVLALLGITVFGLAVTAGGGGGRQVPGRPYREFRITDYSAWLQRHVEVDRYWRAALACVVGSRACPRIAAWTPLDYLQHNLTPIQSGCCKPPTSCTYNEQGIPIAAPAQDEEDCYRWNNAPSVLCYQCDSCKAGVLEQVRRDWHTITILNVIVLVLLIAIYSCGCCAFRNVLKG

SEQ ID NO: 64753 - protein, 322 aa, Streptococcus agalactiae 2603V/R
MVTLSKEQHLDMFLKMQRIRDVDMKFNKLVRRGFVQGMTHFSVGEEAASVGAIQDLTDSDIIFSNHRGHGQTIAKGIDIGGMFAELAGKATGTSKGRGGSMHLANLEKGNYGTNGIVGGGYALAVGAALTQQYEGTDNIVIAFSGDSATNEGSFHESVNLAAVWNLPVIFFIINNRYGISTDITYSTKIPHLYMRADAYGIPGHYVEDGNDLMAVYEKMHEVINYVRSGNGPAIVEVESYRWFGHSTADAGVYRTKEEVDSWKAKDPVKRYRAYLIENEIATEEELAAIEAQVIKEVEEGVKFAEESPFPDMSVAFEDVFVD

SEQ ID NO: 64754 - protein, 332 aa, Streptococcus agalactiae 2603V/R
MSETKVMALREAINVAMSEEMRKDEKVFLMGEDVGVYGGDFGTSVGMLEEFGAKRVRDTPISEAAIAGSAIGAAQTGLRPIVDLTFMDFVTIAMDAIVNQGAKTNYMFGGGLSTPVTFRVASGSGIGSAAQHSQSLEAWLTHIPGLKVVAPGTVNESKALLKSSILDNNPVIFLEPKALYGKKEEVNMDPDFYIPLGKGDIKREGTDLTIVSYGRMLERVMQAAEEVAEEGINVEVVDPRTLIPLDKELIIDSVKKTGKLILVNDAYKTGGFTGEIATMVAESEAFDYLDHPIVRLASEDVPVPYSRVLEQGILPDVAKIKDAIYKVVNKGK

SEQ ID NO: 64755 - protein, 462 aa, Streptococcus agalactiae 2603V/R
MAVEIIMPKLGVDMQEGEILEWKKQVGDVVNEGDVLLEIMSDKTNMEIEAEDSGVLLKITHGNGDVVPVTETIGYIGAEGEEVTEASSSENTSVEENATQVTSEPEKVEETSEPSVPAATSGEKVRATPAARKLAREMSIDLALVSGTGANGRVHREDVENFKGAQPRITPLARRIAEDQGVDIAEITGSGIRGKIVKNDVLAAMSPQAAEAPVETKATPTTEEKQLPEGVEVIKMSAMRKAISKGMTNSYLTAPSFTLNYDIDMTEMMALRKKLIDPIMAKTGLKVSFTDLIGMAVVKTLMKPEHRYLNASLINDAQEIELHNFVNIGIAVGLDDGLIVPVVHNADQMSLSDFVIASKDVIKKTQEGKLKSAEMSGSTFSITNLGMFGTKTFNPIINQPNSAILGVGATIPTPTVVDGEIVARPIMAMCLTIDHRIVDGMNGAKFMVDLKNLMENPFGLLI

SEQ ID NO: 64756 - protein, 301 aa, Azoarcus sp. BH72
MMVERHRILVVDDERINRKLLSELLEEHHDVVIAKSGEQALERVQADSAVDLILLDVVMPGMSGHDVLRRLKASDATKDVPVIFITSLNSVDDEEIGLDLGAADYITKPFHPGIVRLRVENHLRFVRQRKILETLAGRDCLTEIDNRRRFEEVLEREWRRAGRGSGPMSVAIIDVDYFKQYNDHYGHARGDQALKAVAKALSGGPNRASDFVARYGGEEFVMLFPGTPADGARELAESVRHAVASLAIPHAHSAVAPHLTVSIGGATSDDYQSPGHALIEAADTMLYRAKAEGRNRVLWRD

SEQ ID NO: 64757 - protein, 585 aa, Streptococcus agalactiae 2603V/R
MAFDVIMPKLGVDMQEGEILEWKKNEGDTVNEGDVLLEIMSDKTNMEIEAEDTGVLLKIVHQAGDVVPVTEVIAYIGEEGEEVGTSSPSADATITAEDGQSVSGPAAPSQETVAAATPKEELAADEYDIVVVGGGPAGYYAAIRGAQLGGKIAIVEKTEFGGTCLNVGCIPTKTYLKNAEILDGLKVAAGRGINLASTNYAIDMDKTVAFKNSVVKTLTGGVRGLLKANKVEIFNGLGQVNPDKSVVIGDKVIKGRNVVLATGSKVSRINIPGIESPLVLTSDDILDLREIPKSLAVMGGGVVGIELGLVWASYGVDVTVIEMADRIIPAMDKEVSLELQKILAKKGMKIKTSVGVSEIVEANNQLTLKLNNGEEVVADKALLSIGRVPQMNGLENLEPELEMERGRIKVNAYQETSIPGIYAPGDVNGTRMLAHAAYRMGEVAAENALGGNKRKAHLDFTPAAVYTHPEVAMVGMTEEQAREQYGDILVGKNSFTGNGRAIASNEAHGFVKVIAEPKYKEILGVHIIGPAAAELINEASTIMENELTVYDVAQSIHGHPTFSEVMYEAFLDVLGEAIHNPPKRK

SEQ ID NO: 64758 - protein, 918 aa, Streptomyces coelicolor A3(2)
MASASDRSDRSPIIIGGLPSQVPDFDPEETQEWLDSLDAAVDERGRERARYLMLRLIERAREKRVAVPEMRSTDYVNTIPTKSEPFFPGNEEIERKILNATRWNAAVMVSRAQRPGIGVGGHIATFASSASLYDVGFNHFFRGKDEGDGGDQVFFQGHASPGIYARAYLLDRLSEQHLDGFRQEKSKAPYMLSSYPHPRSMPDFWEFPTVSMGLGPIGAIFQARMNRYMHARGIADTSKSHVWAFLGDGEMDEPESLGQLSIAAREGLDNLTFVVNCNLQRLDGPVRGNGKIIQELESVFRGAGWNVIKLVWDRTWDPLLAQDRDGVLVNRMNTTPDGQFQTYATESGAYIRDHFFGDDHRLRAMVENMTDDQILHLGRGGHDHRKIYAAYKAALEHKGQPTVILAKTIKGWTLGPNFEGRNATHQMKKLTVDDLKRFRDRLHLPISDKELESGPPPYYHPGRDTEEMQYMHDRRLGCGGYVPTRVVRSKPLALPDDKTYATVKKGSGQQSIATTMAFVRLLKDLMRDKEIGRRFVLIAPDEYRTFGMDSFFPSAKIYNPLGQQYESVDRDLLLAYKEAPNGQMLHDGISEAGCTASLIAAGSAYATHGEPLIPVYVFYSMFGFQRTGDQFWQMGDQLARGFVLGATAGRTTLTGEGLQHADGHSQLLASTNPACVAYDPAFGFEIAHIVKDGLRRMYGGDEQHPHGEDVFYYLTVYNEPIRHPAEPENVDVEGILKGVYRFSEGTGGSIPAQIMASGVAVPWAVEAQRILAEEWNVRADVWSATSWNELRREAVACEEHNLLHPEEEQRVPWVTRKLAGAQGPFVAVSDWMRSVPDQIARWVPGTYQSLGADGFGFADTRGAARRFFHIDAQSIVVGVLSELAREGKVDRSVLKQAIDRYRLLDVTAADPGAAGGDA

SEQ ID NO: 64759 - protein, 141 aa, Glycine max
MGDRLVVDQQHTGDAQLPSSPPSKDDMVSCVMALEAALLPCLPARELQAIDRSPHPSHQIDVDRYARDFMEAAKKLQLYFISLQREDKPTKLEMLRKEVALMEEELNKKNELIKKQENLIQEWKKELKDQLDKHKIELDRV

SEQ ID NO: 64760 - protein, 851 aa, Oryza sativa (japonica cultivar-group)
MARLNPSKPSSRGGKPRSSSADAMAEHKPLPGRPKREGEGASKRKAKSGGFESMGLCEEVYRGVRHKGYRVPTPIQRKAMPLILAGHDIAAMARTGSGKTAAFLVPMIQRLRRHDAGAGIRALILSPTRDLATQTLKFAQQLGKFTDLKISLIVGGDSMESQFEELAENPDIIIATPGRLVHHLAEVEDLNLRTVEYVVFDEADSLFSLGLIQQLHDILHKLSDTRQTLLFSATLPQALADFAKAGLRDPQIVRLDLDKKISPDLKLAFFTLRQEEKLAALLYLVRERISSEEQTIIFVSTKHHVEFLNILFREEGLEPSLSYGAMDQEARNIHISKFRARKTMILIVTDVAARGLDIPLLDNVVNWDFPAKPKLFVHRVGRVARQGRSGTAYTFVTSEDMAYLLDLHLFLSKPLRPAPTEEELLKDMEGMNLKIDRALANGETVYGRFPQTIIDLVSDGIKEVINGCTDLIALEKPCTNAFHLYLKTRPMPSTESIRRVKDLPREGLHPIFRDVLGSDELSALAFSERLKSFRPKQTILEAEGEAARGSNQWLDVMKKKREVHEGIINLVHQKNNVDHEPKEELVENISNWERKDVCGNKRKLQSFRDEEYYISSVPQNQHLEAGLSVRANEGFVENRLDAAVLDLVDDETSGMQAQKTRYHWKKNKFVKLNSGDRVTATGKIKTESGAKLKPTKTGIYKKWQQKTHRSIDTGRKFGGFAEEGASTTGSHQRGNRKHTAVGRGRRYIPNADVPSEIRNPEQIQKSRQQKAMDIARMKNRSTKESKFQKFQKNNRRHDGPLKDGKFQKNRRPDGNGKNRRPDGNGKGRGKGKGNANGFGKGKGKMKGKGTR

SEQ ID NO: 64761 - protein, 811 aa, Bradyrhizobium sp. BTAi1
MTAPGYIRWFKDLRIEDVPEVGGKTASLGELYSALAPHGVRVPNGFALTAASYRDALRAGGADDELRKLLAGLDKRRIADLAKRAAKARAIVFAATDRDELRREVTQAYRQLEQEYGRGVAVAVRSSATAEDLPNASFAGQHESFLNVRGPKDLFEACRRCFASLYTDRAISYRIDNGFAHDKVALSVAVMKMVRSDLAASGVMFSLDTESGFRDVAFITGVYGLGETIVQGTVDPDEFYVHKPTFAAGFRSVLSRRLGAKDKRMVYAKTGARGATTRTEAMPPADRAKFCIDDADVLELAQATITVEQHYSQKAGRPTPMDIEWAKDGRDGALYIIQARPETVASQRRPEAIETHVLQKTGQVLATGRAVGEKIAAGKIRLIRTAKDLRAFRPGEVLVAASTSPDWEPVMKTAAAIVTDHGGRTCHAAIIARELGVPAVVGTEDFSARAKTGASVTVCCAEGDAGHVYHGALPFEVQRIAIDRLEKPRTEIMVNLGNPELAFKTALLPSDGVGLARMEFIINQSIGIHPMALATPNKVNSAKDRATIKRLTARYKKPADFFVERLSEGVGTIAAAFYPRPVIVRLSDFKTNEYASLIGGSDFEPKEENPMLGFRGASRYAHPAYAAGFALECAALKRVRDVMGLRNLKLMIPFCRRVEEARKVIAAMAGHGLVRGENGLEIYMMCEIPNNVILIDDFAQHFDGFSIGSNDLTQLTLGVDRDSELVAFDFDERDPGMLAMLKLAIDGAHRNHRHVGICGEAPANYPEIARYLAGLGIDSISVNPASILRTMAIVRAAEQELVAPAPQALAS

SEQ ID NO: 64762 - protein, 176 aa, Candida glabrata CBS 138
MPAYNSTFPSDPQTDRMVGNLVLLPLNTKFRGPAYQANSDYDIVDECLDLFRANSFFKNFEIKTNSDRLLIYGILYINDCLNHLKQTTSHNEAIKVLTNLALDDFSLPGTSGFPLNSVYSIPTADHNAMELLKSYLQQFRQELASRLIERIYAESQDHPSKFWLAFTRRKFMNKSL

SEQ ID NO: 64763 - protein, 445 aa, Bradyrhizobium sp. BTAi1
MSAIVSTAELRRSRVRLLIVTMLFLVTTVNYADRATLSIAGPALSKELHLDPVAMGYVFSAFGWSYVLAQVPGGWLLDRFGSRWVYACSIVVWSIFTLMQGWIGFFSGGAAIVALFALRFLVGLAEAPSFPANARIVAAWFPSNERGTASAFFNSGQYFATVIFAPLMGWIAHEFGWRHVFTVMGALGILMGLVWIKTMYGPKEHPGVNEAELDYIKEGGALVDMEGAQDGKTASGGPTWSHIGQLLSNRMMLGVYIGQYCINTLTYFFLTWFPVYLVKERGLSILQAGFVATLPALCGFIGGVLGGFISDAILRKTGSLTLARKIPIVGGMLLSMAIIGCNYVDGQALVVGLMALAFFGKGIGALGWAVVSDTSPKEAGGVSGGLFNTFGNLSSITTPIVIGYILSATNSFNGALVFVGLNALVAAFAYLVIVGRIQRVQLRAS

SEQ ID NO: 64764 - protein, 205 aa, Glycine max
  misc_feature (109)..(109): Xaa can be any naturally occurring amino acid
MCSAISQVEQEELLEKLEVFKIKGRDKHGRKILRIIAKLFPARLVSVDVLKKYLEDKVFPKLGKRKFVVLYVHTGVQRSENFPGISGLRWIYDSIPANVKENLEAVYLXFIHPGLQARLFLATFGRFLFNAGLYGKLRYVSRVDYLWENVRRNEVEIPEFVFDHDEDLDYRPMMDYGLESDHARVYGGAPTMDSPVTTYSMRCIS

SEQ ID NO: 64765 - protein, 482 aa, Bradyrhizobium sp. BTAi1
MNAILKNFIAGEWVDGSGVTRNINPSNTNDVVGEYAKADRAQTEKAIAAAKAAFPAWSRSTPQERYDALNKISAEILSRKEELGRLLAREEGKTLPEGIGEVARAGQIFAFFAGEALRLTGEKGASVRPGLDVEITREAVGVVGMITPWNFPIAIPAWKIAPALCYGNTVVFKPAELVPGSAHALSEIIARSGLPAGVFNLVVGSGSVVGQTLLEHPDVAAISFTGSVGTGRKIAQACVLSNPMKKFQLEMGGKNPLVVLDDADVKVAVEAAANGAYFSTGQRCTASSRLIVTEGIHDTFVAALTERLKGLVVDDAVKQGTHIGPVVDANQLEQDQRYLKIGQDEGAKLAWGGELLNRETPGFYMQPALFTEATNNMRIAREEIFGPVACVIRAKNYDEALAISNDTEFGLAAGVCTTSLKYASHFKRNSEAGMVMVNLPTAGVDYHVPFGGRKGSSYGAREQGSYAREFYTTVKTAYTFPV

SEQ ID NO: 64766 - protein, 539 aa, Brassica napus
MAARSRVSSLLSRSFSASSPFLSRSQGKNLNNGSRIVRRFGTSSAAEEVISPSVQVSYTKLLIDGNFVDAASGKTFPTLDPRTGEVIAHVAEGDAEDINRAVKAARKAFDEGPWPKMTAYERSRVMLRFADLVEKHSEELAALESWDNGKTYEQALTAEIPMVARLFRYYAGWADKIHGLTVPADGNYHVQTLHEPIGVAGQIIPWNFPLLMFAWKVGPALACGNTIVLKTAEQTPLTAFYVGKLFLEAGLPPGVLNIVSGFGATAGASLASHMDVDKLAFTGSTDTGKVILGLAANSNLKPVTLELGGKSPFIVFEDADIDKAVELAHFALFFNQGQCCCAGSRTYVHEKVYDEFVEKAKARALKRVVGDPFKKGIEQGPQIDSKQFEKVMKYIRSGVESNATLECGGGQVGDKGYFIQPTVFSNVKDDMLIAQDEIFGPVQSILKFSDVDEVIKRANDTRYGLAAGVFTKSLDTANRVSRALKAGTVWVNCFDVFDAAIPFGGYKMSGNGREKGIYSLNNYLQVKAVVTPLNNPAWI

SEQ ID NO: 64767 - protein, 492 aa, Xanthobacter autotrophicus Py2
MAAPQPLSRPATARFPLLRDKMLIGGAWVDADSGATIEVNNPATGEIIGTIPKAGAAETRRAIEAASEAFKTWRATTAAERAAKLHKLADLITQNADELAAILTTEQGKPLAEAKGEIGASAGYVRWFAEEARRLYGDVIPSPWGNRRILVTKEPVGVVTAVTPWNFPSSMLSRKIGAALAAGCTVVAKPSELTPYSGLAWGVLAEMAGIPAGVVNIVVGEAPAIGGEMTSNPLVKKVTFTGSTPVGKLLMKQSADTMKKISMELGGNAPFLVFDDADLDLAVEQAIASKFRNVGQTCVCANRFYVQAGIYDAFAAKFAEASKKLKVGNGLDEGVVAGPLIDDRALAKVERLLKDALDKGATVLTGGKQPALGGTFFEPTVLAGATQDMAFARDEIFGPLAPLFKFETEEQAVSYANDTEYGLACYFFTKDLGRAFRVAEKLEYGQVGINAGVITTEVAPFGGVKESGMGREGSKYGCDDYLNIKYMCVGGL

SEQ ID NO: 64768 - protein, 263 aa, Arabidopsis thaliana
MGDLYALDFDGVLCDSCGESSLSAVKAAKVRWPDLFEGVDSALEEWIVDQMHIVRPVVETGYENLLLVRLLLETKIPSIRKSSVAEGLTVDGILESWAKFKPVIMEAWDEDRDALVDLFGKVRDDWINKDLTTWIGANRFYPGVSDALKFASSKIYIVTTKQGRFAEALLREIAGVIIPSERIYGLGSGPKVEVLKLLQDKPEHQGLTLQLATLKNVIKEPELDKWSLYLGTWGYNTEKERAEAAGIPRIQVIELSTFSNKLK

SEQ ID NO: 64769 - protein, 1083 aa, Heliobacillus mobilis
MPKDPTLKKVLVIGSGPIIIGQAAEFDYAGTQACKALKEEGLEVVLVNSNPATIMTDANIADHVYIEPLNVPSLTRIIDQERPDGLLPTLGGQTGLNLAVALSQAGVLEKYQVRLLGTSIEAIKKAEDRELFKQTMQDLNEPIPLSDIVSSLDQAVAFANKTGYPLIIRPAYTLGGTGGGIAHNETELLTICDMGLKKSMIGQVLLEQSVAGWKEIEYEVMRDANNNCITICNMENFDPVGIHTGDSIVVAPSQTLTDKEYQMLRTAALKIIRELKVEGGCNVQFALHPFKCEYIVIEVNPRVSRSSALASKATGYPIAKMAAKIAIGLTLDEITNPVTGKTTACFEPTLDYCVVKIPRWPFDKFVTADRTLTTQMKATGEVMAIDRTFEGALQKAVRSLETGVYGLRLPGAATWTDIEIENKLKKADDERLFAVAQAFRRDWSVREIHQISQIDPWFLVKIKGLVDFEAQLEQWPVDEEVLHEAKVLGFSDYQIAKIANISTQVVREARKSYDILPTYKMVDTCAAEFEAATPYYYSTYEEEDEVRQTEGQKVIVLGSGPIRIGQGIEFDYCSVHAAWALRDCGVESIIINNNPETVSTDFDTADKLFFEPLALEDVLNIVEKEKPEGVVVQFGGQTAINLAAGLSEHGVKILGTSLEGIDAAEDRKKFEALLKSLGIPQSEGKTATSAAEAKAIAEELGFPVLVRPSYIIGGRAMEVVENVKDLESYMETAVRISPKHPILVDKYIRGKEVEVDAISDGTDTLIPGIFEHIERAGVHSGDSMAVYPPQTLTTAERETIVDYTLRIAKALQVVGLLNIQYVVDNQGKVYVLEVNPRASRTVPILSKVTGVPMIKVAVQIMLGKSLAELGYSTGLWPETAYTIVKAPVFSFEKLTDVDISLGPEMKSTGEVMGVDFELSSALYKAMTGAGMKIPTSGTLLVSVAERDKEEVAGLIRDYADLGFKIVATKQTASALKRAGITVTTVNTADHSLQLLLDQIKDGAIQLVINTPTRGKVAGRPGFRIRRAASEYRVPCLTSLDTAGALLEAIRMIRDGNPPSYQAMGSYQDGNSAAWWDKLKELAG

SEQ ID NO: 64770 - protein, 510 aa, Burkholderia sp. 383
MDALQAAAETAAPSGTALKRRLQGRHIAMIAIGGSIGTGLFVASGASVAQAGPGGAIAAYIAIGLMVYFVVTGLGEMAALMPVSGSFAIYGEKYVDEGFGVALGWTYWYSWAVTIAIELVAAQIVMRYWFPTIPGIWWGAGFLVLIFLLNTLSVRGFGESEYWFSLIKVVTVVAFIAAGLLIAAGLIGNGHPVGMRNFTTGDAPFVGGVHAMMSVALIAGFSFLGTELVGITAGESENPRKTIPRAVKQIFWRIMLFYVFAIFVIGLLVPYTDPNLLKSDVTDIGVSPFTLVFSHAGFRLAAGAMNLVILTAVLSAGNSGTYAATRMLYNLAAEGRAPAMFATLSPGGVPRNALYATMAVGGLCFLTSLTNNQSIYLWLLNTVGITGFIAWLGIAVCHYRFRKGFLKQGYRLDQLPYRAKWFPFGPLFAIAICIVISLGQDYQAFFAARIDWMEVLSIYVWIPLFVAIWWAYRRARKSRLVRYEEMDIGPWLTRSVEAVDATVTQHGQPH

SEQ ID NO: 64771 - protein, 715 aa, Yersinia pseudotuberculosis IP 32953
MKKILTVCPYCGSGCKLNLLVEDGEIVGAEPADGVTNQGALCLKGYYGWDFLNDTRLLTPRLTTPLLRRQRGEAFQPVSWEAAIAFITAKLSAIKERHGPDAIMMTGSSRGPGNEANYVMQKFARAAIGTNNIDCCARLCHGPSVAGLQQTLGNGAMSNSIGEIENTDCILVFGYNAADSHPIVARRILKAKNKGAKLIVCDPRHIETARIADQWLPLKNGANMALVNAFIHVLIEEKLYDANYVRDHTRGFDELKAGVAAYRPEDVEPITGLSAKAVRQAMRTYAAAPAATLLWGMGVTQWGQAVDVVKGLSSLALLTGNLGRPNVGVGPVRGQNNVQGACDMGVLPNTFPGYEKVTDSEARARFAHAWGVAELPAHVGYSITDVPHKVAEGKLKAYYVFGEDPIQTEPDLAAMRAAFAALDLVVVQDIFMTKTAELADVVLPATSWGEHEGVYTSADRGFQHFNKAIEPKGDVKPDWEIISLISTAMGYPMAYQNTQQIWDEMRGLCPPFAGATYDKLAGLGYVQWPCPTEDHPGTPYLYTDNQFATADGKGLLSCAPWQPPHEQTDSDYPLALCTVREVGHYSCRSMTGNCATLKILADEPGYVQIHPEDASYLGVIDQALIWISSRRGRVIARASVTERANRGAVYMTYQWWIGACNELTVDHVDPVSKTPEFKHCAVKVEAISDQTAAEQYVEQQYSQLKKRLSDAAVVP

SEQ ID NO: 64772 - protein, 169 aa, Paracoccidioides brasiliensis
MSAPENSKITLIPSDEPEDGRGIEVERVIIERSILIKNMLEDLGDSGEPIPIPNVNKAVLEKVIEWCEHHRNDPPTTNDEDYDSRRKTTDIDEWDQKFMLVDQEMLFEIILAANYLDIKALLDVGCKTVANLIKGKSPDDIRKTFNIQNDFSEQEEAQIRAENEWAEDR

SEQ ID NO: 64773 - protein, 457 aa, Mesorhizobium loti MAFF303099
MLANSLIELDRAHLIHPVSSYRGHEALGVRVLKSAKGATVTEASGRQLVDGFAGLWCVNAGYGHDSIVEAAARQMRELPYATAYFDLGAEPAIRLASELAERAPGDLNHVFFTLGGSDAVDSTVRFVRYYWNARGAPKRDQFISIEQGYHGSSVVGAGLTALPAFHAGFGIPFEWQHKIPSPYPYRNPVGEDANAIIAASLAALKAKIEELGPERVAAFYAEPIQGSGGVIVPPKGWIKAMRELCREYGILFIADEVITGFGRTGPLFACTDEEIVPDFMTTAKGLTSGYVPMGAVFMADHVYDVIADGAGASSVGHGYTYSAHPVSAAVALEVLKLYEDGLLENGIKAGARLMAGLSGLSDHPLVGDVRGRGMLAAIELVVDKEKKTPLPASAMPARRIFDRAWDNGLIIRAFANGVLGYAPPLCCTDADIDAIIERTRRTLDQTLADPDVRQALA

SEQ ID NO: 64774 - protein, 449 aa, Bdellovibrio bacteriovorus HD100
MNQSRGGRNDPEAQRQVQRIFLEQSRDIHIRVDRGFSILLLIQWVAAIVMGILLTPTTWLGSFSGAVENAFVGLIFGGLFSLPAVYCVYVFPGEKWTRYVVAVSQMCFSILFIHLSGGRIETHFHVFVSLAALAFYKDVGLLGVASFIVITDHILRGCLLPISLYGVAESNQWRWLEHAAWILIEDIILIIGIERIRGELHEMAYSKYQLVQAREEALQLSSIKSTFLSNMSHEIRTPLNSIIGFSDILRDTRLDKDQTDYVQTIQRCSDSLLHIINDVLDISKIENGLLQIDRHKFDVKELHTDIFKIFEAKCQEKNLQLEVDIDESIPAFALGDSHRLRQILMNLVGNAVKFTDKGRVCISLQRQPGSGHYVWKVSDTGRGIRLENMSKLFRSFSQEDVSISRTYGGSGLGLMICKNLVEMMGGDIKVESKLGEGTTFHFTLPLEEA

SEQ ID NO: 64775 - protein, 485 aa, Mesorhizobium loti MAFF303099
MKTLKDKNLFREAGLIGGEWVAAGSGKTVDVIDPATQAAIGTVPDMAGSDTRAAIDAAASAYGDWKKKTNAERADLLEAWHGLMLAHLDDLALILTTEQGKPLDEAKGEIRYGASFVKWFAEEARRINGHTIPSPTQDRRIIVLKEPVGVCGIITPWNFPNAMITRKVAPALAAGCTVVIKPSEFTPYSALALGVLAERAGIPAGVINIVTGMPAEIGNEIMANETVRKISFTGSTRVGSLLMRGAADSVKRLSLELGGNAPFIVFDDADLDLAVEGALVSKFRNGGQTCVCANRILVQAGVYEAFAAKLSARVNAMTVGPGTQPGVAIGPMINMAAVEKINRHVEDALAKGAAIITEKPALPEGPQYVAPLVLSGATKDMQLAGEETFGPVAPLFRFETEEEAIALANGTPYGLASYFYTENLKRAWRVGEALEFGMVGLNTGSVSMEVAPFGGIKQSGLGREGAQAGIEEYLEMKSFHIGGLG

SEQ ID NO: 64776 - protein, 389 aa, Yarrowia lipolytica CLIB122
MVYVNAKNYFCDSIINNTDRVLSALIKYHGLSIIAVFLLAIGLFHVALKVVSYVAVLLDVFVLPPTNYLPYGSQRGAWAVVTGASDGIGKEYARQLGLRGFNVFLISRTESKLRELAQEIAEKSKVETKFLAIDVSTDSPQNYKDIETVLETIPSVSILINNVGLSHSIPTPFLETPPAELHNIIAINNLATLKITQLIAPKIVESVKEARATKKFQKGLILTMGSFGGLLPTPLLATYSGSKAFLQHWSNALAVELAPEHVDVELVVSYLVTSAMSKVRKTSALIPNPKQFVTATLSSVGRAGGAQEKFATSTPYWSHALLHWWIAQTVGVFSKLVAGFNYKMHVDIRKRALKKQARQAAGGVADPKNTTAAREGYATESLKNETLKH

SEQ ID NO: 64777 - protein, 347 aa, Mesorhizobium loti MAFF303099
MKSYSIAMIPGDGIGRDVTAAAWTVLEAAAKHAGFALTGTEFPWSCKFYKDTGRMMPEDGIETLRGFDAILLGAVGWPAEVPDSVSLHGLLLPIRKAFVQYANIRPHRLLPGVTGPLRAEGFDILCIRENTEGEYSGAGGRVHQGTLDEVAVETSIFTRAGVERILRFGFEQARTRNGKLASVTKSNAQKYSMVFWDEITRKLAAEYSDVAVTSYHVDALAARMIMAPESLDVVVASNLFGDILTDIGAAIQGGLGYAASANINPDHSAPSMFEPVHGSAPDIAHLGIANPIATIWSGAMMLDHLGEKPAADRVMKAVEVATARGIGTIPAKDRTEAITAAVVAALT

SEQ ID NO: 64778 - protein, 798 aa, Lactobacillus plantarum WCFS1
MSSRDTANVLWFDELHREDVNLVGGKSSSLGEMTSSMDVPVPYGFATTARAYQYFMTQTGLNDKVNDLLASIQDYENSDELHTACEQIRNLIVNATMPADLAADIEQAYADLAKKMGQTDPFVAIRSSATAEDLPNASFAGQQESYLNIKGAADVVNRVQQCYSSLFTDRATYYRHKQHFPHEKVALSAAIQMMVFSKASGIMFSVNVADGDASKIVIDAIYGLGEYIVLGKVTPDHFVIDKQSMKIVEKNIIKQPVQLMRLPGGGTKEESVPDELQGQPVLTDAQVIELAGYAKEIERHYGCYMDMEYALDTNTNRLWIVQARPETVWSQRNKHKDAADDEDVVDEADAKVIVRGLPASPGLASGVVHVIDNPKDIDQFKQGEVLVTLMTSPDWVPAMKKAAAIVTNNGGMTCHAAIVSREMQIPCIVGTKSKEVAATDVLKTGDVVTVDAKNGVVYQGKVASMLKPKSGATAVAGQVVAAESFAPTATGVMMNLGDPDLADKYSSLPADGIGLMREEFLWTTFIHEHPLYLIEQGHPEKVVNMLADGIAKVVRAMAPRPVVLRFSDFKSSEYRNLKGGDKYEPHEPADLLGWRGASRYYDSKYIEAFKLELAAVKKVRNEFGLKNLNVMIPFVRTVDEAQKVTTIMRDEGLARSADFKVYMMAEIPTNIILADQFNQFVDGYSIGSNDLAMLILGCDRNNDTVAHLFDERNLAVKRAIRHLIKTAHKDGKTVSICGQAPSEYPEFTNFLIQSGIDYVSVNPDMVKETKRNVAHFEQRIMLDKATGRGLQDPIDYKW

SEQ ID NO: 64779 - protein, 429 aa, Lactobacillus plantarum WCFS1 [sequence omitted]

SEQ ID NO: 64780 - protein, 351 aa, Aspergillus niger
MNSLTATAPIRAAIPKSYMHIATRNYSGVIAMSGLRCSGSLVANRHQTAGKRFISTTPKSQIKEFFPPPTAPHVKEVETAWVHPVYTEEQMKQVAIAHRDAKNWADWVALGTVRMLRWGMDLVTGYRHPPPGREHEARFKMTEQKWLTRFIFLESVAGVPGMVGGMLRHLRSLRRMKRDNGWIETLLEEAYNERMHLLTFLKLAEPGWFMRLMVLGAQGVFFNGFFLSYLMSPRICHRFVGYLEEEAVITYTRAIKEIEAGSLPAWEKTEAPEIAVQYWKMPEGQRSMKDLLLYVRADEAKHREVNHTLGNLNQAIDPNPYAAKYKDPTKAHPNKGIADLKPTGWEREEVI

SEQ ID NO: 64781 - protein, 433 aa, Burkholderia sp. 383
MTPSDVKATLSFSDNSPSVELPIYKGTMGPDVIDIRKLYGQTGKFTYDPGFMSTAACNSAITYIDGDKGELLYRGYPIDNLAQNADFLESCYLLLKGELPNAAQKKEFVDTVTKHTMVHEQMHFFFRGFRRDAHPMAILVAAVGALSAFYHDSLDINDPRHREVSAIRMIAKLPTLVAMAYKYSIGQPFVYPKNSLSYSANFMHMMFSNPCEEYKVNDVLVRALDRILILHADHEQNASTSTVRLAGSSGANPFACIAAGIACLWGPAHGGANEAALNMLEQIGSPDNIPEFIKQVKDKNSGVKLMGFGHRVYKNYDPRAKLMRETCYEVLNELGLHDDPLFKLAMQLEKIALEDEYFVSRKLYPNVDFYSGIVQRALGIPTSMFTCIFAMARTVGWIAQWNEMIGDPEQKIGRPRQLFIGDTPREAKPLNAR

SEQ ID NO: 64782 - protein, 1586 aa, Emericella nidulans
MSNPTKISILGRESIIADFGLWRNYVAKDLISDCSSTTYVLVTDTNIGSIYTPSFEEAFRKRAAEITPSPRLLIYNRPPGEVSKSRQTKADIEDWMLSQNPPCGRDTVVIALGGGVIGDLTGFVASTYMRGVRYVQVPTTLLAMVDSSIGGKTAIDTPLGKNLIGAIWQPTKIYIDLEFLETLPVREFINGMAEVIKTAAISSEEEFTALEENAETILKAVRREVTPGEHRFEGTEEILKARILASARHKAYVVSADEREGGLRNLLNWGHSIGHAIEAILTPQILHGECVAIGMVKEAELARHLGILKGVAVSRIVKCLAAYGLPTSLKDARIRKLTAGKHCSVDQLMFNMALDKKNDGPKKKIVLLSAIGTPYETRASVVANEDIRVVLAPSIEVHPGVAHSSNVICAPPGSKSISNRALVLAALGSGTCRIKNLLHSDDTEVMLNALERLGAATFSWEEEGEVLVVNGKGGNLQASSSPLYLGNAGTASRFLTTVATLANSSTVDSSVLTGNNRMKQRPIGDLVDALTANVLPLNTSKGRASLPLKIAASGGFAGGNINLAAKVSSQYVSSLLMCAPYAKEPVTLRLVGGKPISQPYIDMTTAMMRSFGIDVQKSTTEEHTYHIPQGRYVNPAEYVIESDASCATYPLAVAAVTGTTCTVPNIGSASLQGDARFAVEVLRPMGCTVEQTETSTTVTGPSDGILRATSKRGYGTNDRCVPRCFRTGSHRPMEKSQTTPPVSSGIANQRVKECNRIKAMKDELAKFGVICREHDDGLEIDGIDRSNLRQPVGGVFCYDDHRVAFSFSVLSLVTPQPTLILEKECVGKTWPGWWDTLRQLFKVKLEGKELEEEPVAASGPDRGNASIYIIGMRGAGKSTAGNWVSKALNRPFVDLDTELETVEGMTIPDIIKTRGWQGFRNAELEILKRTLKERSRGYVFACGGGVVEMPEARKLLTDYHKTKGNVLLLMRDIKKIMDFLSIDKSRPAYVEDMMGVWLRRKPWFQECSNIQYYSRDASPSGLARASEDFNRFLQVATGQIDSLSIIKEKEHSFFASLTLPDLREAGDILEEVCVGSDAVELRVDLLKDPASNNDIPSVDYVVEQLSFLRSRVTLPIIFTIRTQSQGGRFPDNAHDAALELYRLAFRSGCEFVDLDIAFPEDMLRAVTEMKGFSKIIASHHDPKGELSWANMSWIKFYNKALEYGDIIKLVGVARNIDDNTALRKFKNWAAEAHDVPLIAINMGDQGQLSRILNGFMTPVSHPSLPFKAAPGQLSATEIRKGLSLMGEIKPKKFAIFGSPISQSRSPALHNTLFAQVGLPHNYTRLETTNAQDVQEFIRSPDFGGAFRNNSLKLDIMPLLDEVAAEAEIIGAVNTIIPVSTGKNTPSRLVGRNTDWQGMILSLRKAGVYGPKRKDQEQSALVVGGGGTARAAIYALHNMGYSPIYIVGRTPSKLENMVSTFPSSYNIRIVESPSSFESVPHVAIGTIPADQPIDPTMRETLCHMFERAQEADAEAVKAIEHAPRILLEMAYKPQVTALMRLASDSGWKTIPGLEVLVGQGWYHSLNTGLGSRRYMRVPGHVAPPSFN

SEQ ID NO: 64783 - protein, 293 aa, Serratia marcescens
MFTGSIVALVTPMDDKGAVDRASLKKLIDYHVASGTAAIVSVGTTGESATLAHDEHVDVVLQTLELADGRIPVIAGTGANATAEAIALTTRFANTGVVGCLTVTPYYNKPTQEGLYQHFKAIAESTELPQILYNVPSRTGCDMLPPTIARLAKIKNIVAVKEATGNLSRVSQIQVLVDDEDFILLSGDDASGLDFMQLGGKGVISVTANVAAREMAELCALAAQGKFAEARRLNQRLMPLHQDLFVEANPIPVKWACKALGLMATDTLRLPMTPLSEAARPVVERALKSVGLL

SEQ ID NO: 64784 - protein, 250 aa, Cryptococcus neoformans var. neoformans JEC21
MVTAVSPENLKEWHTPSTRPDVIHELIHGVDRYNPSNLPFMEDYLATELKEGQYDLFGNLAILKLYQFNPQHSNPDVIINILIKALAATVSGPDFNLCLEMLREPSAILHDIESADEALVIVMPYLQRLHELSRTCQFTKFWQEINSDSEAAKILRTRYLPQHASPLDDFRFIFSASIASCFRRISLSQLSRWLDIPSDKVGEWCSKVEWTVEGQDAVIPNNGQNDVKAGVVKENVQLGQLTKLVAAAGY

SEQ ID NO: 64785 - protein, 1274 aa, Yarrowia lipolytica CLIB122
ALCPSRPLKSLYLRPLMPQTLELLPQIPELLLPTLELLTLLLTLPQTLLQTLLLLTLLQTLLQTLLPQTLLQTLLQTLLPQTLLQTLLLQTLLQTLPQTLLQTLLQTQLPTPVPQLPTPVPLLPTPVPLLPTLVPLPLTLLPTPVLLPTLVPLPPTLELLLLTLVPLTLLPTLVPLTLLPTLVPLTLLPTLVPLTLLPTLVPLTLLPTLVPLPLTLLPTPVLLPTLVQLLPTLELLPLTLVPRTQLPTLVLLLPTLVPLLPTLVPLPLTLLPTPVLLPTPVLLPTLVPLPPTLELLLLTLVPLTLLPTLVLLLPTLVPLLPTLLPTPVLLPTLVPLPPTLELLLLTLVPLTLLQTLVPLTLLPTLVPLPLTLLPTPVLLPTLVQLLPTLELLPLTLLLTPVLLPILVPLPLTPLPTLVPLPPTLLPTPVLLPTLVPLPPTLLPTAGAATDTGATATDTGATDTGTATDTGATDTGTATDTGATATDTGATATDTGATDTGTATDTGATATDTGATDTGTATDTGATDTGTATDTGATATDTGATATDTGATDTGTATDTGATDTGTATDTGATATDTGATATDTGATDTGTATDTGATDTGTATDTGATATDTGATDTGTATDTGATATDTGATATDTGATDTGTATDTGATDTGTATDTGATATDTGATATDTGATATDTGATATDTGATATDTGVSGTVTSSIPDGTNTNAPTSIQSGDTSDSLSSTPLTSSTNGGGNVGTPTTASPTSSTSTSGNGGNGDGGSGSGGDGDGNGGDGSGSGGDGSSGNGGDGSGSGSGGDGSSGNGGDGSGSGSGGDGSSGNGGDGSGSGSGGDGSSGNGGDGSGTGSGGDGSSGNGGDGSGSGSGGDGSSGNGGDGSGSGSGGDGTSGNGSGSGGDGTSGNGSGSGSGSGSGGDGSSGNGGDGSGSGSGGDGTSGNGSGSGSGSGGDGSSGNGSGSGSGGDGTSGNGSGSGSGGDGTSGNGSGSGSGGDGSSSNGSGSGGDGTSGSGSGSGSGSGSGSGSGSGDGTSGSGSGSSGGNGGSGSGSGSDSGSGSGSGSGSGSGSDSGSGSGSGSGSGSGSDSGSGSGSGSGSGSGSGSDSGSGSGSGSGSGSGSGSDSGSGSGSGSGSDSGSGSGSGSGSDSGSGSGSGSGSGSGSDSGSGSGSGSGSGSGSGSDSGSGSGSGSGSDSGSGSGSGSGSDSGSGSGSGSGSDSGSGSGSGSGSDSGSGSGSGLGTDESGPDQFGTGSGAAQANSASRYSIPASLVSVALVAFLF

SEQ ID NO: 64786 - protein, 601 aa, Mycobacterium avium subsp. paratuberculosis K-10
MCGVTGEVRLDGRAPDVAAVSAMAAVLTPRGPDAGGAWSQGRVALGHRRLKIIDLTEAGAQPMVDSELGLSIAWNGCIYNYKELRSELSGYGYRFFSHSDTEVLIKAYHRWGDDFVSHLFGMFAFAIVERDSGRVLLGRDRLGIKPLYLTEDSHRVRFASTLPALLAGGGVDTRIDPVALHHYMSFHSVVPAPATILRGVRKVPPASLVAIEPDGKRTVTTYWAPDFTRHADRADWSERDWEDAVLSTLRLAVKRRLVADVPVGCLLSGGVDSSLIVGLLAEAGQHGLSTFSIGFESAGGVKGDEFQYSDIVAQRFETNHHQIRIDSDRMLPALDGAIGAMSEPMVSHDCVAFYLLSQEVARHVKVVQSGQGADEVFAGYHWYPPMGEPAAATLDGAVAQYRRAFFDRDTAGVAQLVGPGILAPGDPSLRFVTEHFAQAGAETGIDRALRLDTTVMLIDDPVKRVDNMTMAWGLEGRVPFLDHELVELAATCPPEYKIAHEGKGVLKQAARRVIPSEVIDRPKGYFPVPALTHLEGPYLDMDRDALYAPTAKERGLFNTDAVDALLANPNGKLTPLRGNELWQIALLELWLQRHGVTGPVA

SEQ ID NO: 64787 - protein, 125 aa, marine gamma proteobacterium HTCC2207
MSFLDHISWNSDGLVPAIAQDAATGRILMMAWMNAEALQLSVDEQRAVYWSRSRNKLWRKGEESGHVQLIKELQLDCDSDVIVMQVEQLGGIACHTGRESCFYRVLEDGVWKTVDPVIKDPKDIY

SEQ ID NO: 64788 - protein, 542 aa, marine gamma proteobacterium HTCC2207
MIRFRRLMAIALVVFRYRLDTLLDKSKTPLPLRLMLSPAILWGKPKVSRGERLRKALESLGPIFVKLGQLLSTRPDLVPADICTELTNLQDNVAPFDSDKFRQIVEQALGSSVDEIFLRFEKEPLASASVAQVHAATLKDGSDVVVKAVRPNIEQTISKDIALMYTLARLLAKYSQDGRRLRPVEVIADYEQVIYDELNLQAEGANASLLRHNFDGSPLLYVPKINWDYSNEKVLVMERIYGTPVTNISDLEAAGIDFKLLAERGVEIFFTQVFEHNFFHADMHPGNIFVDTRNPSKPSYIGIDCAIMGSLSKEDQYYMARNLIAIFQRDYRKVAELHIRSGWVPKTTPVNEFTGAIRAVCEPIFQRPLNEISLGHMLISLFTTARRFNMEVQPSLVLLQKTLLNIEGLGRQLYPQLDLWTTAKPFLDRWLKQRYSPKSLFNQFKQLAPDWLEQLPEIPPLIYSALKTAQQTAENPAVTTVVTTSAPMAKQQPLRRLIPWLSAAAVGVGFGLAVSSWTESLAQVPVISLTLVGVGLLVLLLR

SEQ ID NO: 64789 - protein, 138 aa, Streptococcus agalactiae 2603V/R
MEQTFFMIKPDGVKRGFIGEVISRIERRGFSIDRLEVRYADADILKRHYAELTDRPFFPTLVDYMTSGPVIIGVISGEEVISTWRTMMGSTNPKDALPGTIRGDFAQAPSPNQATCNIVHGSDSPESATREIAIWFNN

SEQ ID NO: 64790 - protein, 423 aa, Arabidopsis thaliana
MVKALQGAAQNLPADVNQLIDQLERHCLAPDGSLVTKSVYSDLQLAREEMSRERLRYLEAMAIYCEAVAMVEEYQQAISVANHGGIRDVQGLYPQLGLKNSPQVYETLEHRLVVAEAAQKLRLPLISDGGEIHEEEIEKWSILSRSSLDSASTSFTISSTSNSVNYANSSANSVAGGISLSAVDTDVVGGVPNRFLGITPAYLSYVQLQNTISMDMADYQMFLAREIEGRLKEKCDKLADAIVDDTDSSTGNRNSSARLPERVKFIIEEIERDEAALREDLYSADRKFAEYYNVLEQILGVLIKLVKDLKLEHQHKYNEMQKTWLCKRCETMNAKLRVLENVLLLETYTPDSISALHNIRNYLVEATEEASAAYNKAVTRLREYQGVDPHFDTIARQYHDIVKKLENMQWTIHQVEMDLKSHD

SEQ ID NO: 64791 - protein, 147 aa, Glycine max
MSAYKDQDTRLHGIKTKIRVVPNFPKSGIEARGFIFGPPIALAIGAKFVPLRKPKKLPGKVISQEYILEYGRDCLEMHVGAVEPGERALVVDDLIATGGTLCAAMDLLECSGPEIFFCCSYVHKSSSCQRLVSLRSTPIYDGMKGKT

SEQ ID NO: 64792 - protein, 431 aa, Moorella thermoacetica ATCC 39073
MLPTGQLFLYGLQHVLAMYAGAVAVPLIIAGAAHLTKAETAFLINADMFTCGIATLIQTLGFWKLGIRLPVIQGVSFAAVAPMVIIARSMGMEAVYGAVIVAGLIAFFLAPYFSKLLHFFPPVVTGSVITIIGISLLPVGVEWAAGGTGNANYGALTNLFIAGIVLLAILLIQKYFKGFIANISVLLGLFIGMLIAIPLGLVNFSGVTTAPWLGIDRPFYFGFPKFDWGAIGAMILVMLVTMVESTGDFLALGEIVGKQIDEEDLARGLRGDGFATMLGGVLNAFPYTAFAQNVGLVGLSGVKSRFVVATSGIILAALGLFPKLATIIASIPYAVLGGAGIAMFGVVAANGIKTLSRVDFENNPHNIFIVAISIGVGLIPMVAPDFFKMFPAWSQIILHSGITLGSLTAIILNIFFNYPNSLTLYKKSFTN

SEQ ID NO: 64793 - protein, 458 aa, Rhizopus sp. NK030037
MSTSDRQSVFTLKELELINQKHRDGDKSAMKFIIIDRKVYDVTEFLEDHPGGAQVLLTHVGKDASDVFHAMHPESAYEILNNYFVGDVKDAHVKETPSAQFASEMRQLRDQLKKEGYFHSSKAYYVYKVLSTLALCAAGLTLLYAYGHTSTLAVVASAIIVGIFWQQCGWLAHDFGHHQCFEDRSWNDVLVVFLGNFCQGFSLSWWKNKHNTHHASTNVHGHDPDIDTAPVLLWDEYASAAYYASLDEEPTMISRFLAESVLPHQTRYYFFVLGFARLSWAIQSLLYSFKQGAINKSHQLNLFERFCLVSHWTLFTYCTLAWCSNVYHMILFFLVSQATTGYTLALVFALNHNGMPVITEEKAESMEFFEIQVITGRDVTLSPLGDWFMGGLNYQIEHHVFPNMPRHNLPKVKPMVKSLCKKYDINYHDTGFLKGTLEVLKTLDITSKLSLQLSKKSF

SEQ ID NO: 64794 - protein, 463 aa, Xanthobacter autotrophicus Py2
MSEAVHPVDEILPAPKLAILGLQHVLVMYAGAVAVPLIIGRALKLPPQDVAFLISADLFACGLATLAQCLGFLGVGIRLPVMMGVTFASVGPMLSMAASPEIGLLGIYGSVIAAGIFGIIVAPFVSRLLPLFPPVVTGTIILIIGISLMRVGINWAGGGIPFLTQTIDGKVVQVANPNYGQLQGLGISLFVMLVVLGLIKWGKGFLANVAVLLGIIAGAVLATFLGIMHFEKVAAASWFDVILPFHFGMPTFHIVPIITMCIVMVVVMIESVGMFLALSDITGKPVDQKALTKGLRADGVGTLLGGVFNTFPYTSFSQNVGLVGVTGVRSRWVTVVGGLIMLGLGLLPKMAALVEAVPQVVLGGAGLVMFGMVAATGARILTGVDFKTNRFNLFIVAVSVGFGMIPLVSPNFFKNLPHELHPLLESGILLCAIVAVLLNVFFNGVKKTSTEEIVAAAKQAEAH

SEQ ID NO: 64795 - protein, 729 aa, Synechococcus elongatus PCC 7942
MFDLSKFLPVITPLMIDTAKTLCPYCGVGCGLEAVPPAQPGRATVRDREGTPIWQIRGDRQHPSSQGMVCVKGATVAESVSKSRLKYPMFRASLDDPFTEISWDEALDRLCDRIQQTQADYGKDGICFYGSGQFQTEDYYIAQKLVKGCLGTNNFDTNSRLCMSSAVSAYSLCLGSDGPPACYEDLDLADCLLIVGSNTAECHPILFNRYRKRHKQGGTNLIVVDPRCTPTAEVADLHLALKPGSDVALLNGLGWLLYQMGYVKKDFIANQTEGFEDWLAIIEDYPPQRTAELTGLAVAELVRAADLIASAQRWLSLWSMGVNQSIQGTAKATSLINLHLLTRQIGLPGCGPFSLTGQPNAMGGRETGGLAHLLPGYRKVIDPQHRADVETIWGLPMGSISPQPGRTAWQMIEGLEQGAVGFLWVAATNPAVSLPDVKRAQAALKRSPFTVLQDAYHPTETTTYAHLLLPAAQWSEKTGTMTNSERRVTLCQAFRQPPGEARADWQIFAEVGRRLGFAFDYTDAAAVFAEYVQVTAGRLCDLSGLSHELLAQAGPQQWPFPAGAEPTTESKRLYTKHHFAYADGRARFQPFHHLGVAEPPDDRYPLVLTVGRLYPDWHTQTRTGRIDKINKLHPSAFVEIHPRDADRYNISEGQAVVIRSRRGEGCFPAKVTTAISPGVLFVPMHWGALWGDRTEANALTHPAACPISGEPELKACAVQIEAASSTFTI

SEQ ID NO: 64796 - protein, 579 aa, Corynebacterium efficiens YS-314
MTVKNILGGTPMSAFETRAWLEHYPEWTPHSLDYGDNTLLDVYDNNLAINAERSATYFFGRTQTYGELDKEVRRVAAGLRALGVRPGDRVAIVLPNCPQHIAAFYAVLKLGAVVIEHNPLYTAHELKDPFKDHGARVAIVWDKAASTLERLRADTALETIVSVNMINAMPTLQRFALKLPIPALRKSREALSGAAPNTVPYEVLASSAMGGLGEDIVSEESVTKDTTALILYTSGTTGRPKGAQLSHGNLFANILQGKAWVPGLGDKPERMLGALPMFHAYGLTMVGTLSVFIGGEMVLLPSPRIDLIMDVMKKHTPTWLPGVPTLYEKIVEASEEQGIPIKGVRNAFCGASTLPVRTVERWESHTGGRLVEGYGLTETSPVIVGNPMNDDRRPGYVGIPFPDTLVRIANPDNPDETMPDGTEGEVLVKGPQVFKGYLNQEEATEKSFHDGWYRTGDVGVMEEDGFIRLVARIKEVIITGGFNVYPAEVEEVLAEHPDIEDIAVVGLPREDGAENVVAAITLVEGAALDPEGLKTYARENLTRYKVPRTFYHFEEMPRDQMGKIRRREVQEELLKKHQH

SEQ ID NO: 64797 - protein, 258 aa, Triticum aestivum
MNVRVLFLALLLLASPLLQVARCQVDAEDHSSIVDDVVGEHSDSGAEEDDQDLDNINLTSAPGVETVSVFPKNSAKVVPAGEETELLVALKNDGKSSVGVMGIRASVHLPYDHKLLVQNLTMMRYNNASIPTSVQATFPYIFAVSQYLQPGAFDLVGYIIYDVEGKPYQSVFYNGTIEVVESGGLLSGESVFLITLGVALLLLLGLWAYSQVQRLTKKTKKVSKVEVGTRSTDASLDEWLEGTHLAKTLSGKSKSKKN

SEQ ID NO: 64798 - protein, 250 aa, Corynebacterium efficiens YS-314
MVMTNGKLILLRHGQSAWNASNQFTGWVDVDLTTIGEAEAKRGGELLVENNVLPDVVYTSLLRRAIRTANLALDAADRHWIPVVRDWRLNERHYGALQGLNKAETKDKYGDEQYMAWRRSYGTPPPELADDAEYSQAGDVRYKDLESVPRTECLKDVVERFIPYFEEEILPRVKKGENVLIAAHGNSLRALVKHLDNISDDDIAELNIPTGIPLVYEITPEGTVVNPGGTYLDPEAAAAGAAAVANQGGK

SEQ ID NO: 64799 - protein, 218 aa, Zea mays
MPCLQASSPGSMPYQHHGRGVGCAAEAGAAVGASAGTGTRCGAHDGEVPAEAARHHEHAAPGPGRCCSAVVQRVAAPAEAVWSVVRRFDQPQAYKRFVRSCALLAGDGGVGTLREVRVVSGLPAASSRERLEVLDDESHVLSFRVVGGEHRLQNYLSVTTVHPSPAAPDAATVVVESYVVDVPPGNTPEDTRVFVDTIVKCNLQSLATTAEKLALAAV

SEQ ID NO: 64800 - protein, 369 aa, Aspergillus oryzae
MFSSNYYEDDPMDGVFSSSMLRHGGATRRFDEYYRCYPVAMMPGPERENVNHGGKVIMPPSALDKLTRLHITYPMLFELHNGARERLTHAGVLEFIAEEGKIYLPFWLMQTLLLEPGDLVQVKSTDLPPGQFIKLQAQSTSFLDISDPKAVLENAFRNFSCLTKGDVFTFAYNDQVYEMAVLETKPATNSNAISVLETDLEVDFAPPVGYEEPQRPSGTSTPRSGVSATKLPAGGLLHPHGTMAQSINYAAIAPESTDAAAGAKAVSSNFLIGGQRLNAKKGSKAPTPKASTPTPGATNPQHPPPVRRTNGPMPLRLPPNQLFFGYAIKPVQKRDESGQVVEDEKPRFQGSGQTLRGKKKDTGGSATPT

SEQ ID NO: 64801 - protein, 931 aa, Schizosaccharomyces pombe
MSSSQQSGRANELRTPGRANSSSREAVDSSPLFFPASSPGSTRLTTPRTTARTPLASSPLLFESSSPGPNIPQSSRSHLLSQRNDLFLDSSSQRTPRSTRRGDIHSSVQMSTPSRRREVDPQRPGVSTPSSLLFSGSDALTFSQAHPSSEVADDTVRVIWGTNVSIQESIASFRGFLRGFKKKYRPEYRNELMPPPDAEQLVYIEALRNMRIMGLEILNLDVQDLKHYPPTKKLYHQLYSYPQEIIPIMDQTIKDVMLDLLGTNPPEDVLNDIELKIYKIRPFNLEKCINMRDLNPGDIDKLISIKGLVLRCTPVIPDMKQAFFRCSVCGHCVTVEIDRGRIAEPIKCPREVCGATNAMQLIHNRSEFADKQVIKLQETPDVVPDGQTPHSVSLCVYDELVDSARAGDRIEVTGIFRCVPVRLNPRMRTVKSLFKTYVDVVHIKKQDKRRLGTDPSTLESDIAEDAALQIDEVRKISDEEVEKIQQVSKRDDIYDILSRSLAPSIYEMDDVKKGLLLQLFGGTNKSFHKGASPRYRGDINILMCGDPSTSKSQILKYVHKIAPRGVYTSGKGSSAVGLTAYITRDQDTKQLVLESGALVLSDGGICCIDEFDKMSDATRSILHEVMEQQTVTVAKAGIITTLNARTSILASANPIGSKYNPDLPVTKNIDLPPTLLSRFDLVYLILDRVDETLDRKLANHIVSMYMEDTPEHATDMEVFSVEFLTSYITYARNNINPVISEEAAKELVNAYVGMRKLGEDVRASEKRITATTRQLESMIRLSEAHAKMHLRNVVEVGDVLEAARLIKTAIKDYATDPATGKISLDLIYVNERETLVPEDMVKELANLISNLTVGGKTMLVSQLLTRFREQSSTRLDASDFEACLGAFREQSSTRLDASDFEACLGALERRGRIKVITSAGHRIVRSIAQTD

SEQ ID NO: 64802 - protein, 323 aa, Alteromonadales bacterium TW-7
MDIKAIQALIESDMNDVNQLIHAQMRSEVALVNQLGLYIVNSGGKRVRPMLAILAAKALGYTGKDHITLATIVEFIHTATLLHDDVVDESNLRRGTPTANAEFGNAASVLVGDFIYTRSFQLMVGLGKMQIMQILADATNIIAEGEVLQLMNCNDPDTTEASYMQVIYSKTAKLFEAATGLAAIITNNDEATLNALNLYGMHLGTAFQLVDDVLDYNADANQLGKNIGDDLAEGKPTLPLIYAMQHGNAHQTQLIRDAIEHSNGMEHLEEILSTLKQTNALEFTMQKAELEADKAIACLDFLPESEYKHALVSLARIAVDRDH

SEQ ID NO: 64803 - protein, 1375 aa, Helicobacter hepaticus ATCC 51449
MQENNVQILVLDFGSQYTQLIARRLREYGVYTEIVPYFEKLDSIKSKNPKGIILSGGPASVYEKDAYKPDSAIFTLGIPILGICYGMQLIAQHFGGRVIKADAQEFGKAVLEIMESSQDSKDSSCFAFQGASQGIQAPMTLSFDIFSHHKFPQMLTALLDLWEDSVQASHIFLTKQHIAEIRLEVKAALQSSQNIITATDKKDFLGFIGVEKNKIEMLFVASSVFRKGIGKALLKEALERYLKDYPYILVDCNEQNTQGLAFYKSLGFEKVGMSEKDSAGRDFPIVHLKVSKAILKKALERGTSDSVANAFVCESERVFLRPYTQADFAALHKIVSDKETMYAWGQGFSKKQSQEWLDKQLAHYQQYGFGIWAIIEKQSGAIIGNAGLNHTEISLKGKTQKIVEIGYLLHRDFWGKGYGSEVARMCVKYGFETLGLEEVYCLIKEDNTASIKVAKRLEMQKVGEYPKPYKGKKISHLVFRLEKKVWQESKNNATQGFKSCSLFKGIKQDSIVWMSHADKVESIPQGFRELAKSGNTHYCAIADSKRKIYALQFHPEVVHSECGGQMLQNFAVGICGANTCWNMRHFAQNEIEKLRRIVYGGKAHCENPMSFMQIQEAFKHIGKAQTIQRLVEIWEEGARATHKDLSENEIAGMREEIREAILKSKNLLIAQKNEEWLGFIEIEKNEIAMLFVVPKAFRKGVGKALLKEAFMRYLGAFEVIKVNSLEWALGFYQALGFAKTGKKPIPAGSAGAFSPELIPLSIARESLQKSLGLEAQDSNEGVREKVRCAWATDKDEAARKLYEDYHDTEWGEPLHEDKKLFEHLVLEGFQAGLSWITILKKREAFRVAFDDFDPHIVANYDEDKIKELMRNEGIIRNRAKIEAAIINAKAFMAVQREFGSFDKYIWGFVGGKPIINAFESIADLPASTPLSDKIAKDLKKRGFKFVGTTTMYAMMQSIGMVNDHLTSCFKCNSSLGMQCDKILDFSQGTNTKSANLTKNPKNLHSHTANTRIVDSQHTESSDIKGQSHLESSADSGSAVSLRDFKSCEGATRGSYLEGNDRSGVANSLKITKETTSKVLCAVSGGVDSSVVAALLYRAIGENLIPVFVDTGLLRKGEREAVEKIFKENLKVPLITADASELFLSRLKGVLDPEIKRKIIGETFIEVFEKEAKKHNTKGEIKFLAQGTLYPDVIESVSVKGPSKTIKSHHNVGGLPEWMKFELIEPLRELFKDEVRALGRELGMPESMLMRHPFPGPGLAIRIMGEVNKADLDLLREADSIFIDELHKQSYYDKVWQAFCVLLNVRSVGVMGDNRTYDNTICVRAVEAIDGMTATFAHLPHDFLEGVSNRIINEVEGINRVVYDITSKPPGTIEWE

SEQ ID NO: 64804 - protein, 504 aa, Yersinia pseudotuberculosis IP 32953
MTDHSKKQTRVSLPHSVFSADWVRQNEAAAAAHFSLTLFDLMVRAGNAAFELAHKQYPIARHWLILCGHGNNGGDGYIVANRALAAGIDVTLIACPGNRPLPAEAKEAQSQWLAIGGVIHQPDTQWPQDIDLIIDGLLGIGLRAAPQGIYETLIDMANRHRAAKVALDIPSGLCADNGAALGSVLRADHTLTFVALKPGLLTGQARDWVGQLHYDDLGLATWLDTQSAQIERITADHLPQWLKPRRPCAHKGDYGRLLLVGGDRGFGGAIRMAGEAALRSGAGLVRVLTHFEHVAPILAARPELMVQALTAETLEQSMQWADVLVVGPGLGQSDWSRNALKRLQQSDKPTLWDADALNLLALNPHRRQNWVLTPHPGEAARLLGCRVVDIESDRLLSARNIVKQYGGVVVLKGAGTLIANEQGEMAIADVGNAGMASGGMGDILFGIIGGLIAQKLALYDAACAGCVVHGVAADKLAEVQGTRGLLATDLLPVIPKYINPELAK

SEQ ID NO: 64805 - protein, 364 aa, Streptomyces coelicolor A3(2)
MVVSEHETFSAARPSPSKPQERCPMTDSPALPAVNREWHLVTRPVGWPKPEDFALVEAEVPTPGDGQVLVRNLYVSVDPYMRGRMSAAKSYAAPYELGKPMLGGAVGEVVASNAEGIAVGDHVLHFLGWREYAAVDAKSAVKVDPDAAPLSTYLGVLGMTGLTAYAGLLRTASFKEGDSVFVSGAAGAVGSQVGQIAKLKGASRVIGSAGSDEKVKLLLDEYGFDAAFNYKNGPVSEQLRAAAPDGVDVYFDNVGGDHLEAAIGSLNLNGRIAICGAISVYNNTEPAPGPKNLARLIQTRGRIEGFLVGDHYDLQPKFVEEVGPWVRTGELKYRETVVEGIENNLEAFLGVLRGDNTGKMIVKL

SEQ ID NO: 64806 - protein, 537 aa, Bacillus cereus ATCC 10987
MMMNVPLTISSMMERAEKLFSKKEIVSRTHDTITTLTYKQLGERTRRLSSALKKLGIKEGERIGTLAWNHHRHVEAYFAIPGIASVLHTINIRLSPQHISYIIQHAEDRILLIDEDLVPLVENIQSQLSAVQAYIIMTDKDELPNTTLEPVYHYEKLLEEGDPNFQFVKDIDENTPAGMCYTSATTGNPKGVVYTHRSTVLHCMALGLADTAALSESDAAMAIVPMFHVNAWGLPFAATWFGSKQVLPGPMFTPKILLEMIQSEKVTLAAGVPTIWLGVLQELENNSYDLSSMTRILCGGAAAPKSVIKAFEQKHNVPFIHAYGMTETSPLVTLARLKSYETELSYEEQLEIRSKQGYLVPGVEMKVVGTNGEVKWDGTEMGELCLRAPWIAESYYNDERTVEGFRDGWLYTGDVVTVDEEGCVKIVDRTKDVIKSGGEWISSVDLENALMAHDAIFEAAVVAVPHPQWQERPVACVVQKKNSTVTKEEIYAFLKPQFAKWWLPDDIVFMEEIPKTSVGKFLKQALRKELEHLRKGE

SEQ ID NO: 64807 - protein, 79 aa, Triticum aestivum
  misc_feature (57)..(57): Xaa can be any naturally occurring amino acid
  misc_feature (72)..(72): Xaa can be any naturally occurring amino acid
  misc_feature (75)..(75): Xaa can be any naturally occurring amino acid
ILSALHHTCASLGPLRQQCITLVDYYIPVFFLEVSVVKPEELCESAHLCPKGAATRXSTRGDACGLCHHVLXVEXLMML

SEQ ID NO: 64808 - protein, 485 aa, marine gamma proteobacterium HTCC2207
MQLHDNSLLKTQAHIDGQWVDADSGETLAVVNPANGETIAEVVKCGTAETRRMIEAAAVAQKQWAKSTIKERAAVLRRWFDLVMENQEDLAQILTAEQGKPLAEARGEVAYGANYIEWFSEESKRVYGDTIPQPSNDKRIVVIKQPVGVVACITPWNFPNAMLTRKIAPAIAAGCAVVCKPANATPLSALALMELAVRAGFPRGLMNIVTGRTAQIGAELTGNPLVRKVTFTGSTPVGKQLMAECAQTVKRTSMELGGNAPFIVFDDADIDAAVQGTLVSKYRNAGQTCVCSNRIIVQAGIYDEFVRKLTVATQNLVIGNGTEEGVTVGPLIDEKAANNVCDFIDDAVTKGAKVALGGGRSDLGGAFVLPTILTDVSRDMRVFSEEIFGPVAPVFKFETEAEVVAMANDTEFGLAAYFYSRDIGRVWRVAEQLEYGIVGVNEGVISNEMAPFGGVKESGSGREGSKYGMDDYMDLKYICMGGIDQ

SEQ ID NO: 64809 - protein, 370 aa, Oryza sativa (indica cultivar-group)
MEGLTSAAAFVEGGIQDACDDACSICLEAFCESDPSTLTGCKHEFHLQCILECQELLEAVERERNVRTNQTRNTTIFHHPALGDFEVQHQDELLQLPVVGNDAELEERILQHLAAAAAMGRSHHLGRREGHRGRSGSHGRPQFLVFSSHPNMPSAGSVSSSSVQGEVDNESSPVHTAGELSLHASTHEEAGNQSPGMLTYDADQDAVVSSGNSTPVSSPRFFNRRHSTGQSTPVNNDRAGPSDLQSFSDSLKSRLNAVSMKYKESITKSTRGWKERLFSRNSSVADLGSEVRREVNAGIASVSRMMERLETRGSNNGRTSDGPATSTSEVIPSTESSNERVTENNPTTAATSTSNTSTSSAPCVTTTGSN

SEQ ID NO: 64810 - protein, 383 aa, Bacillus licheniformis ATCC 14580
MKNETALKRSLTLGPLVVIGLAYMDPLVVFDSYGVVAQLTKGHVPAAYVFTVAALLLTALSYGSMVKAYPKAGSVYTYAYESIHPHAGFLAGWTIMLDYLFLPMVNFAIGSAYLTAAFPEVPHGFWVVLLALSITVVNVLGIRLTANITGLFVAFQVIVALTFAGFMIAGLAGGLGTGELISADPFFHSDIEPSLIVSGATILCFSFLGFDAISTMSEETVNPKKNIPLAIFLTVAIGGTLFTAISYLMQQIYPSYDNFRHADSASLEIALYTGGAFLKSFFLAGTMVAVISSSLSSHASASRLLYAMGRDSSLPKRFFGYVHPTLKTPVFNILFIGLISLTAMIGELEVIYSFISFGALIGLFLSICLSSAITTFGGRKKAF

SEQ ID NO: 64811 - protein, 406 aa, Oryza sativa
SRTRGEASTHTHSLSPPPPPPLRLWRLDECLALCLWCVIMTNQDVVVSEMGIAAGAALPGGPAGPAGGLFACRSAAASMRQTYLDLAAAAVAARSASCTSWADAMRASSPTRSSRSASDVDEFTAWVRKHPSALSKFEEIAAKSRGKKIVMFMDYDGTLSPIVADPDTAYMSDAMRAAVREVAKTFPTAIVSGRCRDKVRNFVGLSDLYYAGSHGMDIKGPSSNPESALCQPASEFLPMIDEVYKTLVEKTKSTPGAKVENNKFCLSVHFRCVDEKRWNALGEQVKAVIKEYPKLKLTQGRKVLEIRPSIKWDKGKALEFLLESLGFANCGDVLPVYIGDDRTDEDAFKVLRKRGQGLGILVSKCPKDTNASYSLQDPTEVMEFLLRLVEWKRKSSSSSLMIRPRV

SEQ ID NO: 64812 - protein, 428 aa, Coxiella burnetii RSA 493
MTATITDINAHEILDSRANPTLEVRVTLSSQAYGCAAVPSGASTGEREAVELRDNDLERYGGKGVLQAVENVNGPIRDALLGQDPRSQEEIDRIMIELDGTENKANLGANAILGVSLAVAYAAANNADLPLYRYLGGDGGPFSMPVPMMNIINGGAHATNNLDFQEFMIVPVGAPTFAEALRYGAEVFHALKKRLVSRGLMSAVGDEGGFAPDLPNNEAAFELILEAIEDANYVPGKDIYLALDAASSELYQNGRYDFENNQLTSEEMIDRLTEWTKKYPVISIEDGLSENDWAGWKLLTERLENKVQLVGDDIFVTNPDILEKGIKKNIANAILVKLNQIGTLTETLATVGLAKSNKYGVIISHRSGETEDTTIADLAVATDARQIKTGSLCRSDRVAKYNRLLQIERELNDQAPYAGKEAFLFNRK

SEQ ID NO: 64813 - protein, 319 aa, Bacillus sp.
MTKHKERVMYYGKGDVFAYRTYLKPLTGVRTIPESPFSGRDHILFGVNVKISVGGTKLLTSFTKGDNSLVVATDSMKNFIQKHLASYTGTTIEGFLEYVATSFLKKYSHIEKISLIGEEIPFETTFAVKNGNRAASELVFKKSRNEYATAYLNMVRNEDNTLNITEQQSGLAGLQLIKVSGNSFVGFIRDEYTTLPEDSNRPLFVYLNIKWKYKNTEDSFGTNPENYVAAEQIRDIATSVFHETETLSIQHLIYLIGRRILERFPQLQEVYFESQNHTWDKIVEEIPESEGKVYTEPRPPYGFQCFTVTQEDLPHENIL

SEQ ID NO: 64814 - protein, 475 aa, Alteromonadales bacterium TW-7
MSNELKTQVVVLGGGPGGYSAAFRAADLGLEVTLVESRETLGGVCLNVGCIPSKALLHVAKVIDDAAEMSSHGVTFGAPQIDLDKIRSWKESVVGQLTGGLDGMAKMRKVKVVPGYGKFTGSNTLAVEGADGTTTITFDNAIIAAGSKPVNLPFIPEDDRVIDSTGALELKDIPEKLLVLGGGIIGLEMGTVYRALGSAIDVVEFADQLVPAADKDIIKIYQKYVSDKFNVMLSTKVVAVEAKDDGLYVTFEGKNAPAEPVRYDKVLVAVGRTPNGNLLDAEKAGVNVDERGFINVDKQLRTNVSNIFAIGDLVGQPMLAHKAVHEGHVAAEVISGQKHFFDPKCIPSIAYTDPEIAWVGVTEKEAKEQGLSIETAVFPWAASGRAIASSRTEGSTKLIFDKESGRIIGGAMIGINAGEMLGEIGLGIEMGADGEDLALTIHAHPTLNESIGLAAEIFEGSITDLPNKKAVKKKK

SEQ ID NO: 64815 - protein, 466 aa, Oryza sativa (japonica cultivar-group)
MPPAIPTATMPASPKEAQSRAGAGVRMISSEELRAHASRDDLWISISGDVYDVTAWVPHHPGGDIPLLTLAGQDATDAFAAYHPPSARPLLGRFLVGRLEDYTVSPASADFRRLLAQLSSAGLFERVGPTPKVQVAGMLLLLCAALYCVLACASAWAHLLAGGLIGFIWIQSGWMGHDSGHHRITGHAALDRLLQVLSGNCLTGLSIAWWKCNHNTHHIACNSLDHDPDLQHMPLFAVSSKLFGLWSYFYQRTLVFDAASKFLISYQHWTFYPVMCFARINLLIQSAVFLLSSRKVPQRGLEIAGVAAFWVWYPMVVSCLPNWWERVAFVVASFVITGIQHVQFCLNHFSSEVYVGPPKGNDWFEKQTAGTLDIQCSPWMDWFHGGLQFQIEHHLFPRLPRCHLRKVSPFVRDLCKKHGLPYAAASFWQANVLTWKTLRAAALQARKATSGAAPKNLVWEAVNTHG

SEQ ID NO: 64816 - protein, 888 aa, Alteromonadales bacterium TW-7
MSEVNKIDVDALETQEWLQALESVVREEGVERAQYLLEQVLEQARLDGVDMPTGITTNYVNTIPVDQEPAYPGDVNLERRIRSIIRWNAIMIVLRASKKDLDLGGHMASYQSSAAFYEVCFNHFFKAPNEVDGGDLVYYQGHISPGIYARAFVEGRLSAAQLDNFRQEVDGKGLPSYPHPKLMPEFWQFPTVSMGLGPIASIYQARFLKYLDGRGLKDTKNQRVYAFLGDGEMDEPESRGAISFAAREKLDNLCYLINCNLQRLDGPVMGNGKIIQELEGLFKGAGWNVIKVVWGSGWDILLAKDTTGKLLQLMNETIDGDYQTYKAKDGAYVREHFFGRYPETAALVADMTDDEIFALKRGGHEPSKLYAAFKKAEQTNDRPTVILAKTVKGYGMGEAAEGKNIAHQVKKMDMSHVEHLRDRLGLQDLVSEEAIKDLPYLELDESSEEYKYLHARRKDLEGYTPTRIAKFSEKLQLPEVAAFKPLLEEQKRDISTTMGFVRALNILLKDKGIGKNIVPIIADEARTFGMEGLFRQIGIYNPHGQNYTPQDRDIVSYYKEATSGQVLQEGINELGAMSSWVAAATSYSTNDLPMIPFYIYYSMFGFQRVGDMAWMAGDQQARGFLLGATAGRTTLNGEGLQHEDGHSHILANTVPNCISYDPTYAFEVAVIVQDGIRRMYGEDQENIYYYLTLMNENYHQPAMPEGAEEGIRKGIYKLESYEGKKANVQLLSSGTIMTEVRKAAAILSDDYGIASDVYSVTSFNELTRDGQDVERFNMLNPEIEQKTAYITSVLNDSVTVAATDYMKNYAEQARSFIPSNNYKVLGTDGYGRSDSRENLRRHFEVNASYVVVATLSELAKRGEVEKSVVVDALKKFDIDTNKLNPLYA

SEQ ID NO: 64817 - protein, 713 aa, Arabidopsis thaliana
MNEEEAPSEQKKTLSLVPSPTTNLFLPDDILLSSLSRISRLYYPTFSLVSKSFRSLIASPELYQTRSILGRTESCLYVSLRLLNDSNLRWYTLCRVPDRKLTNFSGGHLLVPILSRYAPPAHWSSVVAVDYNIYAIGGPINDAPSSSVSVLDCQCEKWREAPSMRVARNYPTATVLDGKIYVAGGCEDCTSLDCIEVFDPKTQTWDSVASPGTERCERLVYKSVGIEGKYHLFGGAGHVAYDPKEGRWDSVGMDMEMGRTWVSYCVINNILFYYNDREFKWYDYKGRFWRKLMGLERLIKFLCYSRVNLAAYGEKMAVLWDTFVPSSSKNKMIWCAEITIERHDIYEICGKTEWFDVVLRVPKSYELPMSSPERKRKRVTSTKNPSVKKKKKISPVPTPIPSLPDDLLEGNPDPNPLWFTLCMKPDRTLKNGKKKKKKKMSSGNLLIPIPVPNPPLEHWSGHASVGSDIYFFGGYMEENVRSSRVVILDCRSHTLREAPSLQMERSDPAASVIDGKIYVAGGVDGDDADSLYPIEVFDIKTQIWDHRPIPYWEKDWGALSRSAYVDGKFYLTIGMKVMAYDLEESRWDFAGYQMGQSWFWSCNCVIENVLYCYGDAFRWFDTKLRLWKVMKVKGLPKLSRNVDVKIADYGGKMAIFWDNPSPSASDTNKIIRCAVIALERPNSEEIWGTVEWHEAVLTVPVSYEFEHALAVTV

SEQ ID NO: 64818 - protein, 1122 aa, Rhodococcus sp. RHA1
MPRRTDLSHILVIGSGPIVIGQACEFDYSGTQACRVLREEGLRVSLVNSNPATIMTDPEFADATYVEPITAEFVEKVIALEAEKGHPIDAVLATLGGQTALNTAVALHEQGILEKYDVELIGADFDAIQRGEDRQKFKDIVAKVGGESARSRVCYTMDEVRDTVAELGFPVVVRPSFTMGGLGSGMAYDDEDLTRIAGGGLAASPTANVLIEESILGWKEYELELMRDGRDNVVIVCSIENVDPVGVHTGDSITVAPAMTLTDREYQAMRDLSIDILREVGVDTGGCNIQFAMDPTDGRLVVIEMNPRVSRSSALASKATGFPIAKIAAKLAIGYTLDEIVNDITKETPACFEPTLDYVVVKAPRFAFEKFPGADDTLTTTMKSVGEAMSIGRNFTEAFGKVLRSLETKRAGYWTGPDVEAADLDSLLTELSIPRDGRVYGLEKAFALGATVEQLFDATKIDPWFLDQILQIHELGDALREAPEVTERVLRRAKHHGLSDRQIAALRPEIGGEDAVRALRDQWNVHPVYKTVDTCAAEFEAKTPYHYSTYELDPAAESEVTPQTERPKVLILGSGPNRIGQGIEFDYSCVHAALTLSEAGYETVMVNCNPETVSTDYDTADRLYFEPLTFEDVLEVYRAESLSGTVAGVIVQLGGQTPLGLAKRLKAAGVPIVGTSPEAIDLAEDRGEFGKVLVEAGLPAPKFGTATTFAGAREIAAGIGYPVLVRPSYVLGGRGMEIVYDEASLESYISRATEISDDRPVLVDRFLEDAIEIDVDALCDGSEVYLGGVMEHIEEAGIHSGDSACALPPITLGRADLENVRRSTEALAKGIGVKGLLNVQYALKDDILYVLEANPRASRTVPFVSKATAVQLAKACARVMLGESIADLRASGVLPATGDGGSTPADAPVAVKEAVLPFNRFRRADGTGVDTLLSPEMKSTGEVMGIDADFGTAFAKSQTAAYGSLPTSGSVFVSVANKDKRSLIFPVKRLADLGFRILATEGTAAVLRRNGITCQEVHKHSGEKLEAGERTIVEMIRDGEVDMVINTPYGNSGPRVDGYEIRSAAVAMNIPCVTTVQGASAAVQGIEAAIRGDIGVQSLQALHARLRSPAVVVAPATGSASS

SEQ ID NO: 64819 - protein, 515 aa, Bacillus cereus ATCC 14579
MIILKKQHDTIIVLDFGSQYNQLIARRIREFGVYSELHPHTITAEEIKAMNPKGIIFSGGPNSVYGEGALHCDEKIFELGLPIFGICYGMQLMTQQFGGKVERANHREYGKAVLKVENESKLYANLPEEQVVWMSHGDLVTGLPEGFVVDATSESCPIAGMSNEAKNLYGVQFHPEVRHSEHGNDLIKNFVFGVCGCSEGWNMENFIEVELEKIRETVGDKKVLCALSGGVDSSVVAVLIHKAIGDQLTCIFVDHGLLRKGEAEGVMKTFSEGFHMNVIKVDARDRFMDKLKGVEDPEQKRKIIGNEFIYVFDDEASKLQGMDFLAQGTLYTDIVESGTATAQTIKSHHNVGGLPEDMQFKLIEPLNTLFKDEVRVLGSELGIPDEIVWRQPFPGPGLGIRVLGEITEEKLEIVRESDAILREEIIKAGLDREIWQYFTALPGMRSVGVMGDERTYDYTVGIRAVTSIDGMTADWARIPWDVLEKISVRIVNEVKHVNRIVYDVTSKPPATIEWE

SEQ ID NO: 64820 - protein, 309 aa, Cryptococcus neoformans var. neoformans JEC21
MGDDQPKIITAYPELTDIKAQHQSLPGKDVDMDPLAEFTKLETWDDDGKPYLKEYTGSGKLKGKKAIVTGGDSGIGRAAAQMFAREGADVTIVYLPEEEQDAQRVKKAIEQDGQQCLTIAHDLMQADLAADVVKQHMDKFGKLDILVNNASKQIMSQSIAEIELENVESTFRSNILAMFALTKAAVPHLKRGSTIINTSSVTAFKGSVAMVDYASTKGAIVSYTRSLAVQLAPQGIRVNGVCPGPVYTPLQPASRPPDNMEGWSVGGPPLHGRASMPAEMGPAYVFLASSDANAMTGHFLHLNNGQWLG

SEQ ID NO: 64821 - protein, 327 aa, Mycobacterium avium subsp. paratuberculosis K-10
MTSPPLDPDAAARIASFGETAPMRQRGLPAVRAGLESAPRPATMPEMASVTEALVPSAAGGIPVRIYRPTTDSGVAVLVYLHGGGLVMGSNRSFEPLARELASASAATVVAVDYRLAPESPPPAQFDDAYAATEWVSRKAGELGVDADRLAVIGDSAGGSLAAAVALAARDRRGPPICAQVLLYPGLDRDMSVASIAAMPDAPLLIRDDIDYMHALVDGDAGPPTDPYLVPAYAADLSGLPPAIVVTAGCDPIRDWGERYADRLRDAGVQTTVTRYPGMYHGFLMRSDATARGRLAIAEIGGLLRAKFSHPLRFDVPITGRHSTATR

SEQ ID NO: 64822 - protein, 229 aa, Burkholderia xenovorans LB400
MRASDVMITNVISVTPDMTVREVARIFVDNGISGAPVLDPEGHIAGMISEGDLLRRTEIGTDERKPSSWLDVWSASHEARDYIKTHAVKVRDVMTPDVVTVQPDTPLGEVASILETRRIKRVPVTQAGRVVGIVSRANLVQALASVPDEPASDVTLSDAEIRAMLMGELAGRKWSFAGRNIVVTDGVVHLWGVFHAMEAVDAVRVAAQNIPGVKRVEDHTEPYPVMPGI

SEQ ID NO: 64823 - protein, 1148 aa, Oryza sativa (indica cultivar-group)
MTMMTPPPLEPEEDEMLVPHQELVAADAAQPMEVVAQTEAASTAESQPAEDPQTSRFTWTIENFTRINAKKHYSDAFVVGGYKWRVLIFPKGNNVDHFSMYLDVADSANLPYGWSRYAQFSLAVVNQIQQKYTIRKDTQHQFNARESDWGFTSFMPLSELYDPSRGYLVDDTVVVEAEVAVRKMVDYWTYDSKKETGYVGLKNQGATCYMNSLLQTLYHIPYFRKAVYHMPTTENDMPSGSIPLALQSLFYKLQYSDNSVATKELTKSFGWDTYDSFMQHDVQELNRVLCEKLEDKMKVTNLRTVVEGTIEKLFEGHHINYIECINVDYKSNRKESFYDLQLDVKGCRDVYASFDKYVEVERLEGDNKYHAENHGLQDAKKGVLFLDFPPVLQLQLKRFEYDYMRDTMVKINDRYEFPLQLDLDRDDGKYLVQMQIELMVISYHLSKEVCGVRLPEENHMPYALLLYKFDDERVTKEDTKKALEEQYGGEEELPQINPGFNNAPFKFTKYSNAYMLVYIRESDKDKIMCNVDEKDIAEHLRVRLKKEQEEKEHKKKEKAEAHLYTIIKVARDENLKEQIGKDIYFDLVDHEKVRSFRIQKQLPFTTFKEEVAKEYGIPVQFQRFWLWAKRQNHTYRPNRPLSPHEETQSVGQLREVSNKAHNAELKLFLEVELGPDLRPLPPPEKSKEDILLFFKLYNPEKEELCFVGRLFVKALGKPSEILTKLNEMAGFVPNEEVELYEARAKFMMLYLWDNLVYVTPLRRVLGEIKFEPNVMCEHIDKKATFRASQLEDGDIICFQKSPIPDSDTQMRYPDVPSYLEYVHNRQVQGVYFLSVVHFRLLEKPKDDDFSLELSKLHTYDDVVERVARQLGVDDPAKIRLTSHNCYSQQPKPQPIRYRGVEHLLDMLIHYNQTSDILYYEVLDIPLPELQGLKTLKVAFHHATKDEVVIHSIRLPKNSTIADVINDLKTKVELSSPSAELRLLEVFYHKIYKIFPLHEKIENINDQYWTLRAEEIPEEEKNLGPNDRLIHVYHFMKDPLQNQQIQNFGDPFYLAIREGETLAEVKERIQKKLQVPDEEFCKWKFAFISMNRPDYLQDSDVVSARFQRRDVYGAWEQYLGLEHADTAPKRAYTANQNRHTYEKPVRIYN

SEQ ID NO: 64824 - protein, 484 aa, Rhizobium leguminosarum bv. viciae 3841
MKLNDPSLFRQACPIADRWIEAEGRKAATVRNPATGEPLGVVPDLGAAETEDAIRAAVIAQKLWAKKTAGERAAVLKKWHRLMIENRDDLAMILTLEQGKPLAEAKGEITYGASFIEWFAEEARRINGEVVPGHQPDKRILVLRQPAGVVAAITPWNFPNAMITRKIGPALAAGCAVVLKPALQTPFSAIAIAVLGERAGLPPGLLNIVTGDAAAIGGVLTASRDVRVLTFTGSTRTGELLYRQCAPTIKKLGLELGGNAPFIVFDDADLDAAVEGALIAKFRNNGQTCVCANRLYVQDGVYEAFAAKLAAAVSGLKVGNGLDRDVVLGPLIDDNAVAKVESHIRDAVSKGAGIVSGGKRHALGGHFFEPTILRDVAAGMQVAREETFGPLAPLFRFRDEEDVIEQANDTEFGLASYFYARDLSRVFRVAEALEYGMVGVNTGLVSTAEAPFGGVKMSGLGREGSRHGLDEYTELKYVCLGGIA

SEQ ID NO: 64825 - protein, 266 aa, Brassica napus
  misc_feature (220)..(220): Xaa can be any naturally occurring amino acid
  misc_feature (240)..(240): Xaa can be any naturally occurring amino acid
  misc_feature (259)..(259): Xaa can be any naturally occurring amino acid
RPTRPGPATSKKIFVGGLASSVTEAEFKMYFAQFGTITDVVVMYDHRTQRPRGFGFISFESEEAVDRVLQRTFHELNGKMVEVKLAVPKEMALNPIRNQMNVNSFGSSRISALLMNEYTQGFSQSPISGYGVQPEVRYSPGVGGNRGGFSPFGHGFGIELNFEPGHYGSGSSAGFGRPFSPGYAASQGRYGSQIESGARNNLWGNGGGLGGYMSNSPISXSSFNGNSGMSSLGSIGDNWXGAARARSGYRSEGGGLGLXAMKGVHV

SEQ ID NO: 64826 - protein, 514 aa, Synechococcus sp. CC9311
MIYTLTTPLYYVNDKPHLGSTYTTIACDALARFQRLEGHEVVFVTGVDEHGQKIQRTAADQGISPIDHCNRITASYEKAWNEWDISNDRFVRTTSPRHLPLVQQFFQRCEEAGDIRSGRQTGWYCVGCEEFKDDPAEAVNPTCSIHQKPLEWRDEENLFFCLSHYQEQIEAIIKQSDFIAPASRRNEIQNFVAGGLRDFSISRVNVDWGLPVPGHQGHTFYVWFDALLGYLTALLDDGGTIDLDRLNTIGWPANQHVIGKDILRFHAVYWPAMLMSAGLPLPKKVFGHGFLTREGQKMGKSIGNVLDPELLLNRCGTDAVRWYLLRDIQFGDDGDFQQQRFVDLVNNDLANTIGNLLNRTSSMSRKWFNESTPTVASKDSDQHALRQAAETAIASAREAMPSMAFQKAAESILQLAIQANGYLNDQAPWSKMKKGGQEAQVAVDLYGVLESARLVGWLLKPLVPDLSERILSQLNQPSTTANWSGQLVWGRLESGHPLPQPQPVMQRLELEEAL

SEQ ID NO: 64827 - protein, 377 aa, Shewanella sp. MR-4
MSKRDYYEVLGVGRDASEREIKKAYKRLAMKFHPDRNPGDKAAEASFKEVKEAYEILTDANKKAAYDQFGHAGVDPNRGGGGGYGGAGDFGDIFGDVFGDIFGGGRRGGQRQAARGSDLRYNLELSLEEAVKGLTKELRIPTLASCDVCDGSGAKKGTSATTCGTCHGQGQVQMRQGFFTVQQACPTCHGRGKIIKDPCTKCHGDGRVEKTKTLSVKIPAGVDTGDRIRLAGEGEAGEFGAPPGDLYVQVTVREHAIFVRDGNNLYCEVPISFSKAALGGEIEVPTLDGKVSLKIPAETQTGRMFRLRGKGVKSVRSHAVGDLLCKVVMETPVNLNERQKELLREFEATLTGESKKHSPKAEGFFDGVKKFFQDLNS

SEQ ID NO: 64828 - protein, 249 aa, Xanthomonas campestris pv. vesicatoria str. 85-10
MTRKLVLLRHGQSQWNLDNRFTGWVDVELTDQGRQEAVAAGKLMKDEGLQFDVAHTSVLKRAIHTLQGALKELDQDWLPVSKSWRLNERHYGGLQGLDKAETAAKHGEEQVKIWRRSYDIPPPAMDVNDPGHPCHDRRYATLDRNALPGTESLATTLVRVLPYWHDAIAPQLKAGQTVLVTAHGNSLRALYKYLNDVSNEQILELNIPTGIPLLFELDDNLQVRSFRYLGDPEAAKRAAEAVANQGKAK

SEQ ID NO: 64829 - protein, 284 aa, Corynebacterium efficiens YS-314
MNHDSILLGLIGEDISLSRTPAMHEAEGLAQGAATVYRRIDTLTDRARGRSLQELLDAARSTGFNGLNITHPYKQAVLPLLDEVSEQAAQLGAVNTVVIGEDGRTSGHNTDVTGFARGLEEGLPDATMTTVVQVGAGGVGNAVAYSLVTHGVEQLQVADLDPARAQALADAINSAIGREAVHGIDARGVEEAIAAADGVVNATPMGMLAHPGTAFDTSCLTPHHWVGDVVYMPIETQLLKDARALGCRTLDGTRMAIHQAVDAFRLFTGLEPDVERMRATFLSL

SEQ ID NO: 64830 - protein, 363 aa, Brassica napus
  misc_feature (197)..(197): Xaa can be any naturally occurring amino acid
SGILIFENGVLKQSFRRMRSGLVSARSYAAGSKEMTVRDALNSAIDEEMSADPKVFVMGEEVGQYQGAYKITKGLLEKYGPERVYDTPITEAGFTGIGVGAAYAGLKPVVEFMTFNFSMQAIDHIINSAAKSNYMSAGQINVPIVFRGPNGAAAGVGAQHSQCYAAWYASVPGLKVLAPYSAEDARGLLKAAIRDPXTPLVFLENELLYGESFPISEEALDSSFCLPIGKAKIEREGKDVTITTFSKMVGFALKAAEKLAEEGISAEVINLRSIRPLDRATINASVRKTSRLVTVEEGFPQHGVCAEICASVVEESFSYLDAPVERIAGADVPMPYAANLERLALPQVEDIVRAAKRACFRSK

SEQ ID NO: 64831 - protein, 595 aa, Oryza sativa (japonica cultivar-group)
MAEQPRINSALVSVIRMAKVSKNANSAVSAAAYHYIRNDDRPDKAFTTERAKRAGKANASSGQIFVTIPPDHFGPILAENDPKRSIGVLVGDTWEDRLECRQWGAHFPHVAGIAGQSTHGAQSVALSGGYVDDEDHGEWFLYTGSGGRDLSGNKRTNKEQSSDQKFEKLNAALRISCLKGYPVRVVRSHKEKRSSYAPEAGVRYDGVYRIEKCWRKISVQGKFKVCSDIYGDRPRPLPKVDELKGATDISERKGTPSWDFDEKEGWKWVKPPPISRKPNLSGDPATDKEIRRVARRAQMSVTERLLKEFGCSICKQVMKEPLTTPCAHNFCKLCLVGTYGSQSSMRERSRGGRTLRAQKIVKKCPSCPTDICDFLENPQINREMMDLIESLQRKAVEEGDTKTSSDVSNGAESSGDDGNNEALEKGEDDSSLKDDGSLKDDGKVVKAVVVIKEEDLQPKKSKGEDEKEQGDKKMDSADVVDIAVEKKQATKRASEKAEKKQARKRKGDAVATNDGKRMKTGGDAMETAAEEDAPLSGGTPVKRNSRKSSEVDAKGGGGSPVVSSPRRVTRSNAKASGEADGSPATRTRRATRAEA

SEQ ID NO: 64832 - protein, 336 aa, Aspergillus oryzae
MADMADLLADADDTSDSEEEEEEDLESAKKQLAAGYMPKTRVLMLTSRGVTSRHRHLLADLAGLLPHTHKESKLDTKKKTAGYNLLLNDLADLHSCNVIFFLEARKRGQDLYLWLARPPNGPTLKFHVNNLHTMGELNAGFSGNCLKGGRGVVVFDRSFDEQGPVMSQPGNEYRGLVREMLRGVFSVPKRGVKGMKPFIDRIIGVFGVDGKIWIRVYEIRESEAGGKKKSEDGEEAAKPVPKGKDGLPEVSLVEVGPRFVLTPIVILEGSFGGPVIYENKEYVSPNQVRHDIRISKAARHAKRRDTQTDRFAKRTNLGLGEGQRKPGPLDNKQLFA

SEQ ID NO: 64833 - protein, 374 aa, Magnaporthe grisea 70-15
MATITEIAAPAPETYKLELHSAYGPVYRDVLRTPARDCTSSEVPVIDLTNINGTDDQRRALAETVREAAENTGFFYIKNHGIPESTIGAAFAQAHAFFTQPAELKELVSRDRSKFFSGWTKRHGIQIAPTDKPDNREGFSFRYDPSHDPETKDPAAVPEDVARWLKVEDFMWQGTAHLPNFKRDLVTYWQECVTLSRRMIKIFARALDVDENYFDDVVTYPGSDSVFNYYPKNEGSADAVDIGLGAHTDLQCFTFLWQDDVGGLQVLTNEGQWVKVPPVEGTFVVNIGDFLQRVSNDRFKSTVHRVYNHAPKDRISMPFFFGFNHNAQCSVLPTCTSETNPAKYEPISCGEDVYNHKWCRLRFEKTYSHSQEKK

SEQ ID NO: 64834 - protein, 221 aa, Aspergillus oryzae
MSLVLSFLAGLFSFMQAPVKIMVLIGDSGVGKSNLLSRFTRNEFNLDTKSTIGVEFATRSIQVDSKTIKAQIWDTAGQERYRAITSAYYRGAVGALLVYDISKHQTYDNVNRWLKELRDHADSNIVIMLVGNKSDLRHLRAVPTEEAKQFASENNLSFIETSALDASNVELAFQNILTEIYRIVSSKALDSGDSGQAGLGDRRPVVDINPSQDPETKQGCC

SEQ ID NO: 64835 - protein, 334 aa, Pseudomonas fluorescens PfO-1
MTNQTNRQFLLAKRPAGAATRETFTYQELPVGEPAAGQILVKNEYLSLDPAMRGWMNEGKSYIPPVGLGEVMRALGVGKVVASNNPGFAVGDYVNGAIGVQDYFLGEPKGFYKVDPKLAPLPVYLSALGMTGMTAYFALLDVGAPKAGDTVVLSGAAGAVGSIAGQIAKIKGCRVIGIAGGADKCKFLVDELGFDGAIDYKSEDVLAGLKRECPKGVDVYFDNVGGDILDAVLSRLNFKARVVICGAISQYNNKEAVKGPANYLSLLVNRARMEGFVVMDYAAQYASAAQEMAGWMAKGQLKSKEDIVEGLETFPETLGKLFSGENFGKLVLKV

SEQ ID NO: 64836 - protein, 140 aa, Sinorhizobium meliloti 1021
MAIERTFSMIKPDATKRNLTGAITKMLEDAGLRVVASKRVWMSRREAEGFYAVHKERPFFGELVEFMSSGPTVVQVLEGENAIAKNREVMGATNPANAAEGTIRKVHALSIGENSVHGSDAPETAAEEIAYWFSGTEIVG

SEQ ID NO: 64837 - protein, 162 aa, Trema orientalis
MSSSEVDKVFTEEQEALVVKSWAVMKKNSAELGLKFFLKIFEIAPSANNLFSYLKDSPIPLEQNPKLKPHAMTVFVMTCESAVQFRKAGKVTVRESNLKRIGAIHFKNGVVHEHFEVTRFALLETIKEAVPEMWSPEMKNAWGEAYDQLVAAIKFEVKPSST

SEQ ID NO: 64838 - protein, 307 aa, Mycobacterium avium subsp. paratuberculosis K-10
MSLEPQIAAIIEQLDSGFPPVQQMSGAEARALIRSRLVPPAQPEPVAEVADRLVEGPGGPLRIRVYRPEAAAPLPVVVYAHGGGFVFCDLDSHDGLCRNLANLVPAVVVSVDYRLAPENAWPAAAEDVYAVTCWARDHADALGADPARLVVGGDSAGGNLAAVTTVMCRDRGGPAPAAQLLIYPVIAADFDTESYRLFGQGYYNPAPALRWYWDCYVPSTRDRAHPYATPLNADLRGLPPAVVVVAGHDPLRDEGLAFGAALEAAGVPTVQLRYEGGIHGFMTMPMLDIAHRARNEAAAALADLLQW

SEQ ID NO: 64839 - protein, 380 aa, Medicago truncatula
MASSTEGQVITCKAAVAWEPNKPLTIEDVEVAPPQANEVRIQILFTALCHTDAYTWSGKDPEGLFPCILGHEAAGIVESVGEGVTDVKPGDHVIPCYQAECGECKFCKSGKTNLCGKVRAATGVGVMMNDRKPRFSIKGKPIYHFMGTSTFSQYTVVHDVSVAKIHPDAALDKVCLLGCGVPTGLGAVWNTAKVEPGSIVAIFGLGTVGLAVAEGAKSAGASRIIGIDIDSNKFDTAKNFGVTEFINPKDHEKPIQQVISDLTDGGVDYSFECIGNVSVMRSALECTHKGWGTSVVVGVAASGQEISTRPFQLVTGRVWKGTAFGGFKSRSQVPWLVEKYLKKEIKVDEYVTHNLTLAEINEAFDLMHEGKCLRCVLALH

SEQ ID NO: 64840 - protein, 561 aa, Cryptococcus neoformans var. neoformans JEC21
MPIRSPTSLSLKRSSHFTTATRRLHTSTPTLIAAASLSKKLQRFSPQLTPRLLAPNGSRTMSNWPKVTSENPLGLDDPSLFIQKGFINGQYVGTQSGKTFEVNDPASGKTIGTCPEMTVEDTRHAIEVAEKAFATFRNTSPVQRSNWLSELYRLYQASIKDIARLIVWENGKSWNDAMAEATYAGTFFSWFAGEALRTYGDVIPCSVPGTRNFSIKQPIGVVALLCPWNFPAAMIARKMGPALAVGCTSVIKTPSETPFTTLAIIELARRAGIPDGVINVITTDANLQDVGKELCTNPAVHKVSFTGSTRVGKILASQCSSTLKKMSLELGGNAPLIVFEDADIPTAVAGTIASKFRGSGQTCVCANRIYVHEAIYDEFAKKLAEKVAEFKVGPGFGEGVTHGPLIHSRQADKVEEHVQDAIKKGAKVLVGGKRGNGTEYIPTVLTNVSDECLIATEETFGPVAALFRFSSEEEVVARANRAEVGLAGYFFSRDSDRIWRVAEALETGMVGANTGMISQAVIPFGGIKESGYGKEGGRQGTEEYTITKLVAVGTSLHNMPK

SEQ ID NO: 64841 - protein, 206 aa, Yersinia pseudotuberculosis IP 32953
MTTPSFDSVEAQASYGIGLQIGQQLQESGLQGLLPEALLAGLRDAMEGNTPTVPVDVIHRALQEVHEKADKVRVERQQALVDEGKTFLEENAKRDDVTTTESGLQFSVLQAGDGPIPSRQDRVRVHYTGRLVDGTVFDSSVERGQPADFPVSGVIPGWIEALSMMPVGSKWKLYIPHNLAYGERGAGATIPPFSALMFEVELLEIL

SEQ ID NO: 64842 - protein, 202 aa, Yarrowia lipolytica CLIB122
MSQQQHLEEEEEEEFVDTYVPGEKKSVAEYVNLDAEDESLRKWKEALGITSNVAGQTVGDPNDKRRVVIMENRTYLGDDEPIVKNLEDPKTIEDLKTGTIKIKEKIKYYSEIKFRVQHEIVTGLVYQQTISRMGVPIETRKQVMGSYPPNTPENPFYVKKFELQEAPSGFLVRGKYLGQSKYIDDDGVVHAEYPFNFEITKK

SEQ ID NO: 64843 - protein, 485 aa, Zea mays
MAARKKKPLLIACQATSARITRSQAAANSTRSGLAPSVPVPLKTEHNHAAKKKMKREASDENASADAGASAPLPKRRTVLKNVTNISCAKISKRCTAVTGLKLGPSQKAGQSINKQCTNKISMLLPLAVGGSSLVDDSNNAEETQMVDLLAQKEKQIVLLKEAQPLQNTEQNKGGACDEASVEERNAMNVHETAALKAGVSNGLNIVDIDKNNGDPQMCVTYVAEIYRNLMASELIRRPRSNYMETLQQDITASMRGVLIDWLVEVSDEYKLVADTLYLTVYLIDQFLSQNCIQTHKLQLLGITSMLIASKYEEYSAPSAEEFCNITAGTYAKAEVLEMEQQVLNDLGFHLSVPTTNTFLRRFLRAAQASRTAHLTTLNYLASYLAELTLISYDFMKFLPSEVAASSIFLAKWTLDQSDHPWNPTLEHYTSYKSFDIRTCVRALQELQHNTSNCPLNAIREKYGQQKFECVANLRSPELLRSLFS

SEQ ID NO: 64844 - protein, 764 aa, Bacillus licheniformis ATCC 14580
MTKRCVPMIEITKGVETGYGSILAISDMESAMRDERIKKTKPVCTYCGVGCSFDVWTKGRDILKVEPQEEAPANGISTCVKGKFGWDFINSEERLTKPLIREGDHFREAEWEEALTLIASKFTDLKEEFGPDSLAFITSSKCTNEESYLMQKLARGIIGTNNVDNCSRYCQSPATAGLFRTVGYGGDSGSIADIAQADLVLIIGSNTSESHPVLSTRIKRAHKLRGQKVIVADIRKHEMAERSDLFVQPRAGSDIVWLNAIAKYLIENGKADERFLQERVNGRDEYVKSLTPYTLEYAEEKTGIDQETLIQMAEMIGQADSVCALWAMGVTQHIGGSDTSTAISNLLLVTGNYGKPGAGSYPLRGHNNVQGASDFGSMPDRLPGYEKVTDEQVRQKYEQAWGVPLPKEPGMTNHEMIEKIHSGKLKAMYVKGEEMGLVDSNINHVHAAYEKLDFFVVQDIFFSRTAEFADVVLPASPSLEKEGTFTNTERRIQRLYQVFEPLGESKPDWQIIMEVANKLGADWHYEHPADIMEEAAKLSPIYAGVTYERLEGYNSLQWPVSADGKDSPLLFTERFPFPDGKAILYPVHWTEPEEFGEEYDIHVNNGRLLEHFHEGNLTYKSKGISKKTPEVFLEISPELAAERGIQDGTLVRLTSPFGNVKVKCLITDRVKGKEVYLPMNDSGEAAINLLTGSHADKDTDTPAYKETSAKMEILKRDGSNPLPKINHRNGNPQPQIGVQVQKKWARKDYIFPGDAVKRGIGHNG

SEQ ID NO: 64845 - protein, 271 aa, Ostreococcus tauri
MARNQEKANGMFNKWTTGKQDALRGTVSRSRPSHTHAARDLNEADKWRSDVLREIGQKVMEIQNAGLGEHRIRDLNDEINQLLKVKWQWEMRIIELGGPNYIASAPKMEDADGGMVAPAGSARNAYKYFGAAKTLPGVKELFEAPSVKAVRRTRHQMNLHIDSGYFGFRDEEDGVLLKVEAEAEAEMRRSAIEQWDAEQTLRALESGKSRPETSKGGAGARFVAHVALPDETDIQKQVLDRKKADLLAKYVSDDLKAETEGAKKMLHGAND

SEQ ID NO: 64846 - protein, 503 aa, Oryza sativa (japonica cultivar-group)
MATAIPQRQLFVAGEWRAPALGRRLPVVNPATESPIGEIPAGTAEDVDAAVAAAREALKRNRGRDWARAPGAVRAKYLRAIAAKIIERKSELARLETLDCGKPLDEAAWDMDDVAGCFEYFADLAESLDKRQNAPVSLPMENFKCYLRKEPIGVVGLITPWNYPLLMATWKVAPALAAGCTAVLKPSELASVTCLELADVCKEVGLPSGVLNIVTGLGSEAGAPLSSHPGVDKVAFTGSYETGKKIMASAAPMVKPVSLELGGKSPIVVFDDVDVEKAVEWTLFGCFWTNGQICSATSRLILHKKIAKEFQERMVAWAKNIKVSDPLEEGCRLGPVVSEGQYEKIKQFVSTAKSQGATILTGGVRPKHLEKGFYIEPTIITDVDTSMQIWREEVFGPVLCVKEFSTEEEAIELANDTHYGLAGAVLSGDRERCQRLTEEIDAGIIWVNCSQPCFCQAPWGGNKRSGFGRELGEGGIDNYLSVKQVTEYASDEPWGWYKSPSKL

SEQ ID NO: 64847 - protein, 831 aa, Geobacter metallireducens GS-15
MVSLTIDGKDISVAKGSTILDAAAQLGITIPTLCWLKKVSPTGACRVCAVEVEGVDRPMTACNTPVKEGIKVTTQSEKLSRIRQKIMELMLVNHPLDCPVCDAGGECDLQNSCYGLGASRQEYSALLERREIRYNWPLIESDPNRCILCEKCVKVDHEVVGCDAIAVVNRGEATIIDTIDGKPLNCEFCGNCVGACPTGTLISKPFKFRGRPWAFTVTKSVCAFCSTGCQIEYHTRNGRVERVTSDDDNFNSGNLCINGRFGYSYINSSDRLTQPLVRGEKVDWNAAMGTAATGLKEIVANYGPDAVAGFGSPRVTNEESYLFQKLFRNALGSGNIDSEARLGFAQAQKALRERLGLRGASATIDAIDRAGAILVFGCDLNAEATGIEYRVIKAATKNDAKLVLANMRDVKLKKFANSHLKYRPGSELALINALTRVVLDEGLQDNDFASARIANLAELTAALGTVSVADAAAAVGLSEAELRAAARLLGKKKSVAVLFGADLMRSSGADEAVNALANLAIVLGALGKETGGLFPVYEKTNIRGLLDMGVAPDMLPGYAAPAVAGKDLWQIVEGIEQGSVKALYLLGCDPVASFPEGERIRAALGKLELLIVQDPFPGESAKQAHIVLPSSVAAEKSGTFTTIDGRVQSIAKAANPPGEAREDWDILTELCNRLTGESRPASPASIMAEITALVPGYGADVVLPAGFPSAGPVSLAVSKDVRPVQSQQAPLLLAGAILYHSGTTTTWSKNNLEIVPAGYVEIHPDDAARLGVSDGSSLRISAGAVSVNAPARVSGKVQAGLLFAPSHFRAMNVNALLGKGAGVVPVKVEKA

SEQ ID NO: 64848 - protein, 490 aa, Arabidopsis thaliana
MAPQEQAVSQVMEKQSNNNNSDVIFRSKLPDIYIPNHLSLHDYIFQNISEFATKPCLINGPTGHVYTYSDVHVISRQIAANFHKLGVNQNDVVMLLLPNCPEFVLSFLAASFRGATATAANPFFTPAEIAKQAKASNTKLIITEARYVDKIKPLQNDDGVVIVCIDDNESVPIPEGCLRFTELTQSTTEASEVIDSVEISPDDVVALPYSSGTTGLPKGVMLTHKGLVTSVAQQVDGENPNLYFHSDDVILCVLPMFHIYALNSIMLCGLRVGAAILIMPKFEINLLLELIQRCKVTVAPMVPPIVLAIAKSSETEKYDLSSIRVVKSGAAPLGKELEDAVNAKFPNAKLGQGYGMTEAGPVLAMSLGFAKEPFPVKSGACGTVVRNAEMKIVDPDTGDSLSRNQPGEICIRGHQIMKGYLNNPAATAETIDKDGWLHTGDIGLIDDDDELFIVDRLKELIKYKGFQVAPAELEALLIGHPDITDVAVVA

SEQ ID NO: 64849 - protein, 1074 aa, Shewanella sp. MR-4
MPKRTDIKSILILGAGPIVIGQACEFDYSGAQACKALREEGYRVILVNSNPATIMTDPEMADATYIEPIQWEVVRNIIAKERPDAILPTMGGQTALNCALELEAKGVLAEFNVEMIGATADAIDKAEDRSRFDKAMKSIGLECPRAGIAHSMEEAYGVLDLVGFPCIIRPSFTMGGSGGGIAYNKEEFEEICSQGLDLSPTKELLIDESLIGWKEYEMEVVRDRNDNCIIVCSIENFDPMGVHTGDSITVAPAQTLTDKEYQLMRNASMAVLREIGVETGGSNVQFGINPKDGRMVIIEMNPRVSRSSALASKATGFPIAKIAAKLAVGFTLDELMNDITGGRTPASFEPAIDYVVTKVPRFNFEKFAGSNDRLTTQMKSVGEVMAIGRTFQESLQKALRGLEVSRHGFDPITDLTKPDALARIRLELKEPGCDRIWYIADAMRAGLTLDEIFRLTNIDPWFLVQIEELIKLEGQVAEGGLAGLNEELLRKLKRKGFADARLAAVLGVNETEVRKLRDRFDIHPVYKRVDTCAAEFATDTAYMYSTYEEECEANPSDREKIMVLGGGPNRIGQGIEFDYCCVHAALALREDGYETIMVNCNPETVSTDYDTSDRLYFEPVTLEDVLEIVRIEKPKGVIVQYGGQTPLKLARALEAAGVPIIGTSPDAIDRAEDRERFQQAIQRLEMKQPENDTVTTVEGAVIAAERIGYPLVVRPSYVLGGRAMEIVYDQQDLLRYFNEAVSVSNASPVLLDHFLDDAIEVDIDAVCDGETVVIGAIMEHIEQAGVHSGDSGCSLPPYTLSQAIQDEMRVQVRKLAMELGVVGLMNVQFAVKNNEIYMIEVNPRAARTVPFVSKATGVPLAKIAARVMAGQSLKAQNFTEEVIPPFYSVKEVVLPFNKFPGVDPLLGPEMRSTGEVMGVGDTFAEAYAKAQLGATSEVPKSGRALLSVRNSDKKRVADLAAKLIELGYQIDATHGTAVILGEAGINPRLVNKVHEGRPHILDRIKNGEYTYIVNTTEGRQAIEDSRQLRRGALRYKVNYTTTMNAAFATCMAHAADDRTNVTSVQELHQRVLAK

SEQ ID NO: 64850 - protein, 197 aa, Synechococcus sp. CC9311
MAPFSLRRPLQAMKSGMAWGGGHSLGVVLLGVVAIFFKDLIHAESMSAWAEFLVGVSLLVIGALAIRTAFGLELHTHDHHHDGSALHRHLHLHLRGQNNHRRHAHAASGLGLLHGLAGAGHLLAVIPALALPVHGAVLYLVAYLCGSMGAMLAVVSTLSLLTMRSSARFLPVLVGCTGGLSIVTGAIWLQKTSSFLF

SEQ ID NO: 64851 - protein, 249 aa, Arabidopsis thaliana
MFSNIDQTAVAALLRGQGCANSLKRLLENHKLSSDSTEPLIYTILNSFSLALSFVDPPSLLPHNESSLQNMTSHVLQRSSKKKYYGAEDLEYYRDESPTPRPDDGFTWRKYGQKTIKTSPYQRCYYRCTYAKDQNCNARKRVQMIQDNPPVYRTTYLGKHVCKAVAVHDDTYGSEMIKFDQVVSESVMPQLATIDEQAITMEDEAIDHIMNQECDINDFSVDDDPFWASQFPPFSSEDIMFFDNIANLD

SEQ ID NO: 64852 - protein, 323 aa, Arabidopsis thaliana
MESRLSLFIMKQTILYLISIPYSDVNNFVGVLRYQTSFKSVKLSCGEGGCGACVVLLSNQHSRFVTSPDENSDVVYSFSGYSHASEIVDCYLNGKSPPKTTINPESSKFWWEDPNLYGDCDDLSELRIIEDRLMRTKKHLMDCLEKKEKSYSVSKSDQNPKNNGGSSSSSSSSSSQIASDFGQNPSTSSPFFDHHSYSSLEPSSQVTTCFDQNPIFSVGSESSSDQFRYLVNEDAGFVDCLFETEEEKNRMIVPQETQTQPMFSEEDQSFWENLDVDDVFGLFNDDTNLEVPLQDHSSTNEEDEFMIDISEYLSEEAMEWPMF

SEQ ID NO: 64853 - protein, 209 aa, Buchnera aphidicola
MLSKKENLLKLDWIKTNGLIPAIIQDFASNLVLMHGYMNKEAFLKTQKEGFVTFYSRTKKRLWTKGEESGNLLKVIDIVTDCDYDTILIIVEPLGKTCHLNRKSCFFLKENTLNFLSKLEDLIEDRKNFNTDNSYTARLYKSGTKRIAQKVGEEAIETILAAMKNDGDELINESSDLIYHLIVLLHDQNLNFNLIIENLKKENRKIINL

SEQ ID NO: 64854 - protein, 369 aa, Helicobacter pylori J99
MELSYYEILEVEKHSNQETIKKSYRKLALKYHPDRNAGDKEAEEKFKLINEAYGVLGDEKKRALYDRYGKKGLNQAGTSQSDFSDFFEDLGSFFEDAFGFGARGSKRQKSSIAPDYLQMIELSFKEAVFGCKKTIKAQYQSVCESCDGTGAKDKALENCKQCNGQGQVFMRQGFMSFAQTCGACQGKGKIIKTPCQACKGKTYILKDEEIDAIIPEGIDDQNRMVLKNKGNEYEKGKRGDLYLEARVKEDEHFKREGCDLFIKAPVFFTTIALGHTIKVPSLRGDELELKIPRNAKDRQAFAFRNEGVKHPESSYRGSLIVELQVIYPKSLNKEQQGLLEKLHASFGYEGEPHKSVLETCVSKIKDWFK

SEQ ID NO: 64855 - protein, 219 aa, Shewanella sp. MR-4
MTQDEMKKAAGWAALKYVEKDSIVGVGTGSTVNHFIDALATMKADIEGAVSSSEASTQKMKALGIPVYDLNSVDKLSVYVDGADEINGHMDMIKGGGAALTREKIVAAVAEKFVCIVDNTKQVDILGEFPLPVEVIPMARSYVARELVKLGGDPVYREGVVTDNGNVILDVYNLKIINPKELEEKINAIVGVVTNGLFAKRGADVLLVGTPEGVKTFTA

SEQ ID NO: 64856 - protein, 308 aa, Salmonella sp.
INGFGRIGRIVFRAAQKRSDIEIVAINDLLDAEYMAYMLKYDSTHGRFDGTVEVKDGHLIVNGKKIRVTAERDPANLKWNEVGVDVVAEATGIFLTDETARKHITAGAKKVVLTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDN

SEQ ID NO: 64857 - protein, 341 aa, Glycine max
LIKVVKELWRAFFFLCSPQFWRMALLWTFSILYSYYQLFKPLIHEKCSLFSHKLVSYPRCSPFTTTFKPVCVITGATSGLGLAAAYQLSKEGYFVVLVGRSQQLLSETITKIKDWNEDAHLEAFQVDLSSIESVVKFKMSLQQWLLDSDLHCSIQILINNAGILATSPRVTAEGYDQMIGTNYIGAFALTKLLLPLLEFRPVQSKIVNVYSYTKRMPHLFSYEPHRQLCLMGKSHQIFVTVADPGVVQTNLMREIPAILSWLAIYVLKRLRLLQSPECGVDSIVDAALAPPGTSGAYFFGGNGRTINPSTLSRNAKLARELWESTSKLLSVTPFGAEGNSW

SEQ ID NO: 64858 - protein, 375 aa, Aggregatibacter actinomycetemcomitans
MAKQDYYELLGISRSADEKEIKRAYKKLAMQYHPDRTKGDKEKEEKFKEIQEAYEVLNDKEKRAAYDQYGHAAFEQGTGFGGGSFGGADFGDIFGDMFGDIFGGGGRGRQRVVRGDDLRYDIEITLEEAVKGTTKDIKIHTLAPCDTCHGTGAEAGSKVETCPHCHGAGRLRRQQGFFVTEQPCHFCHGTGKKIEKPCKTCHGDGRVNKAKNLSVKIPAGVDTGNQLRLSGEGAAGENGAPAGDLYVVIHVKEHHIFERDGSNLYCEVPISFTMAALGGEIEVPTLDGRVKLKIPEETQTGKLFRMRGKGVTSTRSGYAGDLTCRIIVETPVKLNEEQKELLRKLEESLEGQTKQRPKSSSFLDGVKRFFDDLTK

SEQ ID NO: 64859 - protein, 236 aa, Arabidopsis thaliana
MIVSSPSSSLPRFLRMESQSQLRQSISCSASSSSSMALGRIGEVKRVTKETNVSVKINLDGTGVADSSSGIPFLDHMLDQLASHGLFDVHVRATGDVHIDDHHTNEDIALAIGTALLKALGERKGINRFGDFTAPLDEALIHVSLDLSGRPYLGYNLEIPTQRVGTYDTQLVEHFFQSLVNTSGMTLHIRQLAGENSHHIIEATFKAFARALRQATETDPRRGGTIPSSKGVLSRS

SEQ ID NO: 64860 - protein, 346 aa, Burkholderia xenovorans LB400
MKALVYHGPGKKSLDERPMPQLASATDAIVKVTRTTICGTDLHILKGDVPTCQPGRILGHEGVGIVQQVGAAVSSLKEGDHVLISCISACGKCDYCRRGMYSHCTTGGWILGNRIDGTQAEYVRIPHAETSLYPIPAGADEEALVMLSDILPTGFECGVLNGKVQPGSAVAIVGAGPIGLASLLTAQFYSPAQIIMIDRDERRLEVASRFGATACIDSRVAEPVVEVMKLTGHVGVDCAIEAVGVPDTFELCQALVAPGGVIANIGVHGVKADLHLESLWDRNISITTRLVDTVSTPMLLKTVQSGRIDPARLITHHFQLDDVLNAYDTFGRAADSHALKVIIEMS

SEQ ID NO: 64861 - protein, 308 aa, Salmonella bongori
INGFGRIGRIVFRAAQKRSDIEIVAINDLLDAEYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDTYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAMKAASEGAMKGVLGYTEDDVVSTDFNGEVCTSVFDAKAGIALNDNFVKLVSWYDN

SEQ ID NO: 64862 - protein, 141 aa, Bdellovibrio bacteriovorus HD100
MSIEQTFSIIKPNAMKKNAIGDIVSMFEANGLKIAAAKITVLTTAKAEEFYAEHKARPFFGELVSFMTSGPVMLMCLQGEGAVLKNREIMGATDPKKANPGTVRAKFGDNVGENAVHGSDSPESAARELALFFEKHEICNV

SEQ ID NO: 64863 - protein, 224 aa, Oryza sativa (japonica cultivar-group)
MRFTASPVVELPVGGAVLTFEQDNDSFEVGTSVWPSSLVLVKFAERCLRDPALPFADVLRFPGTRAVELGSGCGPAGLGLSRLGLADLVLTDIAAVLPALRRNLRRNRRHLPRAPRLAQLHWNCPAHLASLASPRRFDLVVAADVVYVPESVPHLVAAMDVLADADRGVVLLGYQVRSPEAHQAFWDAVPAAFPVIEKIPREHLDPDYAYEESDVFVLRRRPRQ

SEQ ID NO: 64864 - protein, 403 aa, Chlamydophila abortus S26/3
MDRLTVRELSPEEKKVLVRVDFNVPIKDGKILDDIRIRSAMPTIHYLLQKRAAVILMSHLGRPQGKGFEEKYSLQPVVEVLEGYLGHHVPLAPDCVGEVARQAVAQISPGRVLLLENLRFHPGEEHPEEHPAFAAELSSYGDFYVNDAFGTSHRKHASVYTVPQAFPGRSAAGLLMEKELEFLGQHLLISPKRPFTAILGGSKVSSKIGVIEALLSQVDNLLLAGGMGFTFLKALGKSVGNSLVEESGIELARRVLHIAQQRNVRIVLPIDVKVAKACTPAVSWTEVSIDQGIPQDLEGLDIGTKTVQEFCKIIDASSTIFWNGPVGVYEVPPFDQGSMAIANCLARHPSAITVVGGGDAAAVVALAGCTAQVSHVSTGGGASLEFLEKGFLPGTEVLSPSQE

SEQ ID NO: 64865 - protein, 1320 aa, Salmonella enterica subsp. enterica serovar Typhi str. CT18
MGTTTMGVKLDDATRERIKMAASRIDRTPHWLIKQAIFSYLDKLENSDTLPELPALFAGAANESEEPVAPQDEPHQPFLEFAEQILPQSVSRAAITAAWRRPETDAVSMLMEQARLSPPVAEQAHKLAYQLAEKLRNQKSASGRAGMVQGLLQEFSLSSQEGVALMCLAEALLRIPDKATRDALIRDKISNGNWQSHIGRSPSLFVNAATWGLLFTGRLVSTHNEANLSRSLNRIIGKSGEPLIRKGVDMAMRLMGEQFVTGETIAQALANARKLEEKGFRYSYDMLGEAALTAADAQAYMVSYQQAIHAIGKASNGRGIYEGPGISIKLSALHPRYSRAQYDRVMEELYPRLKSLTLLARQYDIGLNIDAEEADRLEISLDLLEKLCFEPELAGWNGIGFVIQAYQKRCPLVIDYLVDLASRSRRRLMIRLVKGAYWDSEIKRAQMEGLEGYPVYTRKVYTDVSYLACAKKLLAVPNLIYPQFATHNAHTLAAIYHLAGQNYYPGQYEFQCLHGMGEPLYEQVTGKVGDGKLNRPCRIYAPVGTHETLLAYLVRRLLENGANTSFVNRIADATLPLDELVADPVEAVEKLAQQEGQAGIPHPKIPLPRDLYGEGRINSAGLDLANEHRLASLSSALLSNAMQKWQAKPVLEQPVADGEMTPVINPAEPKDIVGWGREATESEVEQALQNAVNQAPVWFATPPQERAAILQRAAVLMEDQMQQLIGLLVREAGKTFSNAIAEVREAVDFLHYYAGQVRDDFDNETHRPLGPVVCISPWNFPLAIFTGQIAAALAAGNSVLAKPAEQTSLIAAQGIAILLEAGVPPGVVQLLPGRGETVGAQLTADARVRGVMFTGSTEVATLLQRNIATRLDAQGRPIPLIAETGGMNAMIVDSSALTEQVVVDVLASAFDSAGQRCSALRVLCLQDDIAEHTLKMLRGAMAECRMGNPGRLTTDIGPVIDSEAKANIERHIQTMRAKGRPVFQAARENSDDAQEWQTGTFVMPTLIELENFAELEKEVFGPVLHVVRYNRNQLAELIEQINASGYGLTLGVHTRIDETIAQVTGSAHVGNLYVNRNMVGAVVGVQPFGGEGLSGTGPKAGGPLYLYRLLAHRPPNALNTTLTRQDARYPVDAQLKTTLLAPLTALTQWAADRPALQTLCRQFADLAQAGTQRLLPGPTGERNTWTLLPRERVLCLADDEQDALTQLAAVLAVGSQALWSDDAFHRDLAKRLPAAVAARVQFAKAETLMAQPFDAVIFHGDSDKLRTVCEAVAAREGAIVSVQGFARGESNMLLERLYIERSLSVNTAAAGGNASLMTIG

SEQ ID NO: 64866 - protein, 77 aa, Oryza sativa
  misc_feature (48)..(48): Xaa can be any naturally occurring amino acid
PSASQPSAEMSKTHTSHCPTADQCSHLLIPLNKCRDAEYYLPWKGEPXRHAYKKSQHELMIDRMLQIHYIPYAHEAK

SEQ ID NO: 64867 - protein, 339 aa, Rhodococcus sp. RHA1
MTVRVGVNGFGRIGRNFFRAVDAQKALGTTDIEIVAVNDLTDNATLAHLLKYDSILGRLPHDVSLEGEDTIVVGNQKIKALAIKEGPAALPWGDLGVDVVVESTGIFTDAAKAKGHLEAGAKKVIISAPAKGEDITIVMGVNDDKYDGSQNIISNASCTTNCLGPIAKVLDDEFGIVKGLMTTVHAYTQDQNLQDGPHSDLRRARAAALNVVPTGTGAAKAIGLVLPQLLGKLDGYALRVPIPTGSVTDLTANLKKSASVEDINAAMKAAAEGPLKGILKYTDAPIVSSDIVTDPHSSIFDSGLTKVIDDQAKIVSWYDNEWGYSNRLADLIGLVAKSL

SEQ ID NO: 64868 - protein, 403 aa, Rhodococcus sp. RHA1
MAVQTLDDLLNAGVEGRAVLVRSDLNVPLDGDRITDPGRIIASAPTLKALAEAGAKVIVTAHLGRPKGEPDPQYSLAPVAVKLAEVLGRNVQLAGDVVGQDALARAEGLTDGDVLLLENIRFDPRETSKDEAERTKLAKALVELVGDDGAFVSDGFGVVHRAQASVYEVAKLLPHYAGKLVEAEIKVLGKLTEEPERPYAVVLGGSKVSDKLAVIEALAPKVDTLVIGGGMYYTFLAAQGVSVGNSLCEESMIDTCKALLEQYADVIHIPQDVVIADSFSADAESKIVSVLEIPDGWMGLDIGPQSVRRFAAILTSAKTVFWNGPMGVFEFEKFAAGTKGVAEAIIEATGKGAYSVVGGGDSAAAVRQLGLPEDGFSHISTGGGASLEYLEGKELPGIAVLEG

SEQ ID NO: 64869 - protein, 354 aa, Triticum aestivum
FRAAARAGVSTQSPDNPDWFQGTADAVRQYLWLFEEHNVMEYLILAGDHLYRMDYEKFIQAHRETDADITVAALPMDEERATAFGLMKIDEEGRIIEFAEKPKGEQLKAMMVDTTILGLDDARAKEMPYIASMGIYVISKHVMLQLLREQFPGANDFGSEVIPGATSTGMRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAEKGGIPIGIGKNSHIKRAIIDKNARIGDNVMIINVDNVQEAARETDGYFIKSGIVTVIKDALLPSGTVI

SEQ ID NO: 64870 - protein, 261 aa, Rhodococcus sp. RHA1
MARKPLIAGNWKMNLNHLEAIALVQKIAFSLPAKYFDKVDVTVIPPFTDIRSVQTLVEGDKLLLTYGAQDVSAHDSGAYTGEISGSMLAKLGCTFVVVGHSERRTLHCEDNDTVLAKTKAALKNGITPIVCIGEGLDVREAGEHVSYNVEQLRGSLAGLSGEDIAKVVIAYEPVWAIGTGRVASAANAQEVCAAIRATLGELASQDVASGVRVLYGGSVNAKNVGEIVGQTDVDGALVGGASLKADEFATLSAIAAGGPLP

SEQ ID NO: 64871 - protein, 475 aa, Vibrio cholerae O1 biovar eltor str. N16961
MSKEIKAQVVVLGAGPAGYSAAFRCADLGLDTVIIERYNTLGGVCLNVGCIPSKALLHVAKVIEEAKALTEHGIVFGEPKTDIDKVRLWKEKVINQLTGGLAGMAKMRKVNVVNGYGKFTGPNTIEVDGEEGKTVVTFDNAIVAAGSRPIKLPFIPHEDPRIWDSTDALELKEVPGKLLIMGGGIIGLEMATVYHSLGSKIDVVEMFDQLIPAADKDMVKVYTKRIKDKFNLMLETKVTAVEAKEDGIYVSMEGKSAPAQAERYDAVLVAIGRVPNGKLLDAEKAGLEVDERGFIRVDKQMRTNVPHIFAIGDIVGQPMLAHKGVHEGHVAAEVISGKKHYFDPKVIPSIAYTEPEVAWVGKTEKEAKAEGINYEVATFPWAASGRAIASDCADGMTKLIFDKETHRVIGGAIVGTNGGELLGEIGLAIEMGCDAEDIALTIHAHPTLHESVGLAAEVFEGTITDLPNAKAKKKK

SEQ ID NO: 64872 - protein, 539 aa, Oryza sativa
SCRIVVKRSIDRSAMDLAAWFGPVNSGLVLLILTMLLRNLQNFQLMQTFVARQLNRRARRLAALIDPYLSITIHEYDAGRMTRSDVFAETKAYLDGAVGTRDDVRHLNAEDARGGGGGGGAGEGGGGGAGSSSSKGLVLSMADGEEVEDHFRGATLWWSAHCEQDDYKGRRGGRGRALQRRSYRLVFHECHRDLVRSAYLPHVRDQGRAFMAMSRQRKLYTNIPSSRWGDDGHAKTEVTCVRSHFRSYMCSLWTEVVFKHPKTFETLAMDPEKKREIIDDLDMFKNGKEQHRRVGKAWKRGYLLHGPPGTGKSTMVAAMANYLGYDVYDMELTSVHTNTDLRKLLIQTTSKSIIVIEDVDCSSNLTGRRKATGDGEDDDDDAKTTTKKVIDRGGGGGGVGGDSKVTLSGLLNFIDGLWSAFGEERLIVLTTNHVEDLDPALIRTGRMDKKIEMSYCDFETFKSMAKIHLDVDDHEMFAAVERLLPEVDLVPADVGEHLTAKNPRDDAGACLARLVNALQEAKAKKDAAERQDEDNGVVV

SEQ ID NO: 64873 - protein, 357 aa, Magnaporthe grisea 70-15
MASPRPTTTKQWILTNKPAGEPILSGPDATWQLKEVPLPPLEPGQILAKVKYFSNDTGLRNFIQSTVAADRFYVPTVPLGSPMRSGVIAEVVESASDKFKAGDMVMDFHLGVWGEHCILNADESQPLGPLPGGLSPTHYLGALGASGLAAYTGLYYAGKAKPGQTIVISAAAGATGTMAVQIAAKILGAGKVIGISSSEEKCKFVKSLGAHECLNYNSPTFKEDLIKATPDEVDLFFDNTGGEILDLMLTRVKKHGHVAVCGAVTMYNNEEPLKLKNWFEVISCRITIRGFIMLDYMDKVPAIMGELMGAIADGRLQLGDAETIIDASIEEQPKVWMRLFNGEDQQAKAGKLITRLN

SEQ ID NO: 64874 - protein, 171 aa, Ostreococcus tauri
MAKGGAKKRLEENAATLKRLSTTINAAIAFHVVVRVLLRRRSVTKWKLFLALFTALVSRWSLRSLESYAKPTFGENGEVLDGGESLRGGLTEYYQDLIYVGAFALVATTYSDKFWWVTLVVPGIATYMIVTKFVLPYMLAPREAEEAERKETREEKKRRERSERRAQRKFR

SEQ ID NO: 64875 - protein, 135 aa, Brassica napus
MGASGKWVKSIMGLKKAEKNEIEKGNSGKNKKWKLWRNPSGDLASSWKGIRHGRSESVSYSAAVATVLRAPPKDFKAVREEWAAIRIQTAFRGFLARRASRALKGIVRLQALVRGRQVRKQAAGTLRCMQALVRV

SEQ ID NO: 64876 - protein, 778 aa, Synechococcus sp. CC9311
MLNATSAPDPSQTQSGSTSAACGLTALRERPLRLPDGYDIELPDWLKQCLTHVPPGIGHSCPTDPEALLAAAFDFAFQLHEGQFRASGDPYIVHPVAVADLLRDIGASASVIAAGFLHDVVEDTDVTPDQIESHFGPEVRELVEGVTKLGGLHFTNRTEAQAENLRKMFLAMASDIRVVLVKLADRLHNMRTIGALKEEKQQRIARETREIYAPLANRLGIGRFKWELEDLSFKLLEPEAFREMQQEVSTKRSEREDRLSVTVQLLCDRLAAVGLDSCEVSGRPKHLYGIWTKMQRQQKEFHEIYDVAALRILTPNVESCYRALAVVHDTFRPIPGRFKDYIGLPKPNGYQSLHTAVIGRHRPIEVQIRTWDMHQVSEFGIAAHWKYKEGGSPATGGDTERFNWLRQLVDWQQEGAADDHNDYLASIKEDLFDEEVFVFTPKGDVVGLRKGSTAVDFAFRIHSEVGNHCHGVRINDRLLPLSTPLQNGDFIDILTSKNAHPSLDWLNFVATPTARNRIRQWYKRSHRDETIDRGKELLERELGRSGFDALLGSEAMLKVAERCNLQTTEDLLAGLGFGALTLHQVLNRLREEIRLQTAAVEAPLSNEDVAKQLVKQSEQPSNRDVPSVGAAPILGVEGLDHRLGGCCSPLPGEPILGAVALGNHGITIHRQDCANLEAIPTERRLPVRWNPSLQEVGSRFPAHLRIEVIDRVGILKDILMRLSDGSINVSDAQVRTAYGKPARIDLMVELGSAAQLQRTMNQIRSMADVIDIARTGQS

SEQ ID NO: 64877 - protein, 387 aa, Photorhabdus luminescens
MSVIKMTDLDLAGKRVLIRADLNVPVKDGKVTSDARIRASLPTIEAALKQGAKVMITSHLGRPIEGEYNEEFSLKPVVDYLKEKLSSSVRLEKEYLEGVEVSEGELVVLENVRFNKGEKKDDESLAKKYASLCDIYVMDAFGTAHRAQASTHGVAKFAPVACAGPLLFGELEALGKALDNPARPMVAIVGGSKVSTKLTVLDTLSKIADQLIVGGGIANTFVAAEGHNVGRSLYEDDLIPEAKKLLISCDIPVPTDVRVATEFSETAEATLKSSSDIKDDEQILDLGDESAQRLADILKNAKTILWNGPVGVFEFPNFRQGTEIVARAIADSDAFSIAGGGDTLAAIDLFGIADKISYISTGGGAFLEFVEGKKLPAVVMLEERAKQ

SEQ ID NO: 64878 - protein, 319 aa, Staphylococcus aureus subsp. aureus MRSA252
MRRLFSIGEALIDFIPNITNANLKDVQTFTKQIGGAPCNVACTVQKLGQQAHMITQLGNDAFGDSIIETISSIGVDVSKVYRTNEANTALAFVSLTEAGERDFSFYRKPSADMLFEPSFVNDIDVNENDVVHFCSVDLVDSPMRDAHYQLITKTLNANGTVVFDPNVRLPLWDNAEDLRQTIHTFLPLAHIVKVSDEELEFITGIHDENEAIQSLFTGNVTVVIYTKGADGAAVYLKNGINHYHSGYKVKSVDTTGAGDAFIGAVISRILATDVLNLTQLFENEGEEILAFSNRVAAIVTTKYGAINSLPTLQEVEQAF

SEQ ID NO: 64879 - protein, 513 aa, Bacillus subtilis subsp. subtilis str. 168
MTKLVNEMILVLDFGSQYNQLITRRIREFGVYSELHPHTLTAEEIKKMNPKGIILSGGPNSVYDENSFRCDEKIFELDIPVLGICYGMQLMTHYLGGKVEAASQREYGKANIRIEGTPDLFRDLPNEQVVWMSHGDLVVEVPEGFTVDAATSHHCPNSAMSKADKKWYGVQFHPEVRHSEYGNDLLKNFVFGVCECEGEWSMENFIEIEMQKIRETVGDKQVLCALSGGVDSSVVAVLIHKAIGDQLTCIFVDHGLLRKGEAEGVMKTFSEGFNMNVIKVDAKDRFLNKLKGVSDPEQKRKIIGNEFIYVFDDEADKLKGIDYLAQGTLYTDIIESGTATAQTIKSHHNVGGLPEDMQFELIEPLNTLFKDEVRALGTELGIPDEIVWRQPFPGPGLGIRVLGEVTEEKLEIVRESDAILREEIANHGLERDIWQYFTVLPDIRSVGVMGDARTYDYTIESRRTSIDGMTSDWARIPWDVLEVISTRIVNEVKHINRVVYDITSKPPATIEWE

SEQ ID NO: 64880 - protein, 248 aa, Oryza sativa
  misc_feature (92)..(92): Xaa can be any naturally occurring amino acid
MDSEHWISSLAAAKRFYAAQLGHVDDMAGIGMEEVEMEMEDDGEGMELELEMQLEEATWPDVACPYCYEDHDIASLCAHLEEDHPYEPHTSXPPCPICFEKITRDMLNHITMQHGYLFKSGRRMRRFDIPESQALSLLSRDLRDAQLQALLGGGHRQRRSNTTATNISADPLLSSFGLGFSTLDSEERSKAPVPIPDDTSIHKDTPAQPWESRIDSSLTSEEREQKRKQATDRATFVQGLVLSTLFED

SEQ ID NO: 64881 - protein, 223 aa, Glycine max
  misc_feature (172)..(172): Xaa can be any naturally occurring amino acid
MPPPPIFFIHSLLIKLKQKMCAAISEVEQEELLEKLEVFKIKGRDKHGRKILRIIAKFFPARLVSVEVLKKYLEERVFPKLMGKRKFAVLYVHTGVQRSENFPGISGLRWIYDAIPANVKENLEAVYFIHPGLQARLFLATFGRFLFNAGLYGKLRYVSRVDYLWESGRKNXVGISEFVFDHDQDLDYRPMMDYGLESDHARVYGGAPTMDLTLTTYSMRCIS

SEQ ID NO: 64882 - protein, 282 aa, Pseudomonas putida GB-1
MSQQAILAGLIGRGIQLSRTPALHEHEGDAQALRYLYRLIDADQLQLDDSALPGLLDAAQHTGFTGLNITYPFKQAILPLLDELSDEARGIGAVNTVVLKDGKRVGHNTDCLGFAEGLRRGLPDVARRQVVQMGAGGAGSAVAHALLGEGVERLVLFEVDAARAQALVDNLNAHFGAGRAVVGTDLATALAEADGLVNTTPVGMAKLPGTPLPVALLHARLWVAEIIYFPLETELLRAARALGCRTLDGSNMAVFQAVKAFELFSGQQADAARMQAHFASFT

SEQ ID NO: 64883 - protein, 497 aa, Arabidopsis thaliana; identical to SEQ ID NO: 1035

SEQ ID NO: 64884 - protein, 308 aa, Salmonella sp.
INGFGRIGRIVFRAAQKRSDIEIVAINDLLDAEYMAYMLKYDSTHGRFDGTVEVKDGHLIVNGKKIRVTAERDPANLKWNEVGVDVVAEATGIFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDN

SEQ ID NO: 64885 - protein, 557 aa, Streptococcus pyogenes M49 591
MVLSDIEIANSVSMEPISKVADQLGIDKEALCLYGKYKAKINARQLVALKDKPDGKLILVTAISPTPAGEGKTTTSVGLVDALSAIGKKAVIALREPSLGPVFGVKGGAAGGGHAQVVPMEDINLHFTGDFHAIGVANNLLAALIDNHIHHGNSLGIDSRRITWKRVVDMNDRQLRHIVDGLQGKVNGAPREDGYDITVASEIMAILCLSENISDLKARLEKIIIGYNYRGEPVTAKDLKAGGALAALLKDAIHPNLVQTLEHTPALIHGGPFANIAHGCNSALATKLALKYGDYAVTEAGFGADLGAEKFIDIKCRMSGLRPAAVVLVATIRALKMHGGVPKADLATENVQAVVDGLPNLDKHLANIQDVYGLPVVVAINKFPLDTDAELQAVYDACDKRGVDVVISDVWANGGAGARELAEKVVTLAEQDNQFRFVYEEDDSIETKLTKIVTKVYGGKGITLSPAAKRELADLERLGFGNYPICMAKTQYSFSDDAKKLGAPTDFTVTISNLKVSAGAGFIVALTGAIMTMPGLPKVPASETIDIDEEGNITGLF

SEQ ID NO: 64886 - protein, 402 aa, Helicobacter pylori J99
MLAKMSFMQNVKNIQEVDVNHKRVLIRVDFNVPLDENLNITDDTRIRESLPTIQFCIDNKAKDIILVSHLGRPKGVEEKLSLKPFLKRLERLLNHEVVFSQNIAQLKQALNENAPTRIFLLENIRFLKGEEENDENLAKDLASLCDVFVNDAFGTSHRKHASTYGTAKFAPIKVSGFLLKKEIDSFYQAFNHPLRPLLLIVGGAKVSSKLTLLKNILDLIDKLIIAGAMSNTFLKALGYDVQDSSVEDALINDALELLQSAKEKKVKVYLPIDAVTTDDILNPKHIKISPVQDIEPKHKIADIGPASLKLFSEVIESAPTILWNGPLGVHEKQEFARGTTFLAHKIANTYAFSLIGGGDTIDAINRAGEKDNMSFISTGGGASLELLEGKILPCFEVLDKRH

SEQ ID NO: 64887 - protein, 532 aa, Oryza sativa (japonica cultivar-group)
MGSADLVLKAACEGCGSPSDLYGTSCKHTTLCSSCGKSMALSGARCLVCSAPITNLIREYNVRANATTDKSFSIGRFVTGLPPFSKKKSAENKWSLHKEGLQGRQIPENMREKYNRKPWILEDETGQYQYQGQMEGSQSSTATYYLLMMHGKEFHAYPAGSWYNFSKIAQYKQLTLEEAEEKMNKRKTSATGYERWMMKAATNGPAAFGSDVKKLEPTNGTEKENARPKKGKNNEEGNNSDKGEEDEEEEAARKNRLALNKKSMDDDEEGGKDLDFDLDDEIEKGDDWEHEETFTDDDEAVDIDPEERADLAPEIPAPPEIKQDDEENEEEGGLSKSGKELKKLLGKAAGLNESDADEDDEDDDQEDESSPVLAPKQKDQPKDEPVDNSPAKPTPSGHARGTPPASKSKQKRKSGGGDDSKASGGAASKKAKVESDTKPSVAKDETPSSSKPASKATAASKTSANVSPVTEDEIRTVLLAVAPVTTQDLVSRFKSRLRGPEDKNAFAEILKKISKIQKTNGHNYVVLRDDKK

SEQ ID NO: 64888 - protein, 308 aa, Salmonella typhimurium
INGFGRIGRIVFRAAQKRSDIEIVAINDLLDAEYMAYMLKYDSTHGRFDGTVEVKDGHLIVNGKKIRVTAERDPANLKWDEVGVDVVAEATGIFLTDETARKHITTGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDN

SEQ ID NO: 64889 - protein, 308 aa, Salmonella typhimurium
INGFGRIGRIVFRAAQKRSDIEIVAINDLLDAEYMAYMLKYDSTHGRFDGTVEVKDGHLIVNGKKIRVTAERDPANLKWDEVGVDVVAEATGIFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDN

SEQ ID NO: 64890 - protein, 886 aa, Vibrio cholerae O1 biovar eltor str. N16961
MSDMKHDVDALETQEWLAALESVVREEGVERAQYLLEQVLEKARLDGVDMPTGVTTNYINTIPAAQEPAYPGDTTIERRIRSIIRWNAIMIVLRASKKDLELGGHMASFQSSAAFYETCFNHFFRAPNEKDGGDLVYYQGHISPGIYARAFVEGRLTEEQLDNFRQEVDGKGLPSYPHPKLMPEFWQFPTVSMGLGPISAIYQARFLKYLNGRGLKDTTAQRVYAFLGDGEMDEPESRGAISFAAREKLDNLCFLINCNLQRLDGPVMGNGKIIQELEGLFRGAGWNVVKVIWGNGWDKLLAKDTTGKLLQLMNETIDGDYQTFKAKDGAYVREHFFGKYPETAALVADMTDDEIFALKRGGHESSKLYAAFKNAQDTKGRPTVILAKTVKGYGMGDAAEGKNIAHQVKKMDMTHVLAMRNRLGLQDLISDEEVKNLPYLKLEEGSKEFEYLHARRKALHGYTPQRLPNFTGEFIVPALEDFKPLLEEQSREISSTMAYVRSLNILLKDKNIGQNIVPIIADEARTFGMEGLFRQIGIYNPHGQNYTPQDRDIVSYYKEATSGQVLQEGINELGAMSSWVAAATSYSTNNLPMIPFYIYYSMFGFQRVGDMAWMAGDQQARGFLLGATAGRTTLNGEGLQHEDGHSHILAGTVPNCISYDPTFAYEVAVILQDGIRRMYGEQENVFYYLTLMNESYAHPAMPAGAEEGIRKGIYKLETHAGNKAKVQLMSSGTIMNEVRKAAQILSEEYGVASDVYSVTSFNELARDGQACDRFNMLHPEAEVKVPYIAQVMGTEPAIAATDYMKNYADQVRAFIPAQSYKVLGTDGFGRSDSRENLRRHFEVNAGYVVVAALNELAKRGEVEKSVVAAAIKKFDIDTEKTNPLYA

SEQ ID NO: 64891 - protein, 593 aa, Aspergillus oryzae
MASTSSTAQSLLKKHPLQRIHSPSRGFSALVHHFTSSMQYLPTKDYDIPNIDLLSLIFDSPLSLTTEKTVLHAEAANPTNNITKAQARTITKRLAHVFRADFGIGNNGAGKDAVLCISSNQVLLPAVFFAIIAAGGVYTAASTAFTQSELSRQIQQSKSQLIIASPDSKTKALKAALACGIPVERVLVLESSNHKHLLRDTVDPERNYLFQNTEELDWERVTDRNELETRLICLLFSSGTTGPPKGVMLSHMNLVSEAIIPQLVLRESRKGKPHLEVPYRTIGHLPTAHIAGCQGYFITPAVAGGTVYWMPKFNIDQFMDYCKKYQVTFLATAPPVYLAVAESSRVTDQFNSLIRAESGAAPLPTEVQRRAEEKLGCSISQRWGMTESTGSVTTMPWGEADSTGSISPLLPNTRLRIVDEQDRDVEQGMEGEILVKGPMVTKGYFENQEATAAAFAPNGWFRTGDIGVWKDGKIYMVDRKKELIKYKGLQVSPVEVEACLLSHDGVADAAVIGVPDPSAPGNELPRAYIVLENDRIISEEELKTHVKSNMARHKQLRGGVVFTKEIPKSSSGKILRRLLRDQARKSAEPRAKI

SEQ ID NO: 64892 - protein, 567 aa, Zea mays
VVSTAGLCCSCQEMSLGTCPAAAGDATAEELLQRARGLVPPALAAARAATGFGGRWKAIAARLEKVPPCLSDLSSHPCFSKNSLCRELLQSVAATLAEAAELGARCHEPPKAGKLQMQSDLDALAGKLDLNLRDCSLLVKTGVLSDATVPAAPAACAQADVRELLARLQIGHAEAKHRAVDGLLDALREDEKSVLSALGRGNVAALVQLLTATAPKVREKAATVLCLLAESGSCEGLLMSEGALPPLVRLAESGSLVGREKAVITLQRLSMSADIARAIVGHSGVRALIDMCQTGDSITQSAAAGALKNISAVPEVRQALAEEGVVRVMVSLLDSGVVLGSKEYAAECLQNLTSSNDSLRRAVVSEGGLRSLLAYLDGPLPQESPVAAVRNLVSAVSADSLVSLCVLPRLVHVLRDGSVGAQQAAAATICKMSSSMDMKRLVGEHGCIPLLVRLLEAKSNGAREAAAQAVASLMGCPPNARDMKKDEKSVANLVQLLDPSPQNTAKKYAISCLLALSTSKRCKKLMISHGAIGYLKKLSESEKDVAGAKKLLEKLDRGRLRSLFGRK

SEQ ID NO: 64893 - protein, 326 aa, Listeria monocytogenes str. 4b F2365
MQLHAMWDEYPALSKDLQEVLQTIEKNIQIRDKHVEQNVKDLIHAGGKLLRPAFALLSAQAGPDYDKERAVSIAAALEVLHMATLIHDDVVDDSPLRRGIPTIHSKYGRNYAVYTGDYLFCICFKILSAHASSVENIEFNSKNIEKILMGELDQMRTSYKMNVTVREYLTRISGKTAQLFALSCYSGATGSKATRMTVAKCYNIGHYLGMAFQIIDDVLDYTSTDEGLGKPVLNDMKQGIYSLPLIYAMKGHLAEFEPLLSQKLDMTDEASEQVLALISKYKGVEQAFKLANKYTNKALREIKKLPAGAYRDDMYHLTKNILDRDI

SEQ ID NO: 64894 - protein, 459 aa, Rickettsia sibirica 246
MQEFDLVVIGSGPAGYTGSIRAAQLGMKVACIEKSDTLGGTCLNIGCIPSKVLLNSSEKYEAALKHFENIGIIADVKLDLQKMLANKDKVVLDLTQGIESLFAKNKVTRIKGEAKISSSNIVEVNKEQIKAKNILITTGSSVIEIPNIKIDEEFIVSSTGALKLSKVPENLIVVGGGYIGLELGSVWRRLGAKVTVIEYAPSIVPMLDKEIATQFMKLQQKQGIEFKLNTKVLSAEVKSGKVNLTIEEDGKSSVVTSNVVLMAVGRKAYTQNLGLESVGIITDKQGSIEINDRFQTAISNIYAVGDVVKGAMLAHKAEEEAVAAVEIMAGQAGHVNYNLIPSVIYTYPEVASVGETEEQLKEKGINYKVGKFPFLANSRARAIGSTEGMVKILADSKTDRVLGAHIIGADAGTLIAALTAYMEFGAASEDIARTCHAHPTLSEAIKEAALSVDKRTINM

SEQ ID NO: 64895 - protein, 702 aa, Rhodococcus sp. RHA1
MSITDDIHVLTQPVHPADWTELDTKAVDTIRVLAADAVQKVGNGHPGTAMSLAPLAYTLFQRVMRHDPTDADWIGRDRFVLSCGHSSLTLYIQLYLAGYGLELDDLEALRTWGSKTPGHPEHGHTRGVEITTGPLGQGLASAVGMAMAARRERGLFDPEPALGDSPFDHHIYVIASDGDIEEGVTSEASSIAGVQQLGNLTLIYDDNKISIEDDTAIALSEDTAARYEAYGWHVQIVEGGENVVAIEEALNKAREVTDKPSLILLRTIIGFPAPTKMNTGAAHGAALGADEVAAVKKALGFDPDKTFEVADEVIAHTRKVVERGAQAHKQWQAQYDEWTQRAPEGKKLLDRLIGRDLPAGWADVLPTWEPDPKGVATRKASAAVLNAVGPVLPELWGGSADLAESNNTTIKGADSFGPEAISTRMWTAQPYGRTLHFGVREHAMGSILNGIALHGPTRPYGGTFLVFSDYMRPAVRLAAIMKTPVTYVWTHDSIGLGEDGPTHQPIEHLAALRAIPGLYVVRPGDANETAHAWRAVLEKGADEATRAPAGLALTRQDLPVLEGTSYEGVSRGGYVLADASTGAPEVVLIGTGSELQLAVAARETLEADGIPTRVVSMPCVEWFDAQDQAYRDGVLPPTVKARVSVEAGISMPWYRFVGDAGEIVSIEHFGASADYKTLFREFGFTAEAVTAAAQRSLARVKG

SEQ ID NO: 64896 - protein, 347 aa, Thermoanaerobacter tengcongensis
MDGLMTAVVKQYHKEGADIVKKEIPKIGPDEVLIKVKATSICGTDVHIYVWNEWAKSRIKPPKTMGHEFVGEVVEIGENVTSVKVGDLVSAETHIVCGKCRACRTGNAHICENTLILGVDTDGAFAEYIKVPESNVWINDKNIPLEILSIQEPLGNAVHTVFSGDVVGKSVAVIGCGPIGMMAIPLLKRTGAAAIFAIEPADYRRELAHKLGATRVINPLREDVVSIIKSETEGYGADVVLDFSGNPTAIRQGLEYIAKGGRMSILGLPDNEVPIDITNNVVFKGITIQGITGRRMYDTWYTVKGLLKSGLAEDLKPIITHTFPLTEYQKGMELMIKGQCGKVVLYP

SEQ ID NO: 64897 - protein, 413 aa, Geobacter metallireducens GS-15
MKRVVIIGMGFGGIRAARVLAGKGLDVVLVDRNNYHLFQPLLYQVGTAGLEQESIAYPVRAMAREWRGTRFHLAEVAGVDFPAREVVTGNGRIPYDYLIIGAGSVTNYFGLESVERHAFDLKELVDGERLRNHILTAFERAVVEPDPAKRRALMTFVIVGGGPTGVEFAGALMELVRYVLAKDYPELSVQAARVVLVEAFDRLLAAMPQELQVYTLEKLRAMGVEVLFNARVVDAEPERVILHDGAIIPAHTLFWSAGVKAAPLAATLGVTPKPGGRIPVEPDLTLAGHPEVYVIGDMAHLEQDGAALPMVAPVAMQMGTYAGEAIVAREKGETPKPFRYRDRGSMATIGRSAAVACAFGMKFRGFSAWLVWLLLHLYYLIGFRNRIVVMLNWIWYYWFHERQVRLITERVEE

SEQ ID NO: 64898 - protein, 175 aa, Triticum aestivum
MAPTVMASSATSVAPFQGLKSTAGLPVSRRSSSAGLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 64899 - protein, 865 aa, Medicago truncatula
MFSGITGIINRGEKLKGTVVLMQKNVLDVNELTSIKSNPVGGIIGGAIGGAFGAVGTVLDTATAFLGRNVALKLISATSADGSGKGKVGKQTFLEGVITSIPTLGDKQNAYSVHFEWGSDMGIPGAFYIENFLQHEFFLVSLTLEDVPNHGTINFVCNSWVYNDKKYKSDRIFFANKTYLPSETPAPLVYYRQEELKTLRGDGKGERKEWERIYDYDVYNDLGEPDSKPTLGRPVLGGSSTLPYPRRGRTGRKPAKKDPKSESRSGTVYLPRDEAFGHTKSSDFLAFILKSASQNIIPSLKSVVSKEFNNFEDVRSLYDGGIKLPTNFLSNVSPIPLFTELFRSDGASTLKFSPPKVVQVDHSAWMTDEEFAREMIAGVNPHIIKKLTEFPHKSKLDSQKYGDNTSTITKEQLEPNLGGITVEQAIQNNKLYILDHYDIVYPYLRKINATETKAYAARTILFLQNDGTLKPLAIELSKPHPDDDSYGPVSEVYFPASEGVEASIWLLAKAYVVVNDSCHHQLVSHWLNTHAVVEPFIIATNRHLSTVHPVHKLLLPHYRDTMNINSLARNVLVNAEGIIESTFLWGGYALEMSAVAYRDWVFTEQGLPNDLLKRGVAVEDPASPHGIRLLIEDYPYASDGLEIWAAIKTWVGEYVSFYYKSDAAIAQDAELQAFWKELVEVGHGDLKSATWWFKMQTRAELIEASTILIWIASALHAAVNFGQYPYGGYILNRPTKSRRFMPEKGSAEYAELSKDYQKAYLKTITPKSDTLTDLTIIEVLSRHASDEQYLGERIEGDLWTSDAQPKEAYKKFARKLAEIEEKLVKRNADESLRNRYGPVKMPYTLLYPSSEEGLTFRGIPNSVSI

SEQ ID NO: 64900 - protein, 391 aa, Arabidopsis thaliana
MNRGETLDSIPTDLILDILSRLPTKSIARFHCVSKLWSSMLASQDFTRLFVNRSSSNPRLLLGIVRGGEWSFYSSPQPKNPYEKSSLEVAADFHMKLSEIKQHQHHGTSYAFGLIYLRTVWMSKEGFDPIGKQFKVLVLNILDNHYILTLGTENDKWRSIQSSLRYRPCGQSPICINGVLYYIAYDTQDSSNDVIGCFDVRFEKFKFFHDLEKEEWSKYAYTLKPDNNVVKVNYNLSFVGVTTRGEIVLAKMYACKPFYVFYYNPENNTLLSVEIQGVGEDSEWFSNYQRVYVFVEHVKDLHQFDNTKTSINLPEQKRKPTSISISSKYDDHVRTTLISSRKNQQVTTVSRPQQDRRTTNKFSALCLLVMKNSQVSKPDCFSWSSATMLYL

SEQ ID NO: 64901 - protein, 286 aa, Oryza sativa (japonica cultivar-group)
MAYYARRGGDRVSGGGRVQGGGGGGGGGGRGGYVLRGRSGMPPRGPLGLGVNSRPSARTIAKSFSRTKDMTWRPDLFSDSMAASGIETGTKLYISNLDYGVSNEDIKELFSEVGHLKRFAVHFDGYGRPNGTAEVVFTRRSDAIAALKRYNNVLLDGKAMKIEVIGSDLGLPMTPRINVVGASNGRPTRTVVMTPEIGQRGSGSSSRPTGPTVNRYNRGAFQAGRGRGRGRGRAPFQSQFQGRGTGSVRGRGQFQGRGRGRRQAGKTADELDKDLETYHAEAMKTD

SEQ ID NO: 64902 - protein, 864 aa, Medicago truncatula
MFGIFDKGQKIKGTVVLMPKNVLDFNAITSIGKGGVLDAAGNLIGGVTSIVGGVVDTATAFLGRNVSMQLISATKTDASGKGLVGKETFLSKHLPQLPTLGARQDAFSIFFEYDANFGIPGAFYIRNYTQAEFFLVRVTLEDIPNRGSVQFDCNSWVYNFKSYKNNRIFFTNDAYLPSQTPAPLNHFREEELQNLRGDGTGERKEWDRIYDYDVYNDLGNPDGGDALVRPILGGSSTHPYPRRVRTGRKPTRKDLKSEKPGAIYVPRDENFGHLKSSDFLMYGIKSLSQDVLPLLQSVIFDLNFTPNEFDSFDEVRGLFEGGIKLPTDILSQISPLPALKEILRTDGEQALKFPPPQVIRVSKSAWNTDEEFGREMLAGVNPNVIRLLQEFPPKSTLDATVYGDQNSTITKEHLETNLGDITVEEALDGKRLFLLDYHDAFMPYLERINLNAKAYATRTILFLQDDGTLKPLAIELSLPHSNGVQYGAESKVFLPAHEGVESTIWMLAKAHVIVNDSCYHQLMSHWLNTHAVMEPFIIATNRHLSVLHPINKLLFPHYRDTININGLARQALINAGGIIEQTFCPGPNSIEISSAVYKNWVFTDQALPADLIKRGLAVEDPSSPHGLRLVIEDYPYAVDGLEIWDAIKAWVQDYVSLYYPTDEAVQKDTEIQKWWKEAVEKGHGDLKDKPWWPKMQTVQDLVQSCSIIIWTASALHAAVNFGQYPYGGYILNRPTISRRFIPEPGTPEYDEMVKSPQKAYLRTITPKYQTLVDLSVIEILSRHASDEVYLGENNNKFWTSDTRAVQAFQKFGSKLTEIEGKITKRNNESSLRNRTGPVQLPYTLLLRSSEEGLTFRGIPNSISI

SEQ ID NO: 64903 - protein, 149 aa, Glycine max
HDQDTTDLNKCISFITRNPPGPDNSNLFILVLGALGGRFDHEMGNINVLHRFSNTRIILLSDDSLIFLLPKTHSHEIHIERSVEGPHCGLIPMGAPSSSSSTTGLRWNLDNTSMNFGGLLSTSNIVEEEIVTVTSDSDLIWTISLRKHT

SEQ ID NO: 64904 - protein, 865 aa, Medicago truncatula
MFGILNNKGQKIKGTVVLMPKNVLDFNAITSVGKGGVINTAGNIIGGVTGIVGGVVDTATAFLGRNVSMQLISATKTDANGKGLVGKETFLSKHLPQLPTLGARQDAFSVFFEYDANFGIPGAFYIRNYTQAEFFLVSVTLEDIPNRESVQFICNSWVYNFKSYKKDRIFFTNDTYLPSQTPAPLNHYREEELQTLRGDGTGERKEADRVYDYDIYNDLGNPDGGDALVRPVLGGSSTYPYPRRVRSGRKPTRKDPKSEKPGVIYVPRDENFGHLKSSDFLMYGIKSLSQNVIPLFKSVIFDLNFTPNEFDSFDEVRGLFEGGIKLPTDILSQISPLPALKEIFRTDGEQVLKFPPPHVIKVSKSAWMTDEEFGREMVAGVNPNVIRLLQEFPPKSTLDTTVYGDQNSTITKEHLATNLGDITVEEALNGKKLFLLDYHDAFMPYLERININAKAYATRTILFLKDDGTLKPIAIELSLPHSNGVQYGSESKVFLPADEGVESTIWLLAKAHVIVNDSCYHQLISHWLNTHAVVEPFIIATNRHLSVLHPINKLLFPHFRDTININGLARQSLINAGGIIEQTFLPGPNSVEISSIVYRDWVFTDQALPADLIKRGLAVEDPSSPHGLRLALEDYPYAVDGLEIWDAIKAWVQDYVSLYYPTDEVVQKDTELQTWWKEAVEKGHGDLKDKPWWPKMQTVGDLVQSCSIIIWTASALHAAVNFGQYPYGGYILNRPTLSRRFIPEQGTPEYDEMVKSPQKAYLRTITPKFQTLIDLSVIEILSRHASDEVYLGERNDKFWTSDTRAVQAFQKFGSKLSEIEGKIHGRNKDSSLKNRTGPVELPYTLLLRSSEEGLTFRGIPNSISI

SEQ ID NO: 64905 - protein, 790 aa, Marinobacter sp. ELB17
MHDYIIWFEHLGMSDVDRVGGKNASLGEMISNLANAGVTVPGGFATTSHAYREFLATNGLKDKIDETLDALDVNDVNELARVGAKIRQWVIDTPFPAVLDNALAEAYAQLQNGNPKMAVAVRSSATAEDLPDASFAGQQETFLNVVGLDKIRTSVKEVFASLFNDRAISYRVHHGFDHKLVALSAGIQKMVRSETASSGVMFTLDTESGFRGVVFITGSYGLGETVVQGAVNPDEFYVHKSTLTAGRPAVLRRNLGSKAIKMIYHTNPTEGEFVETVKVDAAERGRFCITDAEVEELAKQAMIIENHYQRPMDIEWAKDGDDGRIYIVQARPETVKSRASANVMERYLLKETGKVLVEGRSIGHKIGAGPVKIITSINEMDKVQDGDVLVTDMTDPDWEPVMKRASAIVTDRGGRTCHAAIIARELGIPAVVGCGDATDLLSNGQKVTVSCAEGDTGFIYEGALDFELRENTIESMPNIPFKIMMNVGNPDRAFDFQALPNEGVGLARLEFIINRMIGVHPKALLNYDTLPRDIQLTVDKRISGYASPVDFYVDKLVEGISTLAGAFAPKKVIVRMSDFKSNEYANLIGGALYEPDEENPMLGFRGASRYISETFRDCFELECRAMKRVRNEMGFTNVEVMIPFVRTVGEAAQVMDLLAENGLKRGENGLRVIMMCELPSNALLADQFLEHFDGFSIGSNDLTQLTLGLDRDSGIIAHLFDERNDAVKVLLSSAIQACRKAGKYIGICGQGPSDHPDLAKWLMEQGIDSVSLNPDSVLDTWFFLADQKPD

SEQ ID NO: 64906 - protein, 235 aa, Medicago truncatula
MSLIYNGNMLVFQVSGPETTVELNVTMHCEACAEQLKRKILQMRGVQTAVAEFSTRKVTVTGTMDANKLVDYVYKKTKKQAKIVPKPEPEPEKKEEENKEGEKPADEEEAKPEENEGETAAEEDVKPEENESEKPADEEEAKPEQNEGEKAAAEEETKPEEKPTEEPKKEEEGENKEEMGGEESKEETKKKESGAVVNIDEGMMYYYQYPPLYVIERTPPPQLFSDENPNACSIS

SEQ ID NO: 64907 - protein, 455 aa, Chlamydophila abortus S26/3
MNIWTKFFQPPKHIKELDDPELVKKQYKYWRIRIFYSMFIGYVFYYFTRKSFTFAMPTLMTDLGFDKAQLGIIGSTLYISYGVSKFVSGVISDQSNPRYFMALGLIVTGFTNIFFGMSSSILLFALWWGLNGWFQGWGWPPCARLLTHWYSKSERGTWWSVWSTSHNIGGALIPILTGFAIDCCGWRGAMFVPGILCILMGLVLINRLRDTPQSLGLPSIEKFRKKQESQKHEETTVDILEEEAEKELSTREILFTYVLKNKWIWLLSFASFFIYVVRMAVNDWSALFLIETKRYVAVKANFCVSLFEIGGLFGMLIAGWLSDKISKGKRGPMNVVFSLGLLFSILGMWYSRNQDMWWLDGSLLFVIGFFLFGPQMMIGLAAAELSHKKAAGTASGFAGWFAYFGAAFAGYPLGKIAQDWGWRGFFIALLGCALIALVLFLPTWNASERSLQTRK

SEQ ID NO: 64908 - protein, 427 aa, Helicobacter hepaticus ATCC 51449
MASITLTNNETKESFEFELIECTRGPKAVDFSKLFERTNIFSYDPGYGSTAGCKSTISYINGKNGELLYKGLPIEKIVEKYQFTDVCKLLITGEVPKNETETKEFEIELVHRSFLNEGLINIFNAFPDSAHPMANLSASLSALSTFHFRHLDMGNEEERQVMARRAIAKIPTLAAFSYRHSLGIPYIYPDVARGYVENFLYMLRAYPGGKMKHTIKGEVEITPLEIEALDKIFTLHADHGQNASTTTVRNVASTGAHPYAALSAGVNALWGAAHGGANEKVLDMLNEIGDAKNVDKFINKAKDKNDPFRLMGFGHRVYKNYDPRAKILKKLKDDLDAKGIKMNTRLSDLAHKVEEVALSDSYFVERNLYPNVDFYSGIILSALKIPVSLFTPIFVIGRMPGWCAQLLEHVKDPTTRITRPRQVYIGE

SEQ ID NO: 64909 - protein, 515 aa, Bacillus cereus ATCC 14579
MVVAYKHEPFTDFSVEANKLAFEEGLKKVESYLGQDYPLIIGGEKITTEDKIVSVNPANKEELVGRVSKASRELAEKAMQVADETFQTWRKSKPEMRADILFRAAAIVRRRKHEFSAILVKEAGKPWNEADADTAEAIDFMEYYGRQMLKLKDGIPVESRPIEYNRFSYIPLGVGVIISPWNFPFAIMAGMTTAALVSGNTVLLKPASTTPVVAAKFMEVLEEAGLPAGVVNFVPGNGSEVGDYLVDHPRTRFVSFTGSRDVGIRIYERAAKVNPGQIWLKRVIAEMGGKDTIVVDKEADLELAAKSIVASAFGFSGQKCSACSRAVIHEDVYDHVLNRAVELTKELTVANPAVLGTNMGPVNDQAAFDKVMSYVAIGKEEGRILAGGEGDDSKGWFIQPTIVADVAEDARLMKEEIFGPVVAFCKAKDFDHALAIANNTEYGLTGAVITNNRDHIEKAREDFHVGNLYFNRGCTGAIVGYQPFGGFNMSGTDSKAGGPDYLALHMQAKTTSETL

SEQ ID NO: 64910 - protein, 142 aa, Brassica napus
  misc_feature (80)..(80): Xaa can be any naturally occurring amino acid
  misc_feature (96)..(96): Xaa can be any naturally occurring amino acid
MAYSMLSSAAVVTSPAQATMVAPFTGLKSSSAFPVTRKANNDITSIVSNGGRVNCMQVWPPIGKKKFETLSYLPDPYRKXMGVREVDYLLRNKWIXLCVEIRVGATGFCVPWSMEAHLDTTMAVIGQCGSFLCSDALTLLKC

SEQ ID NO: 64911 - protein, 914 aa, Zea mays
  misc_feature (281)..(281): Xaa can be any naturally occurring amino acid
  misc_feature (385)..(385): Xaa can be any naturally occurring amino acid
MAAAFSAAILFHLLLLLFSPSAAQPGFISLDCGGARDHTDAIGIQWTSDASFVSGGQAAQLLVQNGLQQTQQQLTTVRYFPADNRKHCYTMNVRNRTRYLVRATFLYGNFDNSNVYPKFDISLGASPWSTIVVDDATTPVVEEAIILAAAPTLSVCLSNASTGQPFISTLELRQFNGSLYYTTDETRFFLGLSARINFGAGSNDSVRYPDDPFDRIWESDSVRRANYLVDVAPGTERISTTKPIFVGTNEEPPEKVMQTAVVGQDGSLNYRMKTSWLEAYXESEEDSAKGIEYLHTGCSPTIIHRDLKSSNILLDKNMRAKVADFGLSKPAVDGSHVSSIVRGTVGYLDPEYYISQQLTEKSDIYSFGVILLELISGHEPISNDXWAQLPEAQEGGDPCLPASWSWVQCSSETSPRIFSITLSGKNITGSIPVELTKLSGLVELRLDGNSFSGQIPDFRECGNLQYIHLENNQLTGELPSSLGDLPNLKELYVQNNKLSGQVPKALFKRSIILNFSGNSGLHIVSNGISHTIIVICLVIGAVVLLGVAIGCYFITCRRKKKSHEDTVVIAAAPAKKLGSYFSEVATESAHRFSLSEIENATGKFERRIGSGGFGIVYYGKLADGREIAVKLLTNDSYQGIREFLNEVTLLSRIHHRHLVTFLGYSQQDGKNILVYEFMHNGTLKEHLRGADNEKITSWLKRLEIAEDSAKGIEYLHTGCSPTIIHRDLKSSNILLDKNMRAKVADFGLSKPAVDGSHVSSIVRGTVGYLDPEYYISQQLTEKSDIYSFGVILLELISGHEPISNDNFGLNCRNIVAWARSHIESGNIHAIIDESLDRGCYDLQSVWKIAEVAIMCVKPKGAQRPPISEVLKEIQDAIAMERVLVSNCSNRMGSGSVEQNGGASFDELLMQPGLR

SEQ ID NO: 64912 - protein, 386 aa, Zea mays
MSDTAGKTITCKAAVAWEAGKDLVVEDIEVLPPRAHEVRIQVYYTGVCHTDAYMLSGKDPEGAFPVIAGHEGAGIVESVGEGVTNVKVGDTVVALYTPECKECKFCKSGKTNLCGKIRATQGKGVMPDGTSRFKCKGKDLLHFMGCSTFSQYTVLADISVVAVTPDAPMDRTCLLGCGITTGYGAAVITAGRGGVEKGSNVAIFGAGCVGLSVIQGAVKQGASKIIVVDVNDAKKEWAKKFGATDFVNPAKDLKEGENIQSRLIDMTDGGCDYTFDCTGNVHVMRSALEACHKGWGESIIIGVAAAGQEISTRPFQLVTGRVWKGCAFGGVKGRSQMGQLVQDYMDNKLKVDEFITHRQPLGGINEAFHDMHAGDCIRCVVDMRKV

SEQ ID NO: 64913 - protein, 196 aa, Oryza sativa (indica cultivar-group)
MRPPRGGGGGRFGGGGGGRFGGGGGRGGRFGGGGRGGRGGGGGFRDEGPPAEVVEVSTFMHACEGDAVTKLTNEKVPYFNAPIYLQNKTQIGKVDEIFGPINESLFSIKMLEGIIATSYSEGDKFYIDPMKLLPLSRFLPQPKGQSQGGGRGGGRGGGGRGGGRGRGGGGFRGRGAPRGRGGPRGGGRGFRGRGRF

SEQ ID NO: 64914 - protein, 475 aa, Ureaplasma parvum serovar 3 str. ATCC 700970
MNYKTLINGAFVDAKEKLPVYNPSNNQIIAYVPNIHNENEINTIFENAHIAYLKFKDTPIKYRCDLLLKLADKLDEHKQELAQIISTEIAKGLKDSLIEVERSADYLRETVFEYQKLMQKPIIFDETVHHVKNKVATYYRIPVGVVLAICPFNYPINLLISKLAPALVSGNSLVYKPSTQGSLIGIRISELVHEVGFPKGVVNCLTTEARITGDLLVTNKYVKAISFTGGPKVGNHIAEITSKISLVLELGGKDPALVLDDADFELAANEIVKGAYGFSGQRCTAIKRVFVSHKNHDLLVNLINKKVDALTVGLPQQNPIITPLINSNSLKYNLSLVEDAIKKGAIVHQKIVYNEKNNLLHPLVIDNVTKEMRVAWEEPFGPILPIITYNSIQEAIDLINQSQYGLQACIFTTNYASIEQLALQIESGTININKSSSRGPDILPFFGVKDSGFGVQGIVDAILSMTTIKGIIINK

SEQ ID NO: 64915 - protein, 361 aa, Arabidopsis thaliana
MATDFKSLPVIASLKFDHDDVADISRLLLKCDDPDMAEDVGVAEVVQQLDKACRDAGFFYVIGHGISEDVINKVREITREFFKLPYEEKLKIKMTPAAGYRGYQRIGENVTKGIPDIHEAIDCYREIKQGKYGDIGKVMEGPNQWPENPQEFKELMEEYIKLCTGDLSRKILRGISLALAGSPYEFEGKMAGDPFWVMRLIGYPGLLTLVNQDDDKTALQVRNLGGEWISAIPIPGSFVCNIGDMLKILSNGVYESTLHRVINNSPQYRVCVAFFYETNFDAVVEPLDICKQKYPGGRGGCQVFKRAVYGEHLKGYTKLIQSDKDSYLKPKKGKLSPRKEKLINTNKKNQREGTGILNLNH

SEQ ID NO: 64916 - protein, 348 aa, Staphylococcus aureus subsp. aureus MRSA252
MTYNIVALPGDGIGPEILNGSLSLLEIISNKYNFNYQIEHHEFGGASIDTFGEPLTEKTLNACKRADAILLGAIGGPKWTDPNNRPEQGLLKLRKSLNLFANIRPTTVVKGASSLSPLKAERVEGTDLVIVRELTSGIYFGEPRYFNNHEALDSLTYTREEIERIVHVAFKLAASRRGKLTSVDKENVLASSKLWRKVVNEVSQLYPEVTVNHLLVDACSMHLITNPKQFDVIVYENLFGDILSDEASVIPGSLGLSPSASFSNDGPRLYEPIHGSAPDIAGKNVANPFGMILSLAMCLRESLNQPDAADELEQHIYNMIEHGQTTADLGGKLNTTDIFEILSQKLNH

SEQ ID NO: 64917 - protein, 543 aa, Medicago truncatula
MASHLLNHSKKLRNASSLLHHDRALLLRMFCSDVQPRNPDVWKTQLQERESSARNHVSESSPNFTKLSFGVQKRNMSTMKRGYMRESLLNREISQNSQVLSRRSYSSASDLPPHQEIGMPSLSPTMTEGNIARWLKKEGDKVSPGEVLCEVETDKATVEMECMEEGFLAKIVRKEGEKEIQVGEVIAITVEEEADIAKFKDYQPSASESSAPPAKETPAPPPPKKEVAEEPAREPEPKVSKPSAPPSSGDRIFASPLARKLAEEKNVNLSSIKGTGPDGLIVKGDIDDYLASGAKEVSAPSKAKPAADAALDYTDIPVSQIRKITASRLLLSKQTIPHYYLTVDTCVDKLMSLRTQLNSLQEASGGARISVNDLVIKAAALALRKVPQCNSSWTNDYIRQYHNVNINVAVQTDHGLFVPVVRDADKKGLSTIGEEVKQLAKKAKENSLKPQDYEGGTFTVSNLGGPFGVKQFCAIVNPPQSGILAVGSAERRVVPGSGAEEFKFASFIAVTLSCDHRVIDGAIGAEWLKAFKGYIENPETMLL

SEQ ID NO: 64918 - protein, 246 aa, Thermoplasma volcanium GSS1
MIDGLLITELNKLTPGSSYIFLDYDGTLVPIIMNPEQSLADPELIEMLTELRSKYKLFIVSGRSPEEIKRFIPLDLNLICYHGACSIVNGKTYYYNNAQSFLGIFNEIYQSSLNLVNEFPGLRIYKKNLAVLYHFGLMKPQDVPALERVIVEISQKEHVDVYKGKMIFELRVPGVNKGIAIKNVRDEETALIAGDDATDECSFKYNEDAITIKVGPGKTSAHFRVNDYSEMREVLKLLLNNAEKRS

SEQ ID NO: 64919 - protein, 464 aa, Helicobacter pylori J99
MLSVYEKGNALDKRVLEEWLLSEDILMENAAMALERAVLQNASLGAKVIILCGSGDNGGDGYTLARRLVGRFKTLVFEMKLAKSPMCQLQKERAKKVGVVIKAWEEKNEDLECDVLVDCVVGSAFKGGLEPFLDFESLSQKARFKIACDIPSGIDSKGRVDKRAFKADTTISMGAIKSCLLSDKAKDYIGELKVGHLGVFNQIYEIPTDTFLLEKSDLKLPLRDRKNAHKGDYGHAHVLLGKHSGAGLLSALSALSFGSGVVSIQALECEITSNNKPLELVFCENFPKKLSAFALGMGLENIPKDFKKWLELAPCVLDAGVFYHKEVLQALEKEVILTPHPKEFLSLLKSVGINISMLELLDNKLEIARDFSQKYPKVVLLLKGANTLIAHQGRVFINNLGSVALAKAGSGDVLAGLIVSLLSQNYTPLDAAINASLAHALAGLEFKNHYALTPLDLIEKIKRL

SEQ ID NO: 64920 - protein, 210 aa, Oryza sativa (japonica cultivar-group)
MRVPAAVTGGCGCGVDGGGGCCRGGGKLADWEEGKDDEMKSVVVKGWTRMAQVVPLHDNASAEDDDDDEEDDDEDDDDDDDEDDEEEAAPPYVMAVDDSSVDRAVITALLRRSKYRVTAVDSGKRALEILGSEPNVSMIITDYWMPEMTGYDLLKKIKESSELKQIPVVIMSSENVPTRISRCLEEGAEDFLLKPVRPADISRITSRMLQ

SEQ ID NO: 64921 - protein, 248 aa, Chlamydomonas incerta
MAEANSRELALYSAKIAEQSERYQDMVEEMKKVAVLANEQELSVEERNLLSVSYKNLVGSRRASWRILQSIEQSEQAKGNEKRVGMIKKYRAVVEGELDKICHEILDLLDKYLVPSASTTEAAVFYLKMKADYHRYLSEYKTDEAKAAAAELTLAAYKVAQEKADELPTTNPIRLGLALNFSVFYYEVMNQPALACSLAKKAFDEAISDLDSLGEDSYKDSALIMQLLRDNLTLWTSEMQDDDKINRA

SEQ ID NO: 64922 - protein, 447 aa, Salmonella typhimurium
MDQTCSLESFLNHVQKRDPHQTEFAQAVREVMTTLWPFLEQNPRYRHMSLLERLVEPERVIQFRVVWLDDKNQVQVNRAWRVQFNSAIGPYKGGMRFHPSVNLSILKFLGFEQTFKNALTTLPMGGGKGGSDFDPKGKSEGEVMRFCQALMTELYRHLGPDTDVPAGDIGVGGREVGFMAGMMRKLSNNSSCVFTGKGLSFGGSLIRPEATGYGLVYFTEAMLKRHGLGFEGMRVAVSGSGNVAQYAIEKAMAFGARVVTASDSSGTVVDESGFTPEKLARLCEIKASRDGRVADYARDFGLTYLEGQQPWSVPVDIALPCATQNELDVDAARVLIANGVKAVAEGANMPTTIEATDLFLEAGVLFAPGKAANAGGVATSGLEMAQNAARLSWKAEKVDARLHHIMLDIHHACVEYGGDNKHTNYVQGANIAGFVKVADAMLAQGVI

SEQ ID NO: 64923 - protein, 479 aa, Bacillus cereus ATCC 14579
MLEKKVGIYFAIKRENNVKKRMGYAMNTKKFAKVNEQIPGPKAASLLERRQNIVPKGVSNGIPTFVRSANGALVTDVDGNQYIDFAGAIGTINVGHCHPTVKEALHKQVDQYIHTGFNVMMYEPYIELAEKLAALAPGSFDKQVLFLNSGAEAVENAVKIARKYTKRPGIIAFSKGFHGRTLMTMTMTSKVKPYKFGFGPFAPEVYKAPFPYEYRRPEGLTEEQYDDFIIEEFKNFFISEVAPETIAAVVMEPVQGEGGFIVPSKKFVQEVRRICSENGILFVADEIQTGFSRTGKYFAIDHYDVVPDLITVSKSLGAGVPISGVIGRKEIMNESAPGELGGTYAGSPLGCAAALAVLDVIENEKLNDRAIELGKVVMNRFEEMKNKYHCIGDVRGLGAMCAFEVVQDRKTKAPDKTLTANLCAEANKRGLLLLSAGTYGNVIRVLMPLVITDEQLEEGLTIIEESLQACYEQTNIARV

SEQ ID NO: 64924 - protein, 431 aa, Salmonella typhimurium
MVSLEKNDRVMLARQLPLKSVALILAGGRGTRLKDLANKRAKPAVHFGGKFRVIDFALSNCLNSGIRRIGVITQYQSHTLVQHIQRGWSLFSEEMNEFVDLLPAQQRMKGENWYRGTADAVTQNLDIIRRYKAEYVVILAGDHIYKQDYSRMLIDHVEKGARCTVACMPVPIKEATAFGVMAVDESDKIIDFVEKPANPAMLGDASKSLASMGIYVFDADYLYELLAADDKDDASSHDFGKDIIPKITREGMAYAHPFPLSCVQSDPQAEPYWRDVGTLEAYWKANRDLASVTPQLDMYDQNWPIRTHMESLPRAKFVQERSGSHGMTLKSLVFGGCIISGSVVVQSVLFPRVRINSFCNIDSAVLLPEVWDGRSCRLRCCVIDRACIIPEGMVIGENAEEDARRFYRSEEGIVLVTREMLRKLQGHKQER

SEQ ID NO: 64925 - protein, 334 aa, Alteromonadales bacterium TW-7
MINVAINGYGRIGRNVLRALYESAQNSEIKIVAINDLAPANVNAHLTQFDSVHGQFSKKVTLADNTMLIGDDVITLTQERDPANLPWKELNVDIVLECTGFFTKREDAAKHITAGAKKVIVSAPGKDLDATVVHGVNSDVINADSNIISNASCTTNCLAPIAKAINDTVGIEQGSMTTIHAYTNDQNLSDVYHPDLYRARSATQSMIPTKTGAAAAVGLVLPELAGKLDGMSVRVPTINVSLVDFTFITKRETTAEEINEVMKAAATGSMKEILEYNELPLVSIDFNHNPASSIFDATQTKAEGKLVKVMAWYDNEWGFSNRMLDQVKALGQYL

SEQ ID NO: 64926 - protein, 483 aa, Bacillus cereus ATCC 14579
MDKKATFVSIDKKAMYINGEWITLQEQIEVNNPATKEIFATVPKGGVTEAKQAVDAAHEAFKTWSKLTAADRATKLKKWFTLIDENKEEIAAIMTKEQGKPFAEALGEVNYANSFVEWYAEEGKRVYGEMIPAAHPNKRILVMKQPVGVMAAITPWNFPAAMITRKVAPALAAGCTAVVKPASQTPLTALKLAELAHEADIPKGVINIITGSAKAIADTWMEDGRVRKVSFTGSTEIGKELMASAAQTMKKVSLELGGHAPFIVMNDADLDKAVEAVIGSKFRNAGQTCICTNRVFVQEEVYEVFVEKFQKAVGQLKVGDGFGDGTTVGPLIDENAVSKVQEHIEDAIQKGGTVLYGGQKVAELEGHFIQPTVIGLANDTMLCMNEETFGPVAPVAKFKTVDEVIERANNTPYGLAAYIFTKDISQAFQISEALEYGIIGLNDGLPSVAQAPFGGFKESGIGREGGHFGIEEYLEIKYISLGL

SEQ ID NO: 64927 - protein, 336 aa, Mycobacterium avium subsp. paratuberculosis K-10
MADQEMTMREALNLALDQALAADERVFLLGEDIADPGASGPTAGLSTKYGRDRVLDTPISEAAIVGAAIGAAIDGLLPVAEIMIMDFIGIAADQLINNAAKLRFMTAGRTSAPLTVRTQVYAGLSTGATHSQSLEAWFMHIPGLKVIVPATPRDGKGLLSSAIFDPDPCLFIETIRLQGKKGLVPVDPGFRIPLGQADIKRPGTDVSLIGYGRPVHDALAAAAMLGDQGVSAEVVDLRTLVPLDVDTVVASVRRTRRAVIVHDAVQFAGPGAEVAAILHSRLFSELAAPVERVAARFVPNPAAAALEAQVYPSPERIAVAALKTLGRTLTGATAHG

SEQ ID NO: 64928 - protein, 330 aa, Mycobacterium avium subsp. paratuberculosis K-10
MTQSAKTSPDIHRRLYALMVLMKTADDRLSRGIGTGEFLCVYWPSRGQEAIAAAMGVTLRPDDQLVTTYRGLHDLIGKGVGLEEIYGEMMGRTIGAGRGKGGTMHIAKPEVGVMLSTGIVGAGPPVAVGLAMAARRKGLDRVTVVSFGDGATNTGSFHEAANMAALWDLPIVFVCQNNRYAEMTPTTDTMKLEHVADRAAGYGMPGVRVDGNDPLAVTAALEEALRRARAGSGPTFLECETFRFRGHYFGDRMPYIPADQLQAALAADPVPRFRRRLAETGVCGEAELARIDDDAAATVEAALRTVLGADSPAADELDRDVYAAPIPFPT

SEQ ID NO: 64929 - protein, 269 aa, Ostreococcus tauri
MDDGDANAGGDRAGENAGEERRAPPPPEGGAPPPSTDPRDLPGVSVLVRNLSWDAREDDVRDRFAGYGNILDVYMPKDRETGRPRGLAFVKYATQSEADAAVDGGVGDFLGREIRCEIATQQRKSRDEMRSGSQRRDDRPYAPRSRGMCYDWKAGKCDRGDSCRFAHSEDAGDDRRGGYDDRRGGYGDRRGGYDDRRGGYDDRRGGHDDRRGGYDDRRGGYDDRRGGHDDRRGGGGYGDRPRGVCYDWQAGRCDRGASCRFAHEGEQRA

SEQ ID NO: 64930 - protein, 580 aa, Ostreococcus tauri
MLALVASATTVASMGADQSRASPVRSSTRAADRAPPTNAVRRAACGPGYASLRDASAYRGLATNDRRGKGVDGLIPAGEVGEEVEIARANAALAQCETPFEKYKQLVALQMTDESTFYRMLRSQTETLLPILYTPTVGEACVKFGTLVQRPMGLWVSSNDAGNVKQLIRNWPATDVKIAVITDGERILGLGDQGANGMGISAGKSMVYAACGVPPSALLPIQVDTGTNNQTLLDDPLYIGLKQKRDRTKAYDALLDEIVVAVRSRYGQKTIIHWEDFAPKNAFRVLRRFQQAPEVVTYNDDIQGTAAVTVSGLLASVRSLGGDVTQQRVLFFGAGQANIGAAELFVSALVQRGVSEEEAKKRVWLFDSKGLVVRSRASQLSEDKLAYAQDAPEESDLERVIELIKPTALVGAAAVPGKFNERVVKKMSKINDRPIIFALSNPTSQAECSAEQAYAWSDGRAIFASGTRFPPVTYRSRKFEPGFANNAFIFPPIALATIVTGTINVTPEMFLTAAEALAESVDDELFSVGAVYPPVDRIASSARVVAARVAHAVDPSISLEEWTDRVDQYVRKNDLFSSVS

SEQ ID NO: 64931 - protein, 372 aa, Salmonella enterica subsp. enterica serovar Typhi str. CT18
MKYDLIIIGSGSVGAAAGYYATRAGLKVLMTDAHMPPYQQGSHHGDTRLIRHAYGEGEKYVPLVLRAQTLWDELSTHNEEPIFVRSGVVNLGPADSAFLANVARSAQQWQLNVERLDATALMTRWPEIRVPDNYIGLFEADSGFLRSELAITTWLRLAREAGCAQLFNSPVSHIHHDDNGVTIETSEGCYHASKALISAGTWVKTLVPELPVQPVRKVFAWFKADGRYSTKNRFPAFTGEMPNGDHYYGFPAENDELKIGKHNGGQRIQAPEERKPFAAVASDGAEAFPFLRNVLPGIGGCLHGAACTYDNSPDEDFIIDTLPGHENTLVITGLSGHGFKFAPVLGEIAADFALGKTPSFDLTPFRLSRFSQ

SEQ ID NO: 64932 - protein, 364 aa, Rhodopirellula baltica SH 1
MPQSFHLVILGGDGIGPEVCDQSVRLLEIMQPHLDGVEFQLDRHSVGVGEYQRSGEALPQSAYDACLASDAVLLGAMGLPNVRYPNGKEIAPQLDLRERLQLYGGVRPIRLYHEADTPLKGHGPGEIDFVLVRESTEGLFYGRDAIADLEADEATNLLRITRSASERVCRLAFETARRRDGKKTVTLIDKANVLSSMVYFRHVFDEVAKEFLDIKAEHVYVDAAALFLVRRPQDFDVMVTENMFGDILSDLAAGLVGGMGMAPSGDIGDDAAVFQPSHGSAPDIAGQSIANPIAMHLSTAMMLEWLDHPETRRAADALNAAIADVLSDPTQRTADMGGNLSTVEITDKIAERLSKRLQGETTAV

SEQ ID NO: 64933 - protein, 671 aa, Listeria monocytogenes str. 4b F2365
MKKTLDRQAVDTIRSLSIDMIEKANSGHPGMPMGAAPMAYMLFAKHLVFNPANPEWFNRDRFVLSAGHGSALLYSMLHLFGYDVKMEDLKQFRQLDSLTPGHPEFGWTAGVDATSGPLGQGIGMAAGMALAESHLAAEYNQPNYPIVDHYTYAICGDGDLMEGVASETASLAGHLGLGKLIVLYDSNDICLDGDLSATFSENAADRFRAYGWQVLRVEDGNNLAAIQEKIVQAKLETSKPTLIEVKTVIGYGAPTKAGSSASHGAPLGEKEANGAKEHYEWAEEPFTVPAEVRDYLRNYKARGEKLEGAWNTMLANYKKEFPELASQLDRVLAGEVAADWNANLPTFEAGTNVATRSASGKMINAIAAELPELFGGSADLGCSNKTFIDASPAYSIQDPAGKNIWFGVREFAMGAMLNGMALHSGLRVFGSTFFVFSDYVRPAMRMAALMQLPVTYVFTHDSIAVGEDGPTHEPIEQLASLRAMPGLTVIRPADAKETRAAWEIAATNTNGPIALVLSRQDLPVLENAQEEVDAGVDKGAYIVAPANSSKPDAIIIATGSEVSLAIEAKAELAKKDIDVSVVSLSSWERFEKTTDAYKESILPKEVTARFAIEAGATFGWKEFIGSEGDMLGIDHFGASAPAKDLFNAYGFTPENVADRVETVIAKAGVRV

SEQ ID NO: 64934 - protein, 106 aa, Zea mays
FWLLLLPHDQACVLCSVLVQAPQGKRSSGENVVMVDPLEAKRLAAKQMQEIRAKEKLKRRRQAEAINGALAVIGLTAGLLVEAQTGKDILGQLAGYLTAISSLFGQ

SEQ ID NO: 64935 - protein, 202 aa, Glomerella lindemuthiana
MSSNRNYDFLIKLLLIGDSGVGKSCCLLRFSEDSFTPSFITTIGIDFKIRTIELDGKRVKLQIWDTAGQERFRTITTAYYRGAMGILLVYDVTDERSFNNIRTWFANVEQHATEGVNKILIGNKCDWEEKRVVSTERGQQLADELGIPFLEVSAKSNINIDKAFYSLAADIKKRLIDNQKNEQPAASGVNVGESSGSGGKCC

SEQ ID NO: 64936 - protein, 469 aa, Salmonella typhimurium
MSAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRATGIADTVLFGPEPEFFLFDDIRFGASISGSHVAIDDIEGAWNSSTKYEGGNKGHRPGVKGGYFPVPPVDSAQDIRSEMCLVMEQMGLVVEAHHHEVATAGQNEVATRFNTMTKKADEIQIYKYVVHNVAHRFGKTATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEPMDKNLYDLPPEEAKEIPQVAGSLEEALNALDLDREFLKAGGVFTDEAIDAYIALRPEEDDRVRMTPHPVEFELYYSV

SEQ ID NO: 64937 - protein, 330 aa, Alteromonadales bacterium TW-7
MSLNSSTQFDPILVADVGGTNARFALITSFDDTTNQFAIEHNNTFPSANFGSLEKALEHYLSTVPHIVPKRACLAVAGPIKAGQVHLTNLGWHFSVNDFKAYFELNELDVINDFAAFAYAAPYLSPSQNVVIKAGQADDNANIGVMGPGTGFGAACLVRTSHSTSVLSSEGGHISLAAVTELDALLIQELKKEHQHVSVETVFSGPGITHLYKAMAAVKGQSPKNLDAAQISSLANSGECDVCDATLNQFCDWIGSVAGDLSLAYGALGGLFIGGGILPRMQARLLESRFVERFSQKGIMSQYTGQIPVTLVTQDNIPLIGAAACLHNAN

SEQ ID NO: 64938 - protein, 413 aa, Ehrlichia ruminantium
MIKKAAVELDDQKITLPILYDTEGNEVLDITSLYKNTGVLTYDPGFMSTAACESKITFIDGNKGILRYRGYDIADLVYNNKSFIEVVYLLFYGVFPNAEQLQEFILHISQEYVLPQMVRDVITSFPQNSHPMAILIASFSSLAAYYCDQKTDGELECKLAVAKVASIVALIYRHITNQDFIQADVGLSYSKNFIHMMFDISSYKFTEIVDKALDVIFVLHADHEQNASTATVRMTGSSGPNLFACLAAGAATLWGPAHGGANEAVINMLMNIGKPENVKQFIQKVKDSNKSTKLMGFGHRVYKNYDPRARIMCTICKEILKDFGLNDPLLEVAVELENIALQDDYFIARNLYPNVDFYSGIVLKTIGIPVKMFTTLFALARTSGWSAQWYEMVSSKNYKISRPRQLYTGNPVQ

SEQ ID NO: 64939 - protein, 876 aa, Arabidopsis thaliana
MSYMPTSCLVLFFLLFLFHPLPWALSKEDLGWCEALFQCGNNTAGFPFWGGNRAKPCGHPLLELRCLNNITSLNISNHEYNVFHIDQTSNTLRLARTDLLGSFCSAEFNTPTFPREIFKLFPTYKSLTVLYNCDPKLSYRSSYTCPDLGLFSMSQSLDYQNSCQDSFKVNVPTSFVPEEKEMNLTHLESALRKGFEVKLVIDEIPCQECSSSRGICGFNSTTQICCNVTSLSGGVTCVPQHQPSADELRRRCSERFSCGNQRNLYYPFWIPGREYCGHPDFKLDCSGGFAELNIASVNFRILNMSYDSSNKRLARSDYLNDLCPPNPLNDEPLIETVLQFSADTELLTLYYDCQLNSSATSPFPSSYFGELGCDEGRSYYVTRNLSSPLLDRFRGVLNNLREMCKRKVSVPASGPALNTLQTNPNSNNLKMALEHGFELQDNSNCSMCVLSGGSCGYNQNSSLFVCYCKDGPQDNQCDINLDVAIIIGIFVALCTIGGFIAFLVLLCPCCKVRIFRNRKTSDDRRQEKLKALIPLKHYTYAQVKRMTKSFAEVVGRGGFGIVYRGTLCDGRMVAVKVLKESKGNNSEDFINEVSSMSQTSHVNIVSLLGFCSEGSRRAIIYEFLENGSLDKFISEKTSVILDLTALYGIALGVARGLEYLHYGCKTRIVHFDIKPQNVLLDDNLSPKVSDFGLAKLCEKKESVMSLMDTRGTIGYIAPEMISRVYGSVSHKSDVYSYGMLVFEMIGARKKERFGQNSANGSSMYFPEWIYKDLEKADNGDLEHIEIGISSEEEEIAKKMTLVGLWCIQSSPSDRPPMNKVVEMMEGSLDALEVPPRPVLQQIHVGPLLESSWITEESSSISEIENRNLQVCEKILS

SEQ ID NO: 64940 - protein, 375 aa, Glycine max
IRLERSFPMQVVSDEAIMTTRVQSLAQSGLSRVPPQYIQPPQTRPIRHAPPESDSESIPVIDLCSFDPTQRASTRDSIARACRHWGAFHVTNHGVPPSLLASLRRAGLSFFSDTPMPDKLRYSCSAAAASEGYGSKMLATTTTTTTSDQNGAVQVLDWRDYFDHHTLPLSRRNPTRWPESPSDYRELVARYSDEMNVLAQKLLALISESLGLRASCIEDAVGEFYQNITISYYPPCPEPDLTLGLQSHSDMGAITLLIQDDVGGLQVLKGSDKWVTVQPLSDAVLVLLADQTEIITNGKYRSCEHRAITNPDRARLSVATFHDPAKTAKISPASELINDSSPAKYRDVVYGDYVSSWYTKGPGGKRNIDALVLDS

SEQ ID NO: 64941 - protein, 392 aa, Aspergillus oryzae
MASSAFPPPPVSSIDWNNVGFKVRDESKLPTNSKTPTVNGHVECHFSHSQGGKWSAPKFVNSPYLPIHGMAPGLNYGQQAYEGLKAFRRPDGSISVFRPDRNAVRMRRSAEFISVPPIPEDLFVESVKLAVAANAEFVPPHETGAAMYVRPLVFGSSAQLGLSPPDEYTFVVFVMPTGVYHGVHAVDALILEDFDRSAPEGTGSAKVGGNYAPVLRHSGRAHSEGFGITLHLDSRTRSEIDEFSTSAFIGVRKDASGAVTLVQPDSKNVIDSVTAASVLEIGERVFGFKTERRRVPYEELQEFKEVIACGTAAALVPIRSITMRSRGDRLTYEAGDDGQSGGEVCAKLLQTLKGIQAGKIEDQFGWNFTVERPPEGWATGGGETESDGANVP

SEQ ID NO: 64942 - protein, 236 aa, Cryptococcus neoformans var. neoformans JEC21
MATTSSSKQMEVNPRGIPRAPFVDNVDEYVGGKDAEVQTTIKKFEETTAKYRYMEISLQQRRKALLGKIPDITQTLQVVKYLHQRRQKTLGQPVEEEKLSDDEDDLDDLDDEEAKKEEQPMKTLFELNDTLYAEAEIVETGEVGLWLGANTMLMYPLEEAIDLLSSKLAAAQKSQDETIEDLEWLREQITVMEVNFARVHNWDVKRRREKGQIGQQSGLLPSRKGNDKDDSEDERD

SEQ ID NO: 64943 - protein, 442 aa, Solanum tuberosum
QTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPHWFQGTADAVRQYLWLFEEHTVLEYLILAGDHLYRMDYEKFIQAHRETDADITVAALPMDEKRATAFGLMKIDEEGRIIEFAEKPQGEQLQAMKVDTTILGLDDKRAKEMPFIASMGIYVISKDVMLNLLRDKFPGANDFGSEVIPGATSLGMRVQAYLYDGYWEDIGTIEAFYNANLGITKKPVPDFSFYDRSAPIYTQPRYLPSSKMLDADVTDSVIGEGCVIKNCKIHHSVVGLRSCISEGAIIEDSLLMGADYYETDADRKLLAAKGSVPIGIGKNCHIKRAIIDKNARIGDNVKIINKDNVQEAARETDGYFIKSGIVTVIKDALIPSGIVI

SEQ ID NO: 64944 - protein, 343 aa, Listeria monocytogenes str. 4b F2365
MKAVVKTNPGYDQMELRDVEEPQVYGDKVKIKVAFTGICGSDIHTFKGEYKNPTTPVTLGHEFSGVVVEVGPDVTSIKVGDRVTSETTFETCGECIYCKERDYNLCSNRRGIGTQANGSFAEFVLSREESCHVLDERISLEAAALTEPLACCVHSALEKTTIRPDDTVLVFGPGPIGLLLAQVVKAQGATVIMAGITKDSDRLRLAKELGMDRIVDTLKEDLAEVVLGMTDGYGAERVFDCSGAVPAVNQGLPLTKKKGDFVQVGLFAEKKNAIDEESIIQREIAYIGSRSQKPSSWILALDLLANGKINTDKMITKVYGLDDWREAFEAVMAGNEIKVLVKS

SEQ ID NO: 64945 - protein, 433 aa, Vibrio cholerae O1 biovar eltor str. N16961
MSKIVKVLGREIIDSRGNPTVEAEVHLEGGFVGMAAAPSGASTGSREALELRDGDKSRFLGKGVLKALAAVNGPIADALVGKDAKDQATIDQIMIDLDGTENKSNFGANAILAVSLANAKAAAAAKGMPLYEHIAELNGTPGVFSMPLPMMNIINGGEHADNNVDIQEFMIQPVGAKTLKEAVRMGAEVFHNLAKVLKSKGYNTAVGDEGGFAPNLKSNAEALEVIAEAVAAAGYKLGTDITLAMDCAASEFYDAEKKEYNLKGEGRIFTSNGFSDFLEELTEKFPIVSIEDGLDESDWEGFAYQTEKLGKKIQIVGDDLFVTNTKILKRGIDNGIANSILIKFNQIGSLTETLAAIKMAKDAGYTAVISHRSGETEDATIADLAVGTAAGQIKTGSMSRSDRVAKYNQLIRIEEALGSRAPFNGLKEVKGQA

SEQ ID NO: 64946 - protein, 350 aa, Listeria monocytogenes str. 4b F2365
MRAAVLYENNVIKAEQIDEATCGKDQVRVEVKAVGICGSDIHKMQTRWKYPLPAVMGHEFAGVVTEIGSEVTNVAIGDRVAGIPLEPCMECNYCKAGDFALCDNYRMVGSHFHGGFAENVVMKADNVISIGDLDFEEGAMIEPLAVSMHGVLGIQPRLGDTVIVFGIGTIGILVVQCLLLAGVKDIIAVDISDKKLADAREFGCKYTINPKNEDLKERVFAYTNGLGADIALECAGSKITQEQCLLVTKKKGKVGYLGIAYADVLLHEEAFENIFRRELTLKGFWNSYSAPFPGEEWRTSIEFVKQGRIKLKPLISHRYKLEETKEAFDMILSREHDYNKVMILPQKGDD

SEQ ID NO: 64947 - protein, 694 aa, Neisseria meningitidis
MQFSYSWLKTQADTELSSDKLEHLLTMSGLEVEEAETAAPAFAGVVIAEVKSVEKHPDADRLNVTRVDVGTGELVQIVCGAPNVKAGIKVPCSLPGAVLPGNFKIKPTKMRGVVSNGMLCSTDELGLPDDGVNGLHILPEDAPVGTNIREYLDLDDTLFTLKITPNRADCLSVKGIAREVSALTGCAFRQPEIRKMPSEGGKTRAVKIDAPADCGRFISRVIENVNAKAATPDWMKQRLERSGIRSISVLVDIGNYVMLEIGQPMHVFDADKLSGSLHIRRAREGETLECLNEKTVSLSENTLVVADEKGALSLAGLMGGAASAVSDGTQNIVLEAAWFAPEIIAGKSRQYGFGSDSSFRFERGVDYRLQADAIERATELVLQICGGAAGEMVEAQGELPEVKQVGLRLGRLKTVLGVDIPSEQVETILQHLGLQPEKTAEGFRVTAPSFRFDIEIEADLIEEIGRVYGYENIPDDYTSGRLKMLELPETRRPRFAVYNEMAARGYREVVSYAFVNEQWEQDFAANADPIRLQNPLAAQYAVMRSTLIGGLVEILQNNLNRKQNRVRVFEIARVFGKGSDGRFVQNERIGGLWYGAAMPEQWGGKTRNADFYDIKADVENLLKNKAVEFVKTGYPALHPGRAANIVSDGKVIGFVGELHPKWLQKYDLPQAPLVFEIDMAAVLECGKTRYRAVS

SEQ ID NO: 64948 - protein, 442 aa, Solanum tuberosum
QTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPDWFQGTADAVRQYLWLFEEHTVLEYLILAGDHLYRMDYEKFIQAHRETDADITVAALPMDEKRATAFGLMKIDEEGRIIEFAEKPQGEQLQAMKVDTTILGLDDKRAKEMPFIASMGIYVISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDADRKLLAAKGSVPIGIGKNCHIKRAIIDKNARIGDNVKIINKDNVQEAARETDGYFIKSGIVTVIKDALIPSGIVI

SEQ ID NO: 64949 - protein, 369 aa, Zea mays
  misc_feature (95)..(95): Xaa can be any naturally occurring amino acid
  misc_feature (161)..(161): Xaa can be any naturally occurring amino acid
  misc_feature (166)..(166): Xaa can be any naturally occurring amino acid
  misc_feature (175)..(175): Xaa can be any naturally occurring amino acid
  misc_feature (199)..(199): Xaa can be any naturally occurring amino acid
MKLTVKTLKGTHFEIRVQPNDTIMAVKKNIEEIQGKDSYPWGQQLLIFNGKVLKDESTLEENKVNEDGFLVVMLSKGKTSGSTGTSSSQHSNTPXTRQAPPLEAPQQAPQPPVAPITTSQPEGLPAQAPNTHDNAASNLLSGRNVDTIINQLMEMGGGQLXKDKVXRALRAAYNXPNVAVEYLYSGIPVTAEIAVSNWXGQGANTTDRAPTGEAGLSGIPNTAPLDLFPQGASNAGGGAGGGPLDFLRNNPQFQAVREMVHTNPQILQPMLVELSKQNPQILRLIEENHDEFLQLLNEPFEGGEGDFLDQPEEDEMPHAISVTPEEQEAIGRLESMGFDRARVIEAFLACDRNEELAANYLLEHAGEED

SEQ ID NO: 64950 - protein, 348 aa, Deinococcus radiodurans
MRALSKQQPGEGIWMIETEVPTPGPNDLLIRIRKGSICGTDVHIYKWDDWASQTVPVPMVVGHEYVGVVAGMGSEVRGFEIGDRVSGEGHVTCGHCRNCRAGRRHLCRNTQGVGVNRPGSFAEYLVLPAFNAFKLPDDIPDDVAAIFDPFGNAVHTALSFDLVGEDVLITGAGPIGCMAAAVARHVGARNVVITDVNDYRLDLARQMGVTRAVNVAREDLWTVATQELDMHEGFDVGMEMSGSGPAFAQMVSVMNNGGKVALLGIPSGEVQIDWNAVIFKMLTIKGIYGREMFETWYKMAALIQSGLDLTPVITHHYGIGDFQQGFDAMLSGQSGKVILDWETEEQSA

SEQ ID NO: 64951 - protein, 439 aa, Streptomyces avermitilis MA-4680
MGLYTALRLQRKLKPELQRGDVEIVVVSPDPYMTYQPFLPEATAGNISPRHVVVPLRRVLTECRLLVGEAQSIDHAKRVATVATLATQETGRTEQITYDELVLAPGSVSRTLPIPGLADHGIGFKTVEEAIGLRNHVIEQMDIASSTRDPAIRDAALTFVFVGGGYAGVEALGELEDMARFAARYYHNVKRDDMKWILVEATNRILPEVGEEMGKYAVTELRRRNIDVRMETRLESCADRIAVLSDGSRFPNRTVVWTAGVKPHPILAATDLPLNEHGRLKCTPQLTVDGATHAWAAGDAAAVPDLTAKEPGKETAPNAQHAVRQAKLLGDNIAHALRGEELETYAHKYVGSVASLGLHKGVAHIYGRKLKGYPAWFMHRAYHLSRVPTFNRKARVLAEWTLAGLFKREIVSLGSLEHPRAEFELAAGGKPSRDPKGSS

SEQ ID NO: 64952 - protein, 1059 aa, Marinobacter sp. ELB17
MFRASKVLEPAFQEQPRSFFWQGLTENYQVDEAAYLKELIPLAQSDASEHKAITDTASSLIRKVRAQDGAVHMIDALLQEYSLDTQEGILLMCLAEALMRIPDKHTADALIRDKMLSADWKKHVGRSESTLVNASTWGLMLTGRVVKMDKRLDGSPSNVWNRLVKRSGEPVIRGAMNQAMAIMGKQFVLGRDINEALKQARDDRKMGYSYSFDMLGEAAMAQDDADRYLKDYLQAIEAVGNDPDPKNNAPRSSISIKLSALHPRYEVSQEHRVLTELYSTVCDLVQFARDKDVSITIDAEEMDRLELSLKLFEKILKSPAASGWGGFGLVIQAYSKRALPALCWLTKLAKETGDEIPIRLVKGAYWDTEIKMCQQMGIESYPVFTRKEATDTSYLACLRFLLSDYTQGALYPQLASHNAHTVAAVLAMAKKRNRKIEFQRLHGMGDALYNSILQEHDIPVRIYAPVGAHKDLLPYLVRRLLENGANSSFVHRLVDAGTPIEDLVQNPVQELQKYDSLANSRIPGPMDIFGEQRRNSRGINIHVASQLEPLINNLQKWNSTRWHACPVINGERRSDGDKTEVRAPYDQSKRVGDVVWADEKHAEDALKVAFAGFPNWNERPVEERALCLEKFANLMEKHMEELIALCCQEAGKTMQDGIDEVREAVDFCRYYANDGRARFAKAIALPGPTGESNELYMEGRGVFLCISPWNFPLAIYTGQIMAALVAGNTVIAKPAEQTSLVAMRGMELMLEAGFPANVLQFLPGDGAKLGKVLTPDSRISGVCFTGSTQVAHFLNRTLAERSGAIVPLIAETGGQNAMIVDSSALPEQVVRDVVQSAFASAGQRCSALRVLYVQQDVADRMETLLAGAMNELVVGNPQSHSTDVGPVIDQKAKENLEKHLVNLEANARLIGRRELPSDCSAGYFVVPSAYGIDSINDLDGEHFGPILHVIRYEAEQLDKVIDEINATGYGLTLGIHSRSESTATYIERRVKVGNCYVNRNQIGAVVGVQPFGGRGLSGTGPKAGGPHYVLRFATERTRTINTTAVGGNASLLSLGIEKV

SEQ ID NO: 64953 - protein, 621 aa, Oryza sativa
MAGAGAGESLDLPVVDLASSDLAAAAKSVRKACVEYGFFYVVNHGAEGLAEKVFGESSKFFEQPLGEKMALLRNRNYLGYTPLGADKLDASSKFKGDLNENYCIGPIRKEENFPCWKETMKLYHETALATGKRILSLIALSLNLDVEFFDCPVAFLRLLHYPGEANESDDGNYGASAHSDYGVLTLVATDGTPGLQICREKDRCPQLWEDVHHIEGALIVNIGDLLQRWTNCVFRSTLHRVVAVGKERYSVAFFLHTNPDLVVQCLESCCSEACPPRWVREERETRGWAAGRASDPGAPAPVDRELAFSEADSSRSNKQQPLPGGRGSWKPEMVAAAGDRLDLPVVDLASSDLRSSAESIRKACVECGFFYVVNHGIEEGLLEKVFAENRRFFEQPLEEKMALLRNSSHLGYTPPYTEKLDASSKFRGDLSETFKIGPIGDEGFQNDANQWPSEERLPCWKETMKLYRGTALGTGKRILSLVALSLNLDAEFFDCPLAFLRLLHYPGEINESDDGNYGASAHSDYGILTLLATDGIPGLQICREKDRHPQLWEDVHHIDGSTLHRVVAVGKERYSVAFFLDPDPDLVVQCLESCCSEACPPRFPPIKSGDYLEERLSSTYK

SEQ ID NO: 64954 - protein, 188 aa, Zea mays
ATSRLPASAAGPPSAQSMPANFAVKSALLEGARGDSSSITANKTSTDPTPRLKKSRTGTPSPLPATFKVRKEKLGDRITALQQLVSPFGKTDTASVLHETIEYIKFLHDQVGSLSLPYLQASGQQEVPPHKVLRDGGGEAAGANGELTGRGLCLVPISSTFAVASETTTTTTTPPLDFWTPFGGPAFR

SEQ ID NO: 64955 - protein, 31 aa, Brassica rapa subsp. rapa
EGAPKRLTYDEIQSKTYMEVKGTGTANQCPT

SEQ ID NO: 64956 - protein, 433 aa, Lactococcus lactis subsp. lactis Il1403
MYKMWQTRVLISTAFVYIGYYIIRLIFTVQQNDISKAYGFSMGQIGTILSMFGIGYGISKLIMGTLADRANPNRYVATGLIVSAIINALYGTTQSFGMIVFLMLLNSVMQGMGAAACQRLVGLWFGRKAKGSIMARGTAFSIWSSAHNAGAFMCVAVINLSAFFFGASLQWSFWTASIVSIVIAIIVLFLGSDRPTTKGLPTIEEYSGDKVVIKDGEIVEGDVSNDNVFKIFFEYIVKNKLVWAVILTSLSIYVVRYGIMSWIPNYLVNIKGFDNSTAKWLTGIFELAAVPGVIIIGFITDLLKGRRAIMVLVSLIAMLACLITYFAATNHTLIIIVLLIMGTFIYAPATIVGLMVNEAVPKFANGMSTGTMGFCQYIIGEVTATLVIGWLVQAYGWSAGNIIVYIFAGIAILASIYILVHQNRLYKKIDDAG

SEQ ID NO: 64957 - protein, 260 aa, Shewanella sp. MR-4
MALRRPMVAGNWKMNGSAALAQELFKKFASKLQNDSAEVVLCPPSIYLESVRQLLEANKEALDGSLVRMGAQNLSQHDFGAYTGEVSGQMLKDCGCRYVIIGHSERRRMYGETSNIVAEKFAAAQKHGLTPILCVGESGPAREARRTFEVIAEELDIVIQKNGTMAFDNAIIAYEPLWAVGTGKSATPEQAQEVHAFIRKRLSEVSPFIGENIRILYGGSVTPSNAADLFAQPDVDGGLIGGASLNSSEFLSLCTIAMSA

SEQ ID NO: 64958 - protein, 711 aa, Sinorhizobium meliloti 1021
MTILLGVIACGLLSVVYAIWATKSVLAADQGNARMQEIAGFIREGAQAYLTRQYTTIAIVGVVVFIAAWLLLSGAAAIGFLIGAVLSGAAGFIGMHVSVRANVRTAQAASVSLASGLDIAFKSGAITGMLVAGLALLGVSVYYLILTAGLGHEPAAREVIDALVALGFGASLISIFARLGGGIFTKGADVGGDLVGKVEAGIPEDDPRNPATIADNVGDNVGDCAGMAADLFETYAVSVVATMVLASIFFAGAPVLATVMTYPLAICAACIITSIIGTFFVKLGANASIMGALYRGLIVTGALSILGLGAATSLTIGWGSIGTVAGMDITGWNLFLCGIIGLIVTALIVVITEYYTGTNKRPVNSIAQASVTGHGTNVIQGLAVSLESTALPAIVIVGGIIATYQFAGLFGTAIAVTAMLGLAGMIVALDAFGPVTDNAGGIAEMSHLPPEVRKSTDALDAVGNTTKAVTKGYAIGSAGLGALVLFAAYSNDLAYFAANGDKHPYFADVGTISFDLSNPYVVAGLIFGGLIPYLFGGIAMTAVGRAGSAVVEEVRRQFKEKPGIMEGKDRPDYGRAVDMLTKAAIREMIIPSLLPVLAPIVVYFGVLLISGSKASAFAALGASLLGVIVNGLFVAISMTSGGGAWDNAKKSFEDGFVDRNGTRHMKGSEAHKASVTGDTVGDPYKDTAGPAVNPAIKITNIVALLLLAVLA

SEQ ID NO: 64959 - protein, 480 aa, Oenococcus oeni PSU-1
MENKKTNISKTNYALNFIKTKSKAERHLKIIALCVTLGGLLFGVDTGVINGALPYMAKKQELNLNPATEGLVTSSITLGAAFGAIFAGRLADRYGRKRILFYLSIVFFFCTAICSLAPNAIIMMIFRFLLGLAVGSASVIVPTFLSEIATVKLRGPLVTQNEIMITGGQLLAFVVNAILGNIFVNVSNIWRYMIAFGMIPSALLFIGTLIVPESPRWLIMKGKTKTALKILKGIRSDKRQSQQEVTQIQATLKKEKEVSHISWYDLKKPWIKKLIILGSGLGIVQQIVGINIIMYYGTTVLIKAGFTHNIALITNIANGIVSVLATYTGMHLMNHINRRKMLLTGIAGTGGALALITLVSQILPHSKLLPVCVVFLTLIFLSFFQGCISPTIWLLMSEIFPQNLRGLGMGISTFFLWMANFLVGFLFPIFLNYFGFSITFGIFVLCNLISFIFVYKFAPETRNKSLERVQLELRTRIDKN

SEQ ID NO: 64960 - protein, 338 aa, Glycine max
MDIKVLSSGVQYSNLPESYIRPESERPRLSEVSECEDVPIIDLGSQNRAQIVHQIGEACRNYGFFQVINHGVALEAAKEMEEVAHGFFKLPVEEKLKLYSEDTSKTMRLSTSFNVKKETVRNWRDYLRLHCYPLEKYAPEWPSNPPSFKETVTEYCTIIRELGLRIQEYISESLGLEKDYIKNVLGEQGQHMAVNYYPPCPEPELTYGLPGHTDPNALTILLQDLQVAGLQVLKDGKWLAVSPQPNAFVINIGDQLQALSNGLYKSVWHRAVVNVEKPRLSVASFLCPNDEALISPAKPLTEHGSEAVYRGFTYAEYYKKFWSRNLDQEHCLELFKNK

SEQ ID NO: 64961 - protein, 297 aa, Frankia sp. CcI3
MAIVLGPNQYGKAEVRLVHVARNGPVHQITDLNVSTALRGDFAAAHLSGDNAHVLTTDAQKNTVYAFAREHGIGQIEDFAIRLGHHFAGSLPGIDGARIEIEQYRWDRIQVDGVPHDHAFSRSAGEKRTTVVTLDRGTAFVVSGLAGLVLLKSTGSEFSGFLRDRYTTLPETTDRILATEVTARWRYAQSDLDFGRLFDGVRTALVSTFASLHSLALQQTLYRMGEAALTAHADVAEIRLSMPNKHHFLVDLEPFGLDNPNTVYYAADRPYGKIEGTVLRDDAPDPGPSWLTLPGFC

SEQ ID NO: 64962 - protein, 322 aa, Arthrobacter nicotinovorans
MPVIPALQTLLDSLPATGLGDLTDLPAVRQAGLEGANALAALVAQEPLDVGSVHTAMVPVNGGEIKVRIYQPGTPGPHPIHVFYHGGGWMAGTIEETFVDNVCRERTALAGYVTVAVEYRLAPEFKFPIPLEDSYAALEWVVEHAADYDGDPENVTIGGGSAGGNLSAAIALKARNENGPHITFQVLEVPALDLTLASPSVEQYSGGEYPLPKAEIDLCVEGYLRSPEDARNPYASPLLADDVSGLPPALIISSEFDPLQMDGSRYAQRLQEVGVHAAFRLGEGHVHGSSQFTKLLPEAAAWRDQVIDALKTHAADHRRVTP

SEQ ID NO: 64963 - protein, 162 aa, Glycine max
MFVLENGVKNKGEDPRLQAISQAIRVVPHFPKQGIMFQDITTLLLDHNAFKDAVDIFVDRYRDMDISVVAGVEARGFIFGSSIALGIGAKFAPLCKPGKLPGEVISEKYVLEYGTDCLEMHVGAVQQNERVIIIDDLVATGGTMSAAIRLLGDLHMQALLLR

SEQ ID NO: 64964 - protein, 167 aa, Triticum aestivum
MCINAFNTSRFLCYQVYLYGGQVTSWKNNSGEQQLFLSKKASFKPPKAIRGGIQICFPQLGNHGVVEQHGFARNRLWSVDESPPLPDTTSDCHIDLILKQSEEDMKTWPHSYELRLQVALSPRGDLILTSRIKNKNADGKPFQFTFAYHAYFSVSDISEVPARAAAR

SEQ ID NO: 64965 - protein, 557 aa, Arabidopsis thaliana
MATSSAWKLDDHPKLPKGKTIAVIVLDGWGESAPDQYNCIHNAPTPAMDSLKHGAPDTWTLIKAHGTAVGLPSEDDMGNSEVGHNALGAGRIFAQGAKLCDQALASGKIFEGEGFKYVSESFETNTLHLVGLLSDGGVHSRLDQLQLLIKGSAERGAKRIRVHILTDGRDVLDGSSVGFVETLEADLVALRENGVDAQIASGGGRMYVTLDRYENDWEVVKRGWDAQVLGEAPHKFKNAVEAVKTLRKEPGANDQYLPPFVIVDESGKAVGPIVDGDAVVTFNFRADRMVMHAKALEYEDFDKFDRVRYPKIRYAGMLQYDGELKLPSRYLVSPPEIDRTSGEYLTHNGVSTFACSETVKFGHVTFFWNGNRSGYFNEKLEEYVEIPSDSGISFNVQPKMKALEIGEKARDAILSGKFDQVRVNIPNGDMVGHTGDIEATVVACEAADLAVKMIFDAIEQVKGIYVVTADHGNAEDMVKRDKSGKPALDKEGKLQILTSHTLKPVPIAIGGPGLAQGVRFRKDLETPGLANVAAKVMNLHGFVAPSDYEPTLIEVVE

SEQ ID NO: 64966 - protein, 803 aa, Oryza sativa
MAGGGGKSVAAALAMACFLLILAAFAPPAAAAPPDIMSIIRYNAEHGVRGLERTEAEARAAYDLWLARHRRGGGGGSRNGFIGEHERRFRVFWDNLKFVDAHNARADERGGFRLGMNRFADLTNGEFRATYLGTTPAGRGRRVGEAYRHDGVEALPDSVDWRDKGAVVAPVKNQGQCGSCWAFSAVAAVEGINKIVTGELVSLSEQELVECARNGQNSGCNGGIMDDAFAFIARNGGLDTEEDYPYTAMDGKCNLAKRSRKVVSIDGFEDVPENDELSLQKAVAHQPVSVAIDAGGREFQLYDSGVFTGRCGTNLDHGVVAVGYGTDAATGAAYWTVRNSWGPDWGENGYIRMERNVTARTGKCGIAMMASYPIKKGPNPKPSPPSPAPSPPQQCDRYSKCPAGTTCCCNYGIRNHCIVWGCCPVEGATCCKDHSTCCPKEYPVCNAKARTCSKSKNSPYNVEALIRTPAAMARSVPEQPDSISFSVYRMAAAARPVDVVRHFPCSSSVAASSSLLLSRSKSRLASPAAAAASSMRRRLVLGVGAAAAPAVAALAASATPAALRDCAATLLITAGAYSLVRAFDGLTARRLIEQNLSRKIVHVLSGVLFMSSWPLFSNSTEARFFAAIVPLLNCIRLLTYGLRLSTDEALVKSVTREGKPEELLRGPLYYVIVLLVSVLVFWRQSPIGIVSLSMMSGGDGFADIVGRRYGSAKLPFNENKSWIGSISMFISGFLLSALMLFYFSCLGYFTVCWDLALGKLALVALAATVVECIPVNDVVDDNISVPLATMLAAYLLFGYSSCC

SEQ ID NO: 64967 - protein, 241 aa, Oryza sativa (japonica cultivar-group)
LKPFQVPGKSAEECLSRVHADLSTPTPIAPRPRTSKMKFSPLGHFTLSDPKHPNVLEPSFRRRTAKQKSLAAQKTVRHLLKKQCLTDQTQEADHFSIFETSPTVLPVEFSFEDSPGTPNSSGKKLLARLETVKNVGINPAEPSPAVLKPIKNVILHEKYVDRLSRREGTTRPRKKAAGSKALDSVKTQQAGGVKAARNALITEATDFISHFKKMQANPLAHVVEDDEDDEIDGIECDTSNH

SEQ ID NO: 64968 - protein, 348 aa, Bacillus subtilis
MSNIIRLLAESLPRISDGNENTDVWVNDMKFKMAYSFLNDDIDVIERELEQTVRSDYPLLSEAGLHLLQAGGKRIRPVFVLLSGMFGDYDINKIKYVAVTLEMIHMASLVHDDVIDDAELRRGKPTIKAKWDNRIAMYTGDYMLAGSLEMMTRINEPKAHRILSQTIVEVCLGEIEQIKDKYNMEQNLRTYLRRIKRKTALLIAVSCQLGAIASGADEKIHKALYWFGYYVGMSYQIIDDILDFTSTEEELGKPVGGDLLQGNVTLPVLYALENPALKNQLKLINSETTQEQLEPIIEEIKKTDAIEASMAVSEMYLQKAFEKLNTLPRGRARSSLAAIAKYIGKRKF

SEQ ID NO: 64969 - protein, 145 aa, Brassica napus
NYRLNMSDSEVRKLVAQKRWDELKNSDQLIRELRRGHVFDGWREGPIKFPPTYKYEFDSDRYAGENLKEGEKKRAPAWCDRILWLGKGIRQECYKRSEIRMSDHRPVTSIFNVGVEVFDQRKLQRALHVNNAAASAVHPEPAFSV

SEQ ID NO: 64970 - protein, 111 aa, Brassica napus
  misc_feature (10)..(10): Xaa can be any naturally occurring amino acid
  misc_feature (24)..(26): Xaa can be any naturally occurring amino acid
  misc_feature (34)..(34): Xaa can be any naturally occurring amino acid
  misc_feature (44)..(45): Xaa can be any naturally occurring amino acid
  misc_feature (48)..(48): Xaa can be any naturally occurring amino acid
  misc_feature (50)..(50): Xaa can be any naturally occurring amino acid
  misc_feature (54)..(54): Xaa can be any naturally occurring amino acid
  misc_feature (57)..(58): Xaa can be any naturally occurring amino acid
MSGRGKGGKXLGKGGAKRPRKVLXXXFQGITKLXIRRLARRGVXXRIXGXIYNXTRXXPHRLFPPFNPSRLTHGTCNSTLCLFFHLFKNHTEDRPPPAIPGHPPASYLSTP

SEQ ID NO: 64971 - protein, 335 aa, Chlamydophila abortus S26/3
MKVVINGFGRIGRLVLRQFLKRNSSIEVVAVNDLVPGEALTYLFKYDSTHGRFPAEVSHENGCLVVDGRRIQLLAQSDVQKLPWKDLGVDIVIESTGLFTKKEDAEKHLASGAKRVLITAPAKGDVPTFVMGVNEHKFDPEKDLIISNASCTTNCLAPLAKVLLDSFGIEEGLMTTVHAATATQSVVDGPSKKDWRGGRGAFQNIIPASTGAAKAVALCLPELKNKLTGMAFRVPVADVSVVDLTVRLQKSTSYEEICKVVKEASEAHLSGILGYTDQEVVSSDFIGCEYSSIFDAGAGIALTDRFFKLVAWYDNEIGYATRIVDLLEYVAKNSK

SEQ ID NO: 64972 - protein, 380 aa, Magnaporthe grisea 70-15
MPENTSRHQGPVQTSAVYLVGQPAQAIERPPSPPSPPSPGPALCRGVTLLIDELPSMSLDDPRVGLPPITSQTTASTTHLPSPVPSPPIDLDKLRPEGHTVTAPPSPSSRPVDDDHEGWSSPTADSTFDLVASDRLAGAVHVLNAEATALASLATMYSTSACARTAFDSAVSVIARNQARPPAGDGGGTLVMIGVGKSGHIARKLAATFSSLSLRSSFMHPTEALHGDLGLLHPVRDAVVLVSFSGRTPELLGLVPHLHPGLPVVVITAASDAACEIARSLRTMREKPMSEGPWRSSREAGPSRTGEIVVLPAPIPTSEVATLGIAAPTASTTVALALGDALAVVAAKEIHGGTANTAAVFLRNHPGGAIGSSFASAVSR

SEQ ID NO: 64973 - protein, 453 aa, Sulfitobacter sp. EE-36
MGNLTFDTLKDLAAKGEVDTVLVALVDMQGRLMGKRFHVTNFIDHSHAETHCCNYLLATDLVMSTPEGFASTSWETGYGDYVLRPDLSTMRHVPWLDKTVLVLGDVLDHHTHEPVSHSPRAMLKKQIARLDALGFDAMMATELEFFLFEGDYRTLQKEKYANLVPLNGHNEDYCLFQTTKEESFLQPLRNHLVGAGIPVECTKGEAEVGQQELNIRYADALACADHHTISKQAVKEIAYQQGFSASFLPKWSADKVGSSSHVHMSLWKDGTPAFYDKDAKLGMSQMMQHFMAGLIAYAPDITYFFAPYINSYKRFAKGTFAPTKTVWSVDNRTAGFRLCGDGTKGIRVECRIGGSDLNPYLAQAVLLAAGLKGIEEKLPLQEPTMGDVYEDANVTEIPRTLRAATQTLRNSAMLREALGDDVVDHYTRAAEWEQEEYDKVVTDWEINRGFERA

SEQ ID NO: 64974 - protein, 353 aa, Arabidopsis thaliana
MSSPVKKMKKKTTTSPILSPTPHSTQILSLPVDLLISILARVSRLDYPILSLVSKSFRSLIASPELYETRSLLGRTESCLYLCLGIPSDFNPRWFTLCRKPKPSGHVMAAISIPNSRPVHCSGLVAVGSDIYNIGGSIINEHSSSVSILDCRYHTWRDAPNMLVERNSHAANVIDGKIYVAGGSRDSNSSNWMEVFDIKTQTWEPVLNPIADGCDRRIRKSAVIEEAICLFGMGMASCCVIDNVLYCYSNIDGIKLYDSKIGCWMKLKGLEGLPEFASYSYVRLADYGGKMAVLWDKLPTTGNNNMVIWCAVITLEKRHNENIWGRVEWFDAVLTVPEPYEFQCVDWLGCSHS

SEQ ID NO: 64975 - protein, 141 aa, Chlamydophila abortus S26/3
MEQTLSIIKPDSVGKAHIGEIIAIFEKSGFRIAAMKMLHLSVKEAEGFYAVHKSRPFFQELVDFMISGPVVVMVLEGNNAVARNREIMGATNPQEAAPGTIRAQFGESIGINAVHGSDSLENAAIEINYFFSKVEIVNSAA

SEQ ID NO: 64976 - protein, 219 aa, Zea mays
MDSSSSSSSLSQQPEFDYLFKLLLIGDSGVGKSSLLLRFTADSFEDLSPTIGVDFKVKMVTIGGKKLKLAIWDTGEMAAGQERFRTLTSSYYRGAQGVIMVYDVTRRETFTNLSDIWAKEIDLYSTNQDCIKMLVGNKVDKESERAVTKKEGIEFAREYGCLFLECSAKTKVNVEQCFEELVLKILDTPSLLADASSGAKKNIFKQKPPEADAAASSCC

SEQ ID NO: 64977 - protein, 415 aa, Ehrlichia ruminantium
  misc_feature (161)..(161): Xaa can be any naturally occurring amino acid
MIKKAAVELDDQKITLPILYDTEGNEVLDITSLYKNTGVLTYDPGFMSTAACESKITFIDGNKGILRYRGYDIADLVYNNKSFIEVVYLLFYGVFPNAEQLQEFILHISQEYVLPQMVRDVITSFPQNSHPMAILIASFSSLAAYYCDQKTDGELECKLAXAKVASIVALIYRHITNQDFIQADVGLSYSKNFIHMMFDISSYKFTEIVDKALDVIFVLHADHEQNASTATVRMTGSSGPNLFACLAAGAATLWGPAHGGANEAVINMLMNIGKPENVKQFIQKVKDSNKSTKLMGFGHRVYKNYDPRARIMCTICKEILKDFGLNDPLLEVAVELENIALQDDYFIARNLYPNVDFYSGIVLKTIGIPVKMFTTLFALARTSGWSAQWYEMVSSKNYKISRPRQLYTGNPVQKV

SEQ ID NO: 64978 - protein, 323 aa, Shewanella oneidensis MR-1
MDLNAIRQLADTDMQAVNQLIYKQLESDVALINQLGFYIINGGGKRLRPLLSVLAARAVDYQGEAHLKLAAIIEFIHTASLLHDDVVDESTLRRGRETANALFGNSASVLVGDFLYTRSFQMMTELDSMRVLRVLADTTNVLAEGEVLQLMNCNDPDTTEESYMRVIYCKTAKLFEAATLLAAVLAGASPEQETALGDYGKYLGTAFQLTDDLLDYTADSDELGKNIGDDLAEGKPTLPLIYAIAHGTEEEKQLIRQAIEQGDGTHAIEKIVAALHHCGALNYTQQKAIEESNKAIAALSVLPDSDFKTALISLAKISVDRNH

SEQ ID NO: 64979 - protein, 780 aa, Ostreococcus tauri
MDVEGGMLGGSRSDASSRAFTARPNSVTSRAHAFYARDPMRTKQILAVAAAVCFLLALRCSWTAAWVFVACAASLAFAAHLANWVMRLDEGSEDMRAVSDAIRDGADGFFTTQYGLISRLAVGVAGAIFFTYLFRATTREQQEAGVGAFSMALLTTVSFISGALCSGVSGYVGMWVSVRANVRVASSARHGAREALTVALRAGGFAALIVVGMTVMGVTVLFALYSFLFSVGSPGGMSVHEIPLMLVGYGFGASFVALFAQLGGGIYTKAADVGADLVGKVEQGIPEDDPRNPATIADLVGDNVGDCSARGADLFESIAAEVISAMILGATMSKSAGIDDATGFIMFPLRDVHSSRGSVQGAQGGYNVSISLAVVGFGLACRIMLASAKYPGAWFYFYLCGLIGIACAYAFVFIAQYYTDHQFPPVRVIAEASTTGHGTNIIAGVGVGMESTAAPVIVISIAIISAFWCGNSSGIVNAQGTPIGGLFGTAVATMGMLSTAAYVLTMDVFGPIADNAGGIVEMSEQPESVREICDELDAVGNTTKATTKGYAIGSAALASFLLFSAFMDEVSAFTGKPFDQVDIAIPEVFVAGLLGAALVYLFSAWSITAVGRSAQEVVREVRRQFSERPGIMTGEEKPDYARCVAIVAASALREMVRPGALAVLSPVAVGVIFKNLGVATGQELLGVKCVAAFLMFATVAGILMALFLNTAGGAWDNAKKYIETGAHGGKGSEAHKAAVSGDTVGDPFKDTAGPSIHVLIKMLATITLVMAPMFIDSTRA

SEQ ID NO: 64980 - protein, 76 aa, Arabidopsis thaliana
MAVPVPLVGAALGVGVQVYANAVRKLPLMRKPWLHVLCGSAGYGFGSWLVEFEAKTHKDLTEMLKNRENANKQLQP

SEQ ID NO: 64981 - protein, 315 aa, Arabidopsis thaliana
MMMMSSLGGGGGGGGGSGGGIGGGGGGRFMTYSSSLSVPPSAPQSPNYSGGLRSQSSVFVEQEKYLSELLAERHKLTPFLPVLPHAFRLLNQEILRVTTLLENATVLSQSGLDHPSPLASGGIFQNARADMNGWASQFPSERSVPSSPGPNWLNSPGSSSGLIAKRTIRVDIPVDNYPNFNFVGRLLGPRGNSLKRVEASTDCRVLIRGRGSIKDPIKEEMMRGKPGYEHLNEPLHILVEAELPIEIVDARLMQAREILDDLLTPMEETHDMYKKQQLRELALLNGTLREEGSPMSGSVSPYNSLGMKRAKTREG

SEQ ID NO: 64982 - protein, 514 aa, Oryza sativa (japonica cultivar-group)
MPLPPPPPPPPLSPLLLLLLLHSPFLPAQLPLILHARACGEAMAPAKMRASGDPYLQHCVETAALLAELGAGPAVVAAGLLHDTVDDAGLGYGSLSVQFGAGVADLVKGVSNLSHLSKLARRNDTASRVDEADKLRTVFLAMEDARAVLIKLADRLHNMRTLDSLPKVKQQCFAKETLEIFAPLANQLGILNWKEQLENLCFKYLYPELYEELSSNLLEFYNQDMIAAAIRRLEQALQVRGLCYHTISGRNKSMYSIYSKMARKKLDMDEIYDIHGVRVILDNKADCFTTLEIVHHLWPRIPGKFKDYINSPKPNGYQSLHTVVLSEETLPLEIQIRTRDMHLQAEFGIAAHWRYKEAVRNCCSSVPEMVEWVRWVVTWQCETLHIDHPSSLTHGAPPRAICSCSSQSDDCPFSYSKRCDHSGPILVILLENEKMSVQEFPQNSTVLDLLKRTSSYDMQLRLRLNCHVVHNLNQELKMGDVVELIPLAQCNPGAGGYAREFHQMYDHRLTVSQS

SEQ ID NO: 64983 - protein, 133 aa, Glycine max
  misc_feature (28)..(28): Xaa can be any naturally occurring amino acid
  misc_feature (55)..(55): Xaa can be any naturally occurring amino acid
  misc_feature (78)..(78): Xaa can be any naturally occurring amino acid
  misc_feature (84)..(84): Xaa can be any naturally occurring amino acid
  misc_feature (118)..(118): Xaa can be any naturally occurring amino acid
MQLYIESIQKGTMEGFYKEFTYFQTQSXPSFTNKTAWGMKLNALNRPPKMESTRXWLDEYMVDCCEPVETLTLAGITXGKLERXPHCAAAKVDALHPTHINMDETGKSLKKRSMYQDXHLFSYYHRTGLIQTE

SEQ ID NO: 64984 - protein, 195 aa, Haloarcula marismortui ATCC 43049
MTDRTAAVTRTTAETDIEVTLDVDGDGDSTIDTGIGFFDHMLDSFSTHGLFDLTVQCDGDLDIDDHHTVEDVAITLGEAFTEALDDKRGIRRFADRKVPLDEAVASVVVDISGRPYFEFDGEFSQASVGGMTSHMAKHFCRSLSMNAGLTLHCGVDGENAHHEIEALFKSLARSLDDATRIDERRSDVASTKGEL

SEQ ID NO: 64985 - protein, 375 aa, Ureaplasma parvum serovar 3 str. ATCC 700970
MAKRDYYEILGVSKSATPEEIKAAFRKLAKEHHPDRNKSADDTLFKEINEAYEVLSDSKKRAQYDQFGHDGPQGFSSASGFSGFSGGFGGVDFDINDIFGSFFNNASSSHNSSNQYETYDIHLRLHLDFMEAVNGISKNINYDRKITCHKCQGTGAKDPKDVKICTKCHGRGTSIENVHSLFGTIQQEVECHECEGTGKVASSKCEQCYGKKVINERVNLTVEIPAGTREGEKLLVSKKGNIVNNQEFDLYLHISVKPSKYFALDGLDIYSETYIDPIKAIVGGIIEVVTINGIKTIEIPSNTPEGKKFRISGSGIVNKKSNIFGKKNGDFYTTIRYAKPVELSKDEIAYLKNISTRTNQNVEYYKNKVLKEISK

SEQ ID NO: 64986 - protein, 868 aa, Xylella fastidiosa Dixon
MSASPTVERWIVLKFGGTSVSRRHRWDTIAMVVRKRLEEHGTRVLIVVSALSGVTNELTAIAQGVVDSAQRVAALEQRHRDFLAELGLDAQAVLGTRFAMLSDLLQDARAVTRSLDWQAELLGQGELLSSTLGAAYLGASGVDIGWMDARDWLTALPPQPNQSEWSQRLSVSCQWKSDVEWRTRFDAQRAQVLITQGFISRHQDGGTAILGRGGSDTSAAYFGALLGAACVEIWTDVPGMFSANPKEVPDARLLTRLDYYEAQEIATTGAKVLHPRSIKPCRDTDVPMLILDTERPDVLGTRIDAEVEPVLGVKAISRRDGIVLVSMEGIGMWQQVGFLADVFTLFKKHGLSVDLIGSAETNVTVSLDPSENLVNTDVLTALSTDLSQICKVKIIVPCAAITLVGRGMRSLLHKLSEVWATFGKERVHMISQSSNDLNLTFVIDETDADGLLAVLHFKLIESGAMPVQDRAVFGSPWREIIGHVRTRVMPWWHSARMRLLAMRDEEGIGPCYVYHLPTVRERARQLNSVAAVDQRYYAIKANPHPAILRTLIEEGFGLECVSLGELRHVFAVVPHLVPSRVLFTPSFASRVEYEQAFLLGVNVTLDNVEALRLWPEVFRDRTLWLRIDLGYGDGHHEKVTTGGKTSKFGLSVKRIDEFIDVAKTLNITVTGLHAHLGSGVERGNHWSRMYDELAGFASRIGSVSTLDIGGGLPIPYRPDDEPFDVGAWGASLAEVKALHPKFQLVIEPGRFLVAEAGVLLTRVTQVIEKDDILRVGLEAGMHTLIRPALYDAWHGVENLSRLDETPHVLCDVVGPICESSDVFGRRRRLPAATASGDLMLIADAGAYGFSMASTYNLRGLPAEVVLDA

SEQ ID NO: 64987 - protein, 550 aa, Pseudomonas putida GB-1
MYVYDEYDQRIIEDRVKQFRDQTRRYLAGELSEEEFRPLRLQNGLYIQRFAPMLRVAVPYGQLNATQVRTLAKIARDYDKGYAHISTRQNVQYNWPALEDIPDILAELATVQMHAIQTSGNCLRNTTTDQFAGVAADEIIDPRPWCEIVRQWTTFHPEFAYLPRKFKIAINGSQEDRAAIEVHDIGLEPVRNAAGELGFRVLVGGGLGRTPVVGSFINEFLPWQDLISYLDAILRVYNRYGRRDNKYKARIKILVKALTPEVFAEKVEAEMVHLRGGSTTLTEDEVQRVSRHFVDPQYLALDNVDYAAQDAEYPGFARWRSRNTRAHKRPGYVAVTLSLKPTGVAPGDLTDKQLDAVADLAERYSFGFLRTSHEQNIILADVEQRQLHALWLELREGGFATPNIGLLTDIICCPGGDYCSLANAKSIPIAESIQRRFDDLDYLFDIGEIDLNISGCMNACGHHHVGHIGILGVDKKGEEFYQVSLGGNAARGASLGKILGPSFAQDAMADVIEKLIAVYVEQRTEEERFIDTYQRIGIDPFKERVYAANH

SEQ ID NO: 64988 - protein, 379 aa, Arabidopsis thaliana
MEYGEEPSIKRFLMLPDDLVFNCLARVSRLHYPTLSLVSKKFRFLLASKELYQTRILLGGTESCLYVCVRLHTDSEQLHWFIIYQGPNSSKKVLVPISSPNFTSAALPGFVVVGHEIYAIGGGSENKNASINATGSKTYNALSSVMVMDSRSHTWREAPSMRVARVFPSACTLDGRIYVTGGCENLNSMNWMEIFDTKTQTWEFLQIPSEEVCKGSEYLSISYQRTVYVGSREKDVTYKMHKGKWRGADICLNHGWSLDPSSCCVIENVFYRCSLGDVRWYDLKKREWAALKGLEGLPTFTNYYRNFKSADHCGKLAISWEEYVLVDDETKIWCAEIAIQKRQNGEIWGTLEWFDNVFISSGPNRHVDLLVNALTATVW

SEQ ID NO: 64989 - protein, 510 aa, Arabidopsis thaliana
MTMISDLSKDLVEEILSKAPITSLGAVRSTHKQWNALSKGRLLYKAEAKDQFLGFMVMDHRFLSMIFHLNGILKGDGEGFDRPSIREVGDIVNQIDISKVFQCDGLVLCVPSDNSSVVVWNPYLGQTKWIEAREPHDESDMFALGYDKDKNHKILRLYDECYYYYEVYNFKTESWGEEDHLPGWDIDSYNRGVSLNGNTYFLTQEQRAKDKYRVFLLCFNFTTEKFENFIAMPFKYHRKYVGTLSCVGNEKLAALYQRWDTGEMAIWVTTKIESNEVLWSNLFKVDMKPLVRFGFQQCKDEAGSFFIDEEKKLAVVFNLDKKRGKRNNKTRCYHTAYIIGEKGYLKKEVLGEAVEVRKDVYRSALVCSSSYVPSLEKINQIEEEEEDKCKSIKMVDTKRQRKKRKRKSKSCFFIDEEKKLAVVFDLAESKRCKTANAYIIGDSYTELMVFSCYVPSLVQIDDPIARRDKRERNRKWMSKRKEKKRKGTNKQQGLTPMKKKQEVHLLLINR

SEQ ID NO: 64990 - protein, 329 aa, Helicobacter pylori J99
MPILFDCNATAIQVLRDEASALLESVKQFQEPNDLEAIVKLILKSQEKGGKLVIVGVGKSALVAQKIVASMLSTGNRSAFLHPTEAMHGDLGMVEKNDVILMISYGGESLELLNLVSHLKRLSHKIITFTKSPTSSLSKLGDYYLSLKIKKEACPINTAPTTSTTLTLALGDVLMACLMRAKNFSQEDFASFHPGGLLGKKLFVKVKDLLQTTNLPLIAPSTSFKDALIEMSEKRLGSAILVNDNNELVGVLSDGDVRRALLKGLSLESEVKHFATLKPKSFKNLDALLLEALEFLERHKIQLLVCVDDRNKVLGVLHLHQLLELGLKA

SEQ ID NO: 64991 - protein, 450 aa, Chlamydophila abortus S26/3
MELQKAGQMIENDFQGYPSSYQVSHFYRDKVGVIVLCGGEGRRLSPLTCWRCKPTVSFGGRYKLIDVPISHAIASGFSKIFVIGQYLTYTLQQHLMKTYFYHGVLQDQIHLLAPEGRDGSQVWYQGTADAIRQNLLYLEDTEIEYFLVLSGDQLYNMDFRRIVDYALYAKSDMVIVAQPIQEKDASRMGVLQIDKDGNLLDFYEKPQEQEILNRFRLSPADCRRHKLDPQYGNFLGNMGIYLFRRESLFQLLLEEPGDDFGKHLIQAQIQRGTVKTFLYDGYWTDIGTIESYYEANIALTQRPRPHVRGLNCYDDRGMIYSKNHHLPGTIVSDSMISNSLLCEGAVIDSSKVSHSVVGIRGVIGKNSVIDHSVVMGNDRYGNTLQTPLGIGDNCEIYKTIIDENCRIGNGVKLTNIKGYKDYDSPDGKLVVRDGIIIIPRGTRIPNNYTF

SEQ ID NO: 64992 - protein, 373 aa, Buchnera aphidicola str. Bp (Baizongia pistaciae)
MNMINYECKMQKIKLKTNLLNFDLQSMKKFFCSIGELEFRAQQVMKWIYQHYCDDFNKMTNISLQLRKKLSTLCCITPPKFLNHKVSVDGTMKWSVVIGNQCIETVCIPKNQRTTLCISSQLGCSLACSFCLTGQQGFNKNLNVSEIIGQVWYIQKLIYFSKINITNKITNVVLMGMGEPLLNLSNVVHALRIMLDEFGLNMSKNHITLSTAGIVPALKKLHTMIDVSLAVSLHASNNTIRNQLMPINKKYNIESVLCAIKKYLYYSNANKKRVTIEYVMLSGINDAAYHAEELFNLLKSIPHKINLIPWNHFSGSNYICSNDITINNFANILIKKGCIVTIRKIRGYDINAACGQLSGIVFDRKFNKINCIS

SEQ ID NO: 64993 - protein, 218 aa, Vibrio cholerae O1 biovar eltor str. N16961
MTQDEMKKAAGWAALKYVEKGSIVGVGTGSTVNHFIDALGTIKDEIKGAVSSSIASTAKLEALGIRVYDCNDVSELDIYVDGADEINPERDMIKGGGAALTREKIVAAIAKKFVCIVDGTKAVDVLGNFPLPVEVIPMARSYVARELVKLGGDPVYREGVITDNGNVILDVYNMKITHPKDLESKINGIAGVVTVGLFAHRGADVVITGTPQGAKIEE

SEQ ID NO: 64994 - protein, 87 aa, Cucumis sativus
EACHNLLFTTCFNSFGGMKIFFPNMIKWIGRAGVNLHTQLAREIRTAVKANGGKITMGAMEQMPLMKSVVYEAFRIEPPVPVQYGRA

SEQ ID NO: 64995 - protein, 320 aa, Ureaplasma parvum serovar 3 str. ATCC 700970
MNDNYLILSIESSCDETSLALFENNKLIAHKISSSASIQSLHGGVVPELASRYHEQNINHLFNEILNETKINPLTITHVAYTAMPGLPGCLHVGKVFAKQLAVLINAELVPINHLHAHVFSASINQNLTFPFLGLVVSGGESCIYLVNDYDEIKVLNQTHDDAIGECYDKIARVLGWKYPGGPIIDKNYQENLATLEFIKSQPAAKDFSFSGLKTAVINYIHNAKQKKISFDPVVVASSFQKFAINEIIKKIKYYLNLYKLNHLAIGGGVSANSLLRKKIQSLDVISYIPEMIYTGDNAAMIGAYAYALIKNHKKSILIK

SEQ ID NO: 64996 - protein, 423 aa, Desulfovibrio vulgaris subsp. vulgaris str. Hildenborough
MSQRSSELFERAQQLIPGGVNSPVRACLGVDSEPLFIARAAGSRLHTVDGETFIDFVESWGPMLLGHTHPEVTAAVHAAVDRGTSYGAPCEDEVVLAAKVVDALPGVDMVRMVNSGTEATMSALRLARGYTGRTKLVKFVGCYHGHADPFLASAGSGVATLSIPGTPGVPESTVRDTLLAPYNDLAAVKDLFALHGKDIAAIIVEAVAGNMGLVPPKAGFLEGLRELCDQHGALLIFDEVITGFRVSFGGAQQRFGITPDLTTLGKIIGGGLPVGAYGGKREIMQRIAPCGEVYQAGTLSGNPLAMAAGIATLDVLSRSDYAGLEARVAAFVKELEAILKGKGVPVRINTLASMFTVFFTNDPVTDFASAKTADGALYTSFYKQMRAQGIYLAPSPFEAAMVSFAHTDDDLAAMLDAARKVTF

SEQ ID NO: 64997 - protein, 479 aa, Haloarcula marismortui ATCC 43049
MRRDFLSGGREPRDMDNDADVDAGAIAFGTDGWRATLDVFTKPRVRMVGQAVATTLAERGASGTVAIGYDARETSPGFADELAHVLRANGFDVLLPDRDTPTPILAWTVKDRGLAGALQITASHNPPEYNGVKFIPGDGSPALPDWTAAFEENLAVLDPLPEDEWGERTEEDLIGPFHDHALDFVDTDLDDLSVAYDALYGSGRGVTDALLEAAGADVTRLNCEQDPEFGGGSPEPSAENAEGLVGEVSEGDAALGIINDGDADRIGVVTPDRGYLDPNLFFAAMYDFLLEDGTGDVVRTVSTSSIVDRVAEAHGQNVHEVAVGFKWVAEAMAEHDALFGGEESGGFGLPDHLRNKDGVLVALAAAAAEREEPLDARVDRLLDEHGEIHQDRISVDCSDDRKEPVLEDLETALPETLAGVAVDGINTVDGFKIRLEDGTWVLVRPSGTEPKLRVYAEAGSDARVGELLDAGQELVEPLV

SEQ ID NO: 64998 - protein, 191 aa, Methanosarcina barkeri str. Fusaro
MRTGRMSRKTKETDIQLELNLDGTGIADVNTGIGFFDHMLTSFARHAEFDLKVRAEGDLYVDEHHLVEDTGIVLGKVLAEALGDMAGTARFGEARIPMDEALADVALDIGGRSYLVLKAEFASPQVGQFSTQLVKHFFETLASNAKITIHASVYGDNDHHKIEALFKAFAYAMKRAVKIEGKEVKSTKGTL

SEQ ID NO: 64999 - protein, 194 aa, Candida albicans SC5314
MKLFESEHSFNYPWDQVTAANWQKYPNELASHVISVDILQREMINNNTTLRTERLIGCKQPIPKWLSFVVGGATVSYVREVSEVDLVNRTLVMKSMNLTMNNLLLVKETVIYKPDDELPHNKTVFHQSAEITAFASLSRLCDKLEDWSVERFGQNAKSGRLAFENVLNKLTLKWEENGIFENNKILQEVKNLSI

SEQ ID NO: 65000 - protein, 357 aa, Helicobacter pylori J99
MKASIYDFTLDELSQLLKPSFRAKQLYLWLYAKYKTSFKDMQNNFSKDFIAYLEQEFTLRTIEIAHVRESVDGSKKYLFKSLRDNHTFEAVLLKMKDKKIDEETNAVLEGEKYTVCVSCQIGCQVGCSFCFTQKGGFVRDLKASEIIQQALLIKEANNLPIEKALNIVFMGMGEPLNNLDEVCKAVEIFNTGMQISPKRITISTSGVADKIPILAGKNLGVQLAISLHAVDDKTRSSLMPLNKKYNIECVLNEVRKWPLEQRKRVMFEYLLIKDLNDSLDCAKKLLKLLNGIKSKVNLILFNPHEGSKFERPSLESARMFADFLNAKGLLCTIRESKALDIEAACGQLREKKLQQKI

SEQ ID NO: 65001 - protein, 244 aa, Sulfitobacter sp. EE-36
MSAQASEKPSWFRYLPFVVILAVAVIGYFALRDYLTFETLRDNREALIAFRDQHYALTILVFLGIYVMIVGFSLPGASVATITGGFLFGTVFGVLANVTGATLGAVVIFLAARMGLGEILKARMDASEGLVRKVKAGIDENQWSMLFFIRLVPVVPFFVANLIPAFLGVPLYRFVISTFLGIIPGSLVFTSIGAGLGSVFARGETPDFGIIFEPHILLPILGLCALSVLPVVLKAVTGKKELLK

SEQ ID NO: 65002 - protein, 235 aa, uncultured bacterium
GISHGIDALVVIGGDGSLTGAHLFYQEYGIPAIGLPGTIDNDLSGTDSTIGFDTACNTAIEAIDKIRDTATSHDRLFFVEVMGRDAGFIAINAGIGSAAAAILIPENKTPIETLVEKLKTRTKAKKTSNIFIVAEGGKSGSAQEIADKVKKHLPYYDIKVTILGHLQRGGAPTSFDRLLSFQMGVAAIEGLMAGKYDVMAGMINNKIVYTPIVKAIVDDKTVDEEDLRVANILST

SEQ ID NO: 65003 - protein, 128 aa, Glycine max
  misc_feature (17)..(17): Xaa can be any naturally occurring amino acid
ASSMISSPPVTTINRAXAGMAATFTGLTSMAGSPTRNTNNDITYIASNSGRVHCMHVWPPDDKKNFETISYLPDLDDAQLAKEVKYLLRKGWIPCLEFELEHGFVFREHNKSPEYYDGHYCTMWKPPI

SEQ ID NO: 65004 - protein, 320 aa, Zea mays
MDMAASGALPVVDLAPFFTDGDEGGASRARATEAVRQACRTHGFFRVVNHGVPAHLMARALEMSSAFFALPDDDKARARAAEGSEAPLPAGYARQPVHSADKNEYLLVFGPKLGFNVYPAEPSGFREAVEECYTKLTELGLLVQEVLNECMDLPPGFLTDYNSDRSFDFLAALRYFPATEEEDNGISAHEDGNCITFVIQDGVGGLEVLNDDGDWVPAEPIEGSIIVNLGDVIQVLSNNKLKSATHRVVRKPVHRHSFVFFFNIHGAKWIEPLPEFTAKIGEPPRYRGFVYNEYMQLRMRNKTHPPARPEDVVHITHYAI

SEQ ID NO: 65005 - protein, 406 aa, Burkholderia vietnamiensis G4
MSADPFVIVGAGHAARRTAEALRARDADAPIVMIGAERELPYDRPALSKDALLNDDGEQRAFVRDAAWYDAQRIALRLGTRVDAIEREAQRVRLDDGTTLPYAKLVLATGSRVRTFGGPIDAGVVAHYVRTVADARALRAQLVRGRRVAVLGGGFIGLEVAAAARQLGCNVTVIDPAARLLQRALPEVVGAYAHRLHDERGVGFQMATLPRAIRAAAGGGAIVETDRGDVHADVVVVGIGVLPNVELAQAAGLDVDNGIRVDAGCRTADRAIFAAGEVTMHFNPLLGRHVRIESWQVAENQPAVAAANLLGADDAYAELPWLWSDQYDCNLQMLGLFGAGQTTVVRGDPARGPFTVFGLGDDGRIVAAAAVNLGRDIGAARRLIAAGAMPDPQQLADPTVGLKTFL

SEQ ID NO: 65006 - protein, 175 aa, Zea mays
MRKHRIVSLVAALLILLALAVSSTRNAQEDSMADNTGTLAGGIKDVPGNENDLHLQELARFAVDEHNKKANALLGFEKLVKAKTQVVAGTMYYLTIEVKDGEVKKLYEAKVWEKPWENFKELQEFKPVEEGASGLRISPSPCASLKLKAKLQNKEPPPNMLDHAPLCNFIRLQPF

SEQ ID NO: 65007 - protein, 530 aa, Triticum aestivum
MPLSGMAIAFKASTSACTAQQLWGHPTRDQCQHGFTHLNERKSRKGSAALHARAIPGNLDLDFGDPSWKQKYQEDWDRRFSLPHITDVFDLEPCRSAFPRSTHASPRGASDASSPDKWNGYVNKDDRALLKVSDYASNTSAGAECIDPDCSWVEHWVHRAGPRKEIYYEPEEVKAAIVTCGGLCPGLNDVIRQIVFTLEIYGVKNIVGIQFGYRGFFEKGLKEMPLSREVVENINLAGGSFLGVSRGGAKTSEIVDSIQARRIDMLFVIGGNGSHAGANAIHEECRKRKLKVSVVAVPKTIDNDILFMDKTFGFDTAVEEAQRAINSAYIEARSAYHGVGLVKLMGRSTGFIAMHASLSSGQIDVCLIPEVSFTLDGEHGVLAHLEHLLETKGFCVVCVAEGAGQDLLQKSNATDASGNVILSDFGVHMQQKIKKHFKDIGVLADVKYIDPTYMVRACRANASDAILCTVLGQNAVHGAFAGFSGITSGICNTHYAFLPITEVITTPKHVNPNSRMWHRCLTSTGQPDFH

SEQ ID NO: 65008 - protein, 119 aa, Salmonella enterica subsp. enterica serovar Typhi str. CT18
MAEETIFSKIIRREIPSDIVYQDELVTAFRDISPQAPTHILIIPNILIPTVNDVTAEHEQALGRMITVAAKIAEQEGIAEDGYRLIMNTNRHGGQEVYHIHMHLLGGRPLGPMLAHKGL

SEQ ID NO: 65009 - protein, 363 aa, Vibrio cholerae O1 biovar eltor str. N16961
MTDRDYKIAVLPGDGIGPEVMAQAHKVLDAIEQKHGIRFSREEHDVGGIAIDNHGCPLPESTLRACEEADAVLFGSVGGPKWEHLPPNEQPERGALLPLRKHFQLFCNLRPAQIHQGLEAFSPLRADISARGFDIVVVRELTGGIYFGQPKGREGEGAHEKAFDTEVYHRFEIERIARIAFESARLRRKKVCSIDKANVLQSSILWREVVSEIAKEYPDVSLSHMYIDNATMQLIKDPAQFDVMLCSNIFGDILSDECAMITGSMGMLPSASMNESKFGLYEPAGGSAPDIAGKNIANPVAQILSAALMLRYSLGEEAAARDIENAVSQALAAGELTADLAGSKPALSTSAMGDKIASYILNS

SEQ ID NO: 65010 - protein, 367 aa, Cucumis melo
MPNLTPFSKLDKTFDRASELKAFDQTKAGVKGLVDSGVAEIPGIFYCPPKEASNSIPEETHLGVPVVDLGDIDKDPFKRRQVVEEIREASETGGFFQVINHGVPVSVQEEIINRVRRFFEQDSEVKKQYYTRDYTKSFIYNCNFDLFSSPVANWRDTIVTVMAPNPPNPHDLPQVCRDILFEYSKHIMKLGELIFGLLSEALGLKSTHLVDLDCNEGLRIIGHYYPSSPQPELSIGTTEHSDDTFITVLLQDNMGGLQVRQQNKWVDVPPVPGAFVINVGNLLQLITNDRFVSSEHKVLANREGPRISVASFFSTGRLPTSKLYGPIKELLSEQNPPKYKEITVREYNIYFAEKGLDGTSALPHFKI

SEQ ID NO: 65011 - protein, 228 aa, Haloarcula marismortui ATCC 43049
MKQGGSDAAKQAAGESAAEAVEDATVVGLGTGSTAAYAIRAIGQAVDAGLDVVGVPTSFQSRQLARDCGIPLADLDDVSVDLAIDGADEVASGNLIKGGGAAHAREKIVDASADRFLVVADPTKEAAVLSYPVPVEVLPMARSTVVTAVEELGGDPTLRRAERKDGPVVTDNGNLVLDCDFNSIHDPAALASDLAALPGVVEHGLFVGMADEIHVGTADGVTVRTLSK

SEQ ID NO: 65012 - protein, 434 aa, Salmonella enterica subsp. enterica serovar Typhi str. CT18
MTTPLKKIVIVGGGAGGLEMATQLGHKLGRKKKAKITLVDRNHSHLWKPLLHEVATGSLDEGVDALSYLAHARNHGFQFQLGSVMDIDREAKTITIAELRDEKGELLVPERKIAYDTLVMALGSTSNDFNTPGVKEHCIFLDNPHQARRFHQEMLNLFLKYSANLGANGKVNIAIVGGGATGVELSAELHNAVKQLHSYGYKGLTNDALNVTLVEAGERILPALPPRISSAAHNELTKLGVRVLTQTMVTSADEGGLHTKEGEYIQADLMVWAAGIKAPDFMKEIGGLETNRINQLVVEPTLQTTRDPDIYAIGDCASCARPEGGFVPPRAQAAHQMATCAMNNILAQMNGKPLKAYQYKDHGSLVSLSNFSTVGSLMGNLTRGSMMIEGRIARFVYISLYRMHQIALHGYFKTGLMMLVGSINRVIRPRLKLH

SEQ ID NO: 65013 - protein, 232 aa, Buchnera aphidicola str. Bp (Baizongia pistaciae)
MKVYKLVLMRHGESIWNELNKFTGWHDVDLSNRGVQESLKAAKLLKKHGFYFDYAYSSVLKRSIHTLWNIIKFLDQSWIPVKKSWRLNERHYGALEGLNKDDVIQKYGNDKVQQWRRSFNIAPPKISYLEKKKLAHDSRYNNINFDILPYCESLKLTTQRVLPYWLNEIFPRFQKNTKIIIVAHGNSLRALIKYLNNINDIDILNLNIATGFPIIYEFNSEFKPIQYYYLKQ

SEQ ID NO: 65014 - protein, 320 aa, Buchnera aphidicola str. Bp (Baizongia pistaciae)
MIKRIGVLTSGGDAPGMNAAIRGVVRTALSRNLEVFGIYDGYLGLYENRMILLDRYSVSDIINKGGTFLGSARFSNFFKKDIRSIAIKNMQQRNIDFLVVIGGDGSYVGAQKLTEMGFPCISIPGTIDNDVAGTDYTIGYFTALETVVEAIDRLRDTSSSHQRISIVEVMGRNCGDLTLSAAIAGGCEFIVLPEIEFTKEELVKEIKNGIKKGKKHAIVAITEYICNVEKLAKYIQRETCRETRATILGHIQRGGAPVVYDRILASRMGEYSVDILLQGFQGRCIGTINEKMVHHDISDALKNMKRPFKFDWLKTAKQLY

SEQ ID NO: 65015 - protein, 252 aa, Buchnera aphidicola str. Bp (Baizongia pistaciae)
MKKKIIIANWKLNGNIQLLQTLLKPLVNFYIRHKNKSSIKLVIMPPYVYLYPMKSIISHSSILLGSQNVDINLIGAFTGEVSINMLKDVGVSYVLVGHSERRQYHRENDVIIAKKFKIVKDSHLIPVLCIGETEHEYLSCKTEKICKFQIDAIFDLLGPSGFNNSVIAYEPKWAIGTNTIPSINFIQKILMFIQNYIFNKQNSTIKLFSLQYGGSVNEHNIIELYDVKNIDGFLVGSASLSLDFFKKLLNNC

SEQ ID NO: 65016 - protein, 321 aa, Desulfovibrio vulgaris subsp. vulgaris str. Hildenborough
MQELKARIIAEQPRFNATLATEVGTLHPLVQPVAAHVLKAGGKRLRPLLTLLVARALGYADDDIYPLACSVELLHSATLLHDDILDDADLRRGMAAAHTVFGSTATVLAGDALLALANLIVARYGDPRLTACISEAIIRTATGEIVEIAHMRGTDHGRDTYIDIITGKTAWMLRASCELGALRAGASEEAVRAAAAFGLDLGIAFQIVDDALDFADRADTGKPVGGDLREGKLTPPLIYYLETLSGPEREAFISRFRDGGFSGDDVARISAEIRALGIIERTRELAGNYIEKAAASLETLPDCPERRTLMQTLAYVQHRDR

SEQ ID NO: 65017 - protein, 448 aa, Triticum aestivum
  misc_feature (415)..(415): Xaa can be any naturally occurring amino acid
SNLSARLPTQIAARNPAAQVSRRRLLQDSNLAAPPFANAPLPPSVPVPSTGSGSFSAFSPKAAPAVNPPVTPPKSPDTPSEAGSTRSMKWLYAILIPSIALLLIIIACMLLLCRNKSVATIGPWKTGLSGQLQKAFVTGVPKLQRSELEGACEDFSNIVASYPHYTVYKGTLSSGVEIAVVSTVLASSKDWSKHSEGRFRKKIDSLSRINHKNFINLLGYCEEEEPFMRMMVLEYAANGTLYEHLHVDGCARIDWNGRMRVIMGVAYCMQYMHELNPCITHPGLQSSAILLSEDGAAKIADMSVWQEVISKEKMPKNDDASEHHEPIRADPAGNVCSFGLLMLEIMSGKPPDSEHEGSLANLAMECIKDDRSISCLLDPTLTTHKENDLDIICELIEDCIQSDPKKRPSMREVTXTKWREVLAISPEAATPRLSPLWWAELEILSVES

SEQ ID NO: 65018 - protein, 302 aa, Triticum aestivum
  misc_feature (133)..(133): Xaa can be any naturally occurring amino acid
  misc_feature (199)..(199): Xaa can be any naturally occurring amino acid
  misc_feature (229)..(229): Xaa can be any naturally occurring amino acid
MASSADPWVREYGEAARLADDVASMVADRAALPQSGPEVMRHTSAIRRKITILGTRLDSLEGMLARLPPKSITDKELNKRRDTLSNLKSRAKQMAESFNMSTFANREDLLGQSKKAADDMSRVAGLDNQGIVXLQRQIMKEQDEGLEKLEQTVAEAQNILALAVNEELDLHARLIVSFLLQSHLFLCSLDSVFTALSSXLQDDLDDHVDGTNSRLQVLFQTLVSVPYPXTLKKVSLLFDTNSSQALHELNFDANTFLMQRVQKRLAVLNKRAKGGCSCMSLLLSTVGIVMLVVIVWLLIKYL

SEQ ID NO: 65019 - protein, 368 aa, Oryza sativa
YISFLIMSEDMVSSPSLWRPPVPIKDAIEQDAITPFPKPEAPEEEEEESQGDCYRRLMSSLPVKVYGERRYLEYQATWWPESAVQAVIAIQRRFRPRPSDVLLASYPKSGTTWMKALVFAIMSRKVYPLRDHPLLRLNPHDCVVHLSGAYATGKEAVVEALPSPRIMAVHMPFSTLPASVVVDSSSGCKIVYVWRDPKDVLVSLWHYYRKLRPEEAHVSEFHDLYESFCQGDTVFGPWWDNVLGYFRASVEMPTRVLFLRYEDMLEDTASAVVAIANFVGCPFSAEEERAGVVDAIVKLCSFEELKNLDTNMSGSNGHLIKLPSSSYFRKGVAGDWVGHMTREMADRIDSIIQGKFQGSGLEIKRAST

SEQ ID NO: 65020 - protein, 458 aa, Rhodopseudomonas palustris CGA009
MASSLTPPASEPVAGLPVLSHIRKDFIWGVSTASFQIEGAANEDGRGQSIWDVYCRSGYVANNDTGDVACDHYHRYQEDVALMKTLGIQAYRFSIAWPRIFPQGTGAINEPGLAFYDRLIDALEAAGIEPWICLYHWDLPQALEERGGWMNRDIVGWFADYAWVIGERYGKRVKRFATFNEPGIFSLFSRSFGARDRSADEKLHRWIHHVNLAHGAAVDVLRETVADAKIGLVTNYQPVYPSSDKPEDVAEAKLISDYWNRAFADPQYRGEYPDLIRDAIKPYIQPGDMERIHRPLDWFGLNHYSPVYINSDPNAIVGLGWGPKPEGIPRSPIDWTIEPDAFRDTLIEISRRYGKPVYVTENGYGSNIEKPDANGEVVDPGRIGFLRDYITALDQAVAAGADVRGYMVWSLLDNFEWESGYSVRFGLIYIDYATLRRIPKASFKWFADVIRHARGTAA

SEQ ID NO: 65021 - protein, 324 aa, Arabidopsis thaliana
MFRQSMAFPPPIHGSDAPPPPQPPSVVNGIETSRRQQQQIAAASSSLVKSHPLHNFPLSDLRWAMNHANTHRLRKASSRSPLREANTGKGNLVIEEVNEASGSSFELRPEKKKGNASGVSDSAADRSATKSTTPDGRSKIFIRIRTKNNEETAVSTDIATSVAASVQVTDDSAGPAIDAEGERISDGGGQEADEFGPKTWNLRPRRPPPTKKRSIGHGGGVLKSCNGALPENKSLGTVRTESIRSRNGVDAKMATTERKEKKPRLSISLSKLEIDEDIYALTGSKPSRRPKKRAKNVQKQLDVLFPGLWMGNVSSEAYKVSEHA

SEQ ID NO: 65022 - protein, 402 aa, Arabidopsis thaliana
MSSIGGEASFFDAVAAQIIPKAVTTSTPVRGETVAKLKVAINGFGRIGRNFLRCWHGRKDSPLEVVVLNDSGGVKNASHLLKYDSMLGTFKAEVKIVDNETISVDGKLIKVVSNRDPLKLPWAELGIDIVIEGTGVFVDGPGAGKHIQAGASKVIITAPAKGADIPTYVMGVNEQDYGHDVANIISNASCTTNCLAPFAKVLDEEFGIVKGTMTTTHSYTGDQRLLDASHRDLRRARAAALNIVPTSTGAAKAVSLVLPQLKGKLNGIALRVPTPNVSVVDLVINVEKKGLTAEDVNEAFRKAANGPMKGILDVCDAPLVSVDFRCSDVSTTIDSSLTMVMGDDMVKVVAWYDNEWGYSQRVVDLAHLVASKWPGAEAVGSGDPLEDFCKTNPADEECKVYD

SEQ ID NO: 65023 - protein, 155 aa, Zea mays
MAAAAAPASVAPSPTSKAGDSRKAVVPVDVSELEKHVLAVDDSSVDRAVIARILRGSRYRVTAVESATRALELLALGLLPDVSMIITDYWMPGMTGYELLKRVKESAALRGIPVVIMSSENVPTRITRCLEEGAEGFLLKPVRPADVSRLCSRIR

SEQ ID NO: 65024 - protein, 797 aa, Clostridium difficile 630
MLVSLKWLRDYVDIDIDVKEFADKMTMTGTKVETIDYYGEEIENILVGKILEIKQHPNADKLVVTKVDIGDKVVQIVTGATNISEGDYIPVAVNGSKLPGGVEIKQTDFRGELSDGMMCSAAELGIDEHYIEEYKRGGIYILDHEDSYELGKDIKDVLGLKDALIDFELTSNRPDCKCMMGIAREAAATIGTKVKYPEIEVKESDEEIDFKVEIDNPDLCRRYVARMVTDVKIEPSPYWMQRRLTEAGVRPISNIVDITNFVMLELGQPLHAFDINQVETGRIVVRNAKDGEKLVTLDDVERTLDKDMLVITNGEKSLGLAGVMGGANSEITSNTKTVLFESANFKPENIRMTAKKVGIRSEASSRNEKDLDPNLAEIAANRAAQLVEMLGAGKVLKGVVDVYPNKPEPKKLVVNPQRINHLLGVDVPMEQFVGILESLEFKCNLVANDKLEIDVPSFRTDMEQEADVWEEIARIYGFENIPSVQLEGNTTAGIKTSKQKFMDALKDNSTAVGLNEILTYSFVSPKGVDKIRVPEGNAKRNFVKLLNPLGEETSVMRTTLIPNMLDVLSTNVSHKIEEVSAFECGHIFIPQDSELPKEENRMCVGMYGKDVDFFTLKGTIETILVNVGFKCYEIEPQDNNTTFHPGRCAKIVYNNKYVGTLGELHPDVIENYNLGQRVYVAEIDIDFVFDNSDRTKNYVPLPKYPSTSRDIALIVKDDVFVKQIEDIIKENGQGLVESYKLFDVYKGSQIEAGYKSIAYSITYRSKDKTLTDEDVAKVHDKILSELSEKLNANLRSN

SEQ ID NO: 65025 - protein, 206 aa, Ureaplasma parvum serovar 3 str. ATCC 700970
MKRPLIIGVGGPVGAGKTMLIERLTRYLSTKGYSMAAITNDIYTKEDARILLNTSVLPADRIAGVETGGCPHTAIREDASMNFAAIEEMCDKHPDLQLLFLESGGDNLSATFSPDLVDFSIYIIDVAQGEKIPRKGGQGMIKSDLFIINKVDLAPYVGANVEVMKADTLKSRGNKDFFVTNLKTDEGLKSVADWIEKRLQLALLEE

SEQ ID NO: 65026 - protein, 401 aa, Candida albicans SC5314
MYRATATSRQLVGTTANILVAKRSMAKAASDLVTIELPASSYEGYNLEVPALSFETEKETLLKMYKDMIIIRRMEMAADALYKSKKIRGFCHLSVGQEAIAVGIENAITPTDTVITSYRCHGFAFMRGASVKSVLAELMGRRSGIANGKGGSMHMFTNGFYGGNGIVGAQVPLGAGLAFSHKYKNDKAVTFDLYGDGASNQGQVFEAYNMAKLWNLPVIFACENNKYGMGTSAARSSAMTEYYKRGQYIPGLKINGMDVLATYQASKFAKDWASQGNGPLVLEYETYRYGGHSMSDPGTTYRTREEVQHMRSRNDPIAGLKAVLLEKEIASEDEIKSYDKAARKYVDEQVAAAEADAPPEAKMDILFEDVYVPGSEIPVLRGRISDDSWDFKNKTFLNKVY

SEQ ID NO: 65027 - protein, 343 aa, Oryza sativa (japonica cultivar-group)
MAAAVVARCGGAKKRKGEGLGEMHDDVLERVLARLPPASYFRLRGGEGQERRLPAVAFDAGEGEWARCGGAPGHVMPVVAASGGRVLYRAPDTGELTVANPLTGASRVLPAPPPGAALHAVAMYGSSPYRVVLITGDLPDLSMTVFDSSKNAWDDAVALSRKPDASSPERDAEGGVGGGGGGGDDETVYFLSKSGDVMATNMQRSASRQYSSAVTSPGILPVYFEYSIDVVACGGRAYVVVLSELLGTASLRLWEFAGGAWRQVAAMPPAMSHAFHGKKADVNCVGHGDRVMVCVSSGEANGCFMCDVPTNRWEELPPCAGAGGEPMDFVAAFSFEPRMEVTV

SEQ ID NO: 65028 - protein, 1061 aa, Bacillus subtilis subsp. subtilis str. 168
MKETSPIPQPKTFGPLGNLPLIDKDKPTLSLIKLAEEQGPIFQIHTPAGTTIVVSGHELVKEVCDEERFDKSIEGALEKVRAFSGDGLFTSWTHEPNWRKAHNILMPTFSQRAMKDYHEKMVDIAVQLIQKWARLNPNEAVDVPGDMTRLTLDTIGLCGFNYRFNSYYRETPHPFINSMVRALDEAMHQMQRLDVQDKLMVRTKRQFRYDIQTMFSLVDSIIAERRANGDQDEKDLLARMLNVEDPETGEKLDDENIRFQIITFLIAGHETTSGLLSFATYFLLKHPDKLKKAYEEVDRVLTDAAPTYKQVLELTYIRMILNESLRLWPTAPAFSLYPKEDTVIGGKFPITTNDRISVLIPQLHRDRDAWGKDAEEFRPERFEHQDQVPHHAYKPFGNGQRACIGMQFALHEATLVLGMILKYFTLIDHENYELDIKQTLTLKPGDFHISVQSRHQEAIHADVQAAEKAAPDEQKEKTEAKGASVIGLNNRPLLVLYGSDTGTAEGVARELADTASLHGVRTKTAPLNDRIGKLPKEGAVVIVTSSYNGKPPSNAGQFVQWLQEIKPGELEGVHYAVFGCGDHNWASTYQYVPRFIDEQLAEKGATRFSARGEGDVSGDFEGQLDEWKKSMWADAIKAFGLELNENADKERSTLSLQFVRGLGESPLARSYEASHASIAENRELQSADSDRSTRHIEIALPPDVEYQEGDHLGVLPKNSQTNVSRILHRFGLKGTDQVTLSASGRSAGHLPLGRPVSLHDLLSYSVEVQEAATRAQIRELASFTVCPPHRRELEELSAEGVYQEQILKKRISMLDLLEKYEACDMPFERFLELLRPLKPRYYSISSSPRVNPRQASITVGVVRGPAWSGRGEYRGVASNDLAERQAGDDVVMFIRTPESRFQLPKDPETPIIMVGPGTGVAPFRGFLQARDVLKREGKTLGEAHLYFGCRNDRDFIYRDELERFEKDGIVTVHTAFSRKEGMPKTYVQHLMADQADTLISILDRGGRLYVCGDGSKMAPDVEAALQKAYQAVHGTGEQEAQNWLRHLQDTGMYAKDVWAGI

SEQ ID NO: 65029 - protein, 352 aa, Arabidopsis thaliana
  misc_feature (22)..(22): Xaa can be any naturally occurring amino acid
SSSGLKTQISEKESKPIFDQSXLEWKKGKVNPFVRGIRSRLIRPKSMPLNVVNDRDGSSRILLTDPAGSTAEVLLYGGQVVSWKNERREKLLYMSTKAQLKPPKAIRGGLPISFPQFGNFGALERHGFARNRFWSLDNDPSPLPPANQQSTVDLVLKSTEDDLKIWPHSFELRVRISISPGKLTIIPRVRNTDTKAFSFMFSLRNYLYVSDISEVRVEGLETLDYLDNLMRRERFTEQADAITFDGEVDKVYLNTPTKIAIIDHERKRTIELRKEGMPNAAVWNPWDKKAKSIADMGDEDYTTMLCVDSGAIESPIVLKPHEEWKGRQELSIVSSSYCSGQLDPRKVLYGDY

SEQ ID NO: 65030 - protein, 214 aa, Brassica napus
  misc_feature (77)..(77): Xaa can be any naturally occurring amino acid
  misc_feature (200)..(200): Xaa can be any naturally occurring amino acid
  misc_feature (208)..(208): Xaa can be any naturally occurring amino acid
MTSFSAFSEMMGSENESPALSGEYCPTLAASCPKKPAGRKKFRETRHPIYRGVRQRHSGKWVCEVREPNKKSRIWLXTFLTAEIAARAHDVAAIALRGKSACLNFADSAWRLRIPETTCPKDIQKAAAEAAVAFQAEINDTTTDHGLDVEETIVEAIFTEENNDGFYMDEEESMFGMPSLLASMAEGMLLPPPSVRFEHXYDFDGDAXVSLWSY

SEQ ID NO: 65031 - protein, 404 aa, Arabidopsis thaliana
MQSLTLTRYPTPISPPRLNLYPLRQIAASVLSAPTAGINRRDMASRHQSTSFKPLAVGRNLTGDDDDGYCTLIDFAGSGGGEGKNVGEDLVVLLYHLQHACKRIASLVASPFNSSLGKLSVNSSSGSDRDAPKPLDIVSNDIVLSSLRNSGKVAVMASEENDSPTWIKDDGPYVVVVDPLDGSRNIDASIPTGTIFGIYNRLVELDHLPVEEKAELNSLQRGSRLVASGYVLYSSATIFCVTLGSGTHAFTLDHSTGEFVLTHQNIKIPTRGQIYSVNDARYFDWPEGLRKYIDTVRQGKGQNPKKYSARYICSLVADLHRTLLYGGVAMNPRDHLRLVYEGNPLAFLVEQAGGKSSDGKRGILSIQPVKLHQRLPLFLGSLEDVAELESYGDVQQTVNPGYEV

SEQ ID NO: 65032 - protein, 372 aa, Rhodopseudomonas palustris CGA009
MKPRHARHKGGTELNQSKDQYRIAVIAGDGIGKEVMPEGLRVLEAAAKKHRVKLVFDHFDFASYDYYEKHGQMMPDDWKEKIGGHDAIFFGAVGWPAKIPDHISLWGSLIKFRREFDQYVNLRPVRLMPGVPSPLAGRKPGDIDFWVVRENTEGEYSSVGGRMFPDTEREFVTQQSVMTRVGVDRILKFAFELAQSRPKRHLTSATKSNGISITMPYWDERVEAVAKSYPEVKWDKYHIDILTAHFVLHPDWFDVVVGSNLFGDILSDLGPACTGTIGIAPSGNINPEGDFPSVFEPVHGSAPDIAGQGIANPIGMIWSGAMMLEHLGEKQAADSIVKAIERTLEERTLRTRDLGGQADTSACGKGVAEMVE

SEQ ID NO: 65033 - protein, 449 aa, Burkholderia vietnamiensis G4
MAGLPIRSPVSMPLLPTTATAPFCPSEVKGSITIDARASRWMKFKRFFGPGLLVAIGYMDPGNWATDIQAGSQFGYSLLWVVAFSSLAAIFLQMLAARLGLVAGKDLAQASYDRYGRVGRLVQWVTAEVSIIACDIAEVLGCALAFKLLLGVPLAWGIVLTALDTMIVLGLQGKGVRQIEAIVLGLISTMAFCFVAQVAITPPDWHAVAKGLVPSNPGHDSKDAIVLALGIVGATIMPHNLYLHSSVVQTRHVVGGARGLIRDTLALVRIDTCVSLFVAMLVNAAILIVAGAAFHATGQHNVTDIEQAYRLITPIAGGAAALLFGIALLASGQSSTLTGTIAGQVIMDGFLHTKIPCYQRRLITRGLALVPALIGVLWLGDGSVGQLLVWSQVVLSLQLPFAMWPLIRSVSDRGTMGEHAIGRGMQALAWALFAVIGGTNLLLITGVAS

SEQ ID NO: 65034 - protein, 674 aa, Burkholderia vietnamiensis G4
MRHQLHAERRVRVKFGHPRRGRLRRTVRPTPPRGLAILAHRASADRRAAAAVAAHHDRSRFHDSRFFTPRRQACLHHGRRGRARPRDRAPDGRAGRARIPDRHRRRHGARCVRGRAERRARGAGRVRRDAGRARRGALAGAARAGRRGAGRPVGAGQQRGRRIDRRADADRARRVATRDGDQRREHRARLQARAVVPRRERRGVDHQHLVGGRVQGRAGLHRVQRVEGRGRVADEVGRDRLRAPRTRRALQLDSPGVHSHGHRRAAVPVARRARRDAQARTRHPAAPPRRAGRRRACGRLSGVRREPLHDGRRARARRRHVRGVTRTDQPLPEENLVSTLVNRQLLLKTRPEARVGREHFSLVETPVAALADGEVLVRVLYLSMDPTNRVWMSDVPQYLPPVAIGEVMRALGIGRVVASRHADFAEGDLVQGLVGWQDYARVPADQAAQLVKLPAQSGLPLPTLLGACGMSGLTAYYGLTEIAPVQPGETLVVSAAAGSVGSIAGQIGKIHGARVVGIAGGADKCRYLTDTLGFDAAVDYKADDFREQLKAATPDGVHVNFENVGGDVMRAVLSRMVIGGRVALCGVISTYNSGRAADDVGVLISKRLTMRGFLILDYRKSCEAVQTLAGWLRDGRLKAEETVADGLENAPDVLNRLFDGDHRGKLVLRVDPQA

SEQ ID NO: 65035 - protein, 466 aa, Bartonella henselae str. Houston-1
MDYKQNSENNPKKKLQRGLHNRHVQLIALGGAIGTGLFMGSGKTISVAGPSIILVYAIIGCALYFVMRAMGELLLSNSRYRSLIDFSTDMLGPGIAFFVGWSYWLSWVVTGAADIIAIITYMHFWWPTLNSWIIVFSCVIFFLTLNLLAVKMFGELEFWFGLIKVLAILALIVVGFYMICTGFTSPNGTVASLSHVWNDGNIFPRGIPGFFAGFQIAIFSFGGIEIAGTTAAEVKEPKKVLPKAINAIPLRIVLFYIFSLVVIMSVTPWDQVVPEKSPFVSMFWLAGIPIAAGLINFVVLTSAASSANSGIFSTSRMIYGLATQKGAPRFFGKLSKYHVPANALFFSCLCILLGYTIASSSPSIISAFTIVSSIPAIAFLFVWSVILVSYIVYRHNHPHLHTESVYKMPGGVITCGIILAFFAFMLYLLTLESDTLTALKYSIFWFIFLGITYFMFIRKKTAQDNK

SEQ ID NO: 65036 - protein, 526 aa, Oryza sativa
  misc_feature (510)..(510): Xaa can be any naturally occurring amino acid
MERVLKDDAVEEKGERARMAAFIGAMAIADLVKTTLGPKGMDKILQSTGRGRSVTVTNDGATILKSLHIDNPAAKVLVDISKVQDDEVGDGTTSVVVLAGELLREAEKLVNMKIHPMTIIAGYRMAVECARNALLERTMDNKENIDKFRSDLMNIAMTTLSSKILSQDKEYFAELAVDAVLRLKGSTNLEAIQILKKPGGSLKDSFLDEGFILDKKIGLGQPKRIENAKILVANTAMDTDKVKIYGARVRVDSMAKVAEIEAAEKQKMREKVQKIIGHGINCFVNRQLIYNFPEELFADAGILAIEHADFEGIERLALVTGGDIASTFDNPESVKLGHCNVIEEIMIGEDKLIHFSGVAMGQACTIVLRGASEHVLDEAERSLHDALCVLSQTVNDTRVLFGGGWPEMVMAKAVDDLARKTPGKKSHAIDAFSRALQAIPTIIADNAGLDSAELISQLRAEHHKENCTAGIDVITGSVGDMQKRGISEAFKVKQAILLSATEAAEMILRXVDEIITCAPRRREDRM

SEQ ID NO: 65037 - protein, 374 aa, Arabidopsis thaliana
MTMTAFLARRLIGNGSSQILGTSSSSSGPFISVSRAFFSSSTPIKATLFPGDGIGPEIAESVKQVFTAADVVIDWDEQFVGTEVDPRTNSFLTWDNLQSVLKNKVGLKGPMATPIGKGHRSLNLTLRKELNLYANVRPCYSLPGYKTRYDDVDLITIRENTEGEYSGLEHQVVKGVVESLKIITRKASMRVAEYAFLYAKTHGRKKVSAIHKANIMQKTDGLFLQCCDEVAAKYPEIYYEKVVIDNCCMMLVKNPALFDVLVMPNLYGDIISDLCAGLVGGLGLTPSMNIGEDGIALAEAVHGSAPDIAGMNLANPTALLLSGVMMLRHLKLNKQAEQIHSAIINTIAEGKYRTADLGGSSTTTDFTKAICDHL

SEQ ID NO: 65038 - protein, 250 aa, Arabidopsis thaliana
  misc_feature (136)..(136): Xaa can be any naturally occurring amino acid
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFELEHGFVYREHGNSPGYYDGRYWTMWKLPFGSGCTDXSAQVLKGKWKSARREYPHAFIRIIGFDTPRQSVDQFHCQKPPSLPVNSLCFWVTSNFIPHLDFNPCFPAFPSFWVLFPDLRLFSGGKLIHRIPRAEEKNRKVKKKKKKSGGGPN

SEQ ID NO: 65039 - protein, 141 aa, Euryale ferox
FSEEQEALVVKSWGVMKKDAGQLGVKFFAKIFEIAPSAKRMFSFLRDSDLPLEQNPKLKPHALSVFAMTCESAVQLRKAGKVTVRESSLKDLGATHFKYGVVDEHFDVRFAFSRSVFSSIRDLFQPEMKIAWGEAYDKLAA

SEQ ID NO: 65040 - protein, 233 aa, Triticum aestivum
  misc_feature (217)..(217): Xaa can be any naturally occurring amino acid
MRARFKGPAGTGILELPDDATVQALFDEIRMKTGISKFGVRYGLPMAMKSLEATQGDQIARSLGLHGETLTIFSEESSSAPVETVPTGTPQSQVTASKTSKKNESPEDVNVPWPQREGTLLLRVMPSDNSCLFTAFGGALQNQLSAQNLRRMMADYILQHPEEYSEAVLGSPPSQYCRSIQDPDRWGGGIELSILSSIFDIQICTFDVQTQSKIEFXEEKQDRCILVYSGIHY

SEQ ID NO: 65041 - protein, 147 aa, Euryale ferox
MGSIGFSEEQEALVKEAWELMKPNVQELGLKMFFLSWADVAGGAGMFYFLKDQNEIPRNNPQLRSHVVKVFTMTCESAAQLHKNGKVEAVGSTLKKMGAIHLKKGVQESHFEVIKVAFLKVVKEAVEEKWSEEMGAAWAEAYDKLAA

SEQ ID NO: 65042 - protein, 468 aa, Silicibacter sp. TM1040
MSKDAVLKLIKDEEAEYVDIRFTDPRGKLQHVTLMSDQVDEDFLDEGFMFDGSSIAGWKSIEASDMKLIPDTESAYVDPFYAEKTICIHCSVVEPDTGEAYERDPRGTAEKAEAYLKASGIGDVAYMGPEAEFFLFDDVRFSNSINKVSYEVDATDASWNTDAEYETGNMGHRPGVKGGYFPVNPVDESQDLRSEMLSTMKRLGMKVDKHHHEVASCQHELGLIFDSLTKQADELQKYKYVIHNVAHAYGKSATFMPKPIAGDNGTGMHVNMSIWKDGKPLFAGDKYADLSQEALYFIGGILKHAKTLNAFTNPSTNSYKRLIPGFEAPVLRAYSARNRSGCVRIPWTESPKAKRVEARFPDPAANPYLAFAALLMAGLDGIKNKIDPGEAMDKNLYDLPAEELADIPTVCGSLREALESLAADHDFLLQGDVFTKDQIEGYIALKMEEVETYEHTPHPVEYQMYYSC

SEQ ID NO: 65043 - protein, 444 aa, Xylella fastidiosa Dixon
MNHSRSHALFVQAQTRIPGGVNSPVRAFRSVGGEPFFVARADGPYLFDVDGHRYIDYVGSWGPMIVGHNHPGVREAVQVAISNGLSYGAPCAAEVTMAETIARLVPSCQMVRMVNSGTEATLSAIRLARGATGRNYIVKFEGCYHGHGDSFLVKGGSGMLTLGLPSSPGVPAELSKLTITLTYNDFDAATALFEEMGHHIAAVIVEPVIGNANCIPPRPGYLQHLRTLCTQYGVLLIFDEVMTGFRVALGGAQALYGVTPDLTTFGKIIGGGMPVGAYGGRRDLMQHIAPAGPIYQAGTLSGNPVAMAAGLAMLELIQAPDFYTHLSNAAAALCTGLQQAASQAGIAMTTQQIGGMFGLFFTDQQVETYAQATACNTDRFNRFFHAMLQRGVFFAPSAYEAGFISSAHSPNIIEATLEAARTAFQTIANEAAILSKSETPIKMR

SEQ ID NO: 65044 - protein, 528 aa, Silicibacter sp. TM1040
MVEVVTAQQMRALEQAAIASGAVTGCELMECAGNAVVAAILEHWPEFAGRADGGAAPRPAAVPRDISEKLKRAVVLCGPGNNGGDGFVVARLLKLRGWAVEVFFYGDAAKLPADAKVNYQRWCALGDVHRLDAATLASGTKVQHADLVVDALFGTGLTRPVDLPLGVICEVARNVVAIDVPSGLCSDSGRVIGAAAVQADLTVTFHAQKLGHVLAEGPQHCGTVRVASIGLEGHELPVAAVPTVSFDAPDHADLAKGSGAHKFSYGHALILSGGAGQTGAARLAARGALRIGAGLVTLGVSPAAQMEVAGHVTAVMLRRVEGADGLEAVLQDARINALCLGPGLGHERARALVPVALAAGRATVLDADALSAYSDAPDALFDQLHKNCVLTPHGGEFARLFPDLAQRLAEPATRGPAYSKVDATRDAAARAGCTILFKGADTVIADEAGDCAIHDAAGARAAPWLATAGAGDVLAGFITGLLARGLAAHDGATTGAWLHADCARQFGPGLIAEDLPEQLPHVFRKLGL

SEQ ID NO: 65045 - protein, 375 aa, Methanosarcina barkeri str. Fusaro
MTQYKIPVLPGDGIGPEIIAEGRKVIDAAGERFGFDVEWIEYPQGADHYLETGELISEDTLKELSGYPAIYLGSIGDPRIAPGVLEKGILLTARFYFDEYVNLRPIKLLDGVWTPLKDKTSKDIDFVVVRENTEDFYVGVGGRAKKGASKDLLEVKRTLYSAKFGLDIETDSEEIGYQIGLISKEGTDRVIEYAFDLAENRRKHVSSVDKANVLSDIYGFWREEFNAISAKHPGVTTDFNFVDAVTMWFVKNPEWFDVVVTPNMFGDIITDLGAMIQGGLGLAPGGNINPTGTSMFEPIHGSAPKYKGQNKVNPIATIWAGAMLIEHLGEKEAADTIVNAIQKNILDSKVKTYDMGGKSTTSDVGDDIARIIKGE

SEQ ID NO: 65046 - protein, 424 aa, Oryza sativa (japonica cultivar-group)
MPPRALPPVEDDAGRDWLGDLPEEVLHHIMSFLDARQAVRTCVLSRRWRNLWRTVPCINADFDEFDLVFYQGDDEDYDDVLAFKRFVNRLLELRDPTAMIDTFWLRYTTRPEGNTNSNEDAYGWISHALQKQARVLEVVVFCCLFELDHSVFTSCYLRRIAFSGIVLCKGFFAQLEAGCPALEDLFLHQCGVHDDEISSHTLKVLTFDSVFFYMPMDTVEFTLLNKTSISLPSVTSLTISTPEGFTPILKDTASVVTASVSVSVTMSSFRFRFDANDLGQYLQSLSGITNLEFNYQGSKLTIENHLQWCPEFLNVVNLTLGQWCLDSNFYALIVFLQNSPRLQKLTLKLEKSNMRISRRIIGELTEISFTCEHLNTVEVICSENDPQVITVQDFFVSSGMTSVQFHIKHWSPYANDLPAFIRSI

SEQ ID NO: 65047 - protein, 329 aa, Magnetospirillum magnetotacticum MS-1
MSGSASGFVLVADIGGTHARFALVGEDGEAVNPVVLRCADYDGPAPAIKAYLSDQGAGAAPRRGAFAVASVIDGDRIELTNSPWRFSISETQRAVGLERLEVVNDFTAVALSVRHLKPEHLLTIGGGAAQAGLPIAVLGPGTGLGVSALIPGESGRWTALATEGGHVTMAAASEREARILDRLRTQFDHVSAERVLSGQGLVNLYQAVAALSGHQAVFSTPDVITKRGLDGSCPISREAVETFFAMMGTVAGNLALSLGAKGGVFIAGGILPRMADAFRASSFRTRFEAHGRFQPYLAAIPTWLITHPLPAFVGLAGLIRPKADHRTLA

SEQ ID NO: 65048 - protein, 529 aa, Triticum aestivum
  misc_feature (132)..(132): Xaa can be any naturally occurring amino acid
  misc_feature (435)..(435): Xaa can be any naturally occurring amino acid
  misc_feature (477)..(477): Xaa can be any naturally occurring amino acid
  misc_feature (505)..(505): Xaa can be any naturally occurring amino acid
MVAMMVERWAGFGSAAATVIFLWPVVQKYVPPTFRLYLTAWAAKLAACFNPYLQITISEYGAERFQRSDFFLAVEAYLSDACTRRARKLKAELVKDSKNLRVTVDDHEEVTDDFSGTTIWWYASQRQSKANXVISIYPGEDERRFYQVVFHRRHRDLVVDSYLPLRAWVRARAVTVKNRQRRLFTNNASRNWNPYRSKSVWSHVAFEHPATFDTLAMHPDEKEAVVDDLMAFQESKDYYAKVGKAWKRGYLLYGPPGTGKSTMIAAMANFLDYDVYDLELTAVKNNTELRKLFIETTGKSIIVIEDIDCSIDLTGKRRKDKKASSDKDSDDDDKPKLPMDPEKDDATKVTLSGLLNFIDGLWSACGGERIIIFTTNHKDKLDPALIRRGRMDKHIEMSYCRFEGFKVLAKNYLDVIEHELFGEIQRLLEETDMSXPADVAENLMPMSKKKKRDPDLCLSGLVKALKQAKEDAAAAAXKAKEEEEAKEAEAKKAKEKEEAEVKKAXEENKGKDKAAEEANGDIKEGDKVK

SEQ ID NO: 65049 - protein, 382 aa, Xanthomonas oryzae pv. oryzae KACC10331
MSAGGNVCAAARFIGDAKRTSPMHATIKRPGASVCRQHPYRVTITYGESRVSSTGLDPHAAAPQPTPTPPRSGLAARIGSLRRWVDSQTDEPLDEARADRIDWLRALPFIALHLACLAVFWVGASWFAVGMAVALYALRMFTLTGFYHRYFSHRAFKTSRVLQFVFAAIGATCVQRGPLWWAAHHRNHHRHTDTGRDPHSPAQHGFWWSHTGWFLTPRNFRTDWDVIPDLRRFAELRFLDRFDIVMPALLALGLYLLGDWLAVAAPALKTNGAQLLAWGFAISTVALFHATFTINSLAHRFGSQRFDTRDDSRNNWLLALLTFGEGWHNNHHFFPGSVRQGLRWWEYDVTWYGLTAMSWVGLVWDLKPMPKRLTQRAERVRQ

SEQ ID NO: 65050 - protein, 330 aa, Mycobacterium avium 104
MTQSAKPSPDIHRRLYALMVLMKTADDRLSRGIGTGEFLCVYWPSRGQEAIAAAMGVSLRPDDQLVTTYRGLHDLIGKGVGLEEIYGEMMGRTIGAGRGKGGTMHIAKPEVGVMLSTGIVGAGPPVAVGLAMAARRKGLDRVTVVSFGDGATNTGSFHEAANMAALWDLPIVFVCQNNRYAEMTPTTDTMKLEHVADRAAGYGMPGVRVDGNDPLAVTAALEEALRRARAGSGPTFLECETFRFRGHYFGDRMPYIPADQLQAALAADPVPRFRRRLAETGVCGEAELARIDDDAAAAVEAALRTVLGADSPAADELDRDVYAAPIPFPT

SEQ ID NO: 65051 - protein, 213 aa, Brassica napus
  misc_feature (156)..(156): Xaa can be any naturally occurring amino acid
  misc_feature (170)..(170): Xaa can be any naturally occurring amino acid
  misc_feature (179)..(179): Xaa can be any naturally occurring amino acid
  misc_feature (181)..(181): Xaa can be any naturally occurring amino acid
  misc_feature (184)..(185): Xaa can be any naturally occurring amino acid
MAATTSSSDDPPEPKTPTQLIPSLPDDVALNCLARVSRCDHPNLSLVSKSFRSLPKSPLLYSIRSLANATENILYVAIRVPPETGARWFTLLRRAATNSHLLVPIPSCPFPSLVGSAYAVVGSEIYVIGGSVKDVPSSSVWVLDCKFHTWRRVNNXEGKGREFAAGWRDXKGKIYVDRXGXVVXXNWARSSNWAEGCDVKAQTWEAVASPAVE

SEQ ID NO: 65052 - protein, 435 aa, Streptococcus pyogenes MGAS315
MSLPKEFINTYQAILGKELEDFLASFNQEPVNAFRINPLKNQLKTFEHPIPNTLWGYYGKLSGKSPEHVSGLVYSQEPAAQMVAQVAAPQKGSRVLDLAAAPGGKSTHLLAYLDNTGLLVSNEISKKRSKVLVENIERFGARNVVVTNESADRLAKVFSHYFDTIVFDGPCSGEGMFRKDPDAIQYWHHGYPAECAKLQKSILEDALAMLKPGGELIYSTCTWAPEENEDVVQWLLETYTFLELVDVPKLNGMVSGIGLPETARMYPHRYQGEGQFVAKLKDKRQEGQSTKLKAPKSNLIKDQLRLWKMFEKDHLNLTLSGTLQTFGDYLYLLPDGLPALDGLKIARNGLELGVFKKKRFEPSYALGLALKPDEVRSSIELREEDFRPYVSGNVITLPQSYPTGWYQLLINGNGLGFAKVVDKTIKNNFPKGLRF

SEQ ID NO: 65053 - protein, 271 aa, Sporobolus stapfianus
NEVEEEGEEFAAYCRRGKGRRRVEMEDRHVAKVALGGDPKAALFGVFDGHGGKNAAEFAAENMPKFVAEEMTKADGGESEIEGAVKRGYLKTDEEFLRRGESGGACCVTAVLQKGGLVVSNVGDCRAVLSRSGKAEALTSDHRASREDEKERIENLGGFVVNYRGTWRVQGSLAVSRGIGDAHLKQWIVADPDTRTLLVDQHCEFLILASDGLWDKIDNQEAVDLARPLCTSNDKASRMAACRMLVETSISRGSTDDISVVIIQLQNFSSS

SEQ ID NO: 65054 - protein, 236 aa, Brassica napus
KMLKKKLTVDEIHDIHGLRLIVDNEKDCYKALGVVHKLWSEVPGKLKDYITHPKFNGYKSLHTVVMGDVPIPLEVQIRTKEMHLQAEFGFAAHWRYKEGDCKHSSFVLQMVEWARWVVTWHCETMSKDRSSICSSEPLCSFPSHAEDCPFSYKPNGNQEGPVYVIVIENDKMTVQEFPASSTVSDLLSRAGPGSSRWSMYSMPAKEELRPRLKQTPVSDLKCKLKMGDVVELTPAI

SEQ ID NO: 65055 - protein, 450 aa, Arthrobacter nicotinovorans
MLATLASATSEDAVAALEAACAAQTSWARTAPRVRAEILRRAFDLVTARSEDFALLMTLEMGKPLAEARGEVAYGAEFLRWFSEETVRDYGRYLTTPEGKNKILVQHKPVGPCLLITPWNFPLAMATRKVAPAVAAGCTMVLKPAKLTPLTSQLFAQTMMEAGLPAGVLNVVSSSSASGISGPLLKDSRLRKVSFTGSTPVGKRLMSDASRHVLRTSMELGGNAPFVVFEDADLDKAVEGAMAAKMRNMGEACTAANRFLVQESVAQEFTRKFAAAMGALSTGRGTDPASQVGPLINNGARDDIHALVTAAVDAGAVAVTGGAPVDGPGYFYQPTVLADVPNNAAILGQEIFGPVAPVTTFTTEQDAIKLANASEYGLAAYLYSRDFNRLLRVAEQIEFGMVGFNAGIISNAAAPFGGVKQSGLGREGGSEGIAEYTTTQYIGIADPYEN

SEQ ID NO: 65056 - protein, 210 aa, Alkalilimnicola ehrlichei MLHE-1
MPELKDLLANNQAWAERKQREDPAFFQRLAREQKPEYLWIGCSDSRVPASEIVDMPPGELFVHRNIANVVTHADVNCLSVLQYAVDVLKVRHIIVCGHYGCGGVKAALSNQYVGFVNNWLRHIEDVYHLNEGQFRDLPEERQVDLLCELNVQQSVRNVCRSTVVQQAWQRGQPLSVHGWIYGLASGRLKDLGLHFHGPECLPVIDRLAMD

SEQ ID NO: 65057 - protein, 558 aa, Clostridium difficile 630
MGFKSDIEIAQEAKPQDIREVAKKLGLGEDDVELYGKYKAKVDYNLLKRETGKKAKLILTTAINPTPAGEGKTTTTIGVADAFAKLDKNVLVALREPSLGPVFGVKGGAAGGGYAQVVPMEDINLHFTGDFHAIGAANNLLAAMLDNHIHQGNALRIDPKKITWRRCVDMNDRQLRNIVDGMGKKGDGAVRQDGFDITVASEIMAAFCLASDISDLKERLGNIIVGYSYEGEPVTARQLKANGAMAALLKDALKPNLVQTLEGTPSFVHGGPFANIAHGCNSVIATRMAMHFADYVITEAGFGADLGAEKFLDIKCRMANLKPDAVIIVATVRALKYNGGVAKADLNNENLEALEKGLPNLLKHVENITQVYGLPAVVAINRFPLDTEAELKLVEDKCKELGVNVALSEVWAKGGEGGIAVAKEVLRLLDEEENNFRFCYEDDLSIKDKINAIATKIYGADGVDYTPEADKEIANLEKLGFTKVPVCMAKTQYSLTDDQTKLGRPTGFRITVRQATISAGAGFIVALTGEIMKMPGLPKVPAAEKIDVDENGVIAGLF

SEQ ID NO: 65058 - protein, 400 aa, Rhodopirellula baltica SH 1
MWGAATMMGDFVALHLPPRFSTFTMHSSRKLSVLWFVSLFCLSLAFAPASSADDEKKPGDKQESAPAEKAAEVKEAAKSEKPAQKDEDKKPEAKKEEKKPEAKKPEPKKADKKADKAEMKEEKKEDKKPEEKPVVKSVFPDKALESAVRAEVFAKRHNDEPITAEDVAKISRVVGTGKGIQSLEGLQHCKSLMLIDLADNKIEDLSPIADLKRLQSVTLANNKIASLDPVAELVAMQLLDVSGNELTSLDPLAKMSNLRTLYVADNKLTSLDPLAGLTKIWSLDAAGNELTSLDPVAKLGWLTTLEISDNKITSLAPLTSLKDLDMLIAPGNPFANLKPLVDMCRADVEGDRRFAPYLNVYLSPAQMKHADWSDDLAALKQLGVRLHEYERKKSGESSNP

SEQ ID NO: 65059 - protein, 149 aa, Oryza sativa (japonica cultivar-group)
MEQSFIMIKPDGVQRGLIGDIISRFEKKGFFLRGMKFMNVERSFAQQHYADLSDKPFFPGLVEYIISGPVVAMVWEGKDVVATGRRIIGATRPWEAAPGTIRADYAVEVGRNVIHGSDSVDNGKKEIALWFPEGLAEWRSNLHPWIYES

SEQ ID NO: 65060 - protein, 429 aa, Magnetospirillum magnetotacticum MS-1
MFDPTERGTAIDIEVNERLRRTLALILAGGRGARLMDLTDWHAKPAIPFAGKFRIVDFTLSNCINSGIRRIGVLTQYKAHSLLQHIQRGWGFLRGEFNEFIELLPAQQRTQGEDWYKGTADAVFQNLDIIRAHRPEHVLILAGDHVYKMHYGKMLAHHLAAGADVTVGCIEVPLETAKGFGVMAADEDDRVIRFDEKPANPQPMPGHPDQALASMGIYIFNYQLLHDLLIKDSTSAETSHDFGKDIIPALVKSHRVIAHHFQDSCVMHEGAREHYWRDVGTIDAYWEANIDLTTVTPALNLYDESWPIWTDQPQSPPAKFVFDSEHRRGMAVDSLVAGGCIVSGAVVRRSMLFSNVRVNSFCVVEDAVILPNVDIGRHARLKRCIVDQGAVVPPGLVVGEDAALDASRFHRTEKGITLVTAERLKLLGA

SEQ ID NO: 65061 - protein, 351 aa, Zea mays
MAGSDEVNRNECKGAVPIHTWVLISNFKLAYNMLRRADGTFDRDLAEFLDRRVPPDARAQEGVSSSDHVIDTSTGLEVRIYRAAANNGGAGAAAVTLPILDFLGGGPSPDPFPVILFFHGGSFAHSSSGTAIYDNLCRRFVKLSKGVVVSVNYRRAPEHRYPCAYDDGWAALKWAMSQPFLRSGGDGRPRVFLSGDSSGGNIAHHVAVRAADAGINICGNILLNAMFGGTERTESERRLDGKYFVTLQDRDWYWKAYLPEDADRDHPACNPFGPNGRRLRGLPFTKSLIIVSGLDLTCDRQLAYAEGLQQDGHHVKVVYREKATVGFYLLSNTDHYHEVMEEIGDFLAANL

SEQ ID NO: 65062 - protein, 316 aa, Oryza sativa
  misc_feature (34)..(34): Xaa can be any naturally occurring amino acid
  misc_feature (63)..(63): Xaa can be any naturally occurring amino acid
  misc_feature (248)..(249): Xaa can be any naturally occurring amino acid
MASPPTASASASEAAESGRRSAPGPIDVPSPRDXPAPLLDRRDTPRVVHVEGTTMQRQRGEAXGAAPAAAAPYPEVNLVTGDGGYVLEDVPHVCDYLPDLPTYSNPLQDNPAYSVVKQYFVNPDDTVCQKAIVHKDGPRGNHFRRAGPRQRVFFESDEVHACIVTCGGLCPGLNTVIREIVCGLYDMYGVSRVLGIQGGYRGFYACNTIDLSPKSVNDIHKRGGTVLGTSRGGHDTMKIVDSIQEIRXXHNITIYCNLVGDGTQRGAGVIFEEIRRRGLKVAVAGIPKTIDNDIPVIDRSFGFHTAVEEAQRAINA

SEQ ID NO: 65063 - protein, 181 aa, Arabidopsis thaliana
LLKNQYSTKERRRFFFLLPFLNESTQQKDLCFTNNTFVESSNISEYDIGEESDLFRAPDPILEEPILTVDPLSAALTMISCGEDTSQGLCELPDLGSLQSGQQLLDKAFYECEQDLMMKSAMESPFSDVLDIKNISVVTTINENQDMQKSVSSGNLSSMDWSHAQQETVMIQKFPDFDFGM

SEQ ID NO: 65064 - protein, 250 aa, Sporobolus stapfianus
MPMRNIAVGNTQEVTHPGALKAALAEFISTLIFVFAGQGSGVAYSKLSGGITTPSSLISAAVAHAFALFVAVSVSANISGGHVNPAVTFGAFLGGNISLFRSILYWIAQLLGSIVACLLLRFVTGGLPTGTFGLTGISVWEALVLEIVMTFGLVYTVYATAVDPKKGSLGTIAPIAIGFIVGANILVGGAFDGASMNPAVSFGPSLVSWSWNNHWVYWVGPFIGAALAALIYDMLFISSHTHEQLPTTDY

SEQ ID NO: 65065 - protein, 474 aa, Xanthomonas oryzae pv. oryzae KACC10331
MERPRSDAPMPEPSSTTAPQFRRSMQVRHLVMLSLGGVIGTGLFFNTGYIIASTGALGTVLAYLIGALVVYLVMQCLGELAVAMPQTGAFHVYAARYLGPATGYVVAWLYWLTWTVALGSSLTAAAFCMQYWFPHSPAWPWCLLFCALIFGLNTVSARWFAEGEFWFSLIKVITILVFIVLGGAAVIGLLPLADGSPAPGLRHLRADGWFAHGTLPILMTMVAVNFAFSGTELIGVAAGETEQPARAIPLAIRTTLMRLVVFFVGTVLVLAALLPAEQAAVETSPFVRAFELLGIPYAADLLNVVILTAILSAANSGLYAAARMLWSLANEGTLPSGLTRLTGRGIPLRAVSLSMLGGLLALLTGVYAADTVFVAISAVSGFAVVVVWLSICASHYVFRRQLLRDGVAPETLAYRARWYPWTPILGFSLCLLACIGLAFDPQQRIALWCGVPFVALCYGAYALTQRLAARRLHA

SEQ ID NO: 65066 - protein, 208 aa, Zea mays
MDPKLVEVTQLFDRFKASNFDVCATLLSQLKVLLTKFPSLPPLFQQTPNAVEELKLAREIYEQAVILSVKMEDQDAFERDFCQLKPYYMDTCGIIPPSSVEYPIMGANLLRLLVQNRIAEFHTELELLPTKALDNAYIKHGVELEQSFMEGAYNRVLSARQTAPHETYIYFMDLLVKTVRDEIAGCSEKGYDYLSINDAKQMFKFSSD

SEQ ID NO: 65067 - protein, 113 aa, Triticum aestivum
MGCAGSTLKPEDNGKKLKKPKPWKHTQAITPAQLRQMRDEFWDTAPHYGGQKEIWDALRAAADSDLALAQTIVDSAGIIISNSDMTLCYDERGAKYELPKYVLSEPTNLIKDG

SEQ ID NO: 65068 - protein, 422 aa, Pseudomonas putida
MNANDNVVIVGTGLAGVEVAFGLRASGWEGNIRLVGDATVIPHHLPPLSKAYLAGKATAESLYLRTPDAYAAQNIQLLGGTQVTAINRDRQQVILSDGRALDYDRLVLATGGRPRPLPVASGAVGKANNFRYLRTLEDAECIRRQLIADNRLVVIGGGYIGLEVAATAIKANMHVTLLDTAARVLERVTAPPVSAFYEHLHREAGVDIRTGTQVCGFEMSTDQQKVTAVLCEDGTRLPADLVIAGIGLIPNCELASAAGLQVDNGIVINEHMQTSDPLIMAVGDCARFHSQLYDRWVRIESVPNALEQARKIAAILCGKVPRDEAAPWFWSDQYEIGLKMVGLSEGYDRIIVRGSLAQPDFSVFYLQGDRVLAVDTVNRPVEFNQSKQIITDRLPVEPNLLGDESVPLKEIIAAAKAELSSA

SEQ ID NO: 65069 - protein, 760 aa, Corynebacterium glutamicum ATCC 13032
MSLERNTQKSSMGVRSMSARLARSLTGNRVRTNPVLDPLLSIHRQFHPRADVQVLERAYDTAERLHDGVIRKSGDPYITHPLAVATIAAEIGMDTTTLVAALLHDTVEDTDYSLDDLTRDFGEEVARLVDGVTKLDKVALGAAAEAETIRKMIVAMSQDPRVLVIKVADRLHNMRTMRFLPPEKQAKKARQTLEVIAPLAHRLGMASVKWELEDLSFAILYPKKYEEIVRLVADRAPSRDRYLKEIIDQVTGGLRENNIAAGVLGRPKHYWSIYQKMIVRGRDFDDIFDLVGIRILVDNVNNCYAAIGVVHSLFNALPGRFKDYISAPRFGVYQSLHTTVMGPGGKPLEVQARTHDMHYNAEFGIAAHWRYKETKGSHSGEQAEVDQMAWMRQLLDWQKEAADPNEFLDSLRYDLTSKQIFVFTPKGDVVNLPVNSTPVDFAYAVHTEVGHRCIGAKINGKLVALETKLKSGDRVEVFTSKDQNAGPSRGWQEFVVSPRAKAKIRQWFAKERREEYLEAGRDALAAVIQRGGLPMHRLFTASSMKTVATELHYPDVDALYTAIGSGSVSAQHVVNRLMAIFGDEEDAEDALVARTPFSELVNSRATTESSTGILVEGSPDVMAKLAKCCMPVPGDEIFGFVTRGGGVSVHRTDCTNVEKLKEEPERIVSVSWASEGQGSVFSATLQLEALDRAGLLFELTRVINEQKVSVTAMNSHCSEDRVATVRFTFAVSDTKQLGSLMTQLRNAEGVFDVYRVTSGG

SEQ ID NO: 65070 - protein, 547 aa, Methanosarcina acetivorans C2A
MKNTFILGIEGTAWNLSAAIVTETEIIAEVTETYKPEVGGIHPREAAQHHAKYAASVIKRLLAEAKEKGVEPSDLDGIAFSQGPGLGPCLRTIATAARMLSLSLDIPLIGVNHCIAHIEIGIWRTPARDPVVLYVSGANSQVISFMEGRYRVFGETLDIGLGNALDKFARRAGLPHPGGPKIEACAKDAKRYIPLPYVIKGMDLSFSGLSTASSEALKKASLEDVCYSYQETAFAMVVEVAERALAHTGKNEVLLAGGVGANTRLREMLNEMCEARGAKFYVPEKRFMGDNGTMIAYTGLLMYKSGNTLTLEDSRVNPNFRTDDVNVTWIKEEEMKKVPEISPEAFLRAPPGERLDNGAEAVIYLDEGPEGKKVLVKERVPKLYRHKEIDERIRRERNRTEARLISEARRAGVPTPIIYDIEEFKLKMQFIEGVPIKYLITPELSEKVGELVGRLHSSGIVHGDLTTSNLLLAGERLYLIDFGLAYFDKSLEARGVDVHVLFQTFESTHRGHETLVKAFEKGYGSTFIDSKDVLKRVEEIKKRARYA

SEQ ID NO: 65071 - protein, 392 aa, Bradyrhizobium japonicum USDA 110
MSKSSSLNKVFADLPVTIFEAMSQAARDNAAINLGQGFPDDPGPEDIRRAAADASLNGYNQYPSMMGLPELRQAIATHYGHWHGLKLDPMSEVMVTSGGTEALTSAILAVVQPGDEVVCFQPVYDSYLPIIRQAGGIPRLVRLEPPHWRLNEDMLKSVFNSKTKAVLFNNPLNPSAVVYPREDLELLARYCQEFDVIAICDEVWEHVTFDEHKHIPLITIPGMRERTIKVGSAGKIFSLTGWKIGFVCAAPPLLRVAAKVHQFLTFTTAPNLQAAVAYGLGKSDDYFLSMRKDLTRSRDRLTKGLESLGFPVLKSQGTYFLTVDLSPLGLNESDTEFCWRIVKDYKVAAIPVSAFYEQDPVTSVVRFCFAKKDQTLDTALERLSDAVRGRKR

SEQ ID NO: 65072 - protein, 588 aa, Haloarcula marismortui ATCC 43049
MAHKKEEYKAELYGDEVREKLEEFAEKGWDSIPEDEREKWFSRFKFWGVFHHRGGQESYFMMRLTNCGGVLEPDQLRAIGEVARDYAKGPAENPEFGNGWIDFTTRQSIQLHWLKLEDIPEIWEKLEAVGVSSRSAGGDTMRNISGCPVAGKAEEYVASRPILDEIQETIRDDNDLSNMPRKFNISVTGCKQGCAQDSINDIGLEPAHKFIDGEEIEGFNVRVGGGLGGREPREARPLDLFIRPEHAVETVRAFVEYYHEAGNRQNRSKNRARFFVDEHGTDAIREELDERLDFEFETAGTDFRGEYTYNAGKSAEHGAHDHVGVYDQQDGKNYVGLSVPVGRLSAEDTIELADLADAYGSGEVRLTRRQNPVIMDVPDGNISNLLNEPLLDKHSPEPNPFVQGAMACTGTEFCSLALTETKARMARLLRWLGDNVDVPDDVDRIKMHFSGCTADCGQAMTADIGLQGMRARKDGQMVEAVDIGVGGGIGAEPTFIEWVRQRVPADEVPGMIANIVEAYAALRSEGQTFREWVDATGHETIVELAEPEEVEGYTDPCLADGKQSWYPFDDGESPAPTDAEGQPISADD

SEQ ID NO: 65073 - protein, 701 aa, Haloarcula marismortui ATCC 43049
MPNWTNGRRDGAWAAVSDWVPTTCMRCAVGCGHMHQGADEGYGIDAVRGDAAHPVSQGLACARGLRESKDPDGEWLTRPMVRSDGELRQTQWDVALARAVEGLQAVHQQDPDAVAVLGSGQQTNEAAYALGKVARGGFGTTNYDANTTLCMASAVTAYYQSFGSDAPPCTYADISDADRHVVWGANPAVAHPVLFRWVQQSADEDGVEIIVVDPVRSETAENAEHHVAPDPGKDLALARAVLARIVETGRVDREFVDEATDGFEDLLATLPDADDAADEAGIEMAEVDLLADAMDQQALIYWGMGINQHVQGTETARALIDLTLATGNLRPGGGPFSLTGQANSMGTRICSSKGTWPGQRAFEDPDHRRLVADHWDVPVDRLPDDTGPGPVGMLEGEPEAVWAVATNPVAGMPESESVRETLEDAFVVVQDAFHTETTEIADVVLPAATWGESDGTTTNMERTISRVRSATDVPSGVRSDLDIIATIGSRLFPGLFESTSPNPSAVFDEFTALTEGTVADCSGITYERLDDSHAVRWPAPDDDSAGGYRYYDDESWSFPTSSGRAQFSTGRQGTLPEPTDDDYPLTLTTAREADGYNTGVRSRGGEAGALVARIHPETVAEHSELVTDETLTVETRRGSATVDIDRDAGVPRGMVWLPIHHPATNRLTLSDRDPQSDEPNFKQCAARLVAAEAELSPATAD

SEQ ID NO: 65074 - protein, 445 aa, Haloarcula marismortui ATCC 43049
MNHEQSRALYDRALSVLSGGVNSSVRATRPYPFFVEKGDGGHVIDADGNRYIDFVMGYGPLLLGHSLPEQVQSAIQQHAAEGPMYGAPTEVEVELAEFVTRHVPSVEMLRFVNSGTEATVSAVRLARGYTGRDKIVVMQSGYHGAQESTLVEGEGDHTAPSSPGIPESFAEHTLTVPFNDEEAAHEVFEEHGDDIAAVLTEPILGNYGIVHPVEGYHDTLRQLCDDHGSLLIFDEVITGFRVGGLQCAQGAFDIDPDITTFGKIVGGGFPVGAIGGKSEIIEQFTPAGDVFQSGTFSGHPVTMAAGLETLRYAAEHDVYGHVNDLGERLRAGLQDILEDQAPEYTVVGRDSMFKVIFTRDGPDSLEGQCEAGCQQQESCPRFEYCPKTGHDVTQAETERWERLFWPAMKDQGVFLTANQFESQFICDAHTGEDIENALEAYKEAI

SEQ ID NO: 65075 - protein, 218 aa, Escherichia coli
MKEIIDGFLKFQREAFPKREALFKQLATQQSPRTLFISCSDSRLVPELVTQREPGDLFVIRNAGNIVPSYGPEPGGVSASVEYAVAALRVSDIVICGHSNCGAMTAIASCQCMDHMPAVSHWLRYADSARVVNEARPHSDLPSKAAAMVRENVIAQLANLQTHPSVRLALEEGGSLHGWVYDIESGSIAAFDGATRQFVPLAANPRVCAIRLRQPTAA

SEQ ID NO: 65076 - protein, 435 aa, Fusobacterium nucleatum subsp. nucleatum ATCC 25586
MNIKKVAINLISQVDRGAYSNIALNETFKTLNVNSKEKAFITEIFYGVIRNKKFLDYIIEKNTKEIKKEWIRNLLRISIYQITFMDSDDKGVVWEGTELAKKKYGIPISKFINGTLRNYLRNKDLELKKLYDEKNYEVLYSIPKWFYDILEKQYGDNNLKQAITSLKKIPYLSVRVNKLKYSEEEFEEFLKERDIQIIKKIDTVYYVNSGLIINSEEFKTGKIIAQDASSYLAAKNLDAMPNELVLDICAAPGGKTAVLAENMKNMGEIIAIDIHQHKIKLIDTNMKKLRIDIVKAIVMDARNVNKQGRKFDKILVDVPCSGYGVIRKKPEILYSKNRENVEELAKLQLEILNSAADILKDGGELIYSTCTITDEENTNNIKKFLEERKEFKVEKLYIPKNVLGDYDSLGGFCINYKEEIMDNFYIIKLKKGEKC

SEQ ID NO: 65077 - protein, 385 aa, Methanosarcina barkeri str. Fusaro
MYSDRINALPPYLFATIDEAKDELIARGVDVIDLGVGDPDLPTHPHIVEAMREAVCDPKTHQYPSYAGMPEFRKAAADWCKKYKGVELDPATEVLALIGSKEAVAHIPLAFVNPGDVVLYTDPGYPVYKIGTMFAGGEPYPLPLTAENNFLPDLDSIPENILKKAKLFFFNYPNNPTAATADMQFFEKVVKFCKKYDIIAVHDNAYCQMTYDGYESPSFLAANGAMDIGMELYSHSKTYNMTGWRLGFAVGNKDLIMGLGKVKSNVDSGVFDAIQIAGIAALCSSQTCVEETTKIYQERRDALIEGLKAMGLKVKLPKATFYIWAPVPEGFTSMSFAKLLLEEAGIIATPGVGFGEAGEGYIRFALTKSVERIREAVERMKKLKF

SEQ ID NO: 65078 - protein, 969 aa, Medicago truncatula
MLPLLFFLLLLQPLTILSLNQEGLYLHQFKLSLDDPSSSLSTWNNNNPTPCTWSGITCDPTNTTVTKINLSNFNLAGPLQTSTLCRLTNLTTLILTNNLINQTLPLDISTCTSLTHLDLSNNLLIGTLPHTLTHLPNLRYLDLTANNFSGSIPTSFGTFPKLEVLSLVYNLLESSIPPSLANITSLKTLNLSFNPFLPSPIPPEFGNLTNLEVLWLSSCNLVGNIPHSFGKLKKLSVFDLSMNSLEGSIPSSIVEMTSLKQIEFYNNSFSGELPVGMSNLTSLRLIDISMNHIGGEIPDELCRLPLESLNLFENRFTGELPVSIADSPNLYELKVFENLLTGELPEKLGKNGPLIYFDVSNNKFSGRIPVSLCERGALEELLMIHNEFSGEIPGSLGECRTLTRVRLGFNKLSGEVPAGFWGLPHVYLLELVDNLFSGSIGKTIGGAGNLSQLTLTNNNFSGVIPEEIGLLENLQEFSGGNNRFNSSLPESIVNLHQLGILDLHKNNLSGELPKGIQSLKKLNELNLAGNEVGGKIPEEIGSMSVLNFLDLSNNRFWGNVPVSLQNLKLNQMNLSYNMLSGEIPPLMAKDMYRDSFIGNPGLCGDLKGLCDVKGEGKSKNFVWLLRTIFIVAALVLVFGLIWFYFKYMNIKKARSIDKTKWTLMSFHKLGFGEDEVLNCLDEDNVIGSGSSGKVYKVVLRNGEAVAVKKIWGGVRMETESGDVEKNRFQDDAFDAEVETLGKIRHKNIVKLWCCCTTRDCKLLVYEYMPNGSLGDLLHSNKGGLLDWPTRYKIALASAEGLSYLHHDCVPPIVHRDVKSNNILLDEDFSARVADFGVAKAVESNGKGTKSMSVIAGSCGYIAPVTGRKPIDPEFGEKDLVMWACNTLDQKGVDHVLDSRLDSFYKEEICKVLNIGLMCTSPLPINRPAMRRVVKMLLEVGPESQTKSSQKDGKLSPYYYDDGSDHGSVA

SEQ ID NO: 65079 - protein, 256 aa, Archaeoglobus fulgidus
GSHHHHHHGSHMDEKLLKTIAESKYLVALTGAGVSAESGIPTFRGKDGLWNRYRPEELANPQAFAKDPEKVWKWYAWRMEKVFNAQPNKAHQAFAELERLGVLKCLITQNVDDLHERAGSRNVIHLHGSLRVVRCTSCNNSFEVESAPKIPPLPKCDKCGSLLRPGVVWFGEMLPPDVLDRAMREVERADVIIVAGTSAVVQPAASLPLIVKQRGGAIIEINPDETPLTPIADYSLRGKAGEVMDELVRHVRKALS

SEQ ID NO: 65080 - protein, 1275 aa, Schizosaccharomyces pombe
MRGRGIDVNSSHYPHISRPRTSSDSQKMYTRAPVDYYYIQENPYFNNIDQDSISDKSLPSTNQSLHHSEEDTESDNDFSESIHPEFDIDVFYKVSNILYDESDLQDPEKRERLEWHSMLSSVLKGDVMQTEKRRLRLTEPDGHSGTYISEVWLGLQAWLHGRLNADQAEVIRKSREGVEPVLREVIDFQIQDEETTKPPLEQVTEILEKVEQCKQFYISSREMEENVPLSASKEFNYKLNALISWSNVMESIQVETLVLQKWVGNDEFDLTMRTPQFNYDGVENTSSFVERIFRQSGLQRTFEQRTLTTLNRIIHQAKQTISENAQAFEEMKLPTYEDKLLPLVRFPIKLLEEALRLRLAYAKKIKGPNFLIVDSMLDDFKIALSVAVRIKREYIKIASPSPGWSLPTNVDEDYDNVLLDSLKFYFKLLTLKLSSGNKNLYFKEIDFLENEWAFLNEHIYWINGGDIHMAGQFSYLSNSLLLNVHRYVESHLNGPTERTAASLTNWYSTLLKNTQIRFRKILRFSETLNSRFENASDFVISEGHLPDLVNRLSTTGHFLAYTANLERDGVFVIADHTLSENPEALKALLFSKDISNLETIQQNCSYVLILCPVHPIVWKGRIEKVDVPDFSVDLKTNRVRIIASNKREHLQAAKSVFQSISGDLVTLAVECRSSITRVYKEFIRLSKLCMRISSTVVDCVSAVREACSGVNCHDLIYHVFSFAAEFGQRILRFLSFDSYWQTKLKRKITSLAVEWISFICDECDLMDRKTFRWGVGALEFLMLMIRGNNILLIDDAMFLKIREKVGKSMAFLLTHFDVLGAKSKVAAKLQRESTEVSSSPRLTSFGDVEEEALSIQLLQKETMLRIDELEIERNNTLLERLAIGHVLDDSVFRNRDFIKLASSFSNITIRWQQGHFVRSGMFGDVYTGVNMETGDLLAVKEIKLQDSRTFRSTVDQIHNEMTVLERLNHPNVVTYYGVEVHREKVYIFMEFCQGGSLADLLAHGRIEDENVLKVYVVQLLEGLAYIHSQHILHRDIKPANILLDHRGMIKYSDFGSALYVSPPTDPEVRYEDIQPELQHLAGTPMYMAPEIILGTKKGDFGAMDIWSLGCVILEMMTGSTPWSEMDNEWAIMYHVAAMHTPSIPQNEKISSLARDFIEQCFERDPEQRPRAVDLLTHPWITDFRKKTIITMPPATITKKTSLSHTITEEKTAQLLAGRHVDSKAETDSLAASYKEESALPVASNVGLRQPNELRIDSINLPPAIVTPDTINYSVD

SEQ ID NO: 65081 - protein, 315 aa, Saccharomyces cerevisiae
MNRSPGEFQRYAKAFQKQLSKVQQTGGRGQVPSPRGAFAGLGGLLLLGGGALFINNALFNVDGGHRAIVYSRIHGVSSRIFNEGTHFIFPWLDTPIIYDVRAKPRNVASLTGTKDLQMVNITCRVLSRPDVVQLPTIYRTLGQDYDERVLPSIVNEVLKAVVAQFNASQLITQREKVSRLIRENLVRRASKFNILLDDVSITYMTFSPEFTNAVEAKQIAQQDAQRAAFVVDKARQEKQGMVVRAQGEAKSAELIGEAIKKSRDYVELKRLDTARDIAKILASSPNRVILDNEALLLNTVVDARIDGRGQINSEG

SEQ ID NO: 65082 - protein, 500 aa, Arabidopsis thaliana
MAHYINIYGKRLFDIGLYLKTSVDLILQQQHVLMSQQKFTDISLCHREAPNPKLDLPDDNRLSPLTELEDIGQQSKTLGTAIHRKISEQKRVIESGSVASIVEHKRTNLSAIMATRANIPEQVRGAPLVDGLKIQNKNGAVKNRRALGDIGNLVSVPGVQGGKAQPPINRPITLSFRAQLLANAQLERKPINGDNKVPALGPKSHDRDEEEVAMSPKNKKVTYSYVLSAQSKAACGIVNKPKILDIDESDKDNHVAAVEYVDDMYSFYKEVEKESQPKMYMHIQTEMNEKMRAILIDWLLEVHIKFELNLETLYLTVNIIDRFLYVKAVPKRELQVNDLVYVTDNAYSSRQILVMKKAILGNLEWYLTIPTQYVFLFCFIKASISDPEVLHVQKKNLQASKTKSFSIQVLRKESSINSQIILPSFSSHKSIVKSDQFCKKFNLCQEVTAPASEFHLGNCEAWRETVTKLKDPETKLKLRISLKCLKVVFEYTASDACGYG

SEQ ID NO: 65083 - protein, 215 aa, Glycine max
MDSDSWISTRLSSSSRRHHYRSDLYAEESEGNDDFRAEFLCPFCAEDYDVVSLCCHIDDHHPIQAKNGVCPICGKKVGVDLVGHFTTQHGNFLRVQRKRRVRKGGSASTISILRKELQEGALQSLLGGSSYLASSNSEPDPLLSSFMFNPVVADESVSATPPSTEDALVKESSKDDFLERKPQQLQLSEEDQVEKARRFEFVQGLLMSTILDDML

SEQ ID NO: 65084 - protein, 127 aa, Alkalilimnicola ehrlichei MLHE-1
MERKTIQTDRAPAAIGPYSQAIRAGRTVYLSGQIPLVPETMQLVEGDMEAQVRRVFDNLQAVAEAADGKLADVVKLNIFLTDLSHFGLVNEIMQEYFAEPYPARAAIGVAELPKGAQVEMDAVLVLP

SEQ ID NO: 65085 - protein, 407 aa, Oceanobacter sp. RED65
MADSQYDIIIFGATSFVGDILTGYMHKTYGTNGEIKWAMAGRSESKLQAIKSKHGAQDVPHFIADASNEEQLKTLADKARVIVSTVGPYALYGEPLVKVCVESGTDYCDLTGEVQWYKRMVDKYEAKAKETGARIVHCSGFDSIPSDLGVYFTQQQAQKTFGEMCHQIDMRVAKLKGGASGGTVASMMNIAKEAAKDPKLRKELQNPYSICPSDHGFKTRQHNVGGAEFDENVDGWIGPFVMAAVNTRVVHRSNVLQDKAYGQDFKYSEAMMMGKGKKGEKRAKSMGRMLKWFMIFAAIAPTRWLLEKFVPKPGEGPSPKEQEEGMFDMRFYGQTPSGKKIIAKVVGDRDPGYGSTAKMLGQAAVCLANINKDEKAGGFWTPASIYQDDLIERLQAKSGLTFEVLGS

SEQ ID NO: 65086 - protein, 339 aa, Escherichia coli B
MKSILIEKPNQLAIVEREIPTPSAGEVRVKVKLAGICGSDSHIYRGHNPFAKYPCVIGHEFFGVIDAVGEGVESARVGERVAVDPVVSCGHCYPCSIGKPNVCTTLAVLGVHADGGFSEYAVVPAKNAWKIPEAVADQYAVMIEPFTIAANVTGHGQPTENDTVLVYGAGPIGLTIVQVLKGVYNVKNVIVADRIDERLEKAKESGADWAINNSQTPLGEIFTEKGIKPTLIIDAACHPSILKEAVTLASPAARIVLMGFSSEPSEVIQQGITGKELSIFSSRLNANKFPIVIDWLSKGLIKPEKLITHTFDFQHVADAISLFEQDQKHCCKVLLTFSE

SEQ ID NO: 65087 - protein, 716 aa, Pseudomonas aeruginosa UCBPP-PA14
MSRKRSPAPSRISEGHPFPLGATWDGLGVNFALFSAHATKVELCLFDARGEKEIERIELPEYTDEIWHGYLPDAHPGQIYGYRVHGPYEPDAGHRFNPNKLLLDPYAKQLVGRLRWSEALFGYTIGSADADLSFDERDSAPFVPKSKVIDPAFTWAERPPVRVPWDRTVIYEAHLRGLSMRHPQVPEAVRGTFAGLMNADLLAHIRRLGVTSVELLPIHGFVDDKHLLENGMSNYWGYNSIAFFAPHPAYLASGQVNEFKEMVAHLHDAGLELILDVVYNHTAEGNELGPTLCMRGIDNASYYRLMPDQRRYYINDSGTGNTLDLSHPCVLQMVTDSLRYWATEMRVDGFRFDLATILGRHPDGFDERHGFLVACRQDPVLSKCKLIAEPWDCGPGGYQVGGFPPGWAEWNDRFRDCVRAYWRGDDGMLPELARRLTASGDLYDQRGRRPYASVNFVTAHDGFTLRDVVSYDHKHNEANGENNADGSDHNLSWNHGCEGPTDDPEIRALRLRQMRNLLSTLLLSQGTPMLVAGDEFSRTQQGNNNVYCQDNELGWIDWRLDDEGRSLLAFTQRLLALRQRYPILRRGRFLVGEYNEALGVKDVTWLAPGGEEMTEEHWHDEHARCLGVLLDGRAQPTGILRSGEDATLLLILNAYHDAVSFRLPEVAEGSGWSCLLDTQRPEDPLGERYPFASEFLVGGRSFLLFELQPPGAGAEG

SEQ ID NO: 65088 - protein, 636 aa, Gibberella zeae PH-1
MTIDCKADDVGGDAGDLRTLFDEHPIPVVSPKTVSLISFKTHNELEQTSVVVDAFNTVLTNNDAAALQACFFPAQSYWKDSLALTYHLRTFRGPEVIAKNLLATKEARQCNPVWKLEGAVFVPATPALQFIDVSLSFRTESPAAACSARVLLLPTENSDEEIEWKIWILSTNLENLDIHPEDTSLLQNPGLSLAGMEKVETDVFIIGGGNSAAALSARLKCFGVESVMVERNANIGDNWALRYDCMKFHVPTSFAEMPYMNYQDEFQGDHLLSKDELADHLRQFVSCFDLNVITSAKIQSTTYNKLTNQWKIKVETPTKIITVIAKHVVQATGIGSQKPHVPILANAHDYKGIAIHSSDYRNGQRLVNQGVKSVLIVGSANTAFDVLEDCHAAGLQVTMVVRSPTYIVPLGYIKNKMSLGAYDFGVAAADRMFLTLPTEISGQLARNSFRMLALQEPDRYAALQKAGFPVLDSAEPNQALYSNLIERAGGHYVDIGGTELLAQGRADVKAGVEPVAFTGTGLRFSDGSAADADAVIWCTGYADHDVRNMAVEILGGDEGVHDENTLGPQEIAARVDATWGVDSEGEIRGMWKRHPRLENYWIIGGFTQQHRWYSRVLALQIKAELEGILPKAYRES

SEQ ID NO: 65089 - protein, 387 aa, Rickettsia prowazekii str. Madrid E
MKKILGIESSCDDTAISIITERRKILSNIIISQNTEHAVFGGVVPEIAARSHLSNLDQALKNVLKKSNTELTEISAIAATSGPGLIGGVIVGSMFARSLSSALKKPFIAINHLEGHALTARLTDNISYPYLLLLASGGHCQFVAVLGLGKYKILGTTIDDAVGETFDKVAKMLNLSFPGGPEIEKRAKLGNPHKYKFPKPIINSGNCNMSFSGLKTAVRTLIMNLKEVNDSVINDIAASFQFTIGAILSSKMQDAIRLYKQILNDYYEDINHPTKLNLKSFRKDEFNWKPLECITRPKYRIHIQNSYRSNLLNDTIVIAGGVAANKYLQEILSDCTRPYGYRLIAPPMHLCTDNAAMIAYAGLERYNNKLFSPLDFCPKAKWSLEDI

SEQ ID NO: 65090 - protein, 283 aa, Staphylococcus aureus
EIISNKYNFNYQIEHHEFGGASIDTFGEPLTEKTLNACKRADAILLGAIGGPKWTDPNNRPEQGLLKLRKSLNLFANIRPTTVVKGSSSLSPLKEERVEGTDLVIVRELTSGIYFGEPRHFNNHEALDSLTYTREEIERIVHVAFKLAASRRGKLTSVDKENVLASSKLWRKVVNEVSQLYPEVTVNHLLVDACSMHLITNPKQFDVIVCENLFGDILSDEASVIPGSLGLSPSASFSNDGPRLYEPIHGSAPDIAGKNVANPFGMILSLAMCLRESLNQPDA

SEQ ID NO: 65091 - protein, 395 aa, Rickettsia prowazekii str. Madrid E
MLSKLNKPALFALIFYPVFIISLVVKYSFDYGIGLTEIIFIIASYYINNITVGIGLHRLWSHNAYKINKYAEFVLVMLSAGTLQGPALSWASNHYKHHAKTDTDQDPHSPLKFDNKVLGFLWSHIGWMLIGSGSYKFIDRITWAKLGKNNLLKWQLKYYWKIAAFMNIVVPLFTGYLVGGTIKSAYAGFLFIGLGRFLQQQATFCVNSLCHFVGSKKYYRGTAGDIWWMALFLLGENWHNYHHAFPSDYRNGVKWYHFDVHKWIIFLMSKIGLASELERTTKVRIQAKMQETLSYLSEKQKQKLSLMQTKIDNLLENLCLKSKEIEESSLAIKEQLKKSFVEIQESLKNLAEQVSSATQITEKPSEKLLKIVNKKIIDAEQSIYKLYNQLNTLKV

SEQ ID NO: 65092 - protein, 283 aa, Staphylococcus aureus
EIISNKYNFNYQIEHHEFGGASIDTFGEPLTEKTLNACKRADAILLGAIGGPKWTDPNNRPEQGLLKLRKSLNLFANIRPTTVVKGASSLSPLKAERVEGTDLVIVRELTSGIYFGEPRYFNNHEALDSLTYTREEIERIVHVAFKLAASRRRKLTSVDKENVLASSKLWRKVVNEVSQLYPEVTVNHLLVDACSMHLITNPKQFDVIVCENLFGDILSDEASVIPGSLGLSPSASFSNDGPRLYEPIHGSAPDIAGKNVANPFGMILSLAMCLRESLNQPDA

SEQ ID NO: 65093 - protein, 283 aa, Staphylococcus aureus
EIISNKYNFNYQIEHHEFGGASIDTFGEPLTEKTLNACKRADAILLGAIGGPKWTDPNNRPEQGLLKLRKSLNLFANIRPTTVVKGASSLSPLKQERVEGTDLVIVRELTSGIYFGEPRHFNNHEALDSLTYTREEIERIVHVAFKLAASRRGKLTSVDKENVLASSKLWRKVVNEVSQLYPEVTVNHLLVDACSMHLITNPKQFDVIVCENLFGDILSDEASVIPGSLGLSPSASFSNDGPRLYEPIHGSAPDIAGKNVANPFGMILSLAMCLRESLNQPDA

SEQ ID NO: 65094 - protein, 283 aa, Staphylococcus aureus
EIISNKYNFNYQIEHHEFGGASIDTFGEPLTEKTLNACKRADAILLGAIGGPKWTDPNNRPEQGLLKLRKSLNLFANIRPTTVVKGASSLSPLKEERVEGTDLVIVRELTSGIYFGEPRHFNNHEALDSLTYTREEIERIVHVAFKLAASRRGKLTSVDKENVLASSKLWRKVVNEVSQLYPEVTVNHLLVDACSMHLITNPKQFDVIVCENLFGDILSDEASVIPGSLGLSPSASFSNDGPRLYEPIHGSAPDIAGKNVANPFGMILSLAMCLRESLNQPDA

SEQ ID NO: 65095 - protein, 283 aa, Staphylococcus aureus
EIISNKYNFNYQIEHHEFGGASIDTFGEPLTEKTLNACKRADAILLGAIGGPKWTDPNNRPEQGLLKLRKSLNLFVNIRPTTVVKGASSLSPLKEERVEGTDLVIVRELTSGIYFGEPRHFNNHEALDSLTYTREEIERIVHVAFKLAASRRGKLTSVDKENVLASSKLWRKVVNEVSQLYPEVTVNHLLVDACSMHLITNPKQFDVIVCENLFGDILSDEASVIPGSLGLSPSASFSNDGPRLYEPIHGSAPDIAGKNVANPFGMILSLAMCLRESLNQPDA

SEQ ID NO: 65096 - protein, 337 aa, Streptococcus pyogenes MGAS315
MKRIAVLTSGGDAPGMNAAIRAVVRKAISEGMEVYGINRGYAGMVDGDIFPLGSKEVGDKISRGGTFLYSARYPEFAQLEGQLAGIEQLKKHGIEGVVVIGGDGSYHGAMRLTEHGFPAVGIPGTIDNDIAGTDYTIGFDTAVNTAVEAIDKLRDTSSSHGRTFVVEVMGRNAGDIALWAGIASGADQIIVPEEEFDIEKVASTIQYDFEHKGKNHHIIVLAEGVMSGEAFAQKLKEAGDKSDLRVTNLGHILRGGSPTARDRVIASWMGSHAVELLKEGKGGLAVGIHNEELVESPILGTAEEGALFSLTEEGQIIVNNPHKARLDFAALNRSLSQ

SEQ ID NO: 65097 - protein, 1482 aa, Glycine max
MDGNNISRSISRSISRSSWKMEEVFASGRYSRRTSHVEEDEEALKWAAIEKLPTYDRLRTSIIQTFAEGDQTGVHKEIDVRKLDVNDRQQIIDKIFRVAEEDNEKFLKKFRNRIDKVGIRLPTVEVRFQNLTVEADSYVGSRALPTLPNVALNLLESALGIFGISTAKRTKLTILKNASGIVKPARMALLLGPPSSGKTTLLLALAGKLDPELRVKGEITYNGHKLNEFVPRKTSAYISQNDVHVGEMTVKETLDFSARCQGVGTRYDLLTELARREKEAGIFPEADVDLFMKATAMEGTESSLITDYTLKILGLDICKDTIVGDEMHRGVSGGQKKRVTTGEMIVGPTKTLFMDEISTGLDSSTTYQIVKCLQQIVHLNEGTILMSLLQPAPETFNLFDDIILISEGQIVYQGPRDHIVEFFESCGFRCPERKGTADFLQEVTSRKDQEQYWADKNMPYRYVTVTEFANKFKRFHVGIRLESELSVPFDKSSAHKAALVYSKNSVPTMDLFKACWDKEWLLIKRNSFVYIFKTAQIIFIAFIAATLFLRTEMHRNNEDDAALYIGAILFTMIMNMFNGFAELALTIGRLPVFYKHRDHLFHPAWTYTLPNFLLRIPISVFESLVWVGVTYYIIGFAPDASRFFKQLLLVFLIQQMAAGMFRVISGVCRTMIIANTGGALMLLLVFLLGGFILPKREIPDWWVWAYWVSPLTYGFNALAVNEMLAPRWMHPQTSSDKTTTLGLSILRNFDVYAKKDWYWIGAAALLGFTVLYNVLFTLALMYLNPLGKKQAIISEEDASEMEAGGDANEEPRLVRPPSNRESMLRSLSTADGNNSREVAMQRMGSQATSGLRKVDSANDSATGVTPKKGMILPFQPLAMSFDTVNYYVDMPAEMRDQGVTEDRLQLLRGVTSSFRPGVLTALMGVSGAGKTTLMDVLAGRKTGGYIEGDIRISGFPKNQETFARVSGYCEQTDIHSPQVTIRESLLYSAFLRLPKEVSKEEKIQFVDQVMDLVELDNLKDAIVGLPGVTGLSTEQRKRLTIAVELVANPSIIFMDEPTSGLDARAAAIVMRTVRNTVDTGRTVVCTIHQPSIDIFEAFDELLLMKRGGQVIYSGPLGRNSHKIVEYFEAIPGVPKIKEMYNPATWMLEVSSVAAEVRLGMDFAEYYKTSSLFQRNKALVKELSTPPPGATDLYFPTKYSQSTLGQFKSCFWKQWLTYWRSPDYNLVRYFFTLACALMIGTVFWRIGKNRESSADLTMIIGAMYAAVIFVGINNCQTVQPIVAVERTVFYRERAAGMYAPLPYALAQVFCEIPYVFFQTVYYSLIVYAMVSFEWKVEKFFWFFFVSFFSFLYFTYYGMMTVSITPNHQVASIFAAAFYGLFNLFSGFFIPRPKIPKWWVWYYWICPVAWTVYGLIVSQYRDIEDPLFVPGSTTQNFTVKGYIEDHYGFKSDFMGPVAAVLVAFTVFFAFVFSFCIKALNFQTR

SEQ ID NO: 65098 - protein, 497 aa, Gibberella zeae PH-1
MGSRMTPEAIKPVMLIDGQANACLIQLVGASDGNSFPLFNPATGEKVADVPEATEDDTNRAVAAAQRAFPEWSAMDPAKRGSYLKKLASLIKEHNEELALLEAKSMGRPLAEFFEGHIAASSYEHYAEAWPHIQGQASLNTPGYVTMTLRQPFGVVAAIIPWNASLLFFASKSAPALIAGNTVVVKSSEKAPLGAAKFAELIHKAGFPPGVFNVLSGHGNPSGATLASHMDVRAISFTGSSPTGRAIQEAAAKSNLKKVILELGGKSPVIIFDDADLEQAAKDTMYSIQWNSGQVCMANSRVYVQDSIADNFIQACKKALSAAKSGNPTEKGINHGPQADKVQYEKVMSYINEGKKSGTLELGGNGNLDKTGGFFVEPTIFLNTPEDAKVMKEEIFGPVVNINVIKTEEEAIEKANDTEYGLYAAVYTKNVDRAMRVTQKLNSGYVGINCTSPTTARDLPFGGYKSSGQGREGWLYSLDNFLEVKSVMMKVDSGSKL

SEQ ID NO: 65099 - protein, 454 aa, Candida albicans SC5314
MGEKKNARERLDLSQLQNTTTVSTMVTLEDLENNQQQEENVIDQEILNSSTSDIINRTKLLDNDIKVMRSESQRLNHEKTVMLERIKDNQEKINNNKQLPYLVGNVVELLNLDADKEASEQGANIDIDAARAGKSAVIKTSTRQTIFLPMIGLVDPSKLKPNDLIGVNKDSYLVLDTLPSEYDSRVKAMEVDEKPTEDYSDIGGLDKQIEELIEAVVLPMKQADKFKNLGIKPPKGALMYGPPGTGKTLLARACAAQSGATFLKLAAPQLVQMFIGDGAKLVRDAFALAKEKAPTIIFIDELDAIGTKRFDSDKSGDREVQRTMLELLNQLDGFGSDDRVKVLAATNRVDTLDPALLRSGRLDRKIEFPLPSEEARESVLKIHARKLHCDNNSVNWRELARSTDEFNGAQLKAVTVEAGMIALRNGKSIIKHEDFVEAISEVQARKSKSVNFYA

SEQ ID NO: 65100 - protein, 604 aa, Medicago truncatula
MKRKRTSIQSSTTTNSYLPDECWERIFKFIFNDDENNDRHYFYPLNSSERIKRKGKGTSVYKSSRLSISSTYSDIPEDIFNDDDPNNRNICRYLNSLSLVSKQLLSITNQIRSSLTILNPTHPFLCRLFKRFTNLNSLNLTRFHGDLDALLRKISRFSSLNITSLNLSNQPTVPANGLRAFSQKNTTLTSLTCSHIANFNSSDLFLIAECFPLLEELDISYCECCYIYPIGYHTKYYKSCFDGVEALSLALFKLRKVNLSSFPINNLSLFHLFHNCKLLEEVIMFSCDPLSGLTFVGITSALRERPTLRSFSFSPPDMKDEMFVVTQHFIDSIMSLKGLTCLDFQFMNISNNLFYCIAREGLPLTRFALRHCFGPHSYAGIFRLLSKCQGIQHLDLELLFLNDQHVLQLSSFLSGLMSINLSCCLKLTKLALYALTRNCPLLSEIKMEGIGKSMSVENSEKLVEVGVYPQLKSLYLGKNQWLSDEGIIMFASNFPNLQLLDLNCCNLLSKGICQVLRICCKIRHLNLAYCKKVKLLGMNFVVPNLEVLNLSNTKVNDKTLYMISKNCCGLLQLLLELCHNVTEEGVKHVVENCTQLREHGYLLY

SEQ ID NO: 65101 - protein, 283 aa, Staphylococcus aureus
EIISNKYNFNYQIEHHEFGGASIDTFGEPLTEKTLNACKRADAILLGAIGGPNWTDPNNRPEQGLLKLRKSLNLFANIRPTTVVKGASSLSPLKQERVEGTDLVIVRELTSGIYFGEPRHFNNHEALDSLTYTREEIERIVHVAFKLAASRRGKLTSVDKENVLASSKLWRKVVNEVSQLYPEVTVNHLLVDACSMHLITNPKQFDVIVCENLFGDILSDEASVIPGSLGLSPSASFSNDGPRLYEPIHGSAPDIAGKNVANPFGMILSLAMCLRESLNQPDA

SEQ ID NO: 65102 - protein, 527 aa, Lonicera japonica
MESSASPLSFSSLPLHLPNHRSLLLTSPKPYPCRISVRPIISSISEKPPTPSKLTTTTTPLPTRKIPGDYGLPLIGPLKDRLDYFYNQGRDDYFKSRIQKYQSTVYRANTPPGSFISNNPNVVVLLDGKSFPVLFDLDKVEKKDLFTGTYMPSTELTGGYRVLSFLDPSEPNHGKLKKLIFFLLQSRRQSVIPEFHTSFTELFESLESELASDGKANFNDPNDQAAFNFLARSLFGTNPAETNLGSDGPKLIRKWVLFQLSPLLVLGLPKLVEELVIHTFRLPPFLVKKDYQRLYDFFYNSSTFVLDEAEKTGISRDEACHNLLYATCFNSFGGMKILFPNMVKWIGRAGVKLHTELAQEIRSVIRSNGGKVTMAAMEQMPLMKSAVYESLRIEPPVALQYGRAKQDFVIESHDAAFQVKEGELLFGYQPFATKDPKIFERSEEFVANRFVGEEGEMMLKHVLWSNGPETESPGIGNKQCAGKDFVVLASRLLLVELFLRYDSFEIEVAKGPLGASVTLTSLKRASF

SEQ ID NO: 65103 - protein, 283 aa, Staphylococcus aureus
EIISNKYNFNYQIEHHEFGGASIDTFGEPLTEKTLNACKRADAILLGAIGGPKWTDPNNRPEQGLLKLRKSLNLFANIRPTTVVKGASSLSPLKEERVEGTDLVIVRELTSGIYFGEPRHFNNHEALDSLTYTREEIERIVHVAFKLAASRRGKLTSVDKENVLASSKLWRKVVNEVSQLYPEVTVNHLLVDACSMHLITNPKQFDVIVCENLFGDILSDEASVIPGSLGLSPSASFSNDGPRLYESIHGSAPDIAGKNVANPFGMILSLAMCLRESLNQPDA

SEQ ID NO: 65104 - protein, 706 aa, Bradyrhizobium japonicum USDA 110
MTALWLIVLCGVLSVVYAIWATSSVLSADAGSPRMQEIAAAVREGAQAYLRRQYTTIGIVGIVIFVLLVYFLGFYVAIGFAIGAILSGAAGFIGMNVSVRANVRTAQAATTSLAGGLELAFKAGAITGMLVAGLALLGVTLYFGFLVYSLKLAPDSRVVVDAMVALGFGASLISIFARLGGGIFTKGADVGGDLVGKVEAGIPEDDPRNPATIADNVGDNVGDCAGMAADLFETYAVTAVATMVLAAIFFAKTPILMSMMTLPLAIGGICIITSIIGTFFVKLGPSQSIMGALYKGLIATGVLSLIGIAVVIYTLIGFGKLDGVDYTGMSLFECGVVGLIVTALIIWITEYYTGTDYRPVKSIAAASVTGHGTNVIQGLAISMEATALPAIVIIAGILVTYSLAGLFGIAIATATMLALAGMIVALDAFGPVTDNAGGIAEMAGLPKEVRKSTDALDAVGNTTKAVTKGYAIGSAGLGALVLFAAYNQDLKFFVADSAHHTYFAGVNPDFSLNNPYVVVGLLFGGLLPYLFGAMGMTAVGRAASAIVEEVRRQFREKPGIMQGTDKPDYGKAVDLLTKAAIKEMIIPSLLPVLSPIVVYFLIYAIAGGGATGKSAAFSAVGAMLLGVIVTGLFVAISMTSGGGAWDNAKKYIEDGHYGGKGSDAHKSAVTGDTVGDPYKDTAGPAVNPMIKITNIVALLLLAILAH

SEQ ID NO: 65105 - protein, 197 aa, Triticum aestivum
VERAVYYRERAAKMYSSFPYAAAQGLIEIPYIATQTLIFGLITYFMINYERNLGKLLLYLLYMFLTFTYFTFYGMVAVGLTPTQSVAAVVASAFYSSWNLFSGFLIPQSRIPGWWIWFYYICPVAWTLKGIITSQLGDVDTRIVGPGFDGTVQEFIQQNLGCEQGMMGVTIAVLIAFCVLFFSVYALSIKMLNFQRR

SEQ ID NO: 65106 - protein, 215 aa, Gossypium hirsutum
QKFELSPEALYLTINLIDRFLSVKVVPRRELQLLGMRAMLISTKYEEIWPPEVNDLVCIADRAYTHEQILIMEKTILGRLEWTLTVPTHYVFLARFIKASIPDPKMENMVYFLAELGIMHYETIRYCPSMVAASAVYAARCTLKKTPAWTDTLKFHTGYTEQQLMECAKLLACFHSKAVDSRLQVVYRKYSSSLRGAVALIPACQNLLSGVVSSA

SEQ ID NO: 65107 - protein, 532 aa, Nostoc punctiforme PCC 73102
MTKAPVAPVVLVILDGWGYCEEKRGNAIVAAKTPIVDSLWAAYPHTLIRTSGKAVGLPEGQMGNSEVGHLNIGAGRVVPQELVRISDAVEDGSIALNPALVKICQEVRSRNSKLHLVGLCSEGGVHSHITHLFGLLDLAKNQQIPEVCIHAITDGRDTAPTDGVRAITMLQNYIDRTGIGRIVTLSGRYYAMDRDHRWDRVKRAYDVMTQDGVGDNRTAVEILQASYAEGVKDEFVNPIRIAPGAIEPGDGVIFFNFRPDRSRQLTQALVSPTFNGFERQQITPLSFVTFTQYDSDLPVAVAFEPQNLSNILGEVIANHGLNQFRTAETEKYAHVTYFFNGGLEEPFAGEDRELVSSPMVATYDHAPAMSAVAVTDVAIAAIQKGTYSLVVINYANPDMVGHTGQIDATITAIETVDRCLGRLLESVIKAGGTTIITADHGNAEYMLDDGGNPWTAHTTNPVPFILVEGEKVKIPGYGTNVELRSDGKLSDIAPTILEILQLPQPPEMTGRSLLKTADYELQRTRTPVQVGL

SEQ ID NO: 65108 - protein, 63 aa, Atriplex garrettii
PRPNIGIHRFAFILFKQNRRDSVNPPCNRDRFCTRKFAEENQLGLPVAAVYFNCQRETTARRR

SEQ ID NO: 65109 - protein, 358 aa, Spinacia oleracea
AAVGEAATQTKARTRSKYEIETLTGWLLKQPMAGVIDAELTIVLSSISLACKQIASLVQRAGISNLTGIQGAVNIQGEDQKKLDVVSNEVFSSCLRSSGRTGIIASEEEDVPVAVEESYSGNYIVVFDPLDGSSNIDAAVSTGSIFGIYSPNDECIVDSDHDDESQLSAEEQRCVVNVCQPGDNLLAAGYCMYSSSVIFVLTIGKGVYAFTLDPMYGEFVLTSEKIQIPKAGKIYSFNEGNYKMWPDKLKKYMDDLKEPGESQKPYSSRYIGSLVGDFHRTLLYGGIYGYPRDAKSKNGKLRLLYECAPMSFIVEQAGGKGSDGHQRILDIQPTEIHQRVPLYIGSVEEVEKLEKYLA

SEQ ID NO: 65110 - protein, 145 aa, Triticum aestivum
  misc_feature (88)..(88): Xaa can be any naturally occurring amino acid
PQAGIEDPCPARSGGRPSPSDEVVQIVHGDAAGDPTVVTVSCPNKTCLGCDLCRLVVLFGLNVHKGDMSTDDRWCYIVLGVAASRRAXAVDWDVLKERLVELRSHRAAADPPPHRPHAPPLAGKVQAHTSQRRCDCFGCSLLQRS

SEQ ID NO: 65111 - protein, 463 aa, Gibberella zeae PH-1
MKSPIPDYLNQVLENARPIEGGKPASYIETLAKADTSKVAVALAMVDGEIYSAGDDDVEFSIQSISKAFVYALAIEDAGLDKVLEKIGVEPSGDAFNSLSLERGSNRPMNPMINAGAITAHSLIGKPDWTMEQRTERILNALSLLAGRQLHVCEEVYEAELRGADRNMGIGYMLKAAGIITGDAQQIVTGYIRQCAINVNVRDLATMAATLCNAGIHPISGDRIIPQDSVRQILSVMSTCGMYDAAGDWLSRIGIPAKSGVAGGIIGALPGQMGIAVFSPKLDHRGNSVRGVAICEQLSSDMGLHMMDVSQIAQATVRTSVATIVAGDNEPNHSNCNKEILIFSLRGVVRFAGSERLTREITRVLGAPNPDDPGCGSSRHACAIVFSFRDVFSFNAVAQRIIQADITRLLLDGRTIVVIDPSGVLTIDTARAGAKLKVVKSETDARDFIGGIGCHTVSKSDEW

SEQ ID NO: 65112 - protein, 448 aa, Oceanobacter sp. RED65
MHRGAVHSRTILLESIMNKIVIVGGGAGGLELATKLGDHFGKRNLAEIHLVDANNTHLWKPLLHEVATGSLDGGIDELSYRAQAHNHHFTFHIGRMNDLDRERNEIVLSSIHDEKHEEILPERRLSYDYLVLAVGSQTNDFGTPGAQAFCSFLDSREQADRFHKVLLNTYLKANNQAQKEDQYNLNIAIVGAGATGVELAAELHNTAAQLRAYGLDYLKKEQLNVSIIEAGERILPALPPRISAAAHRELNKLGVEVQTQTFIKEVTEEGYWTSEGKLIPAQLKVWAAGVKAPEWMENLGGLETTKTNQIKVKPSLQTTLDDRIFAIGDCSFMLQPDGTPVPPRAQAAHQQASHVYKNLLRLVESRELKDFVFKDKGSLVNLSRYSTVGSLMGNLSGGSMMIEGRLARIVYVSLYRLHQIALHGYFKTLLMSLSGRINKVIRPRLKLH

SEQ ID NO: 65113 - protein, 429 aa, Rickettsia prowazekii str. Madrid E
MTNIESKIKMPRSPYVKKYNSWRIRILYSIVIGYATFYFCRQNFNIATPAIREYFGVTKTQIGWILTAASIMYGVSKACNGFISDKVNARIFMVLGLLFVGIITILIGFSDFLWLIGILWIASNWFQSMGWPPATKMLTHWFAAKELGTKWAIGATSNQIGGALAMISCGYLIDKFDWRAAFFVPGLVACVASLFLYNRLRNSPKEVGLSTVEEYKEYPPEAIGNYERLLTKQLLKMVFCNKLIWYVCLANMFVYIIRSGVIYWAPTFLKDLRNISFVNAGLQIGLYEMIGIPGALIAGILSDKLFQGRRGPIASICMILLTLLLVLFWKVPIQSELLSILILALIGFFVAGPQLLVGIAAADFSTRQAVGTANGLSGLFGYLGAAIAGVGVGWISDNYGWNGVFIFFSISALLGGVLFALTWNHSAEK

SEQ ID NO: 65114 - protein, 140 aa, Rickettsia prowazekii str. Madrid E
MTIQYTFSMIKPDVIKRNKIGQVNTYLENAGLKIVAQKMKFLTKYEAECFYDEHRARSFFNSLVEYITSGAVVLQVLKGEDAITLNRTIMGATNPAEAKEGTIRKDLGESIEANSIHGSDSENSAKREIKFFFSKSEIIE

SEQ ID NO: 65115 - protein, 159 aa, Chara vulgaris
MFNFINSLKNYSQESFRAARYIGQGFIVTLNHINRSAITVQYPYEKLITSERFRGRIHFEFDKCIVCEVCVRVCPINLPVVDWNFQQDIRKKKLKNYSIDFGVCIFCGNCVEYCPTNCLSMTEEYELSVYDRHELNYDQIALGRLPFNSFQDALVTKAS

SEQ ID NO: 65116 - protein, 283 aa, Staphylococcus aureus
EIISNKYNFNYQIEHHEFGGASIDTFGEPLTEKTLNACKRADAILLGAIGGPKWTDPNNRPEQGLLKLRKSLNLFANIRPTIVVKGASSLSPLKEDRVEGTDLVIVRELTSGIYFGEPRHFNNHEALDSLTYTREEIERIVHVAFKLAASRRGKLTSVDKENVLASSKLWRKVVNEVSQLYPEVTVNHLLVDACSMHLITNPKQFDVIVCENLFGDILSDEASVIPGSLGLSPSASFSNDGPRLYEPIHGSAPDIAGKNVANPFGMILSLAMCLRESLNQPDA

SEQ ID NO: 65117 - protein, 230 aa, Triticum aestivum
MAAAGDAGEKKMITLKSSDGEEFEVEEAVAMESQTIRHMIEDDCADNGIPLPNVNSKILSKVIEYCNKHVQAKPADGAAAGAGASDASAAAPAAPAEDDCADNGIPLPNVNSKILSKVIEYCNKHVQAKPADGAAAAAGASDAAAPAAPAEDLKNWDAEFVKVDQATLFDLILAANYLNIKGLLDLTCQTVADMIKGKTPEEIRKTFNIKNDFTPEEEEEIRRENQWAFE

SEQ ID NO: 65118 - protein, 281 aa, Medicago truncatula
MTLSSRCDVAHNDKDGIAAGLTVVELHRVPGKSKQDCFDRVHHDFHTPPQCQPRSRAKAIDSSPLHRFSISASKLLIPTGKKAGKSNILKPKSIVAQKSIENLLQRHLKVDQNHKGDIFSVLEPNIDFSTNAILPSEELCTPKQQKENQGFLQICNERSSSSSIHKKSLSRFSGSSGVKDLASPPVLKQVKNKVQHEKYVNQLRFRDLRRRAASTWTNKSVAGEGKGIRKTDVVKAAKVALVSEARDAINKFQQSQINFMGDTCSSDDDNDDDIGVEGESP

SEQ ID NO: 65119 - protein, 235 aa, Triticum aestivum
  misc_feature (209)..(209): Xaa can be any naturally occurring amino acid
APPRSSSRSACKAARSFLASSVLADGRNAALATLANLGRNSTLPAAYAHHLHTNAAASSHAYAWLAAIPAAVYMLQDQEVHAAEMERTFIAIKPDGVQRGLISEIVSRFERKGYKLVAIKLVVPSKQFAEKHYHDLKERPFFNGLCDFLSSGPVLAMVWEGEGVIKYGRKLIGATDPSKSEPGTIRGDLAVVVGRNIIHGSDGPETAKXKIALWFQPKELVSYTSNEEKWIYGVN

SEQ ID NO: 65120 - protein, 296 aa, Zea mays
GITPTPLGEGKSTTTVGLCQALGAFLDKKVVTCLRQPSQGPTFGIKGGAAGGGYSQVIPMDEFNLHLTGDIHAITAANNLLAAAIDTRIFHENSQSDKALFNRLCPANKEGKRHFADIMFRRLTKLGVSKTDPNELTPDEIRRFARLDIDPESITWRRVMDVNDRFLRKITVGQGPEEKGMVRETGFDISVASEIMAVLALTTSLADMRERLGRMVIGNSKSGEPITADDLGVGGALTVLMKDAIHPTLMQTLEGTPVLVHAGPFANIAHGNSSIVADKIALKLVGKGGFVVTEAG

SEQ ID NO: 65121 - protein, 599 aa, Salmonella enterica subsp. enterica serovar Paratyphi A str.
MKNIRNFSIIAHIDHGKSTLSDRIIQICGGLSDREMEAQVLDSMDLERERGITIKAQSVTLDFKASDGETYQLNFIDTPGHVDFSYEVSRSLAACEGALLVVDAGQGVEAQTLANCYTAMEMDLEVVPVLNKIDLPAADPERVAEEIEDIVGIDATDAVRCSAKTGVGVTDVLERLVRDIPPPQGDPDGPLQALIIDSWFDNYLGVVSLVRIKNGTMRKGDKIKVMSTRQTYNADRLGIFTPKQVDRTELKCGEVGWLVCAIKDILGAPVGDTLTSARNPAEKALPGFKKVKPQVYAGLFPVSSDDYESFRDALGKLSLNDASLFYEPESSSALGFGFRCGFLGLLHMEIIQERLEREYDLDLITTAPTVVYEVETTAKETIYVDSPSKLPPLNNIYELREPIAECHMLLPQAYLGNVITLCIEKRGVQTNMVYHGNQVALTYEIPMAEVVLDFFDRLKSTSRGYASLDYNFKRFQASDMVRVDVLINNERVDALALITHRDNSQSRGRELVEKMKDLIPRQQFDIAIQAAIGTHIIARSTVKQLRKNVLAKCYGGDISRKKKLLQKQKEGKKRMKQIGNVELPQEAFLAILHVGKDNK

SEQ ID NO: 65122 - protein, 634 aa, Xanthomonas axonopodis pv. citri str. 306
MNQPTEPLDMDVCAQEPIHIPGLIQPYGVLLVIEPADGRIVQASSTAADLLGVPMDALLGTPYTQVLELPDAQPFAVDDQPQHLLHADVRFPQRSAPTDHPWVAAWHLYPEQWLVEIEPRDARLMDVTLREALPLLRSIERDAGIDEAAVRAAKGLRSMIGFDRVMVYRFDEEWNGDVIAEARQPELEAYLGLHYPASDIPAQARALYLRNRVRQIADVRYQPSPIQPTLHPRLGTPVDLSDVSLRSVSPVHLEYLANMGVSATLVSSIVVNDALWGLISCHHYSPHFTSHAMRDATDAVTRALAGRIGALQAVGRARLESVLLTIREKLITDFNDAEHLTVDMLADMAPDLMDVVDADGVAIFHGNEISRHGSVPDAEALRRIREHLESEHHDALREDAVGALHVDAIGEVFPELADLAPLAAGFIFVPLMPQSRSALLWTRREQVQQVKWAGNPQLAKLQDIPNSRLSPRKSFDLWQQTVRGRARRWSPLHLESARSLRVLIELMERKRFQQDFTLLEASLSRLRDGVAIIERGAKGAAHRLMFVNPAFAELSQTEVADLIGCDILALLDDDAARGKVELLEEALRLGRAAYVTLPLRTRDGAPVYRQFHLEPLPSPSSITAHWLLQLRDPE

SEQ ID NO: 65123 - protein, 241 aa, Arabidopsis thaliana
MERREDHYSNYFVQSPSTVFHDPESEFQSPIRSDSAPLVLSSVNEFPRYSDFLRNSENNFLYEDDEKRLVPLGTSNSSWWIVLQIGRFNQFMLEEGVDSHGVSTKFLTFNCSTKLIIDNKSNVFGLHIHPPSIKFFFGPLNFAKAQGPKLYGLSHESTTFQLYIATTNRAMYGAGTEMNDMLLSRAGLPLILRTSIISDYRVVWNIINPKYHHKVECLLLLADKERHSHVTMIREKCRLVS

SEQ ID NO: 65124 - protein, 510 aa, Clostridium acetobutylicum ATCC 824
MAKKPVMLMILDGFGISDKVDGNAVKAASKPNFDKYFNNYPHTHLGASGLSVGLPDGQMGNSEVGHLNIGAGRIVYQSLTKITKAIEDGDFFKNAALNKAVNNVLENDSTLHLMGLLSPGGVHSHTNHLKGLLQLAKKKNVKKVFVHAFLDGRDVPPSSAKEFIKDIEDYMNEIGLGEIATVSGRYYAMDRDNRWEREELAYNAMVLGKGEEAESAIKAVDASYHDNKTDEFVLPTVIVKEGKPVATIKDKDSVIFFNFRPDRARQITRAIAEEAFDGFKRDRLNIEFVTMTEYDASFKGVDVAFGPENITNTLGEYVSNKGLNQLRIAETEKYAHVTFFFNGGVEEPNKNEDRALISSPKVATYDLKPEMSAYEVTDELLKRLDEDKYDMVILNFANPDMVGHTGILEAAKKAVETVDECLGKIVDKVLKLDGSVFITADHGNSEQMIDYSNGKPMTAHTVNPVPFVYVSNHTEAKKLNEGVLADIAPTMLQEMGLEKPEEMTGKSLFE

SEQ ID NO: 65125 - protein, 431 aa, Clostridium acetobutylicum ATCC 824 [sequence omitted]

SEQ ID NO: 65126 - protein, 345 aa, Pseudomonas aeruginosa UCBPP-PA14
MSQSTQVNRRIVLASRPHGAPTRDNFRIEQVPLPEPGAGQVLLRTVYLSLDPYMRGRMSDAPSYAPPVELGAVMVGGTVSRVEASNHPGFKVGDWVLSANGWQDYALSDGSGLARLGESPEHPSYALGLLGMPGFTAYMGLLDIGKPQAGETLVVGAATGPVGATVGQIGKLKGCRVVGVAGGAEKCRHAVQVLGFDACLDHHAADFAERLAEACPDGIDIYYENVGGKVFDAVFPLLNAKARIPVCGIVAHYNDTDLPPGPDRLPALMGTILRKRIKVQGFIIFDDYGHRYDEFQRDMSKWFADGLIQYREERVDGLENAPEAFFGLLQGRNFGKLVVRVGADA

SEQ ID NO: 65127 - protein, 1161 aa, Bartonella henselae str. Houston-1
MPKRTDIKSILIIGAGPIVIGQACEFDYSGTQACKALKEEGYRIILVNSNPATIMTDPELADATYIEPITPEIVAQIIAHERPDALLPTMGGQTALNTALSLKRMGILDRYHVEMIGANADAIDKAEDRALFRKAMAKIGLETPRSMLANATELKEENRQKYAKKRNELKTQLFGDDLDKALEKLEHDWRHTEADRKQHYIAHATAKAVQALDIIGLPAIIRPSFTLGGTGGGIAYNRSEFYEIIERGLEASPTTEVLIEESVLGWKEYEMEVVRDKNDNCIIVCSIENIDPMGIHTGDSITVAPALTLTDKEYQCMRNASIAVLREIGVETGGSNVQFAVNPENGRLIVIEMNPRVSRSSALASKATGFPIAKVAAKLAVGYTLDELKNDITGGATPASFEPSIDYIVTKIPRFAFEKFPGSSPVLTTAMKSVGEVMAIGRTFQESLQKALRGLETGLTGLDEIVIPEHAEGDEKSSIRSAIAIPSSDRLRYIAQAIRTGLPLNEIHQISKIDPWFLEQIASIIEMEERIRTHGLPQDADNLRMLKAMGFSDARLATLTGQEPDDIAALRKSLNVKHVFKRIDTCAAEFSSPTAYMYSTYEVPFAGVEHSEAQVSERKKIAILGGGPNRIGQGIEFDYCCCHAAFALRDAGFEAIMINCNPETVSTDYDTSDRLYFESLTTEDVIAILETEQQKGELLGVIVQFGGQTPLKLAKALEQHNIPILGTSPDAIDLAEDRDRFQKLLFKLNLTQPKNGIAHSVEQAHFIAHELGFPLVVRPSYVLGGRAMEIIRDERSLQNYLLESVPELVPENIKARYPNDKISQLNTLLGKNPLLFDTYLTEAIEVDIDCLCDGKETLVVGIMEHIEEAGIHSGDSACSLPVHTLSSEIVAELERQTKALAQALHVRGLMNVQYAIKDGTIYVLEVNPRASRTVPFVAKTIGRPIAKMATRIMIGETLHDALKAYGGLPSPQYKQRIAVKEAVFPFARFPGVDTLLGPEMRSTGEVMGLDYEFALAFAKAQLGAGVELPKEGTLFVSVKDEDKKHILDPVKRLIALGFSVLATSGTQKFLTNHNVEAKKINKVLEGHPHIEDAIRNRQIQLIFNTTSTASAISDSKSLRQAALMQKVPYYTTIAGAKSVAEAIEALTKSNLEVRSLQNYFI

SEQ ID NO: 65128 - protein, 357 aa, Malus x domestica
MVSSDSVNSRVETLAGSGISTIPKEYIRPKDELVNIGDIFEQEKNNEGPQVPTIDLKEIESDNEKVRAKCREKLKKAAVDWGVMHLVNHGISDELMDKVRKAGKAFFDLPIEQKEKYANDQASGKIQGYGSKLANNASGQLEWEDYFFHCVYPEDKRDLSIWPQTPADYIEATAEYAKQLRELATKVLKVLSLGLGLDEGRLEKEVGGLEELLLQMKINYYPKCPQPELALGVEAHTDVSALTFILHNMVPGLQLFYEGKWVTAKCVPNSIVMHIGDTLEILSNGKYKSILHRGMVNKEKVRISWAVFCEPPKEKIILKPLPETVSEDEPAMFPPRTFAEHIQHKLFRKSQEALLPK

SEQ ID NO: 65129 - protein, 430 aa, Petunia x hybrida
MVNAVVTTPSRVESLAKSGIQAIPKEYVRPQEELNGIGNIFEEEKKDEGPQVPTIDLKEIDSEDKEIREKCHQLKKAAMEWGVMHLVNHGISDELINRVKVAGETFFDQPVEEKEKYANDQANGNVQGYGSKLANSACGQLEWEDYFFHCAFPEDKRDLSIWPKNPTDYTPATSEYAKQIRALATKILTVLSIGLGLEEGRLEKEVGGMEDLLLQMKINYYPKCPQPELALGVEAHTDVSALTFILHNMVPGLQLFYEGQWVTAKCVPNSIIMHIGDTIEILSNGKYKSILHRGVVNKEKVRFSWAIFCEPPKEKIILKPLPETVTEAEPPRFPPRTFAQHMAHKLFRKDDKDAAVEHKVFNEDELDTAAEHKVLKKDNQDAVAENKDIKEDEQCGPAEHKDIKEDGQGAAAENKVFKENNQDVAAEESK

SEQ ID NO: 65130 - protein, 362 aa, Vitis vinifera
MVTSVAPRVESLSSSGIQSIPKEYIRPQEELTSIGNVFEEEKKDEGPQVPTIDLKDIESEDEVVRREIRERCREELKKAAMEWGVMHLVNHGISDDLINRVKVAGETFFNLPMEEKEKYANDQASGKIAGYGSKLANNASGQLEWEDYFFHLIFPEDKRDMTIWPKTPSDYVPATCEYSVKLRSLATKILSVLSLGLGLEEGRLEKEVGGMEELLLQKKINYYPKCPQPELALGVEAHTDVSALTFILHNMVPGLQLFYEGKWVTAKCVPNSIIMHIGDTIEILSNGKYKSILHRGLVNKEKVRISWAVFCEPPKEKIILKAHCQRRCLRLSHHSSHLAPFPNIFSTSSSGRPRRLYSPNEL

SEQ ID NO: 65131 - protein, 400 aa, Bartonella henselae str. Houston-1
MAFIADKLSHIKPSATIAVSQKARNLKVLGRDVITLGAGEPDFDTPENIKNAAIEAIRRGETKYTPISGIPELRQAISAKFKRENNLTYQPEQIIVGTGGKQILFNALMATLNKGDEVIIPSPYWVSYPEMVTLNGGIPVFLETKAEFSYKLQPQELEAAITHKTKWFIFNSPSNPSGAAYTHEELKKLTDVLIKYPHVYILTDDIYEHLTYEGFTFVTPAQVEPNLYDRTLTMNGVSKAYAMTGWRIGYAGGPQELIKAMDTIQGQQTSGTSSISQWAAVEALNGPQDFIAKNKTVFQTRRDLVVSMLNQAPGIECPTPEGAFYVYPSCAKLIGKKTPEGKVIAHDEDFVTALLEAESIAVVHGSAFGLGPAFRISYATSEKFLEEACSRIKHFCESLL

SEQ ID NO: 65132 - protein, 401 aa, Oceanobacter sp. RED65
MSVQRSLFDEVMVPTYNPPEIIPVSGKGSRVWDQEGREYIDFAGGIAVNCLGHCHPDVVEALQEQSQKLWHLSNVMTNEPALNLAKSLTEKTFADRVYFANSGAEANEAAFKLVRRYAIEQHGEDKTKIISFTRAFHGRTFFAVTVGGQEAYSAGFGPRPGNIVHCDFNDIEQFKALIDDDTCAVIMEPIQGEGGIIEADPHFAHEVRKLCDQHKALLVFDEVQTGVGRTGSLYAYESLGVEPDVLTTAKALGAGFPIAAMLTKEHIAACFKAGVHGSTYGGNPLACAVGLKVLDIVSDPKLLEQVTVKSERLKEGLKTIGERYDVFSDVRGKGLLIGAELKPEFHGKARELLNHGLQQGVMCLVAGPNILRLTPSLIIPDKDIDEGLTRLDAAVKCMVSV

SEQ ID NO: 65133 - protein, 559 aa, Aspergillus oryzae
MAQEYKLKDISSLADIKEMDKVESEVEGIEDGKVLVVNYEGQFHAMSPKCTHYGAPLKLGVVAPEGRITCPWHGACFNISTGDVEDAPAPKALHKFEVFEKDGAVYIKGEESTIKSGQRDPVARCSASAPEKLVIVGGGSGTFGVVEAIRELKYKGDITIISREPNLPIDRTKLSKALISDPSKIEWRPREWYESVSVETVTDEVTSVDFNKRTVATKSGKTYPYTKLVLATGGVPRTLPVEGFNDLGNIFLLRFVTDVQSILKAVGEKNKKIVVVGSSFIGMEVGNALAKDNDVTIVGQEKAPMERVLGEEVGRIIQGNLEKAGVKFKLQAGVAKATPSSSDSSKVGAVHLNDGTVLGADLVILGVGVRPATDFLKNNQAITLENDGSIRTDEHFAVPGLDNHVFAIGDIATYPYHGPGTDPKGTLTRIEHWNVAQNAGRGVARAIVHSLANSASSLQSLKPKAFIPIFWSAVGAQLRYCGNTPNGWDSLVLKGEPENAKFAAYYCKGDTVVAVATMGMDPIMVKCAELMRRKNMPSKSQIESGVDVLKVGLPEGVKI

SEQ ID NO: 65134 - protein, 331 aa, Methanosarcina acetivorans C2A
MKLAVIEGDGIGREVIPAAVEVLDAFGLELEKVSLELGYARWERTGSAISEEDIATIKGCDAVLFGAVTTVPDPSYKSVLLTIRKELDLYANVRPVKPLPGITGVTGRNDFDFIIVRENTEGLYSGIEEIGPDLSWTKRVVTRKGSERVAEYACKLAKQRKNKLTIVHKSNVLKSDKLFLDVCRQVASSHGVEYGDMLVDSMAYSLMMRPDKYDVVVTTNIFGDILSDMCAALVGSLGLVPSANIGEKYAFFEPVHGSAPDIAGKGIANPLAAILCVKMLLEWSGRGKEAALIDRAISYILEKKLITPDLGGVSTTAEVGQTVAKYVMQNL

SEQ ID NO: 65135 - protein, 391 aa, Chara vulgaris
MLIRKTNSMIVSMGPHHPSMHGVLRLIITLDGENVIDCEPVLGYLHRGMEKIAENRTIIQYLPYVTRWDYLATMFTEAITINAPEKLANIQVPKRASYIRVIMLELSRIASHLLWLGPFMADIGAQTPFFYILREREMIYDLFESATGMRMMHNYFRIGGVAVDLPYGWIDKCLDFCEYFLPKVNEYENLITQNPIFLKRVEGIGVINKEEAINWGLSGPMLRASGMEWDLRKVDHYECYDELDWSVQWEKRGDCLARYIVRVGEMRESVKIIQQALKAIPGGPYENLEARKLNTKKSTQWNDFEYQFISKKSSPTFKIPKQEHYVRLEASKGELGIFLIGDDNIFPWRWKIRPPGFINLQVLPPLVNGMKLADIMTILGSIDIIMGEVDR

SEQ ID NO: 65136 - protein, 587 aa, Arabidopsis thaliana
MGKSTKWLKNVLLGKKTSKSSGSKDKERVVSGKEVLVTSKVEESDVVSDLPSFEVAETNTVDRSGGMLETQNVGPEEISDDEIELPEGKSTDSQNVAPVQDHSLSDAERIQREIAATSVQAAFRGYLARRAFWALKGIIRLQALIRGHLVRRQAVATLFSVMGIVRLQAFARGREIRKSDIGVQVYRKCRLQLLQGNKLANPTDAYLGIKKLTANAFAQKLLASSPKVLPVHAYDTSNPNSNLIWLENWSASCFWKPVPQPKKTISRKPQNRLLVEAESAKPKKSVRKVPASNFESSSVQTSFEFEKPKRSFRKVSSQSIEPPAVEDPQIELEKVKRSLRKVHNPVVESSIQPQRSPRKEVEKPKLGVEKTRESSYPLVHETAEEPVNVCDEKKKQEISEQPEEEVHALEMEVHTPGPLETNEALDSSLVNQIDSNEKAMVEEKPSMEKDTKEEKTPKPNNKENSAGKENQKSRKKGSATSKTEREESNGHHETSPSIPSYMQATKSAKAKLRLQGSPKSAEQDGTEKATVPRRHSLPSPGNGRITSHSPRTTRLANSGDKTGNKKEKPLLSSREGNAKTTPAERKR

SEQ ID NO: 65137 - protein, 283 aa, Staphylococcus aureus
EIISNKYNFNYQIEHHEFGGASIDTFGEPLTEKTLNACKRADAILLGAIGGPKWTDPNNRPEQGLLKLRKSLNLFANIRPTTVVKGASSLSPLKAERVEGTDLVIVRELTSGIYFGEPRYFNNHEALDSLTYTREEIERIVHVAFKLAASRRGKLTSVDKENVLASSKLWRKVVNEVSQLYPEVTVNHLLVDACSMHLITNPKQFDVIVCENLFGDILSDEASVIPGSLGLSPSASFSNDGPRLYEPIHGSAPDIAGKNVANPFGMILSLAMCLRESLNQPDA

SEQ ID NO: 65138 - protein, 283 aa, Staphylococcus aureus
EIISNKYNFNYQIEHHEFGGASIDTFGEPLTEKTLNACKRADAILLGAIGGPKWTDPNNRPEQGLLKLRKSLNLFANIRPTTVVKGASSLSPLKAERVEGTDLVIVRELTSGIYFGEPRYFNNHEALDSLTYTREEIERIVHVAFKLAASRRGKLTSVDKENVLASSKLWRKVVNEVSQLYPEVTVNHLLVDACSMHLITNPKQFDVIVYENLFGDILSDEASVIPGSLGLSPSASFSNDGPRLYEPIHGSAPDIAGKNVANPFGMILSLAMCLRESLNQPDA

SEQ ID NO: 65139 - protein, 572 aa, Escherichia coli
MSMSEKHPGPLVVEGKLTDAERMKLESNYLRGTIAEDLNDGLTGGFKGDNFLLIRFHGMYQQDDRDIRAERAEQKLEPRHAMLLRCRLPGGVITTKQWQAIDKFAGENTIYGSIRLTNRQTFQFHGILKKNVKPVHQMLHSVGLDALATANDMNRNVLCTSNPYESQLHAEAYEWAKKISEHLLPRTRAYAEIWLDQEKVATTDEEPILGQTYLPRKFKTTVVIPPQNDIDLHANDMNFVAIAENGKLVGFNLLVGGGLSIEHGNKKTYARTASEFGYLPLEHTLAVAEAVVTTQRDWGNRTDRKNAKTKYTLERVGVETFKAEVERRAGIKFEPIRPYEFTGRGDRIGWVKGIDDNWHLTLFIENGRILDYPARPLKTGLLEIAKIHKGDFRITANQNLIIAGVPESEKAKIEKIAKESGLMNAVTPQRENSMACVSFPTCPLAMAEAERFLPSFIDNIDNLMAKHGVSDEHIVMRVTGCPNGCGRAMLAEVGLVGKAPGRYNLHLGGNRIGTRIPRMYKENITEPEILASLDELIGRWAKEREAGEGFGDFTVRAGIIRPVLDPARDLWD

SEQ ID NO: 65140 - protein, 283 aa, Staphylococcus aureus
EIISNKYNFNYQIEHHEFGGASIDTFGEPLTEKTLNACKRADAILLGAIGGPKWTDPNNRPEQGLLKLRKSLNLFANIRPTTVVKGASSLSPLKEECVEGTDLVIVRELTSGIYFGEPRHFNNHEALDSLTYTREEIERIVHVAFKLAASRRGKLTSVDKENVLASSKLWRKVVNEVSQLYPEVTVNHLLVDACSMHLITNPKQFDVIVCENLFGDILSDEASVIPGSLGLSPSASFSNDGPRLYEPIHGSAPDIAGKNVANPFGMILSLAMCLRESLNQPDA

SEQ ID NO: 65141 - protein, 372 aa, Blastopirellula marina DSM 3645
MKRYGFPLLLLLIASLASAESDSETVATDMLTSQPGVVSVEYLTDGAPHDSCHASTIAHTPAGFVAAWFGGTREGAKDVGIYFNRQVDGKWITPVEVANGVQYVSPTGKEHRHPCWNPVLHQAQEGPLMLFYKCGPTPSTWWGMLMTSDDSGVTWSEPQRLPEGIDGPVKNKAIEHDGRLVCPSSSENHGWRLHLEITSDQGRAWTRVGPLNDGTKIGAIQPSVLVYPNGRWQILARDRNNNGNVWSTWSDDQGITWTPLVSTGLPNPNSGTDAVMLADGRALLVYNHTHRSGPFPSGRNMLNVAVSQDGRTWEAALVLEKSAGEFSYPAVIQTPDGLVHITYTWRRKKIRHVTVDPTKLTAKPIVDGAWPQ

SEQ ID NO: 65142 - protein, 283 aa, Staphylococcus aureus
EIISNKYNFNYQIEHHEFGGASIDTFGEPLTEKTLNACKRADAILLGAIGGPKWTDPNNRPEQGLLKLRKSLNLFANIRPTTVVKGASSLSPLKQERVEGTDLVIVRELTSGIYFGEPRHFNNHEALDSLTYTREEIERIVHVAFKLAASRRGKLTSVDKENVLASSKLWRKVVNEMSQLYPEVTVNHLLVDACSMHLITNPKQFDVIVCENLFGDILSDEASVIPGSLGLSPSASFSNDGPRLYEPIHGSAPDIAGKNVANPFGMILSLAMCLRESLNQPDA

SEQ ID NO: 65143 - protein, 283 aa, Staphylococcus aureus
EIISNKYNFNYQIEHHEFGGASIDTFGEPLTEKTLNACKRADAILLGAIGGPKWTDPNNRPEQGLLKLRKSLNLFANIRPTTVVKGASSLSPLKQERVEGTDLVIVRELTSGIYFGEPRHFNNHEALDSLTYTREEIERIVHVAFKLAASRRGKLTSVDIENVLASSKLWRKVVNEVSQLYPEVTVNHLLVDACSMHLITNPKQFDVIVCENLFGDILSDEASVIPGSLGLSPSASFSNDGPRLYEPIHGSAPDIAGKNVANPFGMILSLAMCLRESLNQPDA

SEQ ID NO: 65144 - protein, 273 aa, Oryza sativa (indica cultivar-group)
MAETLDMTLDDIIKNNKKANPSSGRGRRGSAAGGGGGGGGGVGGGGGGGVGPTRRPFKRSGNRAGPYQPPKAPESAWQHDMYSDVAAGGGGGSGGGGRVSAIETGTKLYISNLDFGVSTEDIKELFSELGDLKKYVIHYDRSGRSKGTAEVVFARRGDAVAAVKKYNNVQLDGKPMKIEILGTNTPTAAAALPANNGGYVRNVAKSAPRGGPAGLPQGRSRPRGGGRRRGGGGGSGGPGGSGGRRGKERSQPKSAEELDADLEKYHADAMQTN

SEQ ID NO: 65145 - protein, 437 aa, Xanthomonas campestris pv. campestris str. 8004
MVSAGPTGPAFLVSRNYDAIYAYNAAESYALSIALLADRLRGGAGLVASWPTDDPGLGRPERRQLQQLLLARGHQIGEADGMVGTATRRAIQVEQTRLGLQPADGRAGQRILTALRTAPPVTGAAVRGTAFTLPAAYPAFVQSPIVQKASPMSDVTGLRTGDFHGFPSLLIDTPYSTAAISLFGGQLLSFVPKGGQDVMWLSPTAKQPPTPIRGGAPVCWPYFGRQDQTGDVPAHGFVRTVPWQLTESRREDDGTLVLTLTPPTFDDLALRLHMTLRIGRTLEQRLVTENVSKAPVRFTQALHNYFRVGDALKVSVQGLDGLDYLDKYENYAIAHRQQGDWSLRDPRDPGRSDRIYTNAGGHYTLTDPVLGRRIDIRTEGSRSLVAWNPGEDAASKMADVGTGWRDYVCLEAANAGPDVIELAPGASHTLGQTISVE

SEQ ID NO: 65146 - protein, 450 aa, Bradyrhizobium japonicum USDA 110
MDARSPDLTTDAAGWRTDVPTTKSLAEVNASVALPTAGVWWRRLLAFVGPGYLVSVGYMDPGNWATDLAGGSKFGYTLLSVILLSNLMAILLQSLAARLGIVTDRDLAQACRATYSPAVNFLLWLACEAAIIACDLAEVIGTAIALKLLFGIPLIGGALIAALDAFLLLLLMNRGFRFLEAFVIALLAVIAVCFAVQIVAAAPPVAEVLHGFMPKSEIFTNPEMLYIAIGIIGATVMPHNLYLHSSIVQTRAYERNETGRREAIKWATTDSTIALMLALFINAAILVVAAATFHKSGHSDVAEIGQAFELLSPLLGLGIASTLFAIALLASGLNSTVTATLAGQIVMEGFLDLRLPSWARRLLTRGIAIIPVIIVTAIYGERGTADLLVFSQVVLSMQLPFAVIPLVRFVSDRRKMGKFAISPYVAAIAWIVAGVIVVLNLKLLADTLLG

SEQ ID NO: 65147 - protein, 454 aa, Oryza sativa (indica cultivar-group)
MASTAARRLRELQGQAGNKTCVDCAQRNPQWASVSYGVFMCLECSGKHRGLGVHISFVRSVTMDSWTEAQLRKMEAGGNDRLNAFLAARGVPKETPHVAKYNSNAAAAYRDRIVAVAEGRPWTDPPVVKETPGSGAPAPTRKPPLPAGGGGGGGGGGWDDWDDDFRPDMRRNQSVGSFGESGAESGRQPPRSKSTQDMYTRQQLEASAANKDSFFARRMAENESKPEGIPPSQGGKYVGFGSSPAPSANRNGAAAQGDVMQVVSQGIGRLSLVAASAAQSAASVVQVGTKEFQSKMREGGYDQKVNETVNVVANKTAEIGSRTWGIMKGVMALASQKVEEYAKEGGNGWGDDWQRREQGSEPYHRFERETNGNGWNSSSHDGSSKNYNSNSWDDWDEPVKKDEPAKERQSSDSWPGWDDGKDDNYDSYNHSTPSKGSNQNGTTGGSYWTEGGFR

SEQ ID NO: 65148 - protein, 986 aa, Medicago truncatula
MEVFLLRSQCHQASPVFNIPKHLPVNQSTEPRSLPPTVHRRNSSISHTLEPVSQAPVAEPPANFPKNSSVSQPSQHGSVPPNVHNTTIHKGHIHTPEPVMPPPISTFPVDPPLIHPVIPAAPPNEVPAPVISPTLTPSRSFNGKNGGEPVSAPLNKKPKSPPAIVNSPAQAPSVNKARPFHHAPEPLTSPPKSPFNKEDHSPASSPSTTFHKHQHTRNTITSPAPASSYFVSPPTSKHQDKPIPPSFLPTNRRRHNAPAPMNRGSADSPFTFPIQSPVSQVSPAPSPSFKTFPHSTKIPFHPPKISPQRSFSKSPKKPILPRVQALPPPPPNEDCLSFVCSEPYTNSPPGVPCMCIWPMRVGLRLNVPLYTFFPLVSELASEISSGVFMKQSQVRIMGANAATDQPDKTDALIDLVPLGEQFDNTTAFLTSDRFWHKKVVIKSSYFGDYEVLYISYPGLPPSPPLPPSSVNMIDGGPYSNNGNNGRTIKPLGVDIQKRQHRSGLSKGIIAIIALSSFLAIVLCSAAVFALIKFRDHVSESQPTSTPRVFPPSLTKTPGTAGPSNAGASASTSFRSSIAAYAGSAKTFSMNEIEKATDNFHPSRILGEGGFGLVYSGNLEDGSKVAFKVLKREDHHGDREFLSEVEMLSRLHHRNLVKLIGICTELSFRCLVYELIPNGSVESHLHGVDREKSPLDWSARIKIALGAARGLAYLHEDSSPHVIHRDFKSSNILLENDFTPKVSDFGLARTAADEDNRHISTRVMGTFGYVAPEYAMTGHLLVKSDVYSYGVVLLELLTGRKPVDFSQPPGQENLVAWARPLLTSREGLEVIIDPSLGSNVPFDSVAKVAAIASMCVQPEVSDRPFMGEVVQALKLVCNECDEAKEAGSTSSNKDGSSSDFYTVTEQLPDNFQSHSAAANYDFGVDIENGLSTSEIFSSSARFERQVSGSFRRHSYSGPLRTGRSKRLWHIIRKLSGGSVSEHGDSLR

SEQ ID NO: 65149 - protein, 337 aa, Xylella fastidiosa Ann-1
MNAPQAPVLVADIGGTNARFALANPTLTSAPLLNDSMREFAVIEFPSLGEAAQHYLHHIGIHTTKGVFAIAGHVDGDEARITNHPWVITRTRTATMLGFDTLHLINDFVAQAMAISVLGPQDVIQIGSAKWEQFPLSAATRNYSIIGPGTGLGVGGLMIRNGRCYPLETEGGHVSFPPSTPEEIRILEILSQQFGRVSNERLISGPGIVNIHRALSEIDGIDPGPLRPQDITMRAADGDIRATRTINLFCNIFGAITGDLVLIQGAWDGVFLTGGLVPKLLNSIQHSGFRQRFEHKGRFSAIMARIPSLAVIHPHPGLLGAAAYARDTEQVPQEIKA

SEQ ID NO: 65150 - protein, 130 aa, Oryza sativa
MGKTWALISHLHAFAGPTLTLIYPLYASICAMESTSKVDDEQWLVYWILYSLITLMEMALHKVLYWIPLWYEAKVLFVAWLVLPQFRGASFIYDKFVREQLKKNRGKTSDGLSRHKIHRLNVNIVCGEQC

SEQ ID NO: 65151 - protein, 205 aa, Thermoanaerobacter tengcongensis MB4
MIDIKELKFDEKGLIPAIVQDYYTKQVLMLAYMNEESLKLTLEKGETYFFSRSRGKIWHKGETSGNTQKVKKIFYDCDEDALLIQVEAKGPACHTGNISCFYRSFDEETEDGIEILNKLYERIKGRKINPVEGSYTNYLFEKGIDKILKKVGEEATEVVIASKNDSKDEIVYEVSDLIYHLMVLLVEKNITLNDIYNELERRYKK

SEQ ID NO: 65152 - protein, 194 aa, Thermoanaerobacter tengcongensis MB4
MRKAEVKRKTAETDIYVELNIDGKGSYDIKTGIGFFDHMLSLFAKHGLFDLKVIAKGDLEVDTHHTVEDVGIVLGTAFLKASGDKKSIKRFSTFYVPMDEALVRVSLDISGRPYLYYDLPLKAERVGNFETETVEEFFRAFAYNFGITLHVELLHGVNTHHIIEASFKALGKALDEALKLDERIDGIPSTKGIL

SEQ ID NO: 65153 - protein, 380 aa, Gibberella zeae PH-1
MAPNIKTLSIPSATVQSHASNLLQLPDKTVLCTWFGGSQEGLPDICIWLSRLEPGSTSWSTPQKVSSDENRSCQNPVLFRAPHNGDLWLLHTSQDAGNQDGAYILKRTSSDEGKTWSEASRLLPNATGIFIRQPIVVNSEGAWILPVFYCRTEPGHRWIGSDDISGVFYSQDNGATWKEKQAPDSVGAVHMNIVPPASDQTTWVAVYRSRWADNVYRSTSKNGIDWEEPKATSLPNPNSGICAARLSSGHIALVFNRSSASADTLKRKGLYDDITPEDDKRPNQVTKTGKDAIWGTPRKTLTLGVSQDEGLTWSERVLEDGDGFCGTNSSSGQENRELSYPSIYIERKGETDVAHVAYTWHRQHIKYVQIEDVEGWVQSK

SEQ ID NO: 65154 - protein, 460 aa, Clostridium acetobutylicum ATCC 824
MEKKELSRGLKARHIELIALGGTIGVGLFMGSASTIKWAGPSVLLAYGVAGIAMYIIMRIMGEMLYLEPLAGSFANYANKYISPLAGYITAWCYWFMWIAVGMSEITAIGIYVKFWFPALPAWIPALIGVAILAAANMASVKFYGEFEFWFSLIKVVTIVVMLIVGVGLIFFGIGNHGVPIGFKNLTAHGGFFAGGLKGWLFALCMVTASYQGVELIGITAGEAQDPKNTLRKATKNIIWRILIFYVGAIFVIVTIYPWDKISTLGSPSVLTFAKIGIAAAAGIINFVVLTAAMSGCNSGIYSCGRMLYTLATNGQAPKFLGKLNKDGVPANGIRTTLVCLLIGVILNYIYPNSKLFVYIYSASVLPGMAPWFVLCISQIKFRKEHAEEMKMHPFKSRLFPYANYIVVAYLCLVLIGMCFNSSTQIPLFIGAVFCAIVTIAYFAFGIHKGKVSKVEELQE

SEQ ID NO: 65155 - protein, 322 aa, Oceanobacter sp. RED65
MQFNDIYQVVETEFARTNEIILEQLSSNVPMVEKIGHHIIESGGKRMRPLLVLLAAKALESNEQNHPLLASIIEFLHTATLLHDDVVDTSDMRRGKATANAAFGNAPSVLVGDFLYSRAFEMMVQLGSMEVMAILSNATCVIAEGEVMQLMNVKNPNVGEDKYMDVIQGKTAMLFEASSHSGAKLANASPEQAEALRLFGHHLGMAFQLVDDVLDYIGNADELGKNVGDDLAEGKPTLPLIFAMQNASQEQADVIRQAIRKGGTEDLPKIIEIVQSCGAIDYTQQKAQEHVNQACEAIAILADTPAKQALQTLADMAINRNK

SEQ ID NO: 65156 - protein, 541 aa, Bradyrhizobium japonicum USDA 110
MQGLMMDMPLLISGLIQYAADYHGEAEIVARQIEGDIHRYTYADAHPRIKRMALALKRLGMQQGDRVGTLAWNTHRHFEMFYAAPGMGYVLHTVNPRLFPEQLVYIINHAEDRLLFVDRATLPIVEAIAPQLKTIEAYVVMSSRERMPETKLVNVHCYEELLGRENDTGFTWPEFDEKSASTICYTSGTTGNPKGVIYSHRAAILQTMTCCNFDFLPGHIEGVREVMMPMAPLFHGNGWNMPFTAPYTGSKLVLPGRNYEPDKLYELLEGEKVTLSAGVPSFWLILLDWLGRTGNRFSTLRATLSSGSAPPRAMVEKLKRDYNIDYIQAWGMTEALGCSMPGLRPGSEHLSDKEKFDRRQVSGRACFGTALRIVDDGGVELPRDGKTVGHLRARGPWVASGYMKLDEGLDRDGWLITGDMAVIDPQGHVTLTDRSKDVIKSGGEWISSIQLEDVALSHPDVLQAAVVAIAHEKWQERPLLLVVRKKGATVDGKALLDHMRPKIASWWMPDAVEFLDEFPMTGTGKVLKSALREKFREYRVA

SEQ ID NO: 65157 - protein, 190 aa, Brassica napus
MAALKGYGLCSMDSVLHFPCPRPPFEAYKRRSSRWVSPKSSCCTKPSHPPYAAALEVKNRTNTDDIKALRVITAIKTPYLPDGRFDLEAYDDLVNIQIQNGVEGVIVGGTTGEGQLMSWDEHIMLIGHTVNCFGGSIKVIGNTGSNSTREAIHATEQGFAVGMHAALHINPYYGKTSMDGIIAHFQSVMH

SEQ ID NO: 65158 - protein, 326 aa, Chara vulgaris
MSEKLLYEALNEGIHEEIERDPKVFVIGEDIGHYGGSYKVTKGLFEKYGNLRILDTPIAENSFTGIAIGAAMTGLRPIIEGMNMGFLLLAFNQIANNAGMLHYTSGGNFTTPLVVRGPGGVGRQLGAEHSQRLESYFQSVPGLQMVACSTPYNAKGLIKSAIRSQNPIIFFEHVLLYNIKENIPQKEYLVPLEKAELVRSGNQITILTYSRMRYHVLQAAKTLIEKGYDPEIIDIISLKPLDMGTISTSLRKTHKVLIVEECMKTGGIGTTLKSAILESLFDFLDTPIMSLSSQDVPTPYNGFLEDLTVIQPSQIVEAAEKIILYS

SEQ ID NO: 65159 - protein, 130 aa, Prochlorococcus marinus subsp. pastoris str. CCMP1986
MSSTKVIKTANAPDPVGPYNQAIKAGNFIYCSGQIAIDPVSNKINCLGNIEKETTQVLKNLLAVLNAGGAKAEDVIKTTIYLTDLKNFKTVNDIYSDFFNVENPPARACVEVSSLPKGVLIEIDCVAFLD

SEQ ID NO: 65160 - protein, 460 aa, Clostridium perfringens str. 13
MEIFKKQSLKRILSEANENKERTLSALDLTLMSVGSVIGTGVMVLTGIVAAKQSGPATSIAFIGGGIAAAIIVLCYAEFSSSIPSAGGSYSFTYVSLGEIIAYISGLCIVIGYTLSTATVASGWGAYLLSLLDILGIKLPKTFTAIPSEGGIVNLPAMISILFIVFVISLGTKESKKVNDIMVFIKIVVIALFIGVGAFHVNTSNWHPFAPFGVKGIVTGTASLFFAYCGFDATASAAEEVKNPQKSLPLGLISSLVICTIIYIAVSLVLTGVTSYTNLNVGDALSYALKLVGQRGVAFVVSLGTVIGILAVIFAGNFTTSHILLAMSRDGLLPKFFSKVDKKDVPYTALWTVGIIGALLAGFFNLGQLANFANIAFLLTYTLVCISLIAFRKKYPHVKRGFKTPLVPFIPLLGAFSCLFLMSNLSEETWKIFIVVLVLLITSYLVYGRKHSLINKNNDN

SEQ ID NO: 65161 - protein, 529 aa, Pseudomonas aeruginosa UCBPP-PA14
MKTRNDVANKGRLSLPGKPTKTSGNEQPGEPHMIDGLLRSLGLDPNAFRDGELAVHTPIDGSRLAAVPLEGRAAVAAKVERAEQAFRAWRQVPAPRRGELVRLFGEELRRHKAELGELVSWEAGKITQEGLGEVQEMIDICDFAVGLSRQLYGLTIASERPGHHMRETWHPLGVVGVISAFNFPVAVWSWNTALALVCGNSVVWKPSEKTPLTALACQALFERAARAFGGDAPAHLSQLLIGDREAGEALVDDRRVALVSATGSTRMGREVAPRVAARFARCILELGGNNAMILAPSADLDLAVRGILFGAVGTAGQRCTTLRRLIAHESVKDEIVERLKAAYSRVRIGHPLEGNLVGPLIDERSYLAMQDALARAREEGGRVFGGERQLQERYPDAYYVSPAIVEMPGQTEVVRTETFAPILYVVGYRDFDEALRLNNEVPQGLSSCIFTTDLREAELFQGAAGSDCGIANVNIGTSGAEIGGAFGGEKETGGGRESGSDAWKAYMRRQTNTVNYSRELPLAQGITFD

SEQ ID NO: 65162 - protein, 443 aa, Clostridium acetobutylicum ATCC 824
MEILKHVMDDVIKRNPNEPEFHQAVKEVLLSLEIVAEKHPEWVKDKIFDKIVEPERQIIFRVPWVDDNGEEHINRGFRIQFNSAIGPYKGGLRFHPSVNLGIVKFLGFEQIFKNSLTGLPIGGGKGGSDFNPKSKSNSEIKRFCQSFMLELNKYIGANTDVPAGDIGVGSREIGYLYGMFKKIRNESTGVLTGKGLTLGGSLVRTEATGYGLCYFMNEALKAKGKSFDGATVIISGSGNVAIYANQKATQLGAKVVAMSDSNGYIYDANGINLNTIRKIKEVERKRIHEYTKYHPNASYTEGCDGIWKLKCDIALPCATQNEIDENSAKTLIANGCYAVGEGANMPSTIEAVDLFIKNKVIFGPAKAANAGGVATSALEMSQNSMRYSWTFEEVDTKLQNIMKNIYIKCSNAANEYGFEDNLVAGANIAGFTKVAEAMYSLGF

SEQ ID NO: 65163 - protein, 962 aa, Arabidopsis thaliana
MTPFRWRLLGGGIHYNTLKVEHNESGPLSLKGLFGSVSGNFTFFTFLGSHLMVRISLLLLCLLVSTCLFTSSSAQAPGFVSLDCGGAEPFTDELGLKWSPDNHLIYGETANISSVNETRTQYTTLRHFPADSRKYCYTLNVTSRNRYLIRATFLYGNFDNSNNVYPKFDISLGATHWATIVISETYIIETAELVFLASSPTVSVCLSNATTGQPFISTLELRQLSGSMYGSMLSEDRFYLSVAARINFGAESEASVRYPDDPYDRIWESDLQKKPNYLVDVAAGTVRVSTTLPIESRVDDRPPQKVMQTAVVGTNGSLTYRMNLDGFPGFGWAFTYFAEIEDLAEDESRKFRLVLPEQPEYSKSVVNIKENTQRPYRVYAPGYPNITLPFVLNFRFAKTADSSRGPILNAMEISKYLRKSDGSVDATVMANVASLYSSTEWAQEGGDPCSPSPWSWVQCNSDPQPRVVAIKLSSMNLTGNIPSDLVKLTGLVELHLENNRLTGKIPSSLTKLPNLKELYLQNNVLTGTIPSDLAKDVISNFSGNLNLEKSGDKGKKLGVIIGASVGAFVLLIATIISCIVMCKSKKNNKLGKTSAELTNRPLPIQRVSSTLSEAHGDAAHCFTLYEIEEATKKFEKRIGSGGFGIVYYGKTREGKEIAVKVLANNSYQGKREFANEVTLLSRIHHRNLVQFLGYCQEEGKNMLVYEFMHNGTLKEHLYGVVPRDRRISWIKRLEIAEDAARGIEYLHTGCVPAIIHRDLKTSNILLDKHMRAKVSDFGLSKFAVDGTSHVSSIVRGTVGYLDPEYYISQQLTEKSDVYSFGVILLELMSGQEAISNESFGVNCRNIVQWAKMHIDNGDIRGIIDPALAEDDYSLQSMWKIAEKALLCVKPHGNMRPSMSEVQKDIQDAIRIEKEALAARGGISDEFSRSSAHSSSLNMGMLDLAGSQSYVSIDESVLQPTAR

SEQ ID NO: 65164 - protein, 161 aa, Aspergillus oryzae
MATPTLTFTSSDGVDIPVERDVAERSQLIKNMLEDLGETGEPIPIPNVNEAVLKKVIEWCTHHKNDPPSTGDDDDSRRKTTDIDEWDQKFMQVDQEMLFEIILAANYLDIKGLLDVGCKTVANMIKGKSPEEIRKTFNIQNDFTPEEEDQIRRENEWAEDR

SEQ ID NO: 65165 - protein, 215 aa, Aspergillus oryzae
MSQPTPNSHQQPDAAAAQVAGQSPSSSTPTAELASLKISLRAALRQFPDFPSPGILFEDILPIFANPTLHEALLRSLELHILQNHGDQKPDVIVGLEARGFLIGPSLALRLGASFVPVRKQGKLPGPCATQAYEKEYGQDFFQMQADSIKPGQKVIVVDDIIATGGSAWAAGELIKKMGGELMSFLFILELEFLKGREKLPAPVYTLLSGQEEKH

SEQ ID NO: 65166 - protein, 459 aa, Prochlorococcus marinus subsp. pastoris str. CCMP1986
MILKVLEFEFDLIVLGAGSGGLAAAKRAASYGAKVAIIEVNKIGGTCVIRGCVPKKLMVYAANNRRNMLSSEGYGLISKEITFESNILLKNVREEVSRLSVLHSNSLKKLNVKVFEGLGRFLNQNTVEVVCPKTKNILRKVSAKSILISVGGKPKKLNIPGTDFAWTSDDIFELKDFPKKLLIVGGGYIACEFASIFKNLGTEVTQLIRGENLLNGFDKDLSECLEKSMTSLGINLKFKNQLKSIKKINDGLESTLESGSKLLTDNILVATGREPSLKRLNLDTLNLKMDGIYLEVNELNKTSISNIFAIGDIVKRPNLTPVAIEQGRVFADNYFAALKRKVNYENIPKAVFTIPEISTVGLSEEKANEIYSEVNVQVFKCNFTPMSNTFKKNKSKCMLKLVVNKKNDKVLGCHMFGEAASEIIQMVAVSLNTGITKKDFDTTMALHPTISEEFVTMYG

SEQ ID NO: 65167 - protein, 560 aa, Triticum aestivum
MAPSPRAMRSLSPLYSLLLLTGAAMAAADPWSTDCPSDTNYTRGGVFQANLDDLLSFLPAAASVAAGLAENTTGREPDEAYGLAHCRADVNASECRSCLDTSARDAAIKCPGQKKSTLFYEACLLRHSNVSFFGVADMSWLTGLCNAVNATQPELFKTQLGALMNNLSSRAASSPRLFAADTVDLTPFTKIYGMSQCTRDLAGDDCNRCLAVAVSYIPKFCDGREGGRVATRSCSIRYELYPFYNAQAAEAAMSPPAPPPPAVNGSDHSGPAERAGNDDATAKIALFVSIPVAAVLLVVLTVAFYLCKRKNKKPREHVLLSSAESEDRTDMRSSESLLYDLSTLRAATDNFSEENKLGEGGFGPVYKGTLQDGQDIAVKRLSKTSQQGHVELKNEVVLVAKLQHKNLVRLLGCCIQEEEKLLVYEYLCNKSLDKILFDPARRQELTWGQRYRIIQGIGRGLLYLHEDSRLTIIHRDLKASNILLDPDMNPKISDFGLAKLFSVDASVGNTSHIAGTYGYMAPEYALHGIFSAKSDVYSYGVLVLEIIAGSPQQFRPISGH

SEQ ID NO: 65168 - protein, 412 aa, Rickettsia prowazekii str. Madrid E
MNNIKNLLIRAQIMSIISTRLNSIKPSPTLAVVKKTLELKKAGVNIIALGAGEPDFDTPDNIKEVAITSIKDGFTKYTNVDGIPLLKQAIKNKFKRENNIDYELDEIIVSTGGKQVIYNLFMASLDKGDEVIIPVPYWVSYPDMVALSTGTPVFVNCGIENNFKLSVEALEHSITDKTKWLIINSPSNPTGAGYNCKELENIAKTLRKYPNVNIMSDDIYEHITFDDFKFYTLAQIAPDLKERIFTVNGVSKAYSMTGWRIGYGAGSKALIKAMTIIQSQSTSNPCSISQMAAIEALNGTQDYIKSNALNFQKKRDLALSILEEVTYFECYKPEGAFYLFVKCDKIFGTKTKSGRIIANSNNFSEYLLEEAKVAVVPGIAFGLDGYFRISYATSMQELEEACIRIKHACNAL

SEQ ID NO: 65169 - protein, 530 aa, Arabidopsis thaliana
MEASISFLGSTKPNISLFNPSSNVLPRRDFPLPALKLKKVSVLPRILHQKRLIRAQCSDGFKPEEDDGFVLEDVPHLTKFLPDLPSYPNPLKESQAYAIVKRTFVSSEDVVAQNIVVQKGSKRGVHFRRAGPRERVYFRSDEVKACIVTCGGLCPGINTVIREIVCGLNNMYGVNNILGIQGGYRGFYSKNTMNLTPKVVNDIHKRGGTFLQTSRGGHDTAKIVDNIQDRGINQVYIIGGGGTQKGAEKIYEEVERRGLQVAVSGIPKTIDNDIAVIDKSFGFDTAVEEAQRAINAAHVEVESVENGVGIVKLMGRYSGFIAMIATLANRDVDCCLIPESPFFLEGKGGLFEFIEERLKENRHMVIVIAEGAGQDYVAQSMRASETKDASGNRLLLDVGLWLTQQIKDHFTNVRKMMINMKYIDPTYMIRAIPSNASDNVYCTLLAQSAVHGAMAGYSGFTVGPVNSRHAYIPISQVTEVTNTVKLTDRMWARLLASTNQPSFLTGEGALQNVIDMETQEKIDNMKISSI

SEQ ID NO: 65170 - protein, 290 aa, Exiguobacterium sibiricum 255-15
MNICVVTGANSGMGMVTIQELLERGDRVIATVRSQKKATLLIQLLREHAVSDANLEVEIVQLDQLDSVRRFADVLFDRIGRIDRLILNAGIMVPPYHVTKDGFESQFQVNYLSHFYLIERLLPLIEQGHDPRVISISSLAGEGGMIRTDIELEAIAHVRKEQYNPMKSYRESKLLQMVHMRELAEQYGTLATFVSVHPGIVNTDLFYRGKYGKVLKTVLKPVAQVGYWTGKLYTPEYGAKTALYLATTDDVIDNGGYYADSAPRLSNPVVEDEAYRQQARALSKRWVGLD

SEQ ID NO: 65171 - protein, 522 aa, Arabidopsis thaliana
MTSLPSSVIKWRFFRRQMPSDVVFSLCLLCFASCLAGKITVLADSDKSVLLRFKKTVSDPGSILASWVEESEDYCSWFGVSCDSSSRVMALNISGSGSSEISRNRFTCGDIGKFPLYGFGVRRDCTGNHGALAGNLPSVIMSLTGLRVLSLPFNSFSGEIPVGIWGMEKLESPGKGGFNSLEIASIASASAIVSVLIALVILFFYTRKWHPKSKIMATTKREVTMFMDIGVPITFDNVVRATGNFNASNLIGNGGFGATYKAEISQDVVVAIKRLSIGRFQGVQQFHAEIKTLGRLRHPNLVTLIGYHASETEMFLVYNYLPGGNLEKFIQERSTRDWRVLHKIALDIARALAYLHDQCVPRVLHRDVKPSNILLDDDCNAYLSDFGLARLLGTSETHATTGVAGTFGYVAPEYAMTCRVSDKADVYSYGVVLLELLSDKKALDPSFVSYGNGFNIVQWACMLLRQGRAKEFFTAGLWDAGPHDDLVEVLHLAVVCTVDSLSTRPTMKQVVRRLKQLQPPSC

SEQ ID NO: 65172 - protein, 99 aa, Brassica napus
TLSKPSSPKEHIDDTEDLINIKLGNAQNQLIQFQLLLTAATFVAAIFAAVTAVFGMNLQDSVFKDPTMFQWVLLVPGIGCGLLYFGFVLYFKHKKVFPL

SEQ ID NO: 65173 - protein, 388 aa, Candidatus Pelagibacter ubique HTCC1002
MSALAKNYNRKKISFKYGKGSFLYSTNGKKYLDFVQGIAVNSLGHANPYLIKAVNKQSKKLWHVSNAFIIPEGEKLAKRLAKKTFADFIIFQNSGAEATEAAIKIARRYFYSIGQPSKNRILCVKNSFHGRTLATIYASGSKKMTEGFGPKVDGFDHFEFGNHKDFKKKITKKTAAIMVETVMGEGGIKVIPNWCLKELRKVCDKRKILLILDEVQCGIGRSGNFFAFENSKIKPDIVPIAKGIGGGFPLGAVLMNKKVASGMTAGTHGSTFGGNPLAMSVGNAVLDQILKKGFLSNVKKLSKYFYSELNKLRKKFPKIIKEVRGVGLLIGLQLHDDQTKFIQKLMDNKLLTIRAAENVIRILPPLNVKKEEIDIAINIIKKVCSTYK

SEQ ID NO: 65174 - protein, 218 aa, Coprinopsis cinerea okayama7#130
MLVTKNLVPGESVYGEKRISVEGGVEGTKVEYRVWNPFRSKLAAGVLGGLDDIFVKPGAKVLYLGAASGTSVSHVADIVGPEGIVYAVEFSPRSGRDLINMAKKRTNVIPIVEDARLPNRYRMLLSIVDVVFADVAQPDQARIVMHNAAQFLKDGGHVLISIKASCIDSTIPPETVFASEVAKLREGNFKPLEQVTLEPYERDHAMVSAVYQRHAKKN

SEQ ID NO: 65175 - protein, 323 aa, Candidatus Pelagibacter ubique HTCC1002
MKKKNYKKIAKSVIDLEIKALKKLKNSINNSFSEAVESLANCQSKVILCGVGKSGLIAAKISATLSSVGTPSFSLSANDCSHGDLGSISKKDVLILISYSGSTEELKNIIKYANRNKITLIGIMSKKNSILYKASDIKLLIPEVTEAGLGIVPTSSTINQLSIGDALAVAVLNKKNINKKDFKKFHPSGNLGAQLRTVEELMITGNKIPFVNESLNMKKALQIISNKKLGTLIVQNNKKITTGIITDGQIRRVNAMSNNLQDLSVKKVMTKNPISINLDTLAEKALSIMNAKKITSLCVHKDKNKKKTVGILHIHNILHSNIR

SEQ ID NO: 65176 - protein, 1016 aa, Salmonella typhimurium LT2
  misc_feature (196)..(196): Xaa can be any naturally occurring amino acid
MQVSRRQFFKICAGGMAGTTAAALGFAPGVALAETRQYKLLRTRETRNTCTYCSVGCGLLMYSLGDGAKNAKASIFHIEGDPDHPVSRGALCPKGAGLVDFIHSESRLKFPQYRAPGSDKWQQISWEEAFDRIAKLMKEDRDANYQAQNAEGVTVNRWLTTGMLCASASSNETGYLTQKFSRALGMLAVDNQARVXHGPTVASLAPTFGRGAMTNHWVDIKNANLVVVMGGNAAEAHPVGFRWAMEAKIHNGAKLIVIDPRFTRTASVADFYAPIRSGTDIAFLSGVMLYLLTNEKYNREYTEAYTNASLIVREDFGFDDGLFTGYDADKRQYDKTSWHYELDENGFAKHDTTLQHPRCVWNLLKQHVSRYTPDMVENICGTPKADFLKVCEYIAETSAKDKTASFLYALGWTQHSIGAQNIRTMAMIQLLLGNMGMAGGGVNALRGHSNIQGLTDLGLLSQSLPGYLTLPSEKQTDLQTYLAANTPKPLLKDQVNYWGNYPKFFVSMMKAFFGDKATAENSWGFDWLPKWDKGYDVLQYFEMMKQGKVNGYICQGFNPVASFPNKNKVVASLSKLKYLVTIDPLNTETSTFWQNHGESNDVDPAKIQTEVFRLPSTCFAEENGSIVNSGRWLQWHWKGADAPGIAMTDGEILAGIFLRLRKMYSEQGGANPEQVLNMTWNYTKPYEPASEEVAMESNGKALADLIDPATGAVVVKKGQQLSSFAQLRDDGTTSSGCWIFAGSWTPEGNMMARRDNADPSGLGNTLGWAWAWPLNRRILYNRASADPQGNPWDPKRQLLKWEGGKWAGWDIPDYSAAAPGSDVGPFIMQPEGMGRLFAIDKMAEGPFPEHYEPFETPLGTNPLHPNVISNPAARIFKDDADALGKADKFPYVGTTYRLTEHFHYWTKHALLNAIAQPEQFVEIGEKLANKLGIAHGDTVKVSSNRGYIKAKAVVTKRIRTLKADGKDIDTIGIPIHWGYEGVAKKGFIANTLTPFVGDANTQTPEFKSFLVNVEKV

SEQ ID NO: 65177 - protein, 479 aa, Pseudomonas aeruginosa UCBPP-PA14
MARIDMQTKLLINGALVAGESESHAVYNPSQGNVLVRITEASGAQVHAAVQSADAAFDAWSQTPPKDRAALLLKLAERIDAQAHVFARLEADNCGKPFNAVLLDELPAVSDVFRFFAGAVRCLQGSAAGEYVAGHTSMIRRDAVGVVASIAPWNYPLLMAAWKLGPALAGGNTVVLKPSEHTPLSTLKLGELLAEIFPAGVVNIVHGRGASVGEPLTSHAQVRMVSLTGSVRTGSRIIEGTAESVKRMHMELGGKAPVLIFDDADIDAAVEGIRAFGFYNAGQDCTAACRLYVQKGVYQEFVRKLGEAVSSIRCGLPDDPATEMGPLITKEHLERVEGFVNRARELPHIEVVTGGKRAEGAGFFFEPTVLAGATQEDEVVRREIFGPVVTVSSFEDEAQALAWANDSDYGLASSVWTADVGRAHRLAARLQYGCTWVNTHFMLVSEMPHGGVKLSGYGKDLSMYGLEDYTVVRHVMFKH

SEQ ID NO: 65178 - protein, 250 aa, Oceanobacter sp. RED65
MRRTFVAGNWKMNGSKAENQSRLEALVAALGQRQDIDMAVFPSMPYVAQCQQILGGSTVAWGAQNVSEHTGGAFTGETSSQMLRDFECRYVLVGHSERRELFAESNQQVAEKFKAAVDSELVPVLCVGETLEQREAGETQRIISEQIEAVLSLVGSDVFANGVVAYEPVWAIGTGKTASPEQAQEVHSAIRAQLAEANIAMAEAMQILYGGSVKPENAAAIFAQQDVDGALVGGASLKAEDFIAICDAAA

SEQ ID NO: 65179 - protein, 66 aa, Zea mays
  misc_feature (31)..(31): Xaa can be any naturally occurring amino acid
  misc_feature (60)..(60): Xaa can be any naturally occurring amino acid
RGYNFLDNFIRELGDYIRFRINNNRAYTIPXKGGPGITQADLLVINMTDLPTAVVADLTXMERDPL

SEQ ID NO: 65180 - protein, 577 aa, Aspergillus oryzae
MSKHLSRFSHHPRAASGPLECPYEGRDIITSCQFNKGSAFSEEERNVFKLHGLLPPNIQTLEEQVQRAFQQYKSRPDALAKNTFMASMKAQNEVLYYKLIQTHLKEMFSVIYTPTEGDAIQNYSRLFRRPEGCFLNIKDQDRIEECLCNFGRGIDVDYIVVSDGEEILGIGDQGVGSILISVAKLVLATLCAGIHPSRQLPVVLDCGTDNKDLLNDELYLGLRQPRVRGDEYDRFVEKFVTTARKMFPKAYIHFEDFGLHNASRLLNQYRPHIPCFNDDIQGTGCVTLAALMAAFHVSNIGLADVRVVVFGSGSAGTGIAKQVADTIATDTGRTKQEASAQIWCLDKPGILLKSLGDQLTAAQAPFARDDNEWPKEKGTDLLSVVKEVKPHVLIGTSTKPKAFTENIIREMAKHVEHPIVFPLSNPTRLHEASPEDINHWTEGRALMATGSPFPPVERNGVEYEVAECNNSTCFPGIGLGAVLSRTQILSDKMLVAAARALASQSPALQDPNRPLLPDVENVREISVHIARAIIETAIEEGYAQEKDIPSHEEELEEWIRVQMWEPIYRPLVKAGEK

SEQ ID NO: 65181 - protein, 118 aa, Taraxacum officinale
ECKERATPEQVADYTLKLLHRRIPPAVPGIMFLSGGQSEVEATLNLNAMNQSPNPWHVSFSYARALQNTCLKTWGGRPENVKAAQDALLQRASSNSLAQLGKYTGQGESEEAKKGMFV

SEQ ID NO: 65182 - protein, 221 aa, Prochlorococcus marinus subsp. pastoris str. CCMP1986
MAYSKNFSIEELRFDNKGLIPAIAQDWLDGSILMLAWMNKESLNKTLETRNVHYWSRSRSEIWRKGATSGSTQFLKEIRFDCDNDALVLSIEQNGSGACHTGEKSCFFNEIDSISMNKTAKKTSPFSNICSELFDTLHERSINPLEKSYTNHLLTKGSNTILKKIGEETAEFIMACKDNDKDEIANEASDIIYHLQVALIYKGVKWRDVLNVLESRRGKNN

SEQ ID NO: 65183 - protein, 869 aa, Kluyveromyces lactis NRRL Y-1140
MQSDEASLKKDYQFNIQEKESSTDNGNLEEFEDYGVEFTNAIVEACGHDPESFPDGIYPKEVEYMITVTKRLSIEESLKILEKTLKEHEDDANLPEDLIERTRSLLDRDDYLKQGHSEFEWFEQCKIDAAMIHYHSPYPEVRTVTSPIDDETIPIETFRAYFLGFFWTILGAGVNEFFVHRKPKISLTAPVMQILLYPCGKLFERVMPNHTFKLGKISVNFNPGPWSFKEQMFSTIIFNVATSYTYVSHNIYVQRLEIFYNNKWLDFGYEVLLMLCSQLLGFGYAGILRKFVIYNEKCIWPTLFPTLALNGALLKPDSKENINGWRMTRYKFFLTFFVIMFIYNWIPTYLFEGLSTFSWLTWCSPKNFDLAVVTGSQYGLGLNPVPTFDWNIIDYNYALTIPFFSQLNQYIGTFIGFFAILGIYYSNYKWTAFLPLNSNDIFTNRGESYVVQDILDENSMLVESKYQEYSPPYYSAGNLLVYGGIFAQYPFAFLYVFFTEWASILQCFKQMYRQIKNFRNVSIKSSTYDGFDDPQTRLMKKYKDVPDWWFLVVLVVALVLGILCIKLYPTQTPVWGLFFILGINFVFLIPICFIFSMTGFNMTMGVITEIIIGYALPGNGLALMTLKSLGYTIDNQAESYIADQKLAHYAKIPQRAVFKGQLVGVLIQCFVSLGVISWQIVNVKDICTSKAENKFTCPKEVNFYSSSVFWGVIGPKRVFNGLYPILKYTFLIGFLLCLLCCAIKYFFPRQTRLFHPTILIGGMQQFAPYNLSYVTAGLYFSFGFMFYIKRYYTKWWEKYNYVLAAAFSSAVAFSAIIIFFSVKYKPKPIDWWGNNIVGVGVDGGEGRQTLKNITSAFDGYFGPRKGSYP

SEQ ID NO: 65184 - protein, 114 aa, Listeria innocua Clip11262
MNKLIDEITKSQLNPDVPSFRPGDTVRVHAKVVEGTRERIQLFEGVVIKRRGAGISETFTVRKISNGVGVERTFPVHTPRIAKLEVIRRGKVRRAKLYYLRNLRGKAARIKEIR

SEQ ID NO: 65185 - protein, 310 aa, Bradyrhizobium japonicum USDA 110
MGLALKTRRVRRKSMAAKTKFRGSFTALVTPFKNGSLDEAAFRSLVNWQISEGTNGLVPVGTTGESPTLSHDEHKKVVEWCIEEAKGRVPVVAGAGSNSTKEAIELAQHAEKAGADAVLVVTPYYNKPTQEGMYQHFKAINDAIGIPIIIYNIPPRSVIDMSVDTMKRLWELKNIAGVKDATASMVRVSQQRAAMGEDFNQLSGEDATILGYMAHGGHGCISVTSNVAPRLCSEFHTAWQKGDHATALKLHDKLMPLHNNLFIESNPAPIKYAMSLLGKLDETLRLPMVPVTEPTRVAVRSAMVHAGLIN

SEQ ID NO: 65186 - protein, 127 aa, Bradyrhizobium sp. BTAi1
MQFHMITGATKPVAPFSHAVETDGFVFVTGQMPDSPEAPGVLPEGIVQQTKAVMQNLKDILQGLNLCFEHIVMARIYLTEFKRDYAAMNETYRSFFPPDRLPARTCVGVTGLAYDALIEIDLVCRRP

SEQ ID NO: 65187 - protein, 211 aa, Triticum aestivum
  misc_feature (58)..(58): Xaa can be any naturally occurring amino acid
MVDPRSPDWGTRTLTGTKGVEKLYPASSSPPIIQIPWAPAVMASSATTVAPFQGLKSXTAGLPVSRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 65188 - protein, 459 aa, Arabidopsis thaliana
MSTKRVDMGSRDYISSLPDEILGKILSLFCTNRAACTSVLSKRWRNLLELVDNLDLNDAYGNHQYFCDFVDRTLALLSNSTTVKRFSLNCAFHNDASRVNSWIRTVFDRGFLDLHLETAHMHRIDTEFFTSNTLLELTICGGFYAEGRLPPGRAFFPALKSLSLVSVEFTDTLTYQNFISGCPVLEELFLHYDNETQCPAWKGLVSSPSIKRLNIYDNPSELRYEAYKCCFQIPSLVYLDYSSYVAKQYAVDLVSLEEARLNIRYPERLVDQNEDIFGDVTDLLKGISNVKTLHLSSDSLEVFHLCCDTMPVFHNLLTLSFESDEEIGWQVVPLLLNKSPNLETLVIKSLVHQVTDMCGNACACISKRRKKKKKTTEDDECCLSTCQVKVLNISGYRGTCKELKQMRHFLENLKCLETVNVGVDVKRREYKNGNNKYQRITNAVMELPRFSSNCQIQFF

SEQ ID NO: 65189 - protein, 590 aa, Cryptococcus neoformans var. neoformans B-3501A
MFFKKNSDAPKKPRHAPDRDDVPSLEDLGVELHPDTARYVADSQALADAIGGNGLKDIFSSGLVLIAAFSTCMGGLLFGFDQGILSIVLTMSQFLGQFPDVDANVSSSAAFNKGIMTALLELGAFIGALQAGFVADRYSRKKAIALGSVWFVIGAILQTTSYSFAQLVIGRFVGGLGVGLLSAVAPMYISEISPPNIRGSLLAMEAATIVSGIVIMFYITYGSRYIPGDWSFRLPFLVQVAPCILLTIGLWKLPYSPRWLAQVGRDEDSLHALMRLRGFPVTDPRLQAEWITIRAEAIQNREVIVKAHPSLQGKDFMSELKLEIASWVDMFKPKLIKRTIIGPILMMFQQFSGINALIYYSPTLFEQLGLDYEMQLDMSGVLNIIQLVACVLAFFVIDRVGRRPLLLFGSTANTICHVIVAVVMAKFSHDWVRYSKEAWVAVAFIFIYIFTYGVGWAPVPWAMPAEVHTSSRRAKGVAITTCANWLGNFIIGLITPPMLQNIKYGTFLFFGAFTFLSGLYVWFFCPEPMGKTLEQMDQIFHSNTAHEDNLAKSDIQAVILNSPVAGPLSGTASAEKINDKDTQQEWVETV

SEQ ID NO: 65190 - protein, 512 aa, Thermoanaerobacter tengcongensis MB4
MIVLTSQQMREVERIAIEKMGIPSICLMENAGKEVAWEVKRVMEENGLSSAVVIAGRGNNGGDGYVVARNLYNWGIDVKVFVIGSIGSISGDARVNLEAIRNLGIYVAEVTQKEHLKFLEKTLKDSDLVVDAIYGTGLRGEVTGLAKEVIELINQSEKFVVAVDIPSGLNADTGRVEGAAVKARITITMHFLKPGLLIYPGIEYAGEVKIADIGIPSRLAAEVRPSYHYVVSQDVALKSRNPDTHKGDYGKVLIVAGSRSMTGAAFMAAKSAVKTGSGLVRLAVPLSIQPVIQSALYEAIIYGLNEEGGVISYKSLSQIFELIEQSDAVAIGPGLTHEGEVSKLIEDVIRNTEKPLVLDADALNALVGRLEVVKGKRVILTPHYGEMARLTGLKVEDIKNNIFEVARSFVRRYEVTLVLKGARTVIATRDGSIYINSTGNAGMATGGSGDVLTGMIVSLLGQGFEEEKAAVYGVFYHGKAGDVAKKSKGEYGMTAVDILESIPEALSEGLKG

SEQ ID NO: 65191 - protein, 463 aa, Cryptococcus neoformans var. neoformans B-3501A
MLARSAIQRALRTAARRPAAAAPLPPRRLARSFSATPWRHSQQPVTPPLPLQQPEPAAAATSTPLPPAPADLLPQPPADAGAPTLEDLILHSGKSVQDVLNSEEAVHAAMKLSDLKLIGYDHGILSVTGWFTDGLVALHTELGLPWWAAIAGTTVLIRLCLTRLVVNTQKHSVRLAAVNPQIQELMAEAKVASANKDTHMQTLISQRLRDLMKEHNVNPLRPLLLPLVQMPIFLTFFSIVRGLANLPLPQLKEGGLGWVTDLTAADPYYILPATSLLFTNLVFKFGADGVPTAAKAGSPMTTAHMRNFIQLTTFLSFPLIMYFPSALLFYWTFSTGFTLLQSIILRQPIVKRYLGLPVTKAQALEPGAEPLKSPSYMDTFNAAKEYFQKSVKQASEDSANRAHAEQKAKHASVQRKQQQGAFVERIQEPGPEVSDAQTVKRPEGREAEKQRRIEEARRRRARS

SEQ ID NO: 65192 - protein, 338 aa, Burkholderia pseudomallei K96243
MSTPVNRQLRLKARPDGRVGHEHFTLAEAPLPPLGPGEMLVRVLYLSMDPTNRVWMSDIPQYLPPVAIGDVMRALGIGRVVASNAPGFAEGDLVQGLVGWQDYAHVRADEIAQYTKLPAALGLPLPRLLGACGMSGLTAYYGLTEIAPVQPGETLVVSAAAGSVGSVAGQIGKIHGTRVVGIAGGADKCRYLTDELGFDAAVDYKSDDWKRALKDATPDGVHVSFENVGGEIMRAVLSRMAIGGRVALCGVIANYNSGRPADDVSVLIAKRLTMRGFLILDYRKSREAIATLAGWLRDGRLKAEETVADGLTNAPDVLNRLFDGSHRGKLVLRVDPQA

SEQ ID NO: 65193 - protein, 307 aa, Burkholderia xenovorans LB400
MSIFSGIWVPLITPFADGAVDHAALRALVRRYAGAGMAGLVALGTTGEPAALDAAEQDAVLATILDEAQAAARHSHDARALPVLVGVAGNHTASMRERIGQLNPLPIAGVLMAAPYYIRPSQAGIVDHFTALADASAKPVVLYDIPYRTGVRLELDTLLALAAHPRIQAVKDCAGSLDTTLALIRDGRLQVLAGEDINIFNTLCLGGSGAIAASAHVRPERFVALYRALAAGRLDEGRRIFHALAPLIQTLFAEPNPAPVKALLAAQGLIRDELRMPMTRAGDALRERLAALAERERSEARETEASV

SEQ ID NO: 65194 - protein, 352 aa, Pseudomonas syringae pv. phaseolicola 1448A
MQAVVCYGPEDYRLETVDVPTPGPDEILTKVELCGICMGDIKTYRGAPSFWGDAEQPRYVKPPMIPGHEFVCRVVALGPGAEKRGVQIGDRVISEQIVPCWGCRFCNHGQYWMCQKHDLYGFQNNVQGAMAQYMIFTKEGIIHKVPDSIAPDEAILIEPLACSLHAAERANVDFDDIVVVAGAGTLGLGIIGAVRMRNPKKLIVLDMKPERAALALRMGADEVWNPAEVDVLAKIREITGGYGCDIYIEATGHHKAVNQGLAMLRKLGRFVEFSVFNDEATVDWSIIGDRKELDVLGSHLGPYMSPRAIDFIGNRKIDMRDVVTHKFPLAEFKEAFAVMERGDKSLKVVLQP

SEQ ID NO: 65195 - protein, 549 aa, Oceanobacter sp. RED65
MNMAQVNVTVPDLGGIEEVEVIEISVGKGDSVDADDSIVVLESDKATMEVPAPSAGTIAEISVSVGDKVSTGSQVAVMDSDSADAGEKNPSPEQKDADEPKPQQVDQQAQTESKQESSSSSAEPQEIEVRVPDLGGIDEVEVIEIPVSKGDQLQQDDSILVLESDKATMEVPAPQEGELVSIEVKVGDKVSQDTLVAKMKVVGSSGSPTDSSSKAKTQEPAEKTSSPSQATQKSAPAKASPEPQQTQTTSGKVHAGPAVRKLAREFGVDLTDVSATGPKGRILKEDVQAFVKQRVKQPAVASGGPMGVVGSNEDFSKFGPITEQPLNKIKQATARNMVKSWSEIPQVTQFDQADITELEAYRKGKMQSMLPEGVRVSPLAFIARACVKALQAYPTFNSSLKGQGESLVLKQYYNIGIAVDTPEGLLVPVIKDADKKGIVELAQDSSELAKKARDKKLPMDAMQGGCFTISSLGGIGGTSFTPIVTAPQVAILGVSKAKMEPVWNGEEFEPRLMLPLSLSYDHRVIDGAEAARFTRYLCELLTDVRHLLL

SEQ ID NO: 65196 - protein, 374 aa, Chlamydomonas reinhardtii
MAAMMQKSAFTGSAVSSKSGVRAKAARAVVDVRAEKKIRVAINGFGRIGRNFLRCWHGRQNTLLDVVAINDSGGVKQASHLLKYDSTLGTFAADVKIVDDSHISVDGKQIKIVSSRDPLQLPWKEMNIDLVIEGTGVFIDKVGAGKHIQAGASKVLITAPAKDKDIPTFVVGVNEGDYKHEYPIISNASCTTNCLAPFVKVLEQKFGIVKGTMTTTHSYTGDQRLLDASHRDLRRARAAALNIVPTTTGAAKAVSLVLPSLKGKLNGIALRVPTPTVSVVDLVVQVEKKTFAEEVNAAFREAANGPMKGVLHVEDAPLVSIDFKCTDQSTSIDASLTMVMGDDMVKVVAWYDNEWGYSQRVVDLAEVTAKKWVA

SEQ ID NO: 65197 - protein, 891 aa, Oceanobacter sp. RED65
MDSTDHDQDPVETQEWLDAIDSVIREEGIERARFVLERLSERATRNGLPLPYAFVTPYRNTIPVAEEAKMPGDLFVERRIRSLIRWNALAMVVRANQSGDELGGHIASFASSATLYDVGFNYFFRAPNKESRDCPNGDLVYYQGHISPGLYARSFLEGRLNTEQLDNFRREVDGKGLSSYPHPRLMPDYWQFPTVSMGLGPMQAIYQAHFMRYMSARGLVPRLDRKVWAFLGDGECDEPETLGAISLAGREKLENLIFVVNCNLQRLDGPVRGNGKIIQELEGQFRGAGWNVVKVVWGRHWDPLFAKDHKGLMQKRMDEVVDGEFQNYKAKGGAYTKEHFFEKYPELKEMVADMSDEEIYRLNRGGHDPYKVYAAYHSAMNHKGQPTVILAHTIKGYGMGDAAEGKNEAHGVKKLDIDNLKAFRDRFDIPISDKDLEQVPYYRPPEDSPEMQYMRKRRESLGGYMPVRTENKEPLPVPKLDAFKAQLEGTGDREISTTMAFVRMLTSLVKDKAMGDRVVPIVPDEARTFGMEGLFRQLGIYSSEGQLYEPVDFGQMMYYKEDKKGRILEEGINESGAFSAWLAAATSYSTYDKAMVPFYIFYSMFGFQRVGDLSWAAGDCQAQGFLIGATAGRTTLNGEGLQHQDGHSHILANTIPNCITYDPTFAYELAVIMQDGLRRMYQEHERVFYYITVMNENYAHPAMPKGAEEGIIKGLYRFKETADSDLKVQLMGSGTILREVIAAADILQSEYDISADIWSATSINELAREGRQCERHNMLNPDSVARTSFVEQCLKDTQGPVICATDYIKQYSEQIRPYLPSDKSFVTLGTDGFGRSDSREKLREFFEVDRHFVVVAALYGLMKEGKVKADVIAEAMKKFNISSDKLDPLYH

SEQ ID NO: 65198 - protein, 129 aa, Chara vulgaris
MENIQLGSRSLQYLVNCWDEQQLTPGLPIIRVGDILKVNLIVQEANKSRFQAIEATVIAKTSSGSNKIVNLRKVVQGIGVERLIPIHSSMVATLQVIRHSKVRKAKLYYLRSSFGKRSRLQQLFIKDSV

SEQ ID NO: 65199 - protein, 104 aa, Oryza sativa
  misc_feature (87)..(87): Xaa can be any naturally occurring amino acid
  misc_feature (95)..(95): Xaa can be any naturally occurring amino acid
MSGRGKGGKGLGKGGAKRHRKVLRDNIQGITKPAIRRLARRGGVKRISGLIYEETRGVLKDFLENVIRDAVTYTEHAKRTTETAMDXVFYALKRXGRTLYGFGG

SEQ ID NO: 65200 - protein, 394 aa, Zea mays
MGGERTGKLAGLDTPGVPGPPRSPREGIGGQRLHEICDGAAPSTTRMDNQFNSEEWSLPVASAMMELEKYNLTGAFTGSMHNMGVPIQPVNLAINASSRHHPTEDPEVQEVDRSQVSNNKGKKKVAQRGKSFTKEEDRAICSAFLHVSTDPIVGTNQSAAGYYTRMHRHFMENIGVGSNRTKVSIENRWTTIQKAVNKFCGFFAAIERRNESGKNEQDRINDAIRIPKWHEKMAESNTSQKVNQKHSLNDSEIEINSMHTNSAIPERPEGRDNAKKRCRVMADTSSSSTTVEMLQKMHERGEKNAEKEDQLRQEMFQMERERLELQKLNWEKKWAIMESNAKLRQNEYELNQWNADLLVMSQDLDKLAPPLRAMYEQKQMEIMKRRGINTPSTS

SEQ ID NO: 65201 - protein, 319 aa, Clostridium perfringens str. 13
MKKIAVLTSGGDAPGMNAALRAVTRMALHHGLEVMGVQRGYAGLINGELFKMDRKSVSEIINRGGTILRTARCLEFKQEEVREKAAQILKAYGVEALVVIGGDGSFMGAKLLSKLGVKTVGLPGTIDNDLSYTDYTIGFDTALNTVVDAINKLRDTSTSHERVSIVEVMGRNCGDLALYAGIAGGAEAIIVPEMPFDKDELIKTILEGRTNGKTHSIIVVAEGVGGSAELAKEIESVTGIETRATILGHIQRGGSPTADDIVLASRMGAKAVEVLLEGKTSKVIGIKENRIFDMDIDEALDIERSFDESLYEMANAINK

SEQ ID NO: 65202 - protein, 484 aa, Azoarcus sp. BH72
MKQIHNFINGEFVATAKPFDKCSPLDNRRIALVHEAGKTEVDAAVAAAQAALKGPWGRMTVAERVDLLNAVADGINRRFDDFLAAECADTGKPKSLASHIDIPRGAANFKVFADVIKSVPTEFFEMATPDGRGALNYALRRPVGVVGVICPWNLPLLLMTWKVGPALACGNTVVVKPSEETPQTATLLGEVMNEVGMPKGVYNVVHGFGPGSAGEFVTTHPKVNAITFTGETRTGAAIMKAAADGARPVSLEMGGKNPAIVFADCDFDAAIEGTMRSVFANCGQVCLGTERVYVERPIFDRFVAALKAGAEGLKLGVPDDASTGMGPLISQEHKNKVLSYYNKARELGATVVTGGGVPQMPGELANGAWVQPTIWTGLDDNSPIAREEIFGPCTLIQPFDAEDEVIRRANDTDYGLACSVWTKDLARAHRVAGQIEAGLVWVNSWFLRDLRTPFGGAKQSGIGREGGVHSLEFYTEQKNICIKL

SEQ ID NO: 65203 - protein, 109 aa, Taraxacum officinale
EYTVRALQRTMPPAVPAVVFLSGGQSEEEATVNLNAMNQYKGKKPWTLTFSFGRALQQSTLKAWSGKVENVEKAQAAFLARCKANSEATLGIYKGGSGLSEGASESLHI

SEQ ID NO: 65204 - protein, 676 aa, Bacillus subtilis
MQLVEQTIVTRKKYTAIGIDNPTTQGRLCIKGMNAHQHALNSSRITRPLLKKNGEFMPVSWEEALNHIKDQVTMIQTEHGHDAMAVYGSASITNEEAYLLGKFARVGLQTKYIDYNGRLCMSAAATAANQTFGADRGLTNPLSDIPHTRVIILAGTNIAECQPTIMPYFEKAKENGAYFIAIDPRETATTKIADLHLKIKPGTDAALANGLVKIIIDEQLINEDFIQSRTNGFEELKQHTDSLDLNDIAEQTSVSLVDIRKAAVKFAKETSGMLFTARGIEQQTDGTAAVKGFLNMVLITGKIGKPYSGYGAITGQGNGQGAREHGQKADQLPGYRSIENEEHRAHIAKVWGIHQDDLPRKGVSAYEVMEKINDGDIKGLFLMCSNPAVSSPNANLVKKALRRLTFFVAIDLFISETAKYADVILPASSYLEDEGTMTNVEGRVTLREASRPCPGEAKHDWQIICDLASALGKGRYFSYTSAEDIFNELREASRGGIADYSGISYGRLRREGGIHWPCPESDHPGTGRLFTESFAHPDQKAALSVIPNEPPVPKEKPTADYPLYLTTGRVMSHYLTGVQTRKSAALAARHFESFMEIHPQTAATYNIEDRVLVKIESPRGSITVRSKLSEQIRKDTVFVPIHWADAQNVNDLIGEALDPACKMPGFKVCAVRIIPI

SEQ ID NO: 65205 - protein, 138 aa, Rickettsia prowazekii str. Madrid E
MNIIDNFEQENIAKLTANKKIPDFEAGDTVKVTVKIIDKAIEKDGKEKLTERFQAYEGVVIAKRNRGITSSFLVRKISHGEGVERRFMTYSPIVHSIDVVKYGVVRRAKLYYLRHRNGKAARIREKLISRAKPKTAIS

SEQ ID NO: 65206 - protein, 138 aa, Petunia x hybrida
MAFINVLIIILTLSSTPISILSGPVTYNTNSTTNSSTNVAVSARKGADPPSKQPGGDNMICETCRALSEKLTCCFNASCVDLSSNRFNCGSCGIVCDLRTRCCGGLCVDITKDNGNCGNCGNACAPGQDCSFGLCGYA

SEQ ID NO: 65207 - protein, 294 aa, Scutellaria baicalensis
MEQYEKVEKIGEGTYGVVYKARDRVTNETFALKKIRLEQEDEGVPSTAIREISLLKEMQHGNIVRLQDVIHSEKRLYLVFEFLDLDLKKHMDSCPEFSKDPRLVKTFLNQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRIMGTPNEDTWPGVTSLPDFKSAFPKWPSKELATVVPNLDAPGLDLLGKMLCLDPSKRITARHALEHDYFKDIGFVP

SEQ ID NO: 65208 - protein, 539 aa, Kluyveromyces lactis NRRL Y-1140
MSKDKYDRSLKNLNMLRRPVLNNVTNTTESTFGKVLRQAKSRLQNSRTNNLPQGTANSYSNTKPAPLRDDIMVPEDKENYNPLAKIDEREELDSNLVHNHKSLGTQKHVTIDERQEIIGYSHLDTEKSAPSSSTYSSEHTENDGVHDVNPNVQRSDNEADFKMQTTNAFHENVNDGSDATDDASSGSKSSNECPAVNVGNSLAPMPIDENANNSASSVELRAKQLQVEDSKKRPISTVVEQTLPKKFKVCEKGKEYEWEDLDEEDINDPFMVSEYVTDIFEYLHRLEMMTLPNRHELFKHANIQQNRDILVNWMVKIHNKFGLLPETLYLALNIMDRFLCKELVQLEKLQLVGTACLFIASKYEEVYSPSVKHFAYETDGACDEEEIKEGEKFILKTLEFNLNYPNPMNFLRRISKADDYDIQSRTLAKYLLEISIVDFKFIGILPSLCAAASMFLSRKMLGKGQWDGNLIHYSGGYTKDELAPVCNMVMEYLVQPVVHDELFKKYASRRFMKASVISRQWAKKVMSHNYDIMTLHDSE

SEQ ID NO: 65209 - protein, 133 aa, Petunia x hybrida
VLIIILTLSSTPISILSGPVTYNTNSTTNSSTNVAVSARKGADPPSKQPGGDNMICETCRALSEKLTCCFNASCVDLSSNRFNCGSCGIVCDLRTRCCGGLCVDITKDNGNCGNCGNACAPGQDCSFGLCGYA

SEQ ID NO: 65210 - protein, 408 aa, Kluyveromyces lactis NRRL Y-1140
MRPRTRSSWSVSDAEAMEKSSHQRKRVALSEQPLHDNKLKSSVGSLRNSQVDEGKNKIYGNSSQTTSSVSLKRQIYRDDDDEEQKSDVRSDDDILEPRKSHKRLKCESLERRREELDSQDKEDVTMCYDYSDDIFDHLYTRQFETTPKINYLKDKNYEFYLRPTMRSILVDWIIEVHCKFQLLPETLYLSINLMDRYLSFNKVTLPKLQLIAITSLLIAAKFEEVNLPKLSNYSYITDNAYSNDEIKQAEFVILNKLEYNIGWPNPLNFLRRISRCDEYDSITRTLGKCLIGYMISCPHFIDVVPSKIASVAMFTAQRIVHEDFQWDELWDYYSCFSFKDNEIELKELSQILINDIAKPTTQLNALIHKYKKIGTWNKIHDWCLKHCTYEELNPSDYASSSPASSTSL

SEQ ID NO: 65211 - protein, 184 aa, Zea mays
QVIKDFASGEIKQASTLFDCDVTLDDYLLKSYYKTASLIAASTRSAAIFSGVGSGVCEQMYEYGRNLGLAFQVVDDILDLTQSAEQLGKPAAGSDLAKGNLTAPVILALREEPRLRGIIESEFCEPGSLAAAVELVHRGGGIRSARELAEEKGGLALRSLQCLPRSEFRSALERVVHYNLQRVR

SEQ ID NO: 65212 - protein, 225 aa, Magnetospirillum magnetotacticum MS-1
MSTLTALSRRAQAVAPFLAMDVMAAAGARERRGEGVVHMEVGQPSAPAPRAVIAAAQAALADGRIPYTEALGLPALRARIARHYAETYGVTVSPERVVVTTGSSAGFVLAFLALFDAGARIGVPRPGYPAYDGILRALDLIPQPLTLQAEDRYAPTSALVGAVHAAHPLSGLLVMSPANPSGTVIAPARLAELCATARGLGLAFISDEIYHGLSYGVPTATALQF

SEQ ID NO: 65213 - protein, 317 aa, Oryza sativa
  misc_feature (297)..(297): Xaa can be any naturally occurring amino acid
MAPSRPLMRGIRPPRVFPTRGGRTSPLALALAALLLASALLLALIAFGVFSLPVSAPNAATTDSAAAGGDAEPADPRPPRTRARRDLSEGLGERGAQWTEVISWEPRAFVYHNFLSKEECDYLIGLAKPHMVKSTVVDSTTGKSKDSRVRTSSGMFLQRGRDKVIRAIEKRIADYTFIPMEHGEGLQVLHYEVGQKYEPHFDYFLDEYNTKNGGQRMATLLMYLSDVEEGGETIFPDANVNSSSLPWYNELSECARKGLAVKPKMGDALLFWSMKPDATLDPLSLHVPLQISLWSEXGGCPVIKGNKWSSTKWMHVL

SEQ ID NO: 65214 - protein, 232 aa, Burkholderia pseudomallei K96243
MTIEVGLLLFPQVQQLDLTGPHDVFASLPGVTVRLVWKTREPVASSSGLVLAPNATFDDCPPLDVICVPGGIGVADLMEDADTLAFLRRHAAHARYVSSVCTGALVLGAAGLLRGRRATTHWAFHSLLAPFGATPVRERVVRDGNLVTGGGVTAGIDFALTLAAELVGEDDAQAVQLQLEYAPAPPFAAGDPDTAPARIVERMRERSKPVLARREQVVARAVAALERRRADG

SEQ ID NO: 65215 - protein, 337 aa, Glomerella lindemuthiana
MAPIKVGINGFGRIGRIVFRNAVEHPDVEIVAVNDPFIETKYAAYMLKYDSTHGIFNGEIAQDGNDLVINGKKVKFYTERDPAVIPWKETGADYVVESTGVFTTIDKAKAHLQGGAKKVIISAPSADAPMYVMGVNEKSYDGSAVISQASCTTNCLAPLAKVINDKYTIIEGLMTTVHSYTATQKTVDGPSAKDWRGGRTAAQNIIPSSTGAPKAVGKVIPELNGKLTGMSMRVPTANVSVVDLTVRIEKGATYDEIKQAIKEAAEGPLKGVLAYTEDDFVSTDMIGNPNSSIFDAKAGISLNNNFVKLVSWYDNEWGYSRRVLDLLAHVAKVDASK

SEQ ID NO: 65216 - protein, 205 aa, Bacillus cereus ATCC 10987
MIKPIKIGIGGPVGAGKTMLVEKLTKHLNTDYEIAAITNDIYTKEDAKILLKTGVLPEDRIIGVETGGCPHTAIREDASMNFEAIEELMIRHNNLDIIFIESGGDNLAATFSPELVDFSIYIIDVAQGEKIPRKGGQGMIKSDVFVINKTDLAPYVGADLGVMEQDTKHYRHNKPYFFTNLKDEEGLQELINWMRQNIMLEGLKK

SEQ ID NO: 65217 - protein, 164 aa, Burkholderia xenovorans LB400
MASVAQLLRSKTSQRVWSTQASASVYDAIAVMAHRQVGALIVAHEGRIAGIVTERDYARKIVLMDRSSRHTPVRDIMSTAVRYIGPDQTTEECMALMTEHRIRYLPVITAGQVIGMVSIGDLVQNLIVEHEQTIQQLEHYIHGNGFQAAQSGSQARRAASLTRQ

SEQ ID NO: 65218 - protein, 173 aa, Oryza sativa
SNTKTPQKAVTSISITPGLSGQLKKAFVTGVPSLERTELEAACEGFINVIGTLPECTLYKGTLSSGVEIAVLSTSLNSAQQWSARSEEQFRNKISVLSRVNHKNFMNLIGYCACDEPFTRMMVFEYAPCGSLFEHLHIREAEHLDWKTRLRIIMGVAYCLEHMSQLDPSSSSP

SEQ ID NO: 65219 - protein, 668 aa, Saccharomyces cerevisiae
MEDKFANLSLHEKTGKSSIQLNEQTGSDNGSAVKRTSSTSSHYNNINADLHARVKAFQEQRALKRSASVGSNQSEQDKGSSQSPKHIQQIVNKPLPPLPVAGSSKVSQRMSSQVVQASSKSTLKNVLDNQETQNITDVNINIDTTKITATTIGVNTGLPATDITPSVSNTASATHKAQLLNPNRRAPRRPLSTQHPTRPNVAPHKAPAIINTPKQSLSARRGLKLPPGGMSLKMPTKTAQQPQQFAPSPSNKKHIETLSNSKVVEGKRSNPGSLINGVQSTSTSSSTEGPHDTVGTTPRTGNSNNSSNSGSSGGGGLFANFSKYVDIKSGSLNFAGKLSLSSKGIDFSNGSSSRITLDELEFLDELGHGNYGNVSKVLHKPTNVIMATKEVRLELDEAKFRQILMELEVLHKCNSPYIVDFYGAFFIEGAVYMCMEYMDGGSLDKIYDESSEIGGIDEPQLAFIANAVIHGLKELKEQHNIIHRDVKPTNILCSANQGTVKLCDFGVSGNLVASLAKTNIGCQSYMAPERIKSLNPDRATYTVQSDIWSLGLSILEMALGRYPYPPETYDNIFSQLSAIVDGPPPRLPSDKFSSDAQDFVSLCLQKIPERRPTYAALTEHPWLVKYRNQDVHMSEYITERLERRNKILRERGENGLSKNVPALHMGGL

SEQ ID NO: 65220 - protein, 285 aa, Escherichia coli CFT073
MSVKRVLRNTIRKEKEENRVTEPLTETPELSAKYAWFFDLDGTLAEIKPHPDQVVVPDTILQGLQLLATASDGALALISGRSMVELDALAKPYRFPLAGVHGAERRDINGKTHIVHLPDAIARDISVQLHTVIAQYPGAELEAKGMAFALHYRQAPQHEDALMTLAQRITQIWPQMALQQGKCVVEIKPKGTSKGEAIAAFMQEAPFIGRTPVFLGDDLTDESGFAVVNRLGGMSVKIGTGATQASWRLAGVPDVWSWLEMITTALQQKRENNRSDDYESFSRSI

SEQ ID NO: 65221 - protein, 294 aa, Scutellaria baicalensis
MDQYEKVEKIGEGTYGVVYKARDRVTNETIALKKIRLEQEDEGVPSTAIREISLLKEMQHGNIVRLQDVVHSEKRLYLVFEYLDLDLKKHMDSCPEFSQDPRTVKMFLYQILRGIAYCHSHRVLHRDLKPQNLLIDRRTNALKLADFGLARAFGIPVRTFTHEVVTLWYRAPEILLGSRHYSTPVDVWSVGCIFAEMVTQRALFPGDSEIDELFRIFRVMGTPTEETWPGVTSLPDFKSSFPKWPTKELATVVPSLDSAGLDLLGKMLILDPSKRITARSALEHEYFKDIGFVP

SEQ ID NO: 65222 - protein, 345 aa, Prochlorococcus marinus subsp. pastoris str. CCMP1986
MNFLACDLGGTKVLLGIFKKEVNTCTPILILKKKYLSSEWDSIDTILEDFLKNECKNINHPFSACFAVAGPISNNNAEIINLSWNISGDELKKKFKFKNCELVNDFAVQIYGIPFLKKSQYSAIQNGDRSVGVNKDLHAIVGAGTGLGIAKGIISGNKVKVLASEGGHVEYSPKSDLEWELKNWLKYSLKVERISCERIISGTGLSRIAEWRLSKPDAKNHPLQKYLKELKTSDNLRKELPQEICNLSNLGDKMMIEVERIWLDAYASLLGDVALQELCYGGLWISGGTAPKHFINFKSGLFMKQFSDKGRLKDILKNIPVNVILDEEFGLFSAACRAKMLSQKE

SEQ ID NO: 65223 - protein, 347 aa, Scutellaria baicalensis
MHLLHKLTSPSLSLSHSDLSFSLWNQFQEREREAQILSPINSSMEKYEKLEKVGEGTYGKVYKAKEKATGQVVALKKTRLEMDEEGVPPTALREVSLLQMLSQSLYVVRLLCVEHVDNKNGKPLLYLVFEYLDTDLKKFIDSHRKGPNPRPLPPPQIQSFLYQLCKGVAHCHSHGVLHRDLKPQNLLLDKDKGILKIADLGLGRAFTVPLKSYTHEIVTLWYRAPEVLLGSTHYSTAVDMWSVGCIFAEMARRQALFPGDSEFQQLLHIFRLLGTPTEKDWPGVSSLRDWHVYPQWEPQNLARAVPALGPDGVDLLSKMLKFDPADRISAKEAMDHPYFDTLDKCQF

SEQ ID NO: 65224 - protein, 285 aa, Pseudomonas putida KT2440
MSDYPTPPFPSQPQSVPGSQRKMDPYPDCGEQSYTGNNRLAGKIALITGADSGIGRAVAIAYAREGADVAIAYLNEHDDAQETARWVKAAGRQCLLLPGDLAQKQHCHDIVDKTVAQFGRIDILVNNAAFQMAHESLDDIDDDEWVKTFDTNITAIFRICQRALPSMPKGGSIINTSSVNSDDPSPSLLAYAATKGAIANFTAGLAQLLGKQGIRVNSVAPGPIWTPLIPATMPDEAVRNFGSGYPMGRPGQPVEVAPIYVLLGSDEASYISGSRYAVTGGKPIL

SEQ ID NO: 65225 - protein, 496 aa, Scutellaria baicalensis
MASSAGVRRPTTSSLAKRHASSASDNVGKVASSASASKKRPALANVTNQRHGTGSANAGRAPLPESSKIAPCTTKIVSIKKGPSASTNSGFPGAILPTSSSVKQNIVAVGRSTFIPKSDVVLPKTLAAPVSCSMDVSPDKSDSLSVSMDESMSTCDSLKSPDVEHVDYIDVAAVDSIERKASNMLCISDHMEIAGNLCKRDALASLESGDKIVDVDENLDDPQLCATIACDIYKHLRASEAKKRPATNFMERVQKDINASMRAILIDWLVEVAEEYRLVPDTLYLTVNYIDRYLSGNVMDRQRLQLLGIACMMIASKYEEICAPQVEEFCYITDNTYFKDEVLEMESAVLNYLKFEMTAPTAKCFLRRFVRAAQGVNETPLLQFECLANYITELSLLEYSMLCFAPSLIAAASIFLARFILLPSKRPWNHTLRHYTLYQPYDLRDCVLALHGFCCNSHNSSLPAIREKYSQHKYKFVAKKYCPLSIPPEYFHNVSS

SEQ ID NO: 65226 - protein, 1581 aa, Glycine max
  misc_feature (1452)..(1452): Xaa can be any naturally occurring amino acid
MDSQVLLGVALSSVGGFSTSIGALFVILSKAPSLKVLGLLQGFAAGLMLSISFFDLTHNALNSLGFLRGNLWFFAGVIFFAVVAKFIPEPTVAPPTSDEKKVGKQGNKDIMKRRRRQVLISGVVTAIGISLHNFPEGMAVYLGSMKGIRVGLNLALAIALHNIPEGVAVALPVYFATQSKWEAFKLASLSGFAEPLGVVIVACLFPTSLNPEILEGILGSVGGVMAFLTLHEMLPLAMASNGLSMFQFSRLTKENYDNWCRRMKALLGSQDAWEIVEKGYAQPQNEAILSPNEKETLLKSKKKDQQALTFIHQGLDEAMFELVSNATTSKEAWEILKTSLEGVDKESKSISDFGNKVLAIVNQMKRYGENMEDVRVVEKILRSLIAKFDYVVCAIEESKDLDSMTVDQLMGSLQAYEERFNRRHDEPLEQVLKAKASLKENGGESSQKARGRGRGRGRGRGHGQGRGGRGDRDNFDNNEWRSHQSTRSHGRGRGRGRNNYEKAYERRYDKSNVECFNCHKYGHYSWECRKNVEEKVNLVDDKEEVEESTLLLSLNNGEKEDKCLWYLDNGASNHMCGCKEKFVELDEKVKGNVSFGDSSKVQIQGKCTILISLKDGAHKLITDVYYVPKLKSNILSLGQLVEKGYEIHMKDCCLWLRDKNSNLIAKVFMSRNRMFTLNIKTNEAKCLKASIKDESWCWHMRFGHLNFGALKSLGEEKMVKGMPQINHPNQLCEACLLGKHARRSFPKEANSRAKEPLQLVYTDVCGPIIPPSCGNNKYFLLFIDDYSRKTWVYFLKQKSEAFVAFKNFKALVEKESGYVIKALRSDRGGEFTSKEFNEFCEKYGIRRPLTVPRSPQQNGVAERKNITILNMTRCMLKAKNMPKEFWAEAVACAVYLSNRSPTKNVKDQTPQEAWSGVKPRVDHLRVFGSIAYAHVPDQGRFKLDDRSEKHVFIGYDASSKGYKLYNPNNGKTIVNRDVEFYEEGTWNWEEKEDTYDFFPYFEEIDEEALTPNDSTPALSLTPSTNEASSSSEGSSSERPRRMRNIQELYDETEVINDLFCLFVDSEPLNFDEAMKDKRWRQAMEEEIKAIEKNNTWELSSLPKGHEAIGVKWVFKIKKNAKGEVERHKARLVAKGYKQQYGVDYDEVFAPVARMETIRLLISLAAQMKWRIFQLDVKSAFLNGYLEENVYVEQPMGFVIEGQEGKVLKLNKALYGLKQAPRAWNTRIDKYFQDNGFVRCQNEYALYVKTFNNGDVLFICLYVDDLIFTGNNPNLFEDFKESMSREFDMTDMGLMSYYLGMEVKQTENGIFVSQERYTKEVLKKFNMLDCNPVNTPMEGGLKLSKFDEGEKVDSTVFKSLVGSLRYLTNTRPDILYAVGVVCRFTEAPTSPHLKAAKRIFRYLKGTIDFGLFYSPSNNYKLVGFCDSDFAGDVDDRKSTTGFVFFMGDCVFTXSSKKQGIVTLSTCEAEYVAATSCTCHVIWLRRLLEELQLLQKESTKIYVDNRSAQELAKNSVFHERSKHIDTRYHFIRECITKKEVELTHVKTQDQVADIFTKPLKFEDFRGLRARLGVQKNFPIKGGC

SEQ ID NO: 65227 - protein, 337 aa, Monascus pilosus
MVVPKVGINGFGRIGRIVFRNALEHEGVDIVAVNDPFIEVHYAAYMLKYDSTHGRFNGTVEFDGNSLIVNGKKIKFYAERDPAQIPWSETGAEYVVESTGVFTKHEKASLHLKGGAKKVIISAPSSDSPMFVMGVNNDQYTKDITVLSNASCTTNCLAPLAKVINDKFGIVEGLMTTVHSYTATQKVVDGPSNKDWRGGRTAAQNIIPSSTGAAKAVGKVIPSLNGKLTGMSMRVPTSNVSVVDLTARLEKAATYDEIKQAIKEASEGPLKGILGYTEDDVVSSDLNGDPHSSIFDAKAGIALNSNFVKLVSWYDNEWGYSRRVIDLIAYIAQVDAQ

SEQ ID NO: 65228 - protein, 471 aa, Xanthomonas axonopodis pv. citri str. 306
MSSWLRRKSIDQVTVHEAGRQLVRSLSWPHLIALGIGAIVGTGIYTLIGVGADKAGPAVLLSFVAAGIVCACAALAYAEMATMMPAAGSAYTYSYTALGESIAWVVGWSLVLEYSLVVSTVAVGWSGYFVGFLQWLGVGLPQALIAGPHAGGIVNLPAVAITFLVAGLLMAGTKESATLNAVLVVLKIIALGVFVAIALPAFNSANLQPFMPYGFSKAMGPDGIERGVMAAAAIIFFAFYGFDAISTAAEETKNPGRDLSIGIVGSMIGCTLIYVLVALAAVGAMSFTVFGKSPEPLALILRELGHGKAALVIGAVAIIALPTVLLAFLYGQSRIFFVMSRDGLLPRGLSKVNARTGTPVAITLFTAVLVAALAGVARLDEIAALANAGTLAAFTAVAACLLVLRVREPGRARAFRTPLAWVVGPVAIGGCLYLFWSLPSKTQGWFLLWNALGVVVYLAYGRRNSRLNQAG

SEQ ID NO: 65229 - protein, 323 aa, Synechococcus sp. RS9917
MSTVTELLQPVEQDLEALLSDLRSLIGAGHPILQAAAEHLFSAGGKRLRPGIVLLISRALSPSGDLTARHRRLAEITEMIHTASLVHDDVVDEAATRRGVATVHSRFNHRVAVLAGDFLFAQASWHLANLDDLEVVKLLSRVIMDLADGEVKQGLFRYDTGQTFATYLEKSYCKTASLIANSAKAAGVLSGESPDHLQALYHYGRQLGLAFQVVDDILDFTGSDQQLGKPAASDLASGYLTAPALYALEEQHTLAGLIEREFSGDGDLEQALELVRASSAIPRTRELAETFAREAREALAWLPESPSRRALLDLPDFVLGRLY

SEQ ID NO: 65230 - protein, 241 aa, Synechococcus sp. RS9917
MSRWRRSGDCWCLWPAQPRALVEFIGGSYLAATPQISYRRLLEGLAQQGWAIHAWSYVPAFDHQLQARQAWDAFRSCRSILIQRVGELPPSLRLGHSLGCKLHLLAPDGGRNSSGLAALSFNNFAADRSIPLLGTLAPSLGVSTEFSPSPEETLRLIARHYLPARNLVVRFGTDSLDQSAALLACLQSRAGDQSTWLPMEGDHLTPASAGLRQGLLGDWADDPKRSRRLRQLIEALVAWAP

SEQ ID NO: 65231 - protein, 868 aa, Xylella fastidiosa Ann-1
MSASPTVERWIVLKFGGTSVSRRHRWDTIAMVVRKRLEEHGTRVLIVVSALSGVTNELTAIAQGVVDSAQRVAALEQRHRDFLAELGLDAQAVLGTRFAMLSDLLQDARAVTRSLDWQAELLGQGELLSSTLGAAYLGASGVDIGWMDARDWLTALPPQPNQSEWSQRLSVSCQWKSDVEWRTRFDAQRAQVLITPGFISRHQDGGTAILGRGGSDTSAAYFGALLGAACVEIWTDVPGMFSANPKEVPDARLLTRLDYYEAQEIATTGAKVLHPRSIKPCRDTDVPMLILDTERPDVLGTRIDAEVEPVLGVKAISRRDGIVLVSMEGIGMWQQVGFLADVFTLFKKHGLSVDLIGSAETNVTVSLDPSENLVNTDVLTALSTDLSQICKVKIIVPCAAITLVGRGMRSLLHKLSEVWATFGKERVHMISQSSNDLNLTFVIDETDADGLLAVLHFKLIESGAMPVQDRAVFGSPWREIIGHVRTRVMPWWHSARMRLLAMRDEEGIGPCYVYHLPTVRERARQLNSVAAVDQRYYAIKANPHPAILRTLIEEGFGLECVSLGELRHVFAVVPHLVPSRVLFTPSFASRVEYEQAFLLGVNVTLDNVEALRLWPEVFRDRTLWLRIDLGYGDGHHEKVTTGGKTSKFGLSVKRIDEFIDVAKTLNITVTGLHAHLGSGVERGNHWSRMYDELAGFASRIGSVSTLDIGGGLPIPYRPDDEPFDVGAWGASLAEVKALHPKFQLVIEPGRFLVAEAGVLLTRVTQVIEKDDILRVGLEAGMHTLIRPALYDAWHGVENLSRLDETPHVLCDVVGPICESSDVFGRRRRLPAATASGDLMLIADAGAYGFSMASTYNLRGLPAEVVLDA

SEQ ID NO: 65232 - protein, 333 aa, Streptomyces arenae
MTVRIGINGFGRIGRNVFRAAAARSSELEIVAVNDLGDVPTMAHLLAYDSILGRFPEEVTAEPGAIRVGDRTIKVLAERDPGALPWGDLGVDIVIESTGIFTDAAKARSHVDGGAKKVIIAAPASGEDFTVVLGVNDGDYDPERHTIISNASCTTNCLGVLAKVLHDAVGIDSGMMTTVHAYTQDQNLQDAPHKDLRRARAAALNIVPTSSGAAKAIGLVLPELAGRLDAFALRVPVPTGSVTDLTVTTRRGTSVEEVKEAYAAAASGPYKGLLSYVDAPLVSTDIVGDPASLFDAGLTRVCGPQVKVVGWYDNEWGYSNRLIDLATLIGSSL

SEQ ID NO: 65233 - protein, 335 aa, Xanthobacter flavus
MSVKVAINGFGRIGRNVLRAIIESGRTDIEVVAINDLGPVETNAHLFRFDSVHGRFPGEVKVAGDTIDVGRGPIKVTAVRNPAELPHKELGVDIALECTGIFTSRDKAAAHLAAGAKRVLVSAPADGADLTVVYGVNHEKLTNEHLVVSNASCTTNCLAPVAKVLNDAVGIEKGFMTTIHAYTGDQPTLDTMHKDLYRARAAAMSMIPTSTGAAKAVGLVLPELAGKLDGTSIRVPTPNVSVIDLKFVAKRATSKEEINEAIIAAASQQLKGILGFTDQPNVSIDFNHNPNSSTFHLDQTKVMEGTLVRVLSWYDNEWGFSNRMSDTAVAMGKLG

SEQ ID NO: 65234 - protein, 776 aa, Arabidopsis thaliana
MMMSDLSLDLVEEILSRVPATSLKRLRSTCKLWNALFKNPGFTKKQFLKAPKESLVLMLKEYSVCPMIANLSVSAPSIEFKGALNLKNYPPYSEEVDIHEACHCDGLLLCTTMDYRIVVWNPCLGETRWIRWPKNIYSRFALGYEKNKYGRIYKILRCWDRHNSPTGRVDEFEIYEFSSDSWRVLDLVALDCHIASHIGVSFKGNTYWLASDKKDKYGLLLCFDFTTERFTRLCLPPSQDVSKMALSVVGGKQLSLLSQSDSTSKIMEMWVTNIIEDVLMWSKSFTVDIPIRGDYCPYLTSYLVDEEKKVAAQVKERMSGKILCCWNTPNTIGAITSPMSFRLVVMHVGDETESFFSLGDQITNREPFMMSDLPLDLVEKILSRVPATSLKRLRSTCRRWNALLKDRRFTEKHFHKAPKESRVLMLKEYRVFPISVNLKVTPPSVDFKGALGYSHSNSEQVVITEVFHCDGLLLCTTNDDRLVVWNPCLGETKWIQLKVDYRRYVSIFALGYIQNNESCRSYKILWTWYSYDYNSSPPQRGLGFEIYEFSSDSSWRVLDDVNHDSVVNHNSIIRSGVSLKGNTYMLAYDIEENSKFLLMFDFTTERLKRLCLPHFQDVGEMDLSVREEQLSVLNWSRITSKMEIWITNNFDTEATLLWKRVHLDSQCNCVRIFSSLYFDEEKKVVLYCNVKDGETSKKVVYIIGEDDGHYIEIPFVKSIKIERLQLIHTTRCAEGKERNLKDFVLADYSKTPSEPLLKFSQANLPQHQNSSNCCLR

SEQ ID NO: 65235 - protein, 319 aa, Salmonella typhimurium LT2
MKAMNKVWVIGDASVDLVPEKQNSYLKCPGGASANVGVCVARLGGECGFIGCLGDDDAGRFLRQVFQDNGVDVTFLRLDADLTSAVLIVNLTADGERSFTYLVHPGADTYVSPQDLPPFRQYEWFYFSSIGLTDRPAREACLEGARRMREAGGYVLFDVNLRSKMWGNTDEIPELIARSAALASICKVSADELCQLSGASHWQDARYYLRDLGCDTTIISLGADGALLITAEGEFHFPAPRVDVVDTTGAGDAFVGGLLFTLSRANCWDHALLAEAISNANACGAMAVTAKGAMTALPFPDQLNTFLSSHSLAQAMTVK

SEQ ID NO: 65236 - protein, 568 aa, Clarkia arcuata
MASPALISETEAWKDLKAHLEGIKRTHLRELMGDTERCQSMMVEFDNIFLDYSRQQASSDTINKLYKLADAAHLKQKIDRMYNGDHINSTENRSVLHVALRAPRNSAICSDGKNVVPDVWNVLDKIKDFSDRVRNGSWIGATGKKLKDVIAVGIGGSFLGPLFVHTALQTDPEASKNARGRELRFLANVDPIDVARNISGLNPESTLVVVVSKTFTTAETMLNARTLREWISSALGPSAVAKHMVAVSTNLPLVEKFGIDPINAFAFWDWVGGRYSVCSAVGVLPLSLQYGFAVVEKFLQGAHSIDQHFSSASFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSISILLPTLDGYRIGQLLAIYEHRVAVQGFVWGINSFDQWGVELGKSLATQVRKQLHASRVKGEPVEGFNFSTKTLLERYLEATSDVPADPSTLLPNI

SEQ ID NO: 65237 - protein, 569 aa, Clarkia concinna
MASPALISETEAWKDLKSHLEGIKKTHLRELMGDTERCQSMMVEFDNIFLDYSRQQASPDTISKLYKLADEAHLKQKIDRMYNGDHINSTENRSVLHVALRASRNSAISSDGKNVVPDVWNVLDKIKDFSDRARNGSWVGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLAIYEHRVAVQGFVWGINSFDQWGVELGKSLATQVRKQLHASRVKGEPVEEGFNFSTKTLLTRYLEATSDVPADPSTLLPNI

SEQ ID NO: 65238 - protein, 127 aa, Phaseolus vulgaris
MQMAPQANILFFTVVSSTYVPCNPPPKTPKHPPVPKPPSTKSGSCPENTLKFGVCADVLGLIGVELGKPPKTPCCNLIQGLADLEAAVCLCTALRANVLGINLNVPIKLNLLLNYCGKKTPKDFVCY

SEQ ID NO: 65239 - protein, 233 aa, Oryza sativa
MAAAAAAASATAAISGALLPHAVACHRLPPRPQLLAVSSSFRRLSLTASPRRASHLVPRADASAEAGEPEPAAEAEAEAVAASTDAEVEEGEAEAAVAVAEEEQEEEDEPPPPSKPPVKFGEIIGILNKQFIEEAEKVKTLPDLRPGDIIELRMQRPNKRRLSLFKGIIIAKHKSGVHTTIRVRRIIAGVGVEITFPMYSPRIKEIKVIRHKKVRRAKLYYLKHKLPRFSTFK

SEQ ID NO: 65240 - protein, 568 aa, Clarkia franciscana
MASPALISETEAWKDLKAHLEGIKTTHLRELMGDTERCQSMMVEFDNIFLDYSRQQASPDTINKLYKLADAAHLKQKIDRMYNGDHINITENRSVLHVALRAPRNSAICSDGKNVVPDVWNVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPINTFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLAIYEHRVAVQGFVWGINSFDQWGVELGKSLATQVRKQLHASRVKGEPVEGFNFSTKTLLTRYLEATSDVPADPSTLLPNI

SEQ ID NO: 65241 - protein, 82 aa, Glycine max
LPQSCPPLPPPLYKPVIGIVSHPGDGASGRLSNATGASYIAASYVKFVEAAGARVVPLIYTEPPEKLLKVKCFNFQPSLPHS

SEQ ID NO: 65242 - protein, 568 aa, Clarkia mildrediae
MASPALISETEAWKDLKAHLEGIKRTHLRELMGDTERCQSMMVEFDNIFLDYSRQQAIPDTIKKLYKLADAAHLKQKIDRMYNGDHINSTENRSVLHVALRAPRDSAICSDGKNVVPDVWNVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPTAVAKHMVAVSTNIPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKNENVAEHLIPHKTFTGNRPSLSILLPTLDAYRIGQLLAIYEHRVAVQGFVWGINSFDQWGVELGKSLATQVRKQLHGSRVKGEPVEGFNFSTKTLLTKYLEATSDVPADPSTLLPNI

SEQ ID NO: 65243 - protein, 311 aa, Aspergillus oryzae
MGLFSSAEPPLTEANLSNQSGMTFVVTGATSGYGLHLATILYQHGGKVYLAARNASRAQSVIDDITRRHPESKGQLVYLHLDLGDLSTIKKSAEEFLTKESKLHVLWNNAGVMIPPQGSTTAQGYELQLGTNVIGPFLFTKLLYPALAKAAADSPPNSVRVVWLSSSAVRMAPTPAIDFSNMDYHKDEGAWTKYGRSKAANVLLAVEFARRSKKDGVASIVGPLKRISPAENNALLASRCRVGQRPEVGAYTELFAGLQPDIDPVNSGNWSLTCRVVVPPGRVVAGRKDLYDPELSEKFWQWNEEQVRSYL

SEQ ID NO: 65244 - protein, 523 aa, Zea mays
MAGGGIVNTGGGKDYPGKLTLFVLLTCIVAATGGLIFGYDIGISGGVTSMNPFLEKFFPEVYRKKQEAKTNQYCKYDNQLLQTFTSSLYLAALVASFFAATVTRAVGRKWSMLVGGLTFLVGAALNGAAQNIAMLIIGRILLGVGVGFANQSVPVYLSEMAPARLRGMLNIGFQLMITIGILAAELINYGTNKIKAGYGWRVSLALAAVPAAIITLGSLFLPDTPNSLLERGHPEEARRMLRRIRGTDDIGEEYADLVAASEEARQVRHPWRNILRRRYRAQLTMAVAIPFFQQLTGINVIMFYAPVLFDTLGFKNDASLMSSVITGLVNVFATVVSIVTVDRVGRRKLFLQGGAQMIVCQLIVGTLIAAKFGTSGTGDIAKGYAAVVVVFICAYVAGFAWSWGPLGWLVPSEIFPLEIRPAGQSINVSVNMFFTFCIAQAFLTMLCHFKFGLFYFFAGWVVIMTVFIAFFLPETKNVPIEEMVLVWKSHWFWKRFIADEDVHVGIGNNHPAKNGSDTKGADA

SEQ ID NO: 65245 - protein, 530 aa, Brassica napus
MKHLGLILAFLLALATCKADEEITCEENLPFKCSQPDRLNSSSFEKDFIFGVASSAYQIEGCLGRGLNVWDGFTHRYPNKSGPDHGNGDTTCDSFSYWQKDIDVLDELNATGYRFSIAWSRIIPRGKRSRGVNKDGINYYHGLIDGLIDKGITPFVTLFHWDLPQVLQDEYEGFLDPQIIHDFKHYANLCFQEFGHKVKNWLTINQLYTVPTRGYGAGSDAPGRCSPMVDTKHRCYAGNSSTEPYIVAHNQLLAHATVVDLYRKNYSIGPVMITRWFLPYNDTDPDSIAATERMKEFFLGWFMGPLTNGTYPQIMIDTVGERLPSFSPEESNLVKGSYDYLGLNYYVTQYAQPSPNPVHWANHTAMMDAGAKLTFRGNSDETKNSYYYPKGIYYVMDYFKTKYYNPLIYVTENGISTPGNETRDESMLHYKRIEYLCSHLCFLSKVIKEKHVNVKGYFAWSLGDNYEFDKGFTVRFGLSYIDWNNVTDRDLKLSGKWYQKFISPAIKNPLKKDFLRSSLTFEKNKKFEDA

SEQ ID NO: 65246 - protein, 472 aa, Aspergillus oryzae
MAPSRVDDDIQSRPNTQILPNVKPNGEGHLLHRSLIEHPVMVEKAKGLTLHLSDGRTVLDACAGAAVALIGHGREEVHQAIMKQMQNVSYIHTQSYTTSSAEDLADFLLSGNPYGLEKAFFVGSGSEAVESALKLARQYHYENNEPDRLHFVSRQQSYHGNSIAAMSISSNLARKVPFTGFMYPHTSHVTPAYAYRHQMAGETEAEFTARLLRELEEEFLRIGPEKIIAFVAEPIVGATAGCVTAPAGYFTGVRAMCDRYGILLILDEIMCGVGRSGTFFAFEQENVVPDIMTIAKGLGGGYAPIAGVLVHKKVIDVLRKGSNAFNHGHTYQAHPVSCAAALAVQQIVRREKLVERCAALGQILEQQLRTELAHCPSVGDIRGRGLFWAVEFVQDSTTKETFDPTFKFGLRVQQAAFDRGLAVYPGAGTVDGMRGDHILLAPPFTVTEAELRQICEVLREAIKSQEKEYMTC

SEQ ID NO: 65247 - protein, 792 aa, marine gamma proteobacterium HTCC2207
MKFSESWLRSAVNPSISIEELVAQVTMAGLEVDAVESAAPEMSGVVVGEILSVEQHPDADKLRVCQVAGGGETAQVVCGAPNARAGIKVPFATVGAKLPGDFKIKKAKLRGVESFGMLCAQTELQLGDDDDGLWELPADASVGSDLIEYLELNDNIIEVDLTPNRGDCLSIRGLAREVGVLNKTAVLEQACAPVTASINDSISITLEAPEACARYVGRVVRNLDLRQPTPQWMQEKLRRSGVRSLGPAVDVTNYVLLELGQPMHAFDLSKIDGGIVVRMGRDEKVKLLDDSDVVIDTQTLVIADQSKALAMAGIMGGDESAVGDDTTDILFESAWFNPLAIAGKARNYGKHTDSSHRFERGVDSELQVAAIERATALMLEICGGEAGPVVIQESAEHLPAPATIKLRDAHLAQQLGVVIGSAEIDDILARLGLTFVSRDDEGSTWVAPSWRFDIAIEQDLVEEVARIYGYNNLPTSTPTMALELQAKPERQQDLSIFRQQLVASGYQEAVTYSFVDPELQKLVDPETDGIALQNPISADMSVMRTSLWSGLLSTAIYNLNRQQNRVRIFEAGQCFVPGENGELTQNMALAGLICGSRTPAGWTASKDKVDFFDIKGDLESVLALTGLAEQFSFSAAEHPALHPGQSAMLSRNGEQVGWIGQLHPKLQAQLDVSTPVYLFQVDVAKVSESRLPKFSEVSKFPAVRRDLAFLVDSQIASADLMSEARNAAGEHLVDLMLFDVYQSKDIDNKGKSLALGLTFQHASRTLTDEEINTAIDRVVKKLDNKFKAELRG

SEQ ID NO: 65248 - protein, 354 aa, Candida glabrata CBS 138
MSDWKVDPDNRRRLLQLQKIGANKKCVDCGAPNPQWASPKFGIFICLECAGTHRSLGVHISFVRSITMDQFKQEELVRMEEGGNEPFTEYMTAHGIDMTLPHKFKYENPIAEDYKEKLTCKVEGREFVEPQHPDFDPKSLGKSEPVSEPSIASEQSSRQNTPIESRRIGSPTRKEKNEEYFAQLGKKNDSKPDHLPPSQGGKYQGFGNTPVNNRNATDPSTNTMSLENLQTDPLGTLTKGWGLFSSAVAKSFDDVNETYIKPNVQQWNTGELSEETKRAAAQFGQKFQETSTYGMQAFSSFTKNIQKQYINGDESYSQLPASQKNQSASTSRDDLLGDTKKSVPKAGEDEWEEF

SEQ ID NO: 65249 - protein, 417 aa, Trichoderma viride
MSLSNKLSITDVDVKGKRVLIRVDFNVPLDENKNITNPQRIAGAIPTIKHALDNGAKAVILMSHLGRPNGAVNAKYSLKPVVPKLEELLGKPVTFAPDCVGPEVEAIVNKADNGAVILLENLRFHIEEEGSSKDKEGNKTKADKAKVEEFRKGLTALGDVYVNDAFGTAHRAHSSMVGVDLPQKAAGFLMKKELDYFAKALESPQRPFLAILGGAKVSDKIQLIDNLLDKVNTLIICGGMAFTFKKVLDNLAIGDSLFDKAGAETVPKLVEKAKAKNVKIVLPTDFITADKFDKDANTGLATDKDGIPDGWMGLDCGDESIKLYKEAIDEAKTILWNGPAGVFEFEKFAGGTKATLDAVVEGCKNGKIVIIGGGDTATVAAKYGVEDKLSHVSTGGGASLELLEGKELPGVTALSSK

SEQ ID NO: 65250 - protein, 372 aa, Scutellaria baicalensis
MVSEFQEHESLLQNPIFDALYCDEERFDECVGGAGSGFKEPEINDFNEIHNNPFAFLFEHDLFWESEELDALLTKEKTQTHLTFDEINSDASLKAMRNEAINWMLKVIAHYGFNALTAVLAVNYYDRFITSVCFQKDKPWMSQLAAVACLSVAAKVEETQVPLLLDLQVEESKYLFEAKTIQRMELLVLSTLQWRMNPVTPISFFDHIARRFEFVKNLHSVFLRRCESLILSIITDCRLVKYFPSVIASAAMIYAIREFETPDALEYEDQLLSVLRTSKDKVDDCRKLIVDAMYGGFSHKPCYKRKYESIPSSPSGVIDAYLSSDSSVDSWAVTLSVSSSPEPSFKRSKAQDQHMRLAPLSSVSLGLAHRIN

SEQ ID NO: 65251 - protein, 106 aa, Triticum aestivum
MGRKKGLPEFEETAPDGFDPANPYKDPVAMVEMREHIVREKWIQIEKAKIMREKVKWCYRVEGVNHYQKCRHLVQQYLDSTRGVGWGKDHRPMSLHGPKPEAVEAE

SEQ ID NO: 65252 - protein, 355 aa, Thermoanaerobacter tengcongensis MB4
MEIFKIMEKYDYENVVLCYDKTSGLKAIIAIHDTTLGPALGGCRMWTYDSEEDAINDALRLARGMTYKNAAAGLNLGGGKAVIIGNPRTDKSEALFRSFGRYVESLKGRYITAEDVGTNVKDMEYIRYETKYVAGLPETSGDPSPFTAYGVYRGMQAAAEEIFGTSDLRGRVVAIQGIGNVGYHLAKYLYEAGAKLIVTDIFEENAKRAVEEFGAEYVKPDEIYGVECDIFAPCALGAIINDETIPQLKCKIVAGSANNQLKEERHGDILQQKGILYVPDYIINAGGVINVADELNPSGYNRERAMRKVSMIYDTVKKVIEKAKKENVPTYVAADRVAEERIKTIAAVKDNYIVR

SEQ ID NO: 65253 - protein, 235 aa, Zea mays
  misc_feature (83)..(83): Xaa can be any naturally occurring amino acid
  misc_feature (97)..(97): Xaa can be any naturally occurring amino acid
MALANKLGGLLKKATSSNPSVYQAIRCMSSKLFVGGISYQTDDHSLRDEFAKYGQVIEARIIIDRESGRSRGFGFVTYTSSEXASAAITALDGKTLXGRSIRVNHANEKTGGFRGGGGYGGGGYGGGGGYGGAGGGGGYGGGHYGGGGGSGGYGGGDYGGNFTAGGSDSFANSNFGSDSSFGGNGAGGFDATGGSTGDDGFSGTPDDNFGGNKNEETMDDIFKDDEPDSYADKRS

SEQ ID NO: 65254 - protein, 355 aa, Thermoanaerobacter tengcongensis MB4
MKIFERMEVKDYENVIFCHDKASGLKAIIVIHDTTLGPALGGTRMWMYNTEEEALEDALRLARGMTYKNAAAGLNYGGGKAVIIGDPRKDKSEALFRSFGRYIEALKGRFITGEDVGITVQDVEYMRYETKHVVGLAETSGDPSPVTAYGVYRGMQAAAEEVFGTSDLKGKKVAIQGVGKVGYTLAKYLNEAGAKIIVTDIFEDNVKRVVEDFGAEYVKPEEIYGVDCDIFAPCALGGVINDETIPQLKCKIIAGSANNQLKEERHGDILQEKGILYVPDYIINAGGVINVADELEPSGYNRERALRKASMIYDTIKSVIKKSKEENIPTYKAADRVAEDRIKAIAAIKTNYILK

SEQ ID NO: 65255 - protein, 570 aa, Clarkia rostrata
MASPALISETEAWKDLKAHLEGIKMTHLRELMGDTERCQSMMVEFDNIFLDYSRQQASPDTISKLYKLADEAHLKQKIDRMYNGDHINTTENRSVLHVALRAPRNSAICSDGKNVVPDVWSVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSVDGLPLPFESGEIDFGEPGTNGQHSFYQLIHQGRVIPCDFIGVVKSQQPVYLKGEVVNNHDELMSNFFAQPDALAYGKTPEELKKENVSEHLIPHKTFTGNRPSISILLPTLDAYRIGQVLAIYEHRVAVQGFVWGINSFDQWGVELGKSLATQVRKQLHGSRVKGEPVEEGFNFSTKTLLTRYLQATSDVPADPSTLLPNII

SEQ ID NO: 65256 - protein, 568 aa, Clarkia williamsonii
MASPALISETEAWKDLKAHLEGIKMTHLRELMGDTERCQSMMLEFDNIFLDYSRQQASPDTISKLYRLADAAHLKQKIDHMYNGDHINSTENRSVLHVALRAPRNLAICSDGKNVVPDVWNVLDKIKDFSDRVRNGSWIGATGKELKDVIAVGIGGSFLGPLFVHTALQTDPEASKNARGRELRFLANVDPIDVARNISGLSPETTLVVVVSKTFTTAETMLNARTLREWISSALGPSAVAKHMVAVSTNIPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSISLLLPTLDAYRIGQLLAIYEHRVAVQGFVWGINSFDQWGVELGKSLATQVRKQLHGSRVKGEPVEGFNFSTKTLLTRYLEATSDVPADPSTLLPNI

SEQ ID NO: 65257 - protein, 568 aa, Clarkia xantiana
MASPALISETEAWKDLKAHLEGIKMIHLRELMGDTERCQSMMVEFDNIFLDYSRQQASPDTISKLYKLADAAHLKQKIDRMYNGDHINSTENRSVLHVALRAPRNSAICSDGKNVVPDVWNVLDKIKDFSDRVRNGSWIGATGKELKDVIAVGIGGSFLGPLFVHTALQTDPEASKNARGRELRFLANVDPIDVARNISGLNPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGIVKSQQPVYLKGEVVNNHDELMSNFFAQPDALAYGKTPEQLKNENVSEHLIPHKTFTGNRPSISILLPTLDAYRIGQLLAIYEHRVAVQGFVWGINSFDQWGVELGKSLATQVRKQLHASRVKGEPVEGFNFSTKTLLTRYLEATSDVPADPSTLLPNI

SEQ ID NO: 65258 - protein, 569 aa, Clarkia concinna
MATPSLISETEAWKDLKAHLEGIKRTHLRELMGDTERCQSMMVEFDNIFLDYSRQQASPDTINKLFKLADAAHLKRKIDRMYNGDHINSTENRSVLHVALRAPRNSAICSDGKNVVPDVWSVLDKIKDFSERVRNGSWVGATGKELKDVIAVGIGGSFLGPLFVHTALQTDPEASKNAIGRELRFLANVDPIDAAKNISGLNPETTLVVVVSKTFTTAETMLNARTLREWISSALGASAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSVDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFNGNRPSLSILLPTLDAYRIGQLLAVYEHRVAVQGFVWGINSFDQWGVELGKSLATQVRKQLHASRVKGEAVEEGFNFSTKTLLTRYLEASSDVPADPSTLLPKI

SEQ ID NO: 65259 - protein, 569 aa, Clarkia xantiana
MATPSLISETEAWKDLKAHLEGIKRTHLRELMGDTERCQSMMVEFDNIFLDYSRQQASPDTINKLYKLAEAAHLKQKIDRMYNGDHINSTENRSVLHVALRAPRNSAICSDGKNVVPDVWNVLDKIKDFSERVRNGSWVGATGKELKDVIAVGIGGSFLGPLFVHTALQTDPEASKNARGRELRFLANVDPIDAARNISGLNPETTLVVVVSKTFTTAETMLNARTLREWISSALGVSAVAKHMVAVSTNLPLVEKFGIDPNNAFAFWDWVGGRYSVCSAVGVLPLSLQYGFAVVEKFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSLSILLPTLDAYRIGQLLAIYEHRVAVQGFVWGINSFDQWGVELGKSLATQVRKQLHASRVKGEPVEEGFNFSTKTLLTRYLEATSDVPADPSTLLPKI

SEQ ID NO: 65260 - protein, 337 aa, Yersinia pseudotuberculosis IP 32953
MKTLGEFIVEKQLDFSHATGELTALLSAIKLGAKIIHRDINKAGLVDILGASGVSNIQGEDQMKLDLFANEKLKAALKARGEVAGIASEEEDDIVIFDGGRAENAKYVVLMDPLDGSSNIDVNVSVGTIFSIYRRITPFGTPITEEDFLQPGTKQVAAGYVVYGSSTMLVYTTGYGVHAFTYDPSLGVFCLSHEKVRYPATGCMYSINEGNYIKFPLGVKKYIKYCQEQDEATKRPYTSRYIGSLVADFHRNLLKGGIYIYPSTASHPQGKLRLLYECNPMAFLAEQAGGKATDGVNRILDIVPEKLHQRAPFFVGTKSMVEDAEGFIAKFPDEEAK

SEQ ID NO: 65261 - protein, 340 aa, Streptococcus agalactiae 2603V/R
MKRIAVLTSGGDAPGMNAAIRAVVRKAISEGMEVYGINQGYYGMVTGDIFPLDANSVGDTINRGGTFLRSARYPEFAELEGQLKGIEQLKKHGIEGVVVIGGDGSYHGAMRLTEHGFPAVGLPGTIDNDIVGTDYTIGFDTAVATAVENLDRLRDTSASHNRTFVVEVMGRNAGDIALWSGIAAGADQIIVPEEEFNIDEVVSNVRAGYAAGKHHQIIVLAEGVMSGDEFAKTMKAAGDDSDLRVTNLGHLLRGGSPTARDRVLASRMGAYAVQLLKEGRGGLAVGVHNEEMVESPILGLAEEGALFSLTDEGKIVVNNPHKADLRLAALNRDLANQSSK

SEQ ID NO: 65262 - protein, 255 aa, Salmonella typhimurium LT2
MRHPLVMGNWKLNGSRHMVNELVANLRKELTGVAGCDVAIAPPEMYIDLAKRAAAGSHIMLGAQNVDLNLSGAFTGETSAEMLKDIGAQYIIIGHSERRTYHKESDELIAKKFAVLKEQGLTPVLCIGETEAENEAGKTEEVCARQIDAVLKTQGAAAFEGAVIAYEPVWAIGTGKSATPAQAQAVHKFIRDHIAKADAKIAEQVIIQYGGSVNASNAAELFAQPDIDGALVGGASLKADAFAVIVKAAEAAKQA

SEQ ID NO: 65263 - protein, 630 aa, Escherichia coli
MCGLAGFLESNLNDNNSAKVLHSMGESIYRRGPDGTGIWFENIENKINVGFVHTRLAIIDLSDAGQQPMHSHCGRYVIAFNGEIYNHLELRYLLESNNHISWRGHSDTETLLACFGIWGIDKTLQACVGMFAIALWDKKEHRLTLARDRVGEKPLYWGWQDDALLFGSELKALKTHPAFSAEINRDALCLLLRHNYIPAPHTIYRGIQKLQPGHYLSVELSNDERKETLHQYWSYEKVVQEGLVNPFMGSPIQAVEHLESLIAQSINGQLISDVPLGAFLSGGIDSSLIVSIMQSLSSSPVKTFSIGFDDKKYDEAIFAVEVARHLGTDHTEMYVNDKDIQDVIPLLPEVYCEPFADSSQLPTFLVSKMAQQHVTVALSGDAGDELFGGYTPYSFTPKYWNYARNIPLQIRKFASRYIDKLPVNPKFKKLIECMAVQNPQLFYRNIISHWLNPEELVKNSSEPSTAFSSSTTFPVNGGYVDWMMSVDAQVYMTDDILVKVDRAAMYNSLETRVPLLDHRIIEFAWQLPVSLKINNGVGKWPLREILYKRVPKSMIERPKKGFSVPLSSWLRGPLRDWAEELIAYKRLADEGYFNVAAVRSCWNLHIQGQADYSRKLWSILMFQSWLENQK

SEQ ID NO: 65264 - protein, 323 aa, Prochlorococcus marinus subsp. pastoris str. CCMP1986
MNTVTELLQPVENDLDDLINELKNLIGAGHPILQAAAEHLFSAGGKRLRPGIVLLISKAISQDFTLTTKHKRLAEITEMIHTASLVHDDVVDEASTRRGVDTVHSRFNTRVAVLAGDFLFAQASWHLANLDNVKVVKLLSRVIMDLAEGEIKQNLNRFDSAQTFSKYINKSYCKTASLIANSTKAAGVLCNLEDDKLNHLYEFGKNIGLAFQVVDDILDFTGNDKQLGKPAVSDLASGYLTAPVLYALEENENLSVLINRELVEKEDLNNALNIVMNSQAIKRSRKLAEDFALHSKEALLWLPDSEYKRALLSLPEFVLSRLY

SEQ ID NO: 65265 - protein, 452 aa, Clostridium perfringens str. 13
MEKQNLKNTEVNLIYGVDDDLDLPKKVLFGLQHIFAAFGGIIVVPLVIATSLGFDSKVTTALISASILGSGLATIIQAKGVGKVGARVACIMGTDFTFVSPAISVGSVLGLPGIIGATILGSLFEVILSFFIKPLMKFFPPLVTGTVVALIGLTLLPVSIDWAAGGAGSANYASLENLAVAMFVLVITLLLNNYGKGMISSASILIGIVVGYIVCIPLGLVDFTPVKEASWLSFPKILEFGVTFDAKAVMAFIPAYFVATIGTVGCLKAIGETSNIDIGDKRVAAGVLSDGVGSALGGLVGSCPNTSFSQNIGIISLTKVASRHVAVMAGILLVILGFLPKVAAIITGIPNPVLGGVGIMMFGTVAAAGIRTLSNIKLTERNLLIIAISMGLGLGVTFRPDVIHNLPEAIRMIFSSGISTGTIAALILNAVLKESPTSMEFENMYDEEKKAS

SEQ ID NO: 65266 - protein, 1372 aa, Cercospora zeae-maydis
MPTSNGGRTSPASLRSHHVRYASDSNIALRSTIMEQPEGPPELETYDSSGTNSSGNDGDEYAGTQESHSDSDGISSRHFVPGSGQAYAQDEVTPLTNVSTYGWSQPGSSNVSRTTTRGSVGSALPGTPAYEGTGTAMTNGTRRPANTRKESSNIYAPNRGPGSSMRYALNTGTRPRNGFTHMRRRNPNDEYRAQEKAYVQRIRQDGPDNDFQTEPRTPSLDYSFGSEDDEESPTNANYADHDPAEVDTLLYYGQEDLEPSVEELNIPANRERLEWHAMLANVLTGDVVKQEKKRLIGGPEQQGENTLKTEVWIGVRAKTCGRSIAAQKRLVEDGRSKVKQTIESIVAFEIKGEAEVGQSPMQQVQDVVKKIEKIEGLYPPRQAFRAAHPPAASSAYEHTCDAVIAWNNTTELIGTELGILQSWVGNMELDFTTARVRPEGEQHNELFDDSSFIDRILKEDGLKSLQGDKNLLNGVNTVIHKAKATLIANAEAFSDRHLPPYIEELLTLINFPSRLIQEIIRMRLSYAKKMKDAAQQGVMTAEQMILQFQILLQLAVKIKEQYLLIGQPEPGWDLPPCIDDNFDSVVLDALKFYFKMLNWKLMANKNTFKEAEILEQEWDFSNELGRHLDGGDVEVAEQFSSLTSKSMGRLAAPFEKELQRPADEVAGTAEMDKRYKSILDSVRVRQRKIFRFSRILSQRFENATEYNINIDNELYEDFLLALRLSGHFLVETNAESSVPTPGENEKAGGKVYILASPVLKERPKDIQSMLGTCYHAEDSPEDPSNPYVLILRPELPLVWEGDRMDASHSGKETLKVPQTLDLKTGRLRLVADGSLQRLQNANMAFTTATGNFDLTILVEQRANLCRESTKNWQRFAKLHTSSPTHSWTRSPLFALRSKPREGKAKAKNSTHPELLCFCYGIWSAFCHSHGRTTAGGQSHKLTKLALDWVSFICDDCVASDRKTFRWAVVALEFAMVMTRGQNILSISDEEYALLRSKVAGCRSLLISHFDIMGARGTVAAQAEKQRMDAMVGKLRLDIGKLKDDDESSRIVRAQWLDELEKLDQARKDREAERQALGRVLEDSNDADRALTHLSASAGNVHLRWQQGQFVGGGTFGSVYAAINLDSGHLMAVKEIRLQDPKMIPTVVSQIRDEMGVLQVLDHPNVVQYYGIEPHRDKVYIFMEYCSGGSLAGLLEHGRIEDETVVQVYALQLLEGLGYLHEASVVHRDIKPDNILLDHNGVIKFVDFGAAKVIAKQGKTMVADGPTGNGRQRSVQGTPMYMSPEVIKGGKHTGRLGAADIWSLGCVISEMATGSRPWANMDNDFAIMYNIANGNSPQMPTRDQMSDVGLDFLQAMLRTRPCEACVRCGASAT

SEQ ID NO: 65267 - protein, 240 aa, Prochlorococcus marinus subsp. pastoris str. CCMP1986
MTFTKYQFNNYCYWPSNPKKIIEFIGGSYLASKPDLTYKRFIKSLIDKNYAVHAYKYTPQFDHQELAMKAWKDFKNCQRSLSKRIGTSIPSIRIGHSLGCKLHLISPDGGRNCEKFISISFNNFSANRSIPFLKKISQKLEFNSEFSPSPERTFGIIKRTYNQKNNFLIKFNSDELDQTDKLLSCLRARKEDNSKGIKLKGTHTIIASAGLRENFLGDWADDDFKRNTIKQISNLIDKSI

SEQ ID NO: 65268 - protein, 332 aa, Xanthomonas campestris pv. vesicatoria str. 85-10
MTIAEDLPTVLGLPQIQSLAAPDMAAVDALIRRRLASDVVLINQIADHIISAGGKRLRPMLVMLAGHAAGGSGPEHHQLAAIIEFIHTSTLLHDDVVDESDLRRGRSTANALWGNAPSVLVGDFLYSRSFQLMVELDRMEVMQILADTTNRIAEGEVLQLLHVHNPDTDEAAYLRVIERKTAVLFAAGTRLGALASGASAQVQQQLYDYGMQLGFAFQIADDVLDYAAEAADLGKNLGDDLAEGKATLPLIHAMAHSDATTRERLRQIVEQGDAAAMPEVLAAIHATGGLDYSRQRAAEYAAAAEQALETLPHSPAVAALRGLARYAVERTH

SEQ ID NO: 65269 - protein, 246 aa, Xanthobacter autotrophicus Py2
MSDNIAGKVVVITGASSGLGAATARHLAAAGAKLVLGARRLDRLQALATELDLGAAAAVETDVTDPAQVKHLVDAAVAAHGRIDVLLNNAGLMPQSLLERGRVDEWDRMIDVNIKGVLYGIAAALPHMKAQKGGHIINVSSVAGHKVRPGSSVYAATKAAVRLLSEGLRQEVKPFNIRTTIISPGAVESELPQSVTEPDTAKAIADFYAAYAIPADSFARVVAFAISQPEEVDINEILFRPTAQEL

SEQ ID NO: 65270 - protein, 725 aa, Oryza sativa (indica cultivar-group)
MGCVASKNAVSVTPAADSSGALRERSLPRAPEAAATVVSVTASSLRCSSAAAAGRRSEKKRDEAAVAAAGEEPSEKAVIAAATASRSFRLRSLRRSLEGEQVAAGWPPWLSAVAGEAIQGWIPLKADSFEKLEKVGQGTYSSVFRARELDTGKIVALKKVRFDNFEPESVRFMAREIQILRRLDHPNVMKLEGLITSRLSCSLYLVFEYMEHDLAGLSSSPDIKFSEAQVKCYMNQLLSGLEHCHSRRIVHRDIKGANLLVNNEGVLKIADFGLANYFDPNKNHPLTSRVVTLWYRPPELLLGSTHYDAAVDLWSAGCVFAEMFRGKPILQGRTEVEQLHKIFKLCGSPADEYWKKSKLPHATIFKPHCPYQSTLQDVFKEMPANALRLLETLLSVEPYKRGTASAALTSEFFKTKPYACDPSSLPKYAPNKEMDAKLREDSHRRKASRGHGPEASRKSRLSRAARETTTVNKQTDGKEESKTKANGTKDNSILDRTKVNCDARLFSDIQPVSVAQVKERSRHVKNDSREEIPFSGPLIVSSSSGFAWAKKPPEDRSFARSRTRSSSRGQFTAELDQDNKMPAKENQNLGLKEQPNRDMHIARANSKVREPHDAAKRAVLKKWSQLGRPDSFDSYDTYHSQNFSNAMYLGDSLSSKNSIKGDHDQGERVEYSGPLLSQSHKVDELLEKHERHIRQVVRKSWFSREYAGKQFYLAILLALTTSGIM

SEQ ID NO: 65271 - protein, 335 aa, Pseudomonas aeruginosa
MTIRLAINGFGRIGRNVLRALYTGHYREQLQVVAINDLGDAAVNAHLFQYDSVHGHFPGEVEHDAESLRVMGDRIAVSAIRNPAELPWKSLGVDIVLECTGLFTSRDKAAAHLQAGAGKVLISAPGKDVEATVVYGVNHRGVVRASHRIVSNASCTTNCLAPVAQVLHRELGIEHGLMTTIHAYTNDQNLSDVYHPDLYRARSATQSMIPTKTGAAEAVGLVLPELAGKLTGLAVRVPVINVSLVDLTVQVARDTSVDEVNRLLREASKGSPVLGYNTQPLVSVDFNHDPRSSIFDANHTKVSGRLVKAMAWYDNEWGFSNRMLDSALALAAARD

SEQ ID NO: 65272 - protein, 429 aa, Thermotoga maritima [sequence omitted]

SEQ ID NO: 65273 - protein, 456 aa, Oryza sativa (indica cultivar-group)
MATPPPPPAPTPEVFDVVIFGASGFTGRYVIREALKFLPPSSSPLRSLALAGRSRDRVAAALRWAAGPGGAAPDLPILVADASDPASLAALAARARVVLSCAGPFRLHGRQVAAACAAAGADCLDISGEPEFMERVEAEFHEAAAKNGSLIISACGFDSIPAELGFLFHSRQWAPPSVPVTVQAYLSLESDKRIVGNFGTYESAVLGVANAGELQALRRSRPRRPRPNIPGPPPPKGSLVEHDKALGLWTIKLPSADTVVVKRTLSTVTEHPEGLPGVEESADFAEHRKSFWSSVKPAHFGVKLTSKSLLGIAQFIFTGLCIGLLGGFCFGRSLLLKFPSFFSAGWFRKSGPTEEQVSSASFKMWFVGRGYSDAARASDRGSKPDKEIITRVSGPEIGYITTPIVLVQCALVLLSQRGNLPKGGVYTPGAVFGPTDIQQRLQENGLSFDLVSTRTL

SEQ ID NO: 65274 - protein, 568 aa, Oenothera mexicana
MASPALISETEAWKDLKAHVEDIKRTHLRELMGDTERCQSMMVEFDNIFLDYSRQQASPDTINKLYKLADAAHLKQKIDRMYNGDHINSTENRSVLHVALRAPRNSAICSDGKNVVPDVWNVLDKIKDFSERVRNGSWVGATGKELKDVIAVGIGGSFLGPLFVHTALQTDPEASKNARGRELRFLANVDPIDAARNISGLDPETTLVVVVSKTFTTAETMLNARTLREWISSALGPSAVAKHMVAVSTNLPLVEKFGIDPNNAFAFWDWVGGRYSVCSAVGVLPLSLQYGFAVVEKFLQGAHNIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLKKENVSEHLIPHKTFTGNRPSVSILLPTLDAYRIGQLLAIYEHRVAVQGFIWGINSFDQWGVELGKSLATQVRKQLHASRVKGESVEGFNFSTKTLLTRYLEATSDVPAAPSTLLPKI

SEQ ID NO: 65275 - protein, 323 aa, Yersinia pseudotuberculosis IP 32953
MNLEKIIELTAPDMAAVNTTILDQLNSDVVLINQLGHYIISGGGKRIRPMIAVLVARALNYQGSKHITVAALIEFIHTATLLHDDVVDESDMRRGKATANAAFGNAASVLVGDYIYTRSFQMMTGLQSMRVLTLMSEATNVIAEGEVLQLMNCNNPDITEESYMQVIYSKTARLFEAAAQSAAILSDASEEQELALQNYGRYLGTAFQLIDDLLDYSAEGSTLGKNTGDDLNEGKPTLPLLHAMHNGTPEQAAMIRQAIEQGNGRHLLEPVLAAMEHCGSLVYTRQRAEEEADKAIAALHALPESDYRLALEGLAHISVHRRF

SEQ ID NO: 65276 - protein, 303 aa, Candida albicans SC5314
MQSELYSSTYGKGNVKFLKVKKDPSNPTVQDVLEANVQVLLRGKFDESYTKADNSSIVPTDTVKNTILVEAKTTDVWPIERFAAHLAKHFTTKYGHVDGIEVTIIQAKWSKIKLEGKEHAHSFKHEGPETRRTYLNYDKHTKKLQLSSSIKDLTVLKSTGSMFYGYNVCDYTTLQPTKDRILSTDVDASWTFDPTQIATLDDILSQPKLFDTTYNTARDVTLELFCKENSPSVQSTMYNMSHKILETVKQVGTVSYVLPNKHYILFNLEWKGIKDNKDLFYPAPDPNGLIKSTVGRKGDKAKF

SEQ ID NO: 65277 - protein, 257 aa, Mesorhizobium loti MAFF303099
MRNASLFDLAGRKALVTGASRGIGRSIAEALSAAGADVAVTARSLASLDGTTAAIRAAGGVAHAVALDVTDVNRCRTATAEAAGLLGGLDILVNNAGMEEVRPSLDVDEALWDRIVDTNLKGAFFCAQAAARQMRDAGHGGAIINLCSLTSEVGIPTAVPYGSSKSGLLGMTRALAAEWAGLGIRVNAIAPGYFRTAMTDVFYSNEAWQQSMLAKIPQHRFGDLGDLHGVAVFLASDAAAYITGQSIPVDGGFLASI

SEQ ID NO: 65278 - protein, 349 aa, Idiomarina baltica OS145
MNAPTLPVISMTALESESGLAELRRAASDVGFFYLVDHGISHESQQDYLRLSREFFQLSVQQKQSVDMIHSPHFRGYNAMGSEMTAGRLDAREQFDWMNEEQAIPDSALSQPWQKLIGPNLWPTSMPGLKPSLTKLQDQLSDITVNLLQRLCASLGVEAHALDHTIGKQPYTHAKLIRYPGQHRPQQGVGAHKDPGYLTLVMQDEQSGLKVERNGQWIAVEPIPGAFVVNIGELLELASNGFLKATNHKVESPKQGVERYSIAFFMAAQLSATVPVLSLPDELSARASGPSADPNNPLLTDVGNNVLKGRLRSHTHVTRRYYCQQTARTLLANSFAQLPINDICSECTI

SEQ ID NO: 65279 - protein, 508 aa, marine gamma proteobacterium HTCC2207
MSFTPEIGLGYTILRRAALSPERKALTFEGKTSTFGEFGQRIRKLAALLRAGGVCRGDRVGYIGLNHPAFLEALYACSCLGAIFVPLNFRLTGPEMRYITNDAGIHTMLADNGLRSLVDQERDNLVCQRYISIEDKAANWESLESLLQDSQPLELIEQVDADEVAFIMYTSGTTGLPKGAMLTHGNLFWNSANTAYGEDFMGTTTLTCAPLFHIGGLNVTTLPSLARGIEVVLIRSFDAAEVLAALEKYQVSTMFGAPTMFLMMSQHDSFASTDLSHIGAFVVGGAPVPVPLINLYSDRDVRFCQGYGLTETSPFATMLETSMALEKVGSAGRPPMFTDVRIVDGENNPLPAGEHGEVCVRGPNVLKGYWNRPEATADAIDAQGWFHSGDIGYFDNQGYLFLCDRVKDMVISGGENIYPAEVESILYGHSSVVEVAVIGLPDEKWGEAVTAVAVLKQDATLDLEELREFASQSLAKYKLPSRLYFLDELPRNPAGKVQKFKIKDELVG

SEQ ID NO: 65280 - protein, 869 aa, Xanthomonas campestris pv. vesicatoria str. 85-10
MSAPHSTDRWIVLKFGGTSVSRRHRWDTIGKLAGKRAHETGGRVLVVVSALSGVTNELTAIADGAADSAQRVAALDQRHREFLAELELDADAVLGERLAALHALLGDARAAMRTLDWQAEVLGQGELLSSTIGAAYLHASGLDMGWLDARQWLSAPPPQPNQSEWSKRLSVSCQWQSDADWRTRFAAQPTRLLITQGFISRHADGGTAILGRGGSDTSAAYFGALLGASRVEIWTDVPGMFSANPKEVPDARLLTRLDYYEAQEIATTGAKVLHPRSIKPCRDSGVPMAILDTERPDLPGTSIDGNAEPVLGVKAISRRNGIVLVSMEGIGMWQQVGFLADVFTLFKKHGLSVDLIGSAETNVTVSLDPSENLVNTDVLAALSADLSQICKVKIIVPCAAITLVGRGMRSLLHKLSDVWATFGQERVHMISQSSNDLNLTFVIDEADADGLLPILHAELIDSGAMPVSEGEVFGPRWRQIIGSVRPRPTPWWHAERAHLLSLSKAGTPRYAYHLPTVRARAHALAQIAAVDQRYYAIKANAHPAILMALEQAGFGLECVSHGELRRVFQTLPELSPRRVLFTPSFAPKAEYEAAFALGVTVTVDNVEALRNWPEVFRGRTIWLRIDLGHGDGHHEKVNTGGKASKFGLSSTRVDEFVDVARTLEVTITGVHAHLGSGVETGEHWRMMYDELAGFARRIGTVETIDIGGGLPIPYSAEDEPFDLEVWAKGLAEVKAVHPGYRLAIEPGRYLVAEAGVLLASVTQVIEKDGVHRVGLDAGMNTLIRPALYDAWHDIENLSQLDAPAGGMFDIVGPICESSDVFGKRRRLPAATAPGDVVLVADAGAYGYTMASTYNQRELPREEVIDASTG

SEQ ID NO: 65281 - protein, 272 aa, Magnetospirillum magnetotacticum MS-1
MTRTRTFRRDQRAPRAHLAWTELAAVGAIEDTDESRQAAVAQHFVAVSTALDKVAAFGIDPANAFGFWDWVGGRYSVDSAIGTSLAIAIGPDRFAELLAGFHAIDEHVRRTPFERNVPVLMGLLNVWYVNFLDAHTHAVLPYAQYLHRFPAYLQQLTMESNGKRVRWDGSPVTTETGEIFWGEPGTNGQHAFYQLIHQGTRLIPADFIAVANPAHPLVDAVGDGGAVQPGADVHGLFLANFFAQTKALAFGKTADESGPRAPRKPRGGSSRV

SEQ ID NO: 65282 - protein, 120 aa, Oryza sativa
  misc_feature (6)..(6): Xaa can be any naturally occurring amino acid
MPATRXIIGALLGLGTQMYSNALRKLPYMRHPWEHVVGMGLGAVFVNQLVKWDEKLKEDLDKMLERAKQANERRYFDSNGGMEELEPPPGQAEIPGFIDNQQIVSISADSYNSWMMMMIS

SEQ ID NO: 65283 - protein, 319 aa, Arabidopsis thaliana
MFFDGYHYHGTTFEQSYRCYPASFIDKPQLESGDKIIMPPSALDRLASLHIDYPMLFELRNAGIERVTHCGVLEFIAEEGMIYMPYWMMQNLLLQEGDIVRVRNVTLPKGTYVKLQPHTTDFLDISNPKAILETALRNYSCLTSGDSIMVPYNNKKYFIDIVETKPANAISIIETDCEVDFAPPLDYKEPERPTAPSAAKGPAKAEEVVDEPEPKFNPFTGSGRRLDGRPLAYEPAPASSSKGKQPVVANGNGQSSVASSSEKATRAQGKLVFGANGNRAPKEAAPKVGAAKETKKEEQEKKDEPKFQAFSGKKYSLRG

SEQ ID NO: 65284 - protein, 376 aa, Deinococcus radiodurans
  misc_feature (78)..(78): Xaa can be any naturally occurring amino acid
MDYYELLGVSRTASADEIKSAYRKLALKLHPDRNKEEGAAEKFAQVSEAYSVLSDTEKRAHYDRFGSAPGAGMPGGDXFGGMGGMGGVGFDPMDIFEQLFGGAAGMGGRGRRGPARGDDLETEVRITLEQARAGEEVEVTVDRLTECEHCHGTRTEPGGKPPVTCSTCNGSGAVRGQARTIFGVVETQQVCPTCKGDGKMVVDPCTVCHGRGRTLKSEPVKVKLPKGIDEGYRIRVAGQGNEGPGGNGDLYVHIEMEPHPELHRQDENLIFPARIGFATAALGGRIQVPTLDGPQEVEVKPGTQHGELHRLRGQGMPRLQGAGTGDLIVDYEIVVPKHLNAEAKDALQAYARAVGDEVPEEHEGLFGKIGKLFGRD

SEQ ID NO: 65285 - protein, 335 aa, Triticum aestivum
  misc_feature (35)..(35): Xaa can be any naturally occurring amino acid
  misc_feature (191)..(191): Xaa can be any naturally occurring amino acid
  misc_feature (205)..(205): Xaa can be any naturally occurring amino acid
  misc_feature (217)..(217): Xaa can be any naturally occurring amino acid
ASSYSGVCPDCTATMPLTLSPPRLLLLLRRRQAKXPREPRSTARPCRGARLSCAPDEVAATDAEQQQGEEEEELVLLASYRTAFNEVIMVIDSPSNRYLVLDPTRNVHSILPKKSAWTNSYWDECVSLPTVVPRGPVALLGLGAGTAAHMMLEVWPWIQLIGWEIDPTVIELPRDYFGMSPLEKTTELGGXSLSVHIGNALSPSXATVEGGFAGIVXVELFADGKVLPQLQEPETWLEIAKKLMPHGRIMVNCGAGDAAVSLAADADVSSWVQNPTIKALCSAFPGQLNWKRLSEKESVNYVALTGPLPDLEEWSASVPSELSLRVKQWVPCKLA

SEQ ID NO: 65286 - protein, 393 aa, Oryza sativa (japonica cultivar-group)
MALRRFAVAGRVLLHRVESLPPPRPPLAFLSSESRGHLVRRFSTPSSTPPHFMVQYLVSKCGLSPAAAAKAAPRFAHLDSASRPDAALAFLRSQGLTRAQVREVVSWKPELLLSDVDATLDPKFRAVRALGLGRADVARLFALYPPALTYGIHTNLLPRVLFWIDFLGSAKLLMKWLAKTWLLRYSVDALLRNLSTLRSLGVQQSRITTTVRMQPTLITQTPARFQKLVGRVEACGVPPSSGMYMWAFFALHNVSEGSFRAKKAAVVGAAGCTEEEFDAMFRRAPCLVFVPAALLRRKVEFLMAEAGCDATHIVTNPVLLTLSLGKRMAPRCRVVEALRSRGVGIGKKANLGSVMRYPEDKFVERYVLRYKEEVPELLELYPPRLCKGSSQTR

SEQ ID NO: 65287 - protein, 160 aa, Rhizobium leguminosarum bv. viciae 3841
MTIPAKSMMTTDLVTVSPEATVAEAARCMLIHHVTAVPVVDADNRPLGLVSEGDVMRHFGSQFQSERAQWLRMLAEGETLAPEFLAEIRLNQQHVREIMHTAIISAGEEASLAELADLMLKHGIKRVPILRDGVLVGIVSRADVVRAVVEKLDDLLEPTD

SEQ ID NO: 65288 - protein, 335 aa, Streptococcus oralis
MVVKVGINGFGRIGRLAFRRIQNVEGVEVTRINDLTDPVMLAHLLKYDTTQGRFDGTVEVKEGGFEVNGKFVKVSAERDPEQIDWATDGVEIVLEATGFFAKKDAAEKHLKGGAKKVVITAPGGNDVKTVVFNTNHDVLDGTETVISGASCTTNCLAPMAKALQDNFGVVEGLMTTIHAYTGDQMILDGPHRGGDLRRARAGAVNIVPNSTGAAKAIGLVIPELNGKLDGAAQRVPVPAGSVTELVAVLEKSVTVDEVNAAMKAASNESYGYTEDPIVSSDILGMSYGSLFDATQTKVLDVDGKQLVKVVSWYDNEMSYTAQLVRTLEYFAKIAK

SEQ ID NO: 65289 - protein, 335 aa, Gracilaria gracilis
MTVPQVGINGFGRIGRLVLRAAIEKDTMSVVAINDPFIDLEYMAYMFKFDSTHGRYAGSVETKDGKLIVNGKSITIYGHRDPAEIPWAEAGADYVVESTGVFTLKEKAEKHFTGGAKKVIISAPSKDAPMFVCGVNEDKYTPDLNVISNASCTTNCLAPLVKVIHEKYGIEEGLMTTVHATTATQKTVDGPSQKDWRGGRGAGANIIPSSTGAAKAVGKVLPELNGKLTGMAFRVPTSDVSVVDLTVRLATETSYDDIKATMKAAAEDSMKGILKYTEEAVVSTDFIHEEASCVFDAGAGIMLNSRFCKLVAWYDNEWGYSNRVVDLIAHVAKLQ

SEQ ID NO: 65290 - protein, 411 aa, Oryza sativa (japonica cultivar-group)
MGGGGAGGDGEAWADQEQGNGGGRGGGGGEAKRSEIYTYEAGWHIYGMNWSVRRDKKYRLAIASLLEQHNNHVQVVQLDESSGDIAPVLTFDHPYPPTKTMFVPDPHSVRPDLLATSADHLRIWRIPSPDEAAAAAAASSNSGSVRCNGTASPDVELRCELNGNRNSDYCGPLTSFDWNDADPRRIGTSSIDTTCTIWDVEREAVDTQLIAHDKEVYDIAWGGAGVFASVSADGSVRVFDLRDKEHSTIIYESGSGGSSNSAGADGGAASPTPLVRLGWNKQDPRYMATIIMDSPKVVVLDIRYPTLPVVELHRHHSPVNAIAWAPHSSCHICTAGDDSQALIWDLSSMGTGSNNGGNGNGNAAAAAAAEGGLDPILAYTAGAEIEQLQWSATQPDWVAIAFSTKLQILRV

SEQ ID NO: 65291 - protein, 336 aa, Streptococcus gordonii
MVVKVGINGFGRIGRLAFRRIQNVEGVEVTRINDLTDPVMLAHLLKYDTTQGRFDGTVEVKEGGFEVNGKFVKVSAERDPENIDWANDGVEIVLEATGFFATKAAAEKHLHAGGAKKVVITAPGGSDVKTVVFNTNHDILDGTETVISGASCTTNCLAPMAKALQDNFGVVEGLMTTIHAYTGDQMILDGPHRKGDLRRARAGAANIVPNSTGAAKAIGLVIPELNGKLDGAAQRVPTPTGSVTELVVVLEKNVTVDEVNAAMKAVANESYGYTEDPIVSSDVVGMSYGSLFDATQTKVLDVDGKQLVKVVSWYDNEMSYTAQLVRTLEYFAKIAK

SEQ ID NO: 65292 - protein, 90 aa, Brassica napus
  misc_feature (58)..(58): Xaa can be any naturally occurring amino acid
  misc_feature (61)..(62): Xaa can be any naturally occurring amino acid
  misc_feature (64)..(66): Xaa can be any naturally occurring amino acid
  misc_feature (69)..(70): Xaa can be any naturally occurring amino acid
  misc_feature (78)..(78): Xaa can be any naturally occurring amino acid
  misc_feature (86)..(86): Xaa can be any naturally occurring amino acid
MDRLLQPPSSSILAPSKSHLRAPPLLLRVHRLDSPSLIPSSPRRVSSISCLFRHNPSXTAXXHXXXPRXXRLRKPTSXNPNPRGFXQRIG

SEQ ID NO: 65293 - protein, 335 aa, Streptococcus sanguinis
MVVKVGINGFGRIGRLAFRRIQNVEGVEVTRINDLTDPVMLAHLLKYDTTQGRFDGTVEVKEGGFEVNGKFVKVSAERDPEQIDWATDGVEIVLEATGFFAKKDAAEKHLKGGAKKVVITAPGGNDVKTVVFNTNHDVLDGTETVISGASCTTNCLAPMAKALQDNFGVVEGLMTTIHAYTGDQMILDGPHRGGDLRRARAGAVNIVPNSTGAAKAIGRVIPELNGKLDGAAQRVPVPAGSVTELVAVLEKSVTVDEVNAAMKAASNESYGYTEDPIVSSDILGMSYGSLFDATQTKVLDVDGKQLVKVVSWYDNEMSYTAQLVRTLEYFAKIAK

SEQ ID NO: 65294 - protein, 293 aa, Bordetella parapertussis 12822
MGKTQEFLRLRRIIALSSLLASRKSAMCLAVLALHAIPGLPVLIAANRDEFHARPTAEATRWPGSPAIYAGRDLQAGGTWMGVSDQGRYAVVTNFRDPRNIQPDAPSRGALVEAFLRGAASAQEYLRDVHARGARYNGFNLIVGDAGGAWYCSNRDGAPRRLAAGVYALSNHLLDTPWPKLARTKAAFERIIAATPQPDLAALYAALADPTPAADHELPATGLALERERLLSSPFIVSPDYGTRSACILALHDDGRGELHERRFRPDGAIAGQADLDFPWRAARAELHRASCV

SEQ ID NO: 65295 - protein, 459 aa, Mesorhizobium loti MAFF303099
MLNQSNELNAWDRDHFFHPSTHMGTHARGESPTRIMAGGEGVTVWDNNGRKSIDAFAGLYCVNVGYGRQKIADAIATQAKNLAYYHAYVGHGTEASITLAKMIIDRAPKGMSRVYFGLSGSDANETNIKLIWYYNNVLGRPEKKKIISRWRGYHGSGVMTGSLTGLDLFHNAFDLPRAPVLHTEAPYYFRRTDRSMSEEQFSQHCADKLEEMILAEGPETIAAFIGEPILGTGGIVPPPAGYWEKIQAVLKKYDVLLVADEVVTGFGRLGTMFGSDHYGIKPDLITIAKGLTSAYAPLSGVIVADRVWQVLVQGSDKLGSLGHGWTYSAHPICVAAGVANLELIDEMDLVTNAGETGAYFRAELAKAVGGHKNVGEVRGDGMLAAVEFVADKDDRVFFDASQKIGPQVATALAASGVIGRAMPQGDILGFAPPLCLTREQADIVVSKTADAVKSVFANL

SEQ ID NO: 65296 - protein, 531 aa, Streptomyces coelicolor A3(2)
MSSALDDRAVAAPPNPPADHHTRGARFLLLLAVFLCAACGLVYELALTALGSYLIGNSVLQTSVVISVMVFAMGVGSLAAKPLRHRPVVAFAVVEGVLALVGGLSVLMLYAAFAWLQLYMPAMIVVSLVVGLLIGAEIPLLMTLLQRIRTQEASSAVADMFAVDYIGALVGGLCFPLFLLPTFGQLKGALVVGVVNAVAGVIVVVFIFRRQTGRLVKAGLLAGVALVLAALGTTYVLADDLEVTARQHMYADPIIHSETTQYQDIVVTRSTAFTGEPDVRLFLNGDLQFSSVDEYRYHESLVHPALSGPHSNVLIMGGGDGLALREVLRHEGVRHVTLVELDPAMTRLARTFEPLRKLNQGSLDDPRAKVVNADAFTWLREARQQYDAVIIDFPDPDSASLAKLYSVEFYDLLRRVLAPDGQVMVQSGSPFFAPKTYWSIAKTIETAGYATTEFQIDVPSFGNWGFVLARPGTEAPPLRLARDTPKLRYLDAAVLKAATVFPVDRRRTDVRPSTLMDPAVLEYVQDEWRDY

SEQ ID NO: 65297 - protein, 497 aa, Mesorhizobium loti MAFF303099
MSAHFARSHRHEALDRLADRRLLRELAYVDGHWTASEAAESFEVTDPATGSTVAFVAALDARQTTQAIDAAALAFPAWRSLLPQERSRILRKWFELIITAKDDLALLMTLEQGKPLQESLGEIDYAASFVEWYAEEAKRLNAESVTSHLANAEMMVRREPLGVVGIVTPWNFPSAMLTRKAAAALAAGCTIVAHPSSETPLSALALAELGERAGLPAGVFNIVTGKAATIVGRMCEDTRVRAMSFTGSTEIGRLIAAQSAPTMKRLVMELGGHAPLIVFADADLDKAVSIAIDAKFATSGQDCLAANRIYVQRPIHDRFCAAFAKRIEALRTGNGLDDMTDIGPLLHERAVQKVEEQVADALAHGARCLAGGKRHQAGPLFYQPTLLADVSDAALIMREETFGPVAAVTPFDSEDEVIARANATEYGLVAYVVTDNGARQQRMGRALDYGMVAINRVKITGAPIPFGGVKQSGIGREGSRHGLEAFTDLKYLCLDVA

SEQ ID NO: 65298 - protein, 498 aa, Bacillus licheniformis ATCC 14580
MTNMSSLTMQVSKKLESFLQGTKKLYINGEFVASASNKTFETPNPATGETLATLYEAGPEDVDKAVKAAREAFDRGEWRTMNPAERSRLMYKLADLMEEHKTELAQLETLDNGKPISETTAGDIPLSIEHMRYYAGWATKITGQTIPVNGPYFNYTRHEPVGVVGQIIPWNFPLLMAMWKMGAALAAGCTVVLKPAEQTPLSALYLAELIDEAGFPKGVINIIPGFGETAGEALTDHALVDKLAFTGSTEIGKKIMEKAAKSVKRVTLELGGKSPNIILPDADLKKAIPGALTGVMFNQGQVCCAGSRVFIHKDQYDKVVDEMAAYSKSLRQGAGLHEDTQMGPLVSKEQHERVLSYIEKGRQEGAKIAAGGTCPYEQGYFVSPTVFTNVEDEMTIAKEEIFGPVLAAIPYETVDEVIERANRSEYGLAAGVWTENLKNAHYIADRLQAGTVWVNCYNAFDAASPFGGYKQSGLGREMGSYALDNYTEVKSVWIHTGE

SEQ ID NO: 65299 - protein, 411 aa, Yersinia pestis biovar Microtus str. 91001
MAELPAKRRFTRIDRLPPYVFNITSELKMAARRRGEDIIDFSMGNPDGPTPPHIVEKMCSVAQREDTHGYSTSRGIPRLRRAISRWYADRYQVDIDPENEAIVTIGSKEGLAHLMLATLDHGDTVLVPNPSYPIHIYGAVIAGAQVRSVPLTEGIDFFGELERAIRETIPKPKMMILGFPSNPTAQCVELDFFERVVALAKQYDVLVVHDLAYADIVYDGWKAPSIMQVPGAKDIAVEFFTLSKSYNMAGWRIGFMVGNPELVSALARIKSYHDYGTFTPLQVAAIAALEGDQQCVRDIAEQYRQRRNALVRGLHEAGWMVDNPKASMYVWAKIPEPYAHLGSLEFAKRLLAEAKVCVSPGIGFGDYGDTHVRFALIENQDRIRQAVRGIKSMFRADGLLKPGKSSPNEMA

SEQ ID NO: 65300 - protein, 520 aa, Streptococcus agalactiae 2603V/R
MTDISILNDIQKIIVLDYGSQYNQLIARRIREFGVFSELKSHKITADEIRDINPIGIVLSGGPNSVYADGAFGIDEEIFELGIPILGICYGMQLITHKLGGKVLPAGEAGHREYGQSALRLRSESALFAGTPQEQLVLMSHGDAVTEIPEGFHLVGDSVDCPFAAMENTEKQFYGIQFHPEVRHSVYGNDILKNFAVNICGARGDWSMDNFIDMEIAKIRETVGDRKVLLGLSGGVDSSVVGVLLQRAIGDQLTCIFVDHGLLRKNEGDQVMDMLGGKFGLNIIRVDASKRFLDLLSGVEDPERKRKIIGNEFVYVFDDEASKLKGVDFLAQGTLYTDIIESGTETAQTIKSHHNVGGLPEDMQFELIEPLNTLFKDEVRALGTALGMPDEVVWRQPFPGPGLAIRVMGEITEEKLETVRESDAILREEIAKAGLDRDVWQYFTVNTGVRSVGVMGDGRTYDYTIAIRAITSIDGMTADFAQLPWDVLKKISTRIVNEVDHVNRIVYDITSKPPATVEWE

SEQ ID NO: 65301 - protein, 224 aa, Idiomarina baltica OS145
MAKVLLITGASSGIGEATAKEAVKQGYKVVATARSEDKLQALANDLGAEHVLPIAADVTDYQQLERVVQQTVDQFGQLDAVFANAGKGLNAAGTENGDPNEWREMIDLNINALLYTAKLTLPHLKKSTGHFIMTGSAAGRTAIKGSVYGASKWFVHGFAQNLAEEMREWSGRCTVIAPGMVNTPFFDEPKPDKLDPQDVADAVLHALNAHPRNCVREVFLMPGY

SEQ ID NO: 65302 - protein, 154 aa, Bradyrhizobium sp. BTAi1
MSADRDHNRCKGWPKLPGTDMAVPGSVPPVLIYRTERSVTQSAPGRRRWILEFERSAAPFIEPLMGWTGSSDPFASIRLEFPDCESAVGFAEKNGWDYRVIDPPARKPLIKGYADRFKYELADAMARAAHGRSKCSEQSSITRTESPSGWPNRK

SEQ ID NO: 65303 - protein, 366 aa, Rhodospirillum rubrum ATCC 11170
MTERKTGSPFSARRSRLGFEEGNGFAMTIPSPSISAPVADLSDEAGRALACARHVLEAEAEALRALAADLNGAFTAAIDLLCDGPAKRSGKVIISGMGKSGHVAAKIAATLASTGTPSFFVHPAEASHGDLGMIGRSDAVIALSNSGETPELADMVAYTRRMGIPLISITGRHPSALSDAADVALVLPALTEACPHGLAPTTSTTAMMALGDALAVALLERRGFTASDFRLFHPGGQLGRKLLKVADLMHGQDRLPLVGPATPMAEAILEISSKSLGCVGVVDAAGRLAGIITDGDLRRHMGADLWSRTAGSVMTPTPKTIAPTTLAIEGLRIMNESAITGLFALDADKRPVGFLHLHDCLRAGLA

SEQ ID NO: 65304 - protein, 426 aa, Bacillus licheniformis ATCC 14580
MAEIKVPELAESISEGTIAQWLKQPGDYVEQGEFLLELETDKVNVELTAEQSGVLQEVLKDSGDTVQVGEIIGTISEGEGEGGKSTAPQADAQESAGASEEKAASSEKTAEPREGASDEADTAKTRTIASPAARKLAREKGIDLSEIPTGDPLGRVRKQDVESYQKNEQPPKAQPEPKRATQAPAAKQTEDAGKPVERQRMSRRRQTIAKRLVEVQHTAAMLTTFNEVDMTAVMNLRKRRKDQFLEQHDVKLGFMSFFTKAVVAALKKYPLLNAEIQGDELVIKKFYDIGIAVAAPDGLVVPVVRDADRKTFADIERDIGELAKKARNNKLSLNELQGGSFTITNGGTFGSLLSTPILNSPQVGILGMHKIQLRPVAIDEERFENRPMMYIALSYDHRIVDGKEAVGFLVTIKNLLEDPEQLLLEG

SEQ ID NO: 65305 - protein, 354 aa, Triticum aestivum
NSALPLGGLDIRASPASSPPPAAVLPPVAGPRLSGSAPTSPQPWPRHCSKAQIISGFLPYILQFYPGADRGAMLRLGLHPCPHFSPPQPHPTLPRRLAASPLPRPPFPSAFTALQARNPPLQAAVSGAASGEERRGVDEGEEGADLHEALTKTRRLVECAMFASVAGLAYFLSNSLAIENYFSCFFPLPIVISSLRWGLEAGRKTMVATVLLLFTLSGPVKALTYLLMHGVVGLSMGTMWRLETNWIVSIIICAIIRAVGACGYVLVTSFLIRENIFQLITVNIHASLTYILAAAGVNTIPSMDAIYVIFGTLVLLNSGFFVFILHIIYTIFLTKLGIKPSLRLPRWLGKATSS

SEQ ID NO: 65306 - protein, 240 aa, Triticum aestivum
PRVRGRVGSSKNAWEDAVPLSRKTEASPADAQARHDDDDIDEDMDGEGDGAVYYLSKSGDVMVSSTQRSAARQYSSAVTCRSDGGEAVAYFLSHSGAVVACDLARRVFTELPRILPAHFEYSIDVVACGGRAYVVVLSEYLDTASLRLWEFSDGAWRHVAAMPPAMSHALYGKKADVNCVGHGGRVMVCVSSGDAGANGCFMCDVGSNAWEELPRCAGGDGEAMDFVAAFSFEPRMEAAV

SEQ ID NO: 65307 - protein, 480 aa, Zea mays
MGQGGEVKAAPAVRVLVVDDSPVDRKVVELLLRNHNHQGGAAPFHVTAVDSGKKAMEHLRLMEQGGQLDSCAADANRITIDIVLTDYCMPEMTGYDLLKAIKALSSPNPIPVVVMSSENEPQRISRCLTAGAEDFILKPLKTKDVQRLRNCSSAARPTDGAAHQCESLRSSSRKLRSDQVAAPAHRSQPTTGLTMVLHASSIELSHYFQFLLKFVLLACSSRLCEESVGLLLQSFIGGSAKLFRPLQLSDRVFRFSLSCKEVGFAVYRRHSFSCSSFKAYLHLWNSGGPNSIKEWQLFLEDESNSWTIVSRGRSVKASFADTARSSVLSGANLVPLGGQVRSGGLKPRSSVFNRISFPVRRLSDQPAVQSYPRGQSVKRAYFQNYSNPSPGNLAWPFSRSSPRSARARPWASRKSFWWPKRILNRHQEISKNKSASSINEASIAVSEDSRYQRNSSFSGNNCHFFGFPGQIYKKDFLTFP

SEQ ID NO: 65308 - protein, 619 aa, Candida albicans SC5314
MEKEILQFDQKKKKLQQGRINPIQPNPTQPNQPNQTNCYTTIMQLLFVSLSFYIGVVLANLARFDENSLSQVCSGMYSKQDWGGSFKPHIGLTLNQFDTLKYDPKNNNKDEKVNDKDISVSYIIFEYKDLVNIGADLGDGRYKFICDDYAINELKVCDEKQKGKFIVNKNVTNSTILTAQLTHLGHANINYPVNVTGYYCVSTFTQYENTVYNGQVNFQNAFGQLSASEIPKLPAYGILAICYAIALALFGFQFFKKRKENQILPLQRYLLAMLGFLTFDTVVVWSYYDLVNRIESPSSGFARFYMIFLALLNAAKITFSFFLLLCISLGYGVVKLKLDKKVMFGCKVLAGFNFIASFVYLFFNYYGGSSNALVSTDSIDTAASGSFLGLLPIIPIAIILSIYYVTILASIRKTTESLHKQRQIIKLNLYQNLFKIIFGSVILTFLGLTLSSFVYLSMSSTEMFEQHWKGSFFIYDFWPSVVFFIVFMAVAWLWRPTETSYMLAISSQVANDDENGEYQQGMELDTFSLMSHSDDDDDDEGDNGEHNPQRQVERDSFELPTTTNNKNKNIQPENPPQYDQLGTHEPHEAPSSTLFELGEDDEISDHEGDNRLKDEKHKE

SEQ ID NO: 65309 - protein, 519 aa, Candida albicans SC5314
MTTFWSQTINRQNGGVATATATATATAATTTPTAGGTGAGTTTSTKGMITPTPFNIDINNDLNDFDGKFIETFKPDLELQKKYRSFIQREGALSFLRTEITQSMSKRDICVLILNLGYPKKAVEDYPILTLKELAYILLKLMLTDSAQLEPKVEIDENDNKNDGTNNSDIDSDIDSNSDMDSQSESGELDDAMDVDDSLSENEDEYDQDMSTTTLKRTINMTPFKYKLPDLISDLSRAKKIMVVTGAGISTSLGIPDFRSFKGLYNQLSKLNLSDPQKVFDLQTFMREPGLFYTIAHLVLPPDGKFSLLHAFLKLLQDKHKLLRNYTQNIDNLEQRAGLKSEKLVQCHGSFAKAKCVSCQGIFAGEKIYNHIRRKQVPRCAICWKNTKQAPIHFGAIKPTITFFGEDLPERFHTLMDKDLQQIDLFLVIGTSLKVEPVASIIERVPYKVPKILINKDPIPNRGFNLQLLGLCDDVVSYLCKCLKWDIPHADFNNNDEFKLSKLKNGDWEIVKKSTSTKK

SEQ ID NO: 65310 - protein, 337 aa, Rhizobium leguminosarum bv. viciae 3841
MARMTMIEAVRSAMDVSMARDDNVVVFGEDVGYFGGVFRSTQGLQAKYGRTRCFDTPISESGIVGTAIGMAAYGLKPCVEIQFADYMYPAYDQLTQEAARIRYRSNGDFTCPIVVRMPTGGGIFGGQTHSQSPEALFTHVCGLKVIVPSNPYDAKGLLIAAIEDPDPVMFLEPKRLYNGPFDGHHERPVTPWSKHDLGEVPDGHYTIPIGKAEVRRAGSAVTVIAYGTMVHVALAAAEDAGIDAEVIDLRSLLPLDLDTIVKSVSKTGRCVVVHEATLTSGFGAEVVALVQEHCFYHLEAPVVRVAGWDTPYPHAQEWDYFPGPGRVGRALAEVMEA

SEQ ID NO: 65311 - protein, 180 aa, Nandina domestica
MFPMVTGFMNYGQQTVRAARYIGQSFMITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYDRHELNYNQIALGRLPMSVIGDYTIRTILNSTPIKKTAGNPLDSKTITNF

SEQ ID NO: 65312 - protein, 465 aa, Rhizobium leguminosarum bv. viciae 3841
MKEIVCKLLVIGAGPGGYVCAIRAGQLGVDTVIVEAGKPGGTCLTVGCIPSKALIHAAEEFDATQKMLAGKNPMGIRVEGASIDLGRTIAWKDGIVGRLTSGVSGLLQKARVKIVHGRAHFRDGKTVEVETETGQQIIRAETVVIATGSDPVELSNLPFGGRVISSTEALSLTELPKKLVVVGGGYIGLELGTAFSKMGSDVTVVEATPQVLPQYDAELVRPVMRKLTEGSIRLLTGAKAIGLADNGEALIVEAADGRRESLPADRILVTVGRRPRTAGSGLEELDLDRAGPYLRIDDRCRTSMRGIYAIGDVTGEPMLAHRAMAQGEMVAEIIAGKKRAWDKRCIPAICFTDPEIVSAGLSPADAKAQGYEIRTGQFPFSANGRAMTMLSEEGFVRIVARADTNLVLGLQAVGAGVSELSAAFALAIEMGARLEDIAGTIHAHPTRSEAVMEAALKALGSALHI

SEQ ID NO: 65313 - protein, 409 aa, Yersinia pestis biovar Microtus str. 91001
MLNGRAVDTSRRPLRKIKLSLMGPAFIAAIAYIDPGNFATNIQAGATFGYTLLWVVVWANVMAMLVQLLSAKLGIATGKNLAEHIRDRFPRPVVWAYWVQAEIIVMATDLAEFIGAAIGFKLLFGVTLLQGAVLTGIATFLILMLQNRGQKPPELVIGGLLLFVAAAYIVELIFSQPDIAALGRGMLIPNLPDGNAVFLAAGVLGATIMPHVIYLHSALTQTGGEESKTERYASTKFDVAIAMTIAGFVNLAMMATAAAAFHFNGYENIAEIEEAYITLQPLLGNAAATVFGLSLIAAGLSSTVVGTLAGQVVMQGFVRFYIPMWVRRIVTMLPSFIVILAGMDATQILVMSQVLLSFGIALALVPLLVFTGNKELMGELVDTKTTQILGKLVVLIVVGLNAYLLISLL

SEQ ID NO: 65314 - protein, 520 aa, Arabidopsis thaliana
MDSANLHQLQDQLQLVGSSSSSSSLDNNSDPSCYGASSAHQWSPGGISLNSVSLSHNYNNEMLNTRAHNNNNNNNTSECMSLSSIHNHSLIQQQDFPLQWPHDQSSYQHHEGLLKIKEELSSSTISDHQEGISKFTDMLNSPVITNYLKINEHKDYTEKLLLKSMSSGFPINGDYGSSLPSSSSSSSPSSQSHRGNFSQIYPSVNISSLSESRKMSMDDMSNISRPFDINMQVFDGRLFEGNVLVPPFNAQEISSLGMSRGSLPSFGLPFHHHLQQTLPHLSSSPTHQKDWSDGESREVSASENITFRALFLLSLFKLKHQPLFYLFFSFLFIPYFVLLSFYESLFLTFFSLIVGGINYYVTFYYYPLHRIAIMNMEMFSNEPQTSEGKRHNFLMATKAGENASKKPRVESRSSCPPFKVRKEKLGDRIAALQQLVSPFGKTDTASVLMEAIGYIKFLQSQIEVSQSQEGDEEETRDLRSRGLCLVPLSCMTYVTGDGGDGGGGVGTGFWPTPPGFGGGT

SEQ ID NO: 65315 - protein, 393 aa, Nandina domestica
MTVPTTRKDLMIVNMGPQHPSMHGVLRLIVTLDGEDVIDCEPILGYLHRGMEKIAENRTIIQYLPYVTRWDYLATMFTEAITVNAPEQLGNIQVPKRASYIRVIMLELSRIASHLLWLGPFMADIGAQTPFFYIFRERELIYDLFEAATGMRMMHNYFRIGGVAADLPHGWIDKCLDFCDYFVTGVTEYQKLITRNPIFLERVEGVGFISGEEAINWGLSGPMLRASGIQWDLRKVDHYECYDEFDWEVQWQKEGDSLARYLVRINEMTESIKIIQQALERIPGGPYENLEVRRFDRTRDSEWNDFDYRFISKKPSPTFELSKQELYVRVEAPKGELGIFLIGDQSVFPWRWKIRPPGFINLQILPQLVKRMKLADIMTILGSIDIIMGEVDR

SEQ ID NO: 65316 - protein, 1134 aa, Selaginella martensii
MSTTKLTYSSGSSAKSKHSVRVAQTTADAKLHAVYEESGESGDSFDYSKSINATKSTGETIPAQAVTAYLQRMQRGGLVQPFGCMLAVEEGSFRVIAFSDNAGEMLDLMPQSVPSLGSGQQDVLTIGTDARTLFTAAASALEKAAGAVDLSMLNPIWVQSKTSAKPFYAIVHRIDVGLVMDLEPVKASDTRVGSAAGALQSHKLAAKAISRLQSLPGGDIGLLCDTVVEEVRDVTGYDLVMAYKFHEDEHGEVVAEIRRSDLEPYLGLHYPATDIPQASRFLFMKNRVRMICDCSAPPVKITQDKELRQPISLAGSTLRAPHGCHAQYMGNMGSVASLVMAMIINDNDEPSGGGGGGGQHKGRRLWGLVVCHHTSPRSVPFLRSACEFLMQVFGLQLNMEAAVAAHVREKHILRTQTLLCDMLLRDAPIGIVSQSPNIMDLVKCDGAALYYGKRFWLLGITPSEAQIKDIAEWLLEHHKDSTGLSTDSLADAGYPGAASLGDEVCGMAAAKITAKDFLFWFRSHTAKEVKWGGAKHDPDDKDDGRKMHPRSSFKAFLEVVKRRSLPWEDVEMDAIHSLQLILRGSFQDIDDSDTKTMIHARLNDLKLQGMDELSTVANEMVRLIETATAPILAVDSSGFINGWNAKVADVTGLPVTEAMGRSLAKELVLHESADMVERLLYLALQGDEEQNVELKLKTFGGQKDKEAVILVVNACASRDVSDNVVGVCFVGQDVTGQKVVMDKFTRIQGDYKAIVQNPNPLIPPIFGADEFGYCSEWNPAMEKLSGWRREEVLGKMLVGEIFGIQMMYCRLKGQDAVTKFMIVLNSAADGQDTEKFPFAFFDRQGKYVEALLTATKRADAEGSITGVFCFLHIASAELQQALTVQRATEKVALSKLKELAYIRQEIKNPLYGIMFTRTLMETTDLSEDQKQYVETGAVCEKQIRKILDDMDLESIEDGYLELDTTEFMMGTVMDAVISQGMITSKEKNLQLIRETPKEIKAMFLYGDQVRLQQVLADFLLNAIRFTPSSENWVGIKVATSRKRLGGVVHVMHLEFRITHPGVGLPEELVQEMFDRGRGMTQEGLGLSMCRKLVKLMNGEVEYIREAGKNYFLVSLELPLAQRDDAGSVKFQASS

SEQ ID NO: 65317 - protein, 264 aa, Methanothermobacter thermautotrophicus str. Delta H
MLYIIGLGLYDENDISIKGLRAIEDCDEVYAEFYTAMLQGSSLSAIERRIGRSVKVLGRGEIEEERIPIERALELDVALLVAGDPLVATTHTELLIDAHRRGIETRVIHSSSIISAAPGLAGLQAYKFGRIITIPFTSDNYFPTSPYTNIGENLKAGSHSLVLLDIEAHRNRYMTATEGLRYLLKASEKLDDGTISGETLAVVIARAGSEKPLVRADKIATLVEEDFGDPLHCLVVPAGLHFIEADYLVEIAGAPRAVVERMIL

SEQ ID NO: 65318 - protein, 259 aa, Chlamydomonas incerta
MAVDREECVYMAKLAEQAERYDEMVEEMKKVAKLVHDQELSVEERNLLSVAYKNVIGARRASWRIISSIEQKEESKGNEEHVQRIRKYRTVVEEELSKICASILQLLDDHLIPTASTGESKVFYLKMKGDYHRYLAEFKTGADRKEAAEHTLLAYKAAQDIALVDLPPTHPIRLGLALNFSVFYYEILNSPERACHLAKQAFDEAIAELDSLGEESYKDSTLIMQLLRDNLTLWTSDMQDPAAGDDREGADMKVEDAEP

SEQ ID NO: 65319 - protein, 379 aa, Brassica napus
  misc_feature (221)..(221): Xaa can be any naturally occurring amino acid
  misc_feature (318)..(318): Xaa can be any naturally occurring amino acid
  misc_feature (347)..(347): Xaa can be any naturally occurring amino acid
MASSIAIRSRLVPSLLKLRSRNPRRALFSTEASSSSSNPSSKVSSSQQQSLFSDFPPPNHLPPPPPPEAAAEAAVGKERKGLKYLSNGLIWAFTGATAAIGYTSYAYTLDEVNEKTKSFRESAMKPPPPALDSSSAIDKYQAMLYSAAIKVPARAIEMYLELRERVEEHVKGFTEPLSEKLLPDLHPSEQNVVYTLVLDLNETLLYTDWKRERGWRTFKRXPGVDAFLEHLGKFYEIVVYSDQMDMYVYPVCEKLDPNGYIRYKLARGATKYENGKHYRDLSKLNRDPKRILYVSGNAFDTSLQPENCVPIKPYKLEXDDTALVDLIPFLEYVARNGPADIRPVLAXYERKDVAKEFLERSIEYQKRMQGQRQGRLWRR

SEQ ID NO: 65320 - protein, 130 aa, Chlamydomonas incerta
MVRISVLGDALKTMYNAEKRGKRQVLLRPASKVVIKFLSLMMKHGYIGEFEYVDDHRSGKIVVELNGRLNKCGVISPRYDIGHHEIERWVARLLPSRQFGIIVMTTSAGIMDHEEARRKRVGGKVLGFFY

SEQ ID NO: 65321 - protein, 319 aa, Oryza sativa (indica cultivar-group)
MDSGGASDPSRQVRVRFLTKLPAPLRAPPTSIAVPADLTRMGLSEIVNSLLLAASPDHQAQPFDFLVDGELVRLPLQEFLLAKGISVERVLELEYVKAVAPRKQEDPCPHDDWVSAVDGSNPSFVLTGCYDGLARIWRDASECTHILEGHSDGITSARFINKGETEDRLHVVTASKDRSLRLFKICSGSWDNSIKLWSVEGSEEDGDTVSVKKRRTNSDSSGPEESLFEGSATSTFLGHTQCVSAVTWPERQTIYSASWDHSVRQWDVQTGKETWNMVSGKALNCLDCGGESSSLIAAGGSDPVLRWPLASVESHKDKV

SEQ ID NO: 65322 - protein, 125 aa, Triticum aestivum
DDGTIISTARLNRTVHVDAAKRLMTVESGMLLRDLVEAAAVAGLSLPHSPYWHGLTIGGLLSTGAHGSSLWGKGGAAHEYVVGLRIVTPAPASQGFAVVRELGAGHPDLDAAKVSLGVLGVISHV

SEQ ID NO: 65323 - protein, 376 aa, Zea mays
MAEEDVQPLVCDNGTGMVKAGFAGDDAPRAVFPSIVGRPRHTGVMVGMGQKDAYVGDEAQSKRGILTLKYPIEHGIVGNWDDMEKIWHHTFYNELRVAPEEHPILLTEAPLNPKANREKMTQIMFETFSCPAMYVSIQAVLSLYASGRTTGIVLDSGDGVSHTVPIYEGYTLPHAIIRLDLAGRDLTDNLMKILTERGYSFTTTAEREIVRDIKEKLAYVALDYEQELETARTSSTVEKSYELPDGQVITIGAERFRCPEVLFQPSFIGMESPGIHEATYNSIMKCDVDIRKDLYGNVVLSGGSTMFPGIGDRMSKEIAALAPSSMKVKVVAPPERKYSVWIGGSILASLSTFQQMWISKEEYDESGPGIVHMKCF

SEQ ID NO: 65324 - protein, 421 aa, Streptomyces coelicolor A3(2)
MVDADQTFVIVGGGLAGAKAAETLRTEGFTGRVILVCDERDHPYERPPLSKGYLLGKEERDSVFVHEPAWYARHDIELHLGQTVVAIDRAAKTVHYGDDGTHVSYDKLLIATGAEPRRLDVPGTGLAGVHHLRRLAHAERLKGVLATLGRDNGHLVIAGAGWIGLEVAAAAREYGAEVTVIEPAPTPLHGVLGPELGAVFAELHESRGVRFRFGVKLTEIVGQDGVVLAARTDDGEEHPAHDVLAAIGAAPRTALAQAAGLEIADRAHGGGIVVDDHLRTSDPDIFAAGDVASFHHALFDTSLRVEHWANALNGGPAAARAMLGRGLAHDRVPYFFTDQYDLGMEYSGWAPAGSYDQVVIRGDAAKREFIAFWVKEGRVLAGMNVNVWDVTEPIQQLIRSKTRVDTEDLANPHVSLESLVA

SEQ ID NO: 65325 - protein, 327 aa, Rickettsia sibirica 246
MNIIVKIQQDLKDEVTKLNNLIISCLKSDEELIEKVGKYLLEAGGKRIRPLLTIITAKMFDYKGDNHIKLASAVEFIHTATLLHDDVVDDSTLRRFKPTANVIWGSKTSILVGDFLFSQSFKLMVASGSIKAMNVLAKASAIISEGEVVQLVKLNERRIITIDEYQQIVKSKTAELFGTACAVGAIIAGQVDHISKDMQDFGKLLGTIFQVIDDLLDYLGNDKQVGKNIGDDFLEGKVTLPLIFLYNKLAQDKQLWLENIIKCDKRTKDDFVKIHDLMVKHEIYNEIVNYLSNLENAASKLLNKIPVQNIYKDYLFSIIKFILERSY

SEQ ID NO: 65326 - protein, 666 aa, Bacillus cereus ATCC 10987
MSHSIEQLSINTIRTLSIDAIEKANSGHPGMPMGAAPMAYTLWTQFMKHNPNNPTWFNRDRFVLSAGHGSMLLYSLLHLSGYDVTMDDLKNFRQWGSKTPGHPEYGHTPGVDATTGPLGQGISTAVGMAMAERHLAAKYNRDAYNVVDHYTYAICGDGDLMEGVSAEASSLAAHLQLGRLVVLYDSNDISLDGDLNRSFSESVEDRYKAYGWQVIRVEDGNDIEAIAKAIEEAKADEKRPTLIEVRTTIGFGSPNKSGKSASHGSPLGVEETKLTKEAYAWTAEQDFHVAEEVYDNFRKTVQDVGETAQAEWNTMLGEYAQAYPELANEFQAAMNGQLPEGWEQNLPTYELGSKAATRNSSGAVINAIAESVPSFFGGSADLAGSNKTYMNNEKDFTRDDYSGKNIWYGVREFAMGAAMNGIALHGGLKTYGGTFFVFSDYLRPAIRLAALMQLPVTYVFTHDSIAVGEDGPTHEPIEQLAALRAMPNVSVIRPADGNESVAAWRLALESTNKPTALVLTRQDLPTLEGAKDDTYEKVAKGAYVVSASKKETADVILLATGSEVSLAVEAQKALAVDGVDASVVSMPSMDRFEAQTAEYKESVLPKAVTKRFAIEMGATFGWHRYVGLEGDVLGIDTFGASAPGEKIMEEYGFTVENVVRKVKEML

SEQ ID NO: 65327 - protein, 502 aa, Gibberella zeae PH-1
MVSETHSLDGKSPKSDLSFENVEHLATVEHAPVVLLNEDISYGRGGIRGVIESPYIFGVAFLASMGGFSFGYDQELGAFIGCLFMPTLCDKISRKKALSIVVVIFNIGAIMQTAANSYGLLVAGRTIGGIGVGTLAMGAPIYISEIAPPNLRGTLLVLESVSCVIGVVVSFWITYGTRELAGELSFRLPFGLQMVCSTILGIGIHFFPYSPRWLALVDRSDDALTNLERLRRLPRTDPRVHQEHAGICNEVTIQKRMQEKRHPGVTGLKLEILCWADLFKKSSWHRTSIAVGVAFFQQLSGINAFIYYAPTLFQSLGQSTEMSLIMSGVFNMLQLVAVTVCFFIIDKVGRRPLAIWGGIGGGTAWGIMAVLVGVFNEKWGSNPTAGWAAVAMAFCFILIYGVSYAPLGWALPAEVFPNSSRSKGVALATATVWLFNFVVGVATPPMIESIGFGVYIFFGSWCFLAAVWAFFLVPETKGKTLEQIDEVFNDHAAQEELMILRS

SEQ ID NO: 65328 - protein, 819 aa, Streptomyces coelicolor A3(2)
MQNTGTRTPATTPTHCPYCALQCGMNLTPVEGGTVEVSERTDFPVNRGALCGKGRTAAAVLAPGARLTSPLVRSGDGALVPAGWDEALDRIAGNLERTRARYGADALGVFGGGGLTNEKAYALGKFARVVLGTSQIDYNGRFCMSSAAAAGTRAFGLDRGLPFPLEDVPRTGCVILVGSNPAETMPPSLRYFTELRENGGTLIVVDPRRTKTAEQADLHLAPRPGTDLALALGMLHLVVAEGRVDEAYVEERTSGWEEARAAAMAHWPEYVERITGVSVPELREAVRLFCAPEAAMVLTARGPEQQAKGTDTVGAWINLCLATGRAGRPLSGYGCLTGQGNGQGGREHGQKADQLPGYRKLTDPAARRHVAEVWGVDPDALPGPGRSAYELLDALGTDVRSLLVMGSNPVVSAPRAAHVEGRLRSLDFLAVCDVVLSETAELADVVLPVTQWAEETGTTTSLEGRVLLRRRAITPPDGVRGDLEVLHGLAGRLGVQKGFPTDPEEVFEELRRASAGGPADYSGIDYRRLAEENGVFWPCPAQPAADDTHTADPGTGTDTRTRTGTGSGSGSGSGRDMSTETGTGSGMYTDTGTASGMSTDTGSGSTDAGIGRDPRAATGTGSGMSTDTGRVTRTATGTGSGMSTDTGSDSDSDSSDAGAGLRAAPHPGTPRLFLDRFATDDGRARFAPVTHRPSAEEPDDEYPVLLTTGRVVSQYQSGAQTRRVAELNAAAPGPFVELHPRLAARLGAADGDPLAVVSRRGRAVAPARITTGIRPDTVFMPFHWPGEGRANTLTNPALDPTSRMPEFKVCAVRVETVTS

SEQ ID NO: 65329 - protein, 485 aa, Burkholderia xenovorans LB400
MRIDHLINGKSGAAKDYFETVNPATQEVLAEVARGGAEEVDAAVRAAKDAFPAWAARPAAERAKLVRKLGELIAKNVPEISETETKDTGQTISQTRKQLVPRAADNFSYFAEMCTRVDGHTYPTDTHLNYTLFHPVGVCALISPWNVPFMTATWKVAPCLAFGNTAVLKMSELSPLTAAMLGNLALEAGIPAGVLNVVHGFGKETGEPLVAHPDVHAVSFTGSTATGNRIVQTAGLKKFSMELGGKSPFVIFDDADFERALDAAVFMIFSNNGERCTAGSRILVQRGIYARFAERFIERAKRLSVGDPLSDSTIVGPMISQGHLAKVRSYIELGPKEGATLACGGLDLPELPDALRKGNFVQPTVFVDVDNRMRIAQEEIFGPVACLIPFDDEADAIELANDISYGLSSYIWTENTGRALRVAAAVAAGMCFVNSQNVRDLRQPFGGTKASGVGREGGTWSYEVFLEPKNVCVSLGSHHIPRWGV

SEQ ID NO: 65330 - protein, 403 aa, Glycine max
MKNGIMECSVCHSKLVSPSAKTISRAYDRHKSRISSKQRALNVFLVVGDCVLVGFQPILVYMSKVDGKFNFSPISVNFLTEITKVFFAIVMLLLQARHQKVGEKPLLSISTFVQAARNNVLLAVPALLYAINNYLKFIMQLYFNPATVKMLSNLKVLVIALLLKVIMKRRFSIIQWEALALLLIGISVNQLRSLPEGTTALGLPVTMGAYIYTLIFVTVPSLASVYNEYALKSQYDTSIYLQNLFLYGYGAIFNFLGILGTVVVKGPSSFDILQGHSKATMLLIANNAAQGILSSFFFKYADTILKKYSSTVATIFTGIASAVLFGHTLTMNFVIGISIVFISMHQFFSPLSKVKDEQNGVLELHDVHDKQRSKESFINMAAGANEEATHRVGHDERQPLLPS

SEQ ID NO: 65331 - protein, 196 aa, Synechococcus sp. CC9311
MTATIGNFLKNLCGEYSNQKQAFDNPPLFAHIFLRYKPIEHLQPGSILLEQTYAVDPKHPYRLRVIRAEEVTSGIIKLWNHTFKAPENFSSATFDDEQRKTIKEEDLILLDHCHYQVRQLDNGFFGELEPGCRCIVHRNGKETYLVSSFHLEGDELTTLDRGHDPQTHERCWGSIAGEFHFQRISNWAENIPEKWL

SEQ ID NO: 65332 - protein, 527 aa, Thermoplasma volcanium GSS1
MIVLGLEGTAHTISCGILDENSIMANVSSMYKPKTGGIHPTQAAAHHVDKVSEVIAKAIEIAGIKPSDIDLVAFSMGPGLGPSLRVTSTAARTLAVTLKRPIIGVNHPLGHIEIGKRLSGAQDPVMLYVSGGNTQVIAHLNGRYRVLGETLDIGIGNMIDKFARYAGIPFPGGPEIEKLAKDGRKLLTLPYSVKGMDTSFSGILTSALEYLKKGEPVEDISFSIQETAFSMLVEVLERALYVSGKDEVLMAGGVALNNRLREMVSEMGREVDATTYMTDKNYCMDNGAMIAQAGLLMYKSGIRMNIEDTSINPRYRIDEVDAPWVIEKNVKYRDAGAESRIVNTDFYGRSAVKKIRIAKGYRLKELDERIRGERMKNEFTVIRRMRDAGICVPIVYDYDPFEKTLTLSQIQGELLRDVIRARPNVMGNVGHDVAVMHKNKISHGDLTVNNIIVSDRICFIDASMGKVNAELEDLAVDVYTLEDSINSLSENGKTLMKEFKMSYRANFPQANDVLNIVEDIRRRHRYV

SEQ ID NO: 65333 - protein, 380 aa, Lactobacillus plantarum WCFS1
MAEQDLYKVLGVEKDASQDEIKKAYRKLSKKYHPDLNHEPGAEEKFKAVNEAYETLGDAQKRAQYDQFGSTGGQQGFGGAGGFGGQDFGGFGGGGGFEDIFSSFFGGGAGGSRRSNPTAPQQGRDLQYEMTLKFEDAIFGKKTTITYNREEQCETCGGSGAKPGTSPVTCSKCHGAGYIQVQTNTPLGRMMSQQVCDVCHGTGKEIKDKCATCGGSGHTEQSHSIKVTVPAGVEEGQQMRLQNQGEAGTNGGPYGDLFIIFRVEPSKDFERDGATIYFKLPIDFVQAALGDEVQVKTVHGDVKLKIPAGTQTGTTFRLRGKGAPRLRGNGNGDERVTVNIETPTHLNKGQKEALKTFAKASGKSVAGNGKSSLFDKLRGV

SEQ ID NO: 65334 - protein, 483 aa, Triticum aestivum
  misc_feature (155)..(155): Xaa can be any naturally occurring amino acid
  misc_feature (219)..(219): Xaa can be any naturally occurring amino acid
  misc_feature (230)..(230): Xaa can be any naturally occurring amino acid
MADKVVATYYYPPMEVAAAELGHTAGSKLDDDGRNKRTGTMWTASSHIITAVIGSGVLSLGWAIAQLGWVAGPAVMLLFSLVTYFTSSLLADCYRSGDQSTGKRNYTYMDAVNANLSGIKVQICGVLQYANIVGVAIGYTIAASTSMLAIKRANXCFHGNGHADPCKLSSVPYMIIFGVAQVFFSQIPDFDQISWLSMLAAAMSFTYSSIGLGLGIVQXYSKTEAVKGSXLTGISIGTVTPMQKVWRSTQAFGDIAFAYSYSLILIEIQDTIRAPPPSESTVMKRATMVSVAVTTVFYMLCGCMGYAAFGDAAPGNLLTGFGFYEPFWLLDVANAAIVVHLVGAYQVYCQPLFAFVEKWAAKRWPESTFVTGEVEVPLFRTYKVNMFRATWRTAFVVATTVVSMMLPFFNDVVGFLGALGFWPLTVYFPVEMYVVQKKVPKWSTQWVCLQMLSLGCLAISLAAAAGSIAGIKSDLKVYHPFKS

SEQ ID NO: 65335 - protein, 374 aa, Methanothermobacter thermautotrophicus str. Delta H
MIMRKFASRVKDIQLSEIRKIFEVADEDTINLGIGEPDFSVPDHVREAVKDAVDEGLTHYTSNMGMEELREAIADKLKSENRVHAEPESIIVTVGASEAIFMCTQALLDIGDHALIPDPGFLSYDACVRLSGAVSIPVPLSMDEGFSMSPERVESLITQDTRVIIMNSPSNPTGSVMGKDDVKGIAEIAEDNDLIIISDEIYEKIIYDGKHYSPAQFTDNALIVNGFSKTYAMTGLRIGYVAGCEDIIEELLKVHQYNTACAPSISQYAALAAIRGPQNCVKDMVDEFRRRRDLMFRSLTDMGLECVLPGGAFYMFPYAGDSEEFTKLSLEAGVAVVPGSAFGNEGKGYIRMSYATSYELIEEAMERLKTVCGV

SEQ ID NO: 65336 - protein, 260 aa, Chlamydomonas incerta
GINPARMSADSAAAGDAALAESYMAHPAYSDEYVESVRPTHVSPQKLHQHVGLRTIQVFRYLFDKATGYTPAGTMTEAQWLRRMIFLETVAGCPGMVAGMLRHLKSLRSMSRDRGWIHTLLEEAENERMHLITFLQLRQPGPAFRAMVIVAQGVFFNAYFLAYLLSPRTCHAFVGFLEEEAVKTYTHALEEIDAGRLWKDTPAPPVAVQYWGLKQGATMRDLILAVRADEACHAHVNHTLSQLNPSTDANPFATGASQLP

SEQ ID NO: 65337 - protein, 672 aa, Coprinopsis cinerea okayama7#130
MTEDEEDWEDYVKGGYHPVKIGDEFSDGRYVVVRKLGWGHFSTVWLARDTKMNRHVALKIVKSAPRYTETALDEIKLLQRLITSSTPPVAPTPENPNPPPSPSHTHPGKSHVIQFLDHFRHKGPNGTHVCMVFEVLGENLLGLIKRHQSKGVPMHLVKQIAKQILLGLDYMHRCCGVIHTDLKPENVLICIDDVENVILAELEASSAAASTPPTRLVGVPPSKGRGGNQTPRSESVFITGSQPLPSPSSSFGTSPMLDKWAFGMSRIEGDDNSNGIVEKKGLSTVKRAVSTDLVAEVNNVSLETQASYVGRMPGAPGPSLLTDTKPVPIPGAPSPEPPADGAPRSVMSVDQRSDSSSAIDLSEKITVKIADLGNATWVEHHFTDDIQTRQYRCPEVILGAKWGTSADIWSVACVLFELITGGDYLFDPASGSRYSKDDDHIAQIMELLGELPRSIAFSGKYSSEFFNRKGELRHINKLRYWPLDSVLHDKYLFPKHEADALAAFLLPMLRLHPDRRAKASELIHHNWLEGTVVQGEIDVIKRAEAEEAARKKAKADQQRQASQKHKRDDSKLVQAGGMQLLDEDEADAMKPIEAGAVVADGEAEGEQKDLKPVQQLQLQHQPPVLNPPPIPHGASGLTRTAPANVAKQVSPPPAANNRQPSAGKKTSKSGRS

SEQ ID NO: 65338 - protein, 327 aa, Synechococcus sp. RS9917
MAGTLLFNALREAIDEEMARDPHVCVMGEDVGHYGGSYKVTKDLYEKYGELRVLDTPIAENSFTGMAVGAAMTGLRPIVEGMNMGFLLLAFNQISNNMGMLRYTSGGNFTIPTVVRGPGGVGRQLGAEHSQRLEAYFHAVPGIKIVACSTPTNAKGLMKAAIRDNNPVLFFEHVLLYNLSEELPAGEYTCALDQADLVQEGSDITILTYSRMRHHCLKAVEQLEADGISAELIDLISLKPFDMDTIARSIRKTHRVIVVEECMKTGGIGAELIALITEHCFDDLDARPLRLSSQDIPTPYNGTLENLTIIQPHQIVEAAMQIVRKGL

SEQ ID NO: 65339 - protein, 471 aa, Aspergillus oryzae
MAISDTPPNCVSVVIIGAGFSGLVVACQLKHQLNCDDFVIYDRAATLGGTWAANTYPGCGVDIPAPFYSLSFAPNAEFSRFFPKQQEVLQYLESVALRYDISGHVVGNTEWIGASFEDSTKTWLIKLRDVKSGQEYIQESKILVSAVGGLTNPNPFHIDGIERFQGSMIHTARWDHSVSLSDKDVVVIGNGSSATQLVPAIASNVHSVTQFIRSPQHYFPGNDTTIPSSWRTTFRRLPALLRFVRLLIFLYLETSLFQFDLTKTGERMREEAREKSCRYIEQYAPEEYWDLLMPTADIGCKRRVFDHDGYISCLNRDNVHLTNDPIIALREHSVLTQSGKTYPADVIVLANGFSLTQFDAELRGRHGHSRKGHWQEFGYIEAYNSVAMSGFPNFFYMMGPNSGRGHTSIIYSLESYANLIIRVIKPVISRHALTVEPKVSSERAYNDQLHTALEKTVLTNACRSVSYLSWV

SEQ ID NO: 65340 - protein, 323 aa, Oryza sativa (indica cultivar-group)
MGGLVAYAWKDADSESGGGACEARIIIDRDTGKSKGYGFITYTSSEEAAAAVTAMDGKDLQGRIVRVSTANDRAGGIRGGGGFGAGGYGSGGGYSSGGGYGTGEYGRGGGYAGNGGYGGRASEYGGYGAGGYSSSGGYNATSVPHGNAGGYGSSGVSHGNAGDYRSSDVYNTTNTYGAGNFSHSGGGFGENSGGYNSGQFGAAGHSNGGYSASNFSNASFGANSSVFSSGQSGATGRNNGGNSASNFSLDGSFGANNGGISSGQFGAVGHSNGGYSTSNFSRGSGFGANSGGSSNGQYGAAHGNNGSNFSHGGGFGANNGTRA

SEQ ID NO: 65341 - protein, 997 aa, Oryza sativa (indica cultivar-group)
MRVVALNVSSSPGRRLAGALSPAVAALRGLRVLALPSHALSGQLPAAIWSLRRLLVLDLSGNRLQGEIPPALACAGLQTLDLSYNQLNGSVPASLGALPGLRRLSLASNRLGGAIPDELGGAGCRSLQYLDLSGNLLVGGIPRSLGNCSKLEALLLSSNLLDDVIPPEIGWLRNLRALDVSRNSLSGSVPAELGGCVELSVLVLSNPYTPIGGSNSSDYGDVDDFNYFQGGIPDAVVALPKLRVLWAPRATLEGELPCNWSACQSLEMINLGENLFSGGIPNGLVECSHLKFLNLSSNKLTGAIDPSLTVPCMDVFDVSGNRFSGAMPVFEQKGCPSSQLPFDDLVSEYSSFFSYQALAGFHSSSFVLGTDLTSYHSFAQNNFTGPVKSLPLAADKLGMQGSYAFLADGNNIAGQLQPDLFSKCNSSRGFIVDVSNNLITGGIPVEIGSLCSSLVVLGVAGNQLSGLIPTSIGQLNYLISLDLSRNHLGGEIPTSVKNLPNLERLSLGHNFLNGTIPTEINQLYSLKVLDLSSNLLTGEIPGALADLRNLTALLLDNNKLTGKIPSAFAKSMSLTMFNLSFNNLSGPVPANSNTVRCDSVIGNPLLQSCHMYTLAVPSAAQQGRGLNSNDYNDTSSADSQNQGGSNSFNAIEIASITSATAIVSVLLALIVLFIYTRKCAPRMSSRSSRRREVITFQDIGVPITYETVVRATGSFNASNCIGSGGFGATYKAEISPGVLVAIKRLSVGRFQGVQQFHAEIKTLGRLRHPNLVTLVGYHLGESEMFLIYNYLPGGNLERFIQERSKRPVDWKMLHKIALDIAKALAYLHDTCVPRILHRDVKPSNILLDTEYNAYLSDFGLARLLGNSETHATTGVAGTFGYVAPEYAMTCRVSDKADVYSYGVVLMELISDKKALDPSFSPYGNGFNIVAWACMLLRQGRAREFFIDGLWDVGPHDDLVETLHLAVMCTVDSLSVRPTMKQVVQRLKQLQPPIREHR

SEQ ID NO: 65342 - protein, 404 aa, Zea mays
  misc_feature (231)..(231): Xaa can be any naturally occurring amino acid
MEWASAAYTAAALVCAAAACVVALAHIYRHLLHYAEPIYQRFIVRIIFMVPVYAVMSFLSLILPNNAIYFNSIREIYDAWVIYNFLSLCLAWVGGPGAVVVSLSGRTLKPSWILMTCCYPAIPLDGRFIRRCKQGCLQFVILKPILVVITFILYAKGKYKDGNFSVNQSYLYITIIYTISYSMALYALALFYAACRDLLRPYNPVPKFIMIKSVVFLTYWQGVLVFLAAKXRFIKNADKAADLQNFFLCVEMLIATVGHFFSFPYKEYTGPNARPSRGFRESLLHALKFNDFYHDTVHQFAPTYNEYVLYNHNEGDSAQTKYPSGSTATSGQGVELAGITVAASNSPVSSSVSSNQADQEETMTTPIKDKVDPPGGLYDLTELLDIDLSSYPAKLPGTTDVRKQ

SEQ ID NO: 65343 - protein, 643 aa, Oryza sativa (japonica cultivar-group)
MSLIEHPNVIRAYCSFVVEHSLWVVMPFMTEGSCLHLMKIAYPDGFEEPVIGSILKETLKALEYLHRQGQIHRDVKAGNILVDNAGIVKLGDFGVSACMFDRGDRQRSRNTFVGTPCWMAPEVLQPGTGYNFKADIWSFGITALELAHGHAPFSKYPPMKVLLMTLQNAPPGLDYDRDRRFSKSFKEMVAMCLVKDQTKRPTAEKLLKHSFFKNAKPPELTMKGILTDLPPLWDRVKALQLKDAAQLALKKMPSSEQEALSMIRDDEPPEIKEDDDTARTIEVEKDSFSRNHLGKSSSTIENFFSGRTSTTAANSDGKGDFSFEAFDFGENNVDTKIMPNGYENARSENSSSPSTSKQDPESKYWRSTSGQKQQTSGTPAVHSGGVNSSTTEKGHGVERDATVQLASDKLRTETRRATNLSGPLSLPTRASANSLSAPIRSSGGYVDSLGDKSKRNVVEIKGRFSVTSENVDLAKVQEVPLSSLSRKSPQASPLKKSASVGDWLVNTKPMSNSHHVKELCNSSVSSSILIPHLENLVKQTMFQQDLIMNVLSSLQQNEKVDGVLSGISPQLRNTDSDTMVGSVNSEKERSLLVKISELQSRMITLTDELIAAKLKHVQLQQELNALYCREEIEDIRDDDNEET

SEQ ID NO: 65344 - protein, 251 aa, Oryza sativa (japonica cultivar-group)
MSGTGYTVEVTNLSSRASESDLHEFFSFSGAIEHIELIRSGEYGSTAYVTFKEPYSLETAVLLSGATIVDQPVCIARWGQPNEPYNFWDTPNWYTEEEIEYRTYQTCQFNSTPQEALTIAQDVVKTMLARGYVLSKDALARARAFDESHQVTATAAAKAAELSKRIGLTDRVSGLTDRVSAGVGAIRSVDETYHVSETTKTVATATGRTAVKVVNGIMTSSYFSAGAMMLSDALHRAAQAAADLAAHGRHN

SEQ ID NO: 65345 - protein, 392 aa, marine gamma proteobacterium HTCC2207
MQSNRELDVVVYGATGFTGRLVAEYLNNQYGVNGDVKWAMAGRSQAKLESVRDEMGISNDVPLIVADAADMDSVNAMVLSSKVILTTVGPYQLYGNELVAACAEHGTDYVDLCGEPAWMHQMIGAHSAAAEASGARIVFSCGFDSVPFDLGVLFLQQTAEQQLGAMVPRVKGRVRSMKGTFSGGTLASFRATMAAAGKDRELINVLRNPFALTEGFVGADQPRGDKPEFDEALQSWIAPFVMASINTKNIHRSNKLLGHAYGTDFVYDEMMITGPGERGEAVAKAVTEDTSMATDPRQPGEGPSLDERVNGHYDVLLIGEAADGRSVRVSVKGDMDPGYGSTSKMIAESAVCLVLNPELASGGIWTSAPAMGSALIERLQANAGLTFAVEAE

SEQ ID NO: 65346 - protein, 475 aa, Oryza sativa (japonica cultivar-group)
MATTPAPVSLSAAASTVPARLLVGRGAAAAPVARRRARMVVVRAKIREIFMPALSSTMTEGKIVSWSAAEGDRVAKGDAVVVVESDKADMDVETFHDGIVAAVLVPAGESAPVGAPIALLAESEDDLQAALAKAQELSKAHPQQAPPPSDAAAPPPPPPPPAAAPAAPAPVAAGTKGIATPQAKKLAKQHRVDLAKVAGTGPFGRITPADVEAAAGIEPKPKVVPAASAAPVPLSAPAIGAVPQAAELPPVPGATVVPFTGMQAAVSKNMVESLAVPAFRVGYPIVTDKLDELYEKVKSKGVTMTVLLAKAAAMALAQHPVVNASCRDGKSFTYNTNINIAVAVAIDGGLITPVLEDADKLDIYLLSQKWKELVKKARAKQLQPNEYSSGTFTLSNLGMFGVDRFDAILPPGQGGIMAVGASKPTVVADKDGFFSVKSKMLVNVTADHRIVYGADLAAFLQTFAKIIEDPESLTL

SEQ ID NO: 65347 - protein, 386 aa, Triticum aestivum
  misc_feature (199)..(199): Xaa can be any naturally occurring amino acid
  misc_feature (204)..(204): Xaa can be any naturally occurring amino acid
  misc_feature (207)..(207): Xaa can be any naturally occurring amino acid
  misc_feature (221)..(221): Xaa can be any naturally occurring amino acid
  misc_feature (225)..(225): Xaa can be any naturally occurring amino acid
  misc_feature (248)..(248): Xaa can be any naturally occurring amino acid
  misc_feature (250)..(250): Xaa can be any naturally occurring amino acid
MLRLRECVVSHLLSSPSNSATSPLRRLLSATASAPISPNPCGFAVEEYLVATCGLTRVQALKASKKLAHLKTPDKPNAVLAFLSGLGLSGADVAAVVGKDPLLLCTKVDQTLAPKVVELTGLGLSPPEIARLVSLTPDRFRRRAIVSRLHYFLPLFGSFHSFLRLLKRSSRLLSSDLDKLVKPNVAFLRECGLGACDIXKLCSXQPXIVTANLERVQAMVXCAEXIGVPRASGMFRPRLHAVAFLSEXKXAARVNYLKNTFSWTDAEVGMAVSKVPPVLARSKESLQLMSEFLISEVGLEPVHIAQRSVILGHSLYGRLMPRYYAMKFLKENGLLKRDSSYYTVFKESDMAFKKKFIHPHKEAAPHLEKDYDAACKGEVPTNFRFT

SEQ ID NO: 65348 - protein, 92 aa, Oryza sativa
  misc_feature (24)..(24): Xaa can be any naturally occurring amino acid
VDAQGADIYPPDGLIQCADHVYAXPKDLQLQAPCYQGMFHQSVACPGFIAAQAVSSLQIGGDSSDITSPSQGATVVNRMLGATNRLNLYREI

SEQ ID NO: 65349 - protein, 311 aa, Chlamydomonas incerta
MRGQARPSVAAARRSAVSARRAVSVVASSVADLNKKYGIPGSVEFKEGKSGSPIVVLKHACGATAEMYLFGACVTSWKQPSGDEVLYVRPDAVFDKSKPISGGVPHCFPQFGPGAMQQHGFARNLDWAVSTTSADPNPDEKDPSVEVVLTESDYTLKMWPHKFKAVYTVSLHGEQLNLQLRVINTDDKPFDFTAALHTYFEVLEIAKAKVTGLKGLTYLCKAKDPKVPETKTEDRDAITFTGYTDSVYLNSPAHVELEVGTGAAVALDSTGWEDTVVWNPHLTMKDCYQHFCCVENAKFGKSATVKPGESW

SEQ ID NO: 65350 - protein, 321 aa, Alteromonadales bacterium TW-7
MKRLNTVLKEDGVRTDLILLIRTILATSKEIAFRVGQGELAGVLGSTMNENIQGEVQKKLDIIANQLLKDILLDDSSVRTVASEEEDHAVGGHPEGTFIVAFDPLDGSSNIDVNGQIGTIFTIYLARDDVPFDSDEQFNQPGVSQVCAGYVLYGPSSLLVMTTGGPTRCYTLDSTHGGYLLTNPQLQIPSQSREFAVNMANYRYWDEPTQVYFDKLLYTSESFEKSSIRWNAAMVGDVHRILCRGGLFLYPQDKRVGNDNGKIRLLYEANPLAMLVENAGGKATSRGARILDITPDDLHQRVPVTLGSIEPVDYFNNSAPS

SEQ ID NO: 65351 - protein, 387 aa, Methanosarcina thermophila
MATTRDYYEILGLSRDATPEDIKKSYRKLALKYHPDRNKEPGAEEKFKEISEAYAVLSDPEKRAQYDRFGHAGINGQYTAEDIFRGADFSGFGDIFEMFFGGSRRGPRGPRRGSDLQYDLYITFEEAAFGVRKDIDVPRTERCSNCSGTGARPGTSPKRCPTCGGTGQIRTTRTGLGMQFVSTTTCSTCRGKGQVIESPCPVCSGTGRVRNTRKITVNVPAGADSGMSLRLSGEGDAGDPGAPPGDLYVVLHVMEHKIFKRVDYDVISEVPISFAQAALGTDIMVDTLYGKVKMNIPAGTPTHSVFKIKEKGIQHLHGNRRGDQLVRVVIKTPTNLSHEQKRNFFASLKALSSGKNPGGEKGRYDKFTEKSKKSKGFFEKVKDAFES

SEQ ID NO: 65352 - protein, 444 aa, Bacillus cereus ATCC 10987
MARYTKEDIFRLAKEENVKYIRLQFTDLLGVIKNVEIPVSQLTKALDNKMMFDGSSIEGFVRIEESDMYLYPDLDTWVIFPWTAEKGKVARLICDIYNADGTPFEGDPRNNLKRVLKEMEALGFSDFNLGPEPEFFLFKVDEKGNPTLELNDNGGYFDLAPMDLGENCRRDIVLELEEMGFEIEASHHEVAPGQHEIDFKYANAIRSCDDIQTFKLVVKTIARKHGLHATFMPKPLYGVNGSGMHCNLSLFKNGENVFYDQNGDLQLSDDARHFIAGILKHAPAFTAVANPTVNSYKRLVPGYEAPCYVAWSAQNRSPLVRIPASRGISTRVEVRSVDPAANPYLVMATLLAAGLDGIKNKLTPPAAVDRNIYVMTKEEREEAGIVDLPATLAQALVTLQANEVISNALGDHLLEHFIEAKEIEWDIFRTQVHQWERDQYMSLY

SEQ ID NO: 65353 - protein, 289 aa, Triticum aestivum
SALKTWGFFQISNHGMEASMMDSVMTASREFFHLPLEEKKKCSNLIDGKHFQVEGYGNDQVRTQDQRLDWSDRLHLRVEPEGGRNLAHWPTHPKSFRDNLHEYALKCKRIKSDILRAMAKILKLDEDCLVNQFNSNAPTFARFNHFPPCPRPDLVLGIKPHADFPALTVLLMDKDVAGLQYLRDGTWYNVPAACDHTLLINIGLTMEIMTNGIFRGPMHRVVTNADKERISVAMFYGVDPEQEIGPIAHLLSEEQSAQYRKMKAKDLLVLHHEHYAGGRGPRIADALKI

SEQ ID NO: 65354 - protein, 300 aa, Triticum aestivum
MAAARPALPSSPTSLLLARSTSAPDLAARRPRRWLVAAAGVPAVAGALAASASTPAASMLLRDGGATLLVTAGAYSLVRAFDALTERRLVQQSLSRKVVHVLSGVFFMASWPLFSNSTSARFFAAVVPFLNCVRLLTYGLGFYSDEALVKSVTREGKREELLRGPLYYVIVLLIIVLVFWRDSPIGIVSLSMMSGGDGFADIVGRRFGSLKLPFNKKKSWVGSAAMFISGFLLSALMLSYFSWLGYIHVSWDQALGKLVLVALAATVVECIPVTDVVDDNISVPLATMLVAFLLFGNTAN

SEQ ID NO: 65355 - protein, 871 aa, Streptomyces coelicolor A3(2)
MTATPGNPPTIVLVGHGMVGQRFLEALAERGLTGTHRVVVLCEEPRPAYDRVQLTSYFSGKTPEDLSMTDPAFIAEHGIELRVGDPAETIDREARRVTARSGLVVEYDVLVLATGSYPFVPPVPGKDAEGCFVYRTIEDLLAIEAYARTRATTGAVVGGGLLGLEAAGALNGLGLTSHIVEFAPRLMPVQVDEGGGAALLRTIEEMGLSVHTGVGTQEITTGEDGAVTGMKLSDGSELATDLVVFSAGVRPRDQLARDCGLAVGERGGISVDERCRTVTDERVFAIGECALAADGRVYGLVAPGYEQAETAAATIAAQEASFTGADLSTKLKLLGVDVASFGDAHGTTEDCLDVVYSDSRAGLYKKLVVGRDGTLLGGILVGDAEAYGTLRAFTGSVPPVSPESLVLPAGAGAPAQLGPAALPDDAVICSCHNVTKGTIRGAVTEHSCTTVPEVKKCTRAGTGCGSCVKVLGQLVTAELEASGVEVDKGLCGCFAQTREELYEIVGALRITSYRELLDRHGREGARGGEGCEVCKPAVGSIIASLAPSIGASGYVLEGEQAALQDTNDHFLANLQRNGSYSVVPRIPGGEIAPEKLIVIGEIARDFGLYTKITGGQRIDMFGARVEQLPLIWARLVDAGFESGHAYGKSLRTVKSCVGQTWCRYGVQDSVRMAIDLELRYRGLRSPHKLKSAVSGCARECAEAQSKDFGVIATSNGWNLYVGGNGGATPRHADLLAQDLSDAELVRLIDRFLMFYIRTADKLERTSTWLERIPGGLDHVRDVVVHDSLGICDELESLMRAHVSHYRDEWAETVNDPEKLARFVSFVNAPDVPDPVVGFVPERDQIKPDLPLLDIGRRPASADDLLEGSTRR

SEQ ID NO: 65356 - protein, 175 aa, Triticum aestivum
MAPTVMASSATSVAPFQGLKSTAGLPVSRRSNGASLGSVSNGGRIRCMQLWPIEGIKKCDTLSYLPPLSTEALLKQVDYLIRSKWVPCLEFSKVGFIFREHNASPGYYDGRYWTMWKLPMFGCTDATQVINDVDEVKKEYPDAYVRIIGFDNMRHVQCVRFIAFKPPGCDESGKA

SEQ ID NO: 65357 - protein, 522 aa, Oryza sativa
MGTRTNPPGSMVESFHGLVVVDLRTAAPLLATAVALYILIEQLSYHRKKGSMPGPPLVVVPFLGSVTHLFRDPVGFWDLQATRASKSGAGLTADFLFGRLMVFIRDSELSRRVFANVRADAFHLVGHPFGKKLFGDHNLIYMVGKEHKDLRRRIAPNFTPRALSTYAVIQQRVILSHLRRWIDRSVANGGKAEPIRVPCRDMNLETSQTVFVGPYLTVETRERFDRDYNLFNHGFITLPIDLPGSAFRRARLAVPRLKHILEDCARQSKQRMRGGGEPECLVDYLMQETVREIDEAAAAGLPPPPHTSDMETGNLLFDFLFAAQDASTSSLCWAVSALDSHPDVLARVRAEVAALWSPESGEPITAEMMTEMKYTQAVAREVVRYWPPGPVVPHIAGEAFQLTEQYTIPKGTIVFPSVYESSFQGFPDAGTFDPERFFSEARREDVVYKRNFLAFGAGPHQCVGQRYALNHLVIFMALLASLIDFRRERTEGCDVPVYMPTIVPRDGCVVHLKQRCAKLPSF

SEQ ID NO: 65358 - protein, 909 aa, Streptomyces coelicolor A3(2)
MSENKDPQVANAAKFVYDFTEGNKDLKDLLGGKGANLAEMTNLGLPVPPGFTITTEACKTYLDSGEEPAALRDEVSAHLDALEATMGKKLGQADDPLLVSVRSGAKFSMPGMMDTVLNIGLSDKSVQGLAKQAGDDRFAWDSYRRLIQMFGKTVLGVDGDLFEEALEAAKTAKKVAVDTELEAADLKKLVTKFKKIVKTEAGRDFPQDPREQMDLAIKAVFESWNGERAKLYRRQERIPHDLGTAVNVCSMVFGNLGPDSGTGVAFTRDPASGHQGVYGDYLQNAQGEDVVAGIRNTVALADLEQIDKKSYDQLMQIMETLENHYLDLCDIEFTIERGQLWMLQTRVGKRTAGAAFRIATQLVDQGLIDEAEALQRVNGAQLAQLMFPRFDDEAKVEKVGRGIAASPGAAVGKAVFDSYTAVKWSRSGEKVILVRRETNPDDLDGMIAAEGILTSRGGKTSHAAVVARGMGKTCVCGAEELEVDTKRRRMTVPGGHVVEEGDVISIDGSSGKVYLGEVPVVPSPVVEYFEGRMHAGAEDADELVEAVHRIMAFADRKRRLRVRANADNAEDALRARRFGAQGIGLCRTEHMFLGDRRELVERLILADTEAVREESLKELLPLQKQDFVQLFESMDGLPVTVRLLDPPLHEFLPDITELSVRVALAESRQEPHENELRLLQAVHRLHEQNPMLGLRGVRLGLVIPGLFTMQVRAIAEAAAERKAAKGDPRAEIMIPLVGTVQELEIVREEADQVIAEVEAATGAKLKLSIGTMIELPRAALTAGQIAEAAEFFSFGTNDLTQTVWGFSRDDVEASFFTAYLEKGIFGVSPFETIDKDGVGSLVAAAAKAGRATRPDLKLGVCGEHGGDPESVHFFHEVGLDYVSCSPFRIPVARLEAGRAASRSKGSDHR

SEQ ID NO: 65359 - protein, 881 aa, Pseudomonas syringae pv. phaseolicola 1448A
MQDLDPVETQEWLDALESVLDKEGEDRAHYLMTRLGELATRSGSQLPYAITTPYRNTIPVTHEARMPGDLFMERRIRSLVRWNALAMVVKTNLNDPDLGGHISSFASSATLYDIGFNYFFQAPTDEHGGDLIYFQGHASPGVYARAFLEGRITEDQMNNFRQEVDGNGLSSYPHPWLMKDFWQFPTVSMGLGPIQAIYQARFMKYLEHRGYIPEGKQKVWCFLGDGETDEPESLGAIALAGRENLDNLIFVVNCNLQRLDGPVRGNAKIIQELEGVFRGAQWNVTKVIWGRFWDPLLAKDVDGILQRRMDEVIDGEYQNYKAKDGAFVREHFFNSPELKAMVADLSDDEIWKLNRGGHDPYKVYAAYHEAVNHKGQPTVVLAKTIKGYGTGAGEAKNTAHNTKKVDVDSLRHFRDRFDIPVKDSELEALPFYKPEEGSAEARYLSERRAALGGFVPQRRAQSFSLPTPPLDTLKAILDGSGDREISTTMAFVRILAQLVKDKEVGQRIVPIIPDEARTFGMEGMFRQLGIYSSVGQLYEPVDKEQVMFYREDKKGQILEEGINEAGAMSSFIAAGTSYSSHNQPMIPFYIFYSMFGFQRIGDLAWAAGDSRTRGFLIGGTAGRTTLNGEGLQHEDGHSHILASTIPNCRTFDPTYGYELAVIIQDGMRRMFEEQQDVFYYLTVMNESYTQPAMPVGAEEGIVKGMYLLEEDTREAAHHVQLLGSGTILREVREAAKILRDEFNIGADVWSVTSFNELRRDGLAVEHNNRLHPGQKPELSYVQQCLNGRKGPVIASTDYMKLFADQIRQWVPTKEYKVLGTDGFGRSDSRKKLRHFFEVDRHFVVLAALEALADRGDIEPKVVAEAIAKFGIDPEKRNPLDC

SEQ ID NO: 65360 - protein, 332 aa, Bacillus anthracis str. A2012
  misc_feature (328)..(328): Xaa can be any naturally occurring amino acid
MNPLIFKENRPFDLIAVGRLCVDLNANETQRPMEETRTFTKYVGGSPANIAIGAARLGLQTGFIGKVSDDQMGRFITGYLKDNKINTDQIPIDCTGAVTGLAFTEIKSPEDCSILMYRDNVADLNLDPTEVSEDYIKQSKALLISGTALAKSPSREAVFLALEYARKHDVVVFFDVDYRPYTWQSEAETAVYYNLAAEKSDVIIGTREEFDMMEKLLNYEKSNDQVTAERWFSHHAKIVVIKHGGDGSIAYTRDGQSHRGGIFKTKVLKTFGAGDSYASAFIYGLMQGLEIPQAMRLGGASASIVISKHSCSDAMPTRAEISAFMETXEELV

SEQ ID NO: 65361 - protein, 284 aa, Saccharomyces cerevisiae
MTPSTPPRSRGTRYLAQPSGNTSSSALMQGQKTPQKPSQNLVPVTPSTTKSFKNAPLLAPPNSNMGMTSPFNGLTSPQRSPFPKSSVKRTLFQFESHDNGTVREEQEPLGRVNRILFPTQQNVDIDAAEEEEEGEVLLPPSRPTSARQLHLSLERDEFDQTHRKKITKDVPGTPSDKVITFELAKNWNNNSPKNDARSQESEDEEDIIINPVRVGKNPFASDELVTQEIRNERKRAMLRENPDIEDVITYVNKKGEVVEKRRLTDEEKRRFKPKALFQSRDQEH

SEQ ID NO: 65362 - protein, 558 aa, Candida albicans SC5314
MDWYNNRSRRSSITTGQPTQSNPAFHGIINSNNSTTASSSLSSSSNSYSSSSMINPNKYPTQQQQQQQHGNIPSPLNLSSQQTMGRNLSPVSQTNSPIVTIPPTPLERNSYYFSEFPLYACDWTCLNNGQMDCIAVGSYKETFANKLEIVHGSNYENEFNMENSLSPGTDNSFNYNNKNNTNAYYEDEEIASRDEGFCFQKVCDVTLDYPITHLQWDPSMLSYGSSGVERLATSSEVLRLYKVANNGNDSYSLQQTHVLANNTASCSSTSSNSNNSSGSSSARTIEDVNTFPPVTSFDWNKTDPNVLITSSVDTTCIVWDLHRSPGRTAINEEMLDTATVKTQLIAHDSEVFDVKFLHKSTNVFASVGNDGSMRVFDLRSLEHSTIIYEPSPSASSSATASASASTSAANHSLSATFNSKALLTLSTSNVDQHHLAAVGVNSNQIIIIDMRMPGLPVVIIDASLGGMNNSSINSIKWHPTSNYLLSGGDDCQALVWDINNLSNATNGSTNGSNHSGRIIDTPVLAYSEDLEINNVCWRQNQGDWMGVVSGKGFQAVSI

SEQ ID NO: 65363 - protein, 420 aa, Triticum aestivum
MPLLPRRPPAALYVPVRGLLEARVPWGRDRALDHVVERERHLVPFLLTKDALLTAAPPPHAVPLHALPSTIPFPFRPLRFLRLYASAFALSPHPVTVSPTHRLSALHLDEAQAVDATRADAADRLLRLLMLAPSRALPLHLVARIRLDLGLPSDFPRSLLPHYPDYFALSADGRLLELVCYRKDLAVSAVQSYAQRTGGYKVGDPIAFQLSFPRGFELDKNVRKWLDEWQKLPYISPYEDGSHLAPRSDITEKRTVAVLHEALSLTVGKKMEKEVLVKLGEALRLPPGFRKVLARHPGIFYLSHKLRTQTVVLREAYRRHMLVDKHPMMGIRYQFLHLMHMGREEAGKAKGKERKTIRGDQMMGDEYGADGENEDDYDDEEDEEEDEENIEAGVASEEEESDDEDTENRGETGEPQQAAN

SEQ ID NO: 65364 - protein, 473 aa, Synechococcus sp. RS9917
MAKTAQDVLRQIKDDGIELIDLKFTDLHGKWQHLTVCADMVDDQAFSEGLAFDGSSIRGWKAINASDMAMVPDPNTAWIDPFYRHKTLSLICSIQDPRTGEPYDRCPRALAQKALAYLAGTGLADTAFFGPEPEFFLFDDVRYSSSEGGCFYSVDTIEAPWNSGRLEEGGNLAYKIQLKEGYFPVAPNDTAQDIRSEMLLMMGQLGIPIEKHHHEVAGAGQHELGMKFAELIQAADNVMTYKYVVRNVAKKYGKTATFMPKPVFNDNGSGMHVHQSLWKGGQPLFFGEGTYANLSQTARWYIGGILRHAPSFLAFTNPTTNSYKRLVPGFEAPVNLVYSEGNRSAAVRIPLTGPNPKAKRLEFRSGDALANPYLAFTAMMMAGIDGIKNQIDPGDGTDVDLFELPADELAQIATVPASLNGALEALNADKHYLMEGGVFSEDFINNWIDIKYEEVQQLRQRPHPHEFVMYYDA

SEQ ID NO: 65365 - protein, 333 aa, Xanthomonas campestris pv. vesicatoria str. 85-10
MAVSPLPSATVSDASLVASGQRVLQIEREALASVGARIGSEFAAACRLVLASRGRVVATGMGKSGHVARKIAATLASTGTPAFFVHPGEAGHGDLGMITEADIVLALSYSGESDEVRMLLPVLKRQGNPIIAMTGRTGSTLAQAADVHLDVSVSAEACPLHLAPTSSTTASLAMGDALAVALLDARGFTADDFARSHPAGSLGRRLLLHITDVMHAGEDLPRVREDASLSEALMEMSRKRLGMTAVVDADDRLIGLFTDGDLRRALDSDIDVRSAGIAQVMTRNPRTIAADQLAAEAARLMEDYKINGLIVVDAQHRAVGALNIHDLLRAKVV

SEQ ID NO: 65366 - protein, 204 aa, Zea mays
MADYEQEQDMEVEALQAILMDDIKEIDPSESGIATTARCFQILLSPQDDDFDESAYVPVQLALIFAHTEKYPDEPPLLNVKSVRGIKPHDLASLKEKLEQEVIIPHGEAVTVESFLAWRDRFEAELALQRAKLMPDSALTSSKEKKLTGRQYFESGRHAVKGASTVADEDEEEEEDIEFDDDFEDDEEDMLEHYLAQQSENSAA

SEQ ID NO: 65367 - protein, 143 aa, Heliobacillus mobilis
MFPSGWRDFFRTTPFSDNRWNLSKGGELELSDCIFCKIVRKEIPAQIVYEDDVVVAFKDINPAAPTHILIIPREHISSIAAAEASHQAILGQLLLASQKVTAALGIEPDKHRLVINTGADAGQTVFHLHVHLLAGRNLGWPPG

SEQ ID NO: 65368 - protein, 262 aa, Heliobacillus mobilis
MALRRGRCRKRPGLVEVFTLTLFSLRGPAREAGRFILGLETSCDETSAAVLKDGKEILSNVISSQIATHQRFGGVVPEIASRKHMENITGVVDSALEEAGIGWDDLTAIAVTSGPGLVGALLVGVAYAKGAAMARKLPLVGVHHIEGHIYANLLTERELSFPLLCLVVSGGHTHLVRLLEHGRLEIIGSTRDDAGGEAFDKVARALGLGYPGGPLIEKLAKEGTIDAYDWPPGVARRTALNFSSGGLKPAGLNLVNRAKERW

SEQ ID NO: 65369 - protein, 744 aa, Glycine max
ACDLEKKMETQSKELWDLKDDLKKHVTTTELREMLEASGQDSTGSELDLRDRCADGMMFGALDLCPICSGFLRYSGGMYRCHGYISEWSKCSYSTCEPKRIEGKWKIPKETNNQYLKKWFKSQKGKKPVRILPLPSPRKSAESQMIASQHHHSSNSGNLRDLKVAICGLPNDSIAEWKRKIDGIGGVFHAKVNKDTNCLVVVGSLNDEAEMRKARRMKKPIVREDYLIDCIERKKRLPFDMYKVEMIGETSSMVTIKVKGRSAVHEASGLQDSGHILEEGKSIYNTTLNMSDLSTGTNSYYILQIIEEDKGSDCFVFRKWGRVGNDKIGGTKLEEMSKSDAICEFKRLFYEKTGNPWEAWEQKTIQKQPGRFFPLDIDYGVNKQVPKNKKNDADSKLPPPLIELMKMLFNVETYRAAMMEFEINMSEMPLGKLSKSNIQKGFEALTEIQNLLKISNPDPSVKESLLINASNRFFTMIPSIHPHIIRDEDDFKSKVKMLEALQDIEIASRLVGFDANNDDSIDDNYKKLHCDISPLPHDSEEFCLIEKFLQNTHAPTHTDWSLELEEVFSLEREGESDKFAPYRDKLGNRMLLWHGSRLTNFVGILNQGLRIAPPEAPATGYMFGKGVYFADLVSKSAQYCFTDKKNPVGLMLLSEVALGNVYELKKAKYMDKPPEGKHSTKGLGKKMPQESEYVKWRGNVTVPCGKPVPSNVKSSELMYNEYIVYNTAQVKMQFLLKVRFHHKR

SEQ ID NO: 65370 - protein, 330 aa, Yarrowia lipolytica CLIB122
MAAHFDPPEYPCKKSTLPPRPKLTGEQEGKYKQVLQFLQEKTEFPTSEKGAEKNSGPMEPLTDEEKAWLSEECILRYLRATKWNVADAQKRLLSTLGWRREFGVERTRSNTITADRVAVENESGKELIFGFDNDSRPCLALRNGRQNTEASHRQVEHMFFMLERAIDYMPPGQEQLALLIDFKAHTKLGKKVPSMTTGRQVLHILQTHYPERLGKALLTNLPWIAWTFMKIIHPFIDPTTREKLVFTKPFPDYVPKEQLEKEYGGDVDFEYQHAKYWPKMNEIADKKHAAFMAQYHKLGGGIGLSEEKMRQPLDADDQATLVGGMKKLSV

SEQ ID NO: 65371 - protein, 446 aa, Bacillus licheniformis ATCC 14580
MSFLIKPDLHASYPVVQYAKGSWIVDHSGKRYLDGCSGAVTCNLGHGVQEVIEPLKEQLDAVSFVYRSQFTSEPAEQLAELLAEWLPGDLNWSFFVNSGSEAVETAMKIAVQYWQEKGQNDKTIFLSRWNSYHGITNGALSLSGFYERRYRFTHMLHKYPAASAPNCYRCRLSHPECQEACVKEIELAVKRIGKQFIAGFVAEPVIGAAGAAITAPAGYYKKVKEICEDNEILFIADEVMSGIGRTGRMLAIEHWGVTPDIAVLGKGLSAGYSPIAAAVMSDGMMETVKNGSGAIMSGHTYSANPFSARAALAVLRYILKHDLVKQAEIKGEKLKRMLKEVMKQSSIIGDVRGKGLLLGIEFVADQKSKKTFPSSMPVSALVISEAKKRGLLLYPSQAGIDGGGGDAVIIAPPLTISDKEMEELIEIFKHAVYEIEKQAEKVMRER

SEQ ID NO: 65372 - protein, 202 aa, Brassica napus
MSSSEAFPVIQEIMLEFRAGKMSLQGTRVVPDARKGLVRIARGEEGLVHFQWLDRTLNAVEDDQIVFPDEAIFEKVNQSSDRVYILKFNSDDRKLFLWLQEPRAEGDADICSAVNQYLNQPLEFGEGDAVAIPEEVEEMAEDDVSSRAGNLVVPNVSTEVSDVSSSSGPVKLADLQRILNNLSSGPAGITGDEDEGLVLGDI

SEQ ID NO: 65373 - protein, 583 aa, Solanum lycopersicum
MSKQTYKVGFFFRRQFTMAAAEAPADIKSLFKRYSDDSGVMSVQNLHSFLIEIQKEKNVSLENAEAIINNHGGDSKQKGLQLDGFFKFLFSDVNPPLDPKLGIHHDMTAPLSHYYIYTGHNSYLTGNQLSSDCSDVPIIQALQRSVRVIELDIWPNSDKDDIEVLHGRTLTAPVTLIKCLRSIKEHAFCASEYPLVITLEDHLTPDLQEKVAEMITQTFGEMLFSPSESLKELPSPESLRKRVMISTKPPKEYLKSKEVKEKDDTKKEAELFIVSTSSRNPLIDLPHNVFQQDDVDEEEDEDDEEDSKSDKKAASEYKRLIAIHAGKGKGGLSDWLRVDLNKVRRLSLSEPELEKAVDTHAKEIIRFTQHNLLRIYPKGIRVDSSNYDPFVGWMHGAQMVAFNMQQGYGRSLWLMHGMFRANGGCGYVKKPDLLLKAGPDNEVFDPTANLPVKTTLKVTVYMGDGWDKDFDQTDFDTYSPPDFYAKLGIAGVPADEVKKRTETIDDNWIPSWNEQFEFPLTVPELALLRIKVLDYNLSDKDEFAGQTCLPVAELRQGIRAVPLYDRKGEKYSSVKLLMHFEFK

SEQ ID NO: 65374 - protein, 341 aa, Synechococcus sp. CC9311
MTLRVAINGFGRIGRNVLRGWISRGADTGLEIVGMNSTSDPKTSAHLLTYDSILGRLDPSVDIKTTDDSMFINGKEIKFFADRNPLNCPWKEWGVDLVIESTGVFNTDEKASMHIQAGAKKVILTAPGKGAGVGTFVVGVNDDQYRHEDWDILSNASCTTNCLAPIVKVLDQNFGMEWGLMTTIHSYTGDQRILDNNHRDLRRARAAALNMVPTTTGAAKAVALVYPEVKGKLTGFAMRVPTPNVSAVDLTFGTSKGPSVEEVKAAMKSASENGMKGIIKYTDLPLVSTDYAGTNESTIFDADLTYAMGDKAVKILAWYDNEWGYSQRVVDLAEVVAKGWK

SEQ ID NO: 65375 - protein, 225 aa, Solanum lycopersicum
MANRNKLSPSLVVWVLVLFGTLIFILNRLGDSGVSSDGKDIKIEAKTSEDLERVTHKVYFDVEINGKPTGRIVMGLFGKTVPKTAENFRALCTGEKGTGKAGKPLHYKGSSFHRIIPSFMIQGGDFTRGDGRGGESIYGESFPDENFDLKHTEPGILSMANAGPDTNGSQFFITTVTTSWLDKHHVVFGKVLSGMDVVHKIEAEGRQSGTPKSKVRITNSGDLPQ

SEQ ID NO: 65376 - protein, 191 aa, Candida albicans SC5314
MQTIKCVVVGDGAVGKTCLLISYTTSKFPADYVPTVFDNYAVTVMIGDEPFTLGLFDTAGQEDYDRLRPLSYPSTDVFLVCFSVISPASFENVKEKWFPEVHHHCPGVPIIIVGTQTDLRNDDVILQRLHRQKLSPITQEQGEKLAKELRAVKYVECSALTQRGLKTVFDEAIVAALEPPVIKKSKKCTIL

SEQ ID NO: 65377 - protein, 1118 aa, Adiantum capillus-veneris
MSSTRHSYSSGGSGKSKHGRRIAQTSADAKLYAAYEESSESGSFDYSQSVSAGKEGISSQLVTAYLQRMQRGGLVQQFGCLIAVEEETFRVLAYGANAPEMLDVATQAVPTMGQYSRLCIGADVRTLLSPASASALDRVIGVVDVSMFNPITVQSRSSGKPFYAILHRNDVGLVIDLEPIRPDDASITGGALQSHKLAAKAIARLQSLPGGDIGLLCDSVVEEVHELTGFDRVMAYKFHEDEHGEVVAEIRRTDLEPYIGLHYPATDIPQAARFLFMKNRVRMICDCRLPPVKLIQDKTLSQPMSLTGSKLRAPHGCHTQYMANMNSISSLVMAVIVNDSDDDSPGHSSQGIKLWGLVVCHHTSPRYVPFPVRSACEFLMQVFSLQLNMEVGMAAQVREKHILRTQTLLCDMLLRDAPIGIVSQSPNIMDLVTCDGAALYYGKKCWLLGTTPTEAQIVDIAAWLLDCHKDSTGLSTDSLAKTGYPEASCLGDAVCGLAAAKITATDFLFWFRSHTAKEVRWGGARHDPEERDDGRRMHPRSSFKAFLEVVKQQSLPWEDVEMDAIHSLQLILRGSFQDIDDSNTKTMIHARLNDLKLQGLDELSTVASEMVRLIETATAPILAVDGQGLINGWNGKVAELTGLSFETAMGKSLAKELVHEESKTIVERVLHLALEGEEEQDIEIHLRTYDQHKQKGVVILIVNTCCSRDVSNNVVGVCFVGQDVTGQKLVLDRFIRIQGDYKAIVQSLNPLIPPIFGADEYGFCSEWNAAMEKLSNWRREEVLGKMLVGEIFGLQMVCCRLQGQDVVTKLMIVLNDAVNGQESEKFPLVFYDRNGRRVEALLIASKRTDADGRITGVFCFLHTASPELLQALIIKRAKEKVDKELSYVKEELKKPLEGLAFTRTVLEGTNLTIEQRQLIKTNAWCERQLRKILEDDLNNIEEGYMDLEMSEFFMGSVIDAVISQGMAASRGKGVQILTEIPNDVKLMCLFGDQARLQQVLADLLFCAINHATTTNEDEKDWVTIKVSRTKTRLDDGVHLMHFEFRISHSGQGISEALVEEMTNKSQKWTPEGLAISISCTLIRLMNGDVKYTTDAGNKCFLVTIQFPLAHRDDATSVR

SEQ ID NO: 65378 - protein, 406 aa, Pseudomonas fluorescens PfO-1
MSVEHAAVQRADFDQVMVPNYAPAAFIPVRGAGSRVWDQAGRELIDFAGGIAVNVLGHAHPALVGALTEQANKLWHVSNVFTNEPALRLAHKLIDATFAERVFFCNSGAEANEAAFKLARRVAFDRFGTEKYEIIAALNSFHGRTLFTVNVGGQSKYSDGFGPKITGITHVPYNDLAALKAAVSDKTCAVVLEPIQGEGGVLPAELAYLQGARELCDANNALLVFDEVQTGMGRTGNLFAYQHYGVTPDILTSAKSLGGGFPIAAMLTTEALAKHLVVGTHGTTYGGNPLACAVAEAVIDVINTPEVLNGVHAKHDKFKTRLQQIGEKYGLFTQVRGLGLLIGCVLSDAWKGKAKDIFNAAEQEGLMILQAGPDVIRFAPSLVVEDADIDAGLDRFERAAAKLTQA

SEQ ID NO: 65379 - protein, 103 aa, Cryptococcus neoformans var. neoformans JEC21
MASSSDYLGYAYASLLTIGGVMGGIRKGSVISAVAGVGSGIAAAYGANRVSKDPLDVIPSLSVSAVLLTLMSWRLYKTRKFMPAGLVVTLSLLMTVRYALLLA

SEQ ID NO: 65380 - protein, 486 aa, Triticum aestivum
MEKRQATYGKGAARMAPMEVSVEAGNGRESDWLDDDGRPRRSGTVWTASAHIITAVIGSGVLSLAWAIAQLGWVAGPAIMLLFALVIYYTSTLLAECYRSGDPETGKRNYTYMDAVRSYLPGTKVKLCGVIQYANLVGVAIGYTIAASISMRAIGRADCFHYHDVRGRSGKDECKSSSNPYMIVFGVVQILFSQIPDFDQIWWLSIVAAVMSFTYSTIGLGLGIAQTVANGIQGSLTGLSVGPGVTSMQKVWRSLQAFGNIAFAYSYSIILIEIQDTVKAPPPSEAKVMQKATGISVATTTVFYMLCGCMGYAAFGDAAPDNLLTGFGFYEPFWLLDVANAAIVLHLVGAYQVFCQPLFAFVEKWAAARWPDSAFIARELRVGPFAISVFRLTWRTAFVCLTTVVSMLLPFFGDVVGLLGAVAFWPLTVYFPVEMYIVQRGVRRGSTRWVCLQMLSAACLVVSVAAAAGSIADVIGELKEYRPFSG

SEQ ID NO: 65381 - protein, 314 aa, Oryza sativa (indica cultivar-group)
MGSGSLLKVLAKNFDVLAGPLVALAYPLYASVKAIETKSPVDDQQWLTYWVMYSLITLFELTFASIIQWLPFWPSMKLIFICWLVLPYFNGAAFVYQNYVRPMFVKHQMVNIWYVPQKKGLFGKSDDFLTALDKFIEENGPEALKKLTNKAGKSSKQSGKSWKDSKSSKESKDSKSSKESKEPKPSKDSKQLKPPKVSKESKPLKDSKEDKKAVKEDKKAAAKDSKEQKKALKDSKELKKALKDSKEQGLQKDSDELKPKSNKRVTFAEVEPEKELKASNSDWHPTSEYHSVYPEHNSWSSSFMIFEDENSYWN

SEQ ID NO: 65382 - protein, 464 aa, Rhodococcus sp. RHA1
MSIKSVESRRHRVVVIGSGFGGLFGTQALKNADVDITMIARTTHHLFQPLLYQVATGILSVGDIAPATRLVLRKQKNTKVLLGDVDKIDLEAKTITSRFLDRTTVTPYDSLIVAAGAGQSYFGNDHFSEFAPGMKTIDDALELRGRILGAFEQAELSSDPAERARLLTFVVVGAGPTGVELAGQIAELSRRTLSGAFRNIDPREARVILLDGADDVLPVYGGKLSRKARQQLEKLGIEIQLGAMVVDVDVDGLVVKDKDGTQRRIESQCKVWSAGVQASPLGKQIAEQSDAEIDRAGRVLVKPDLSVPGHPEVFVIGDMMALDKLPGLAQVAMQGGKYAAKQIQAGLSGHKPEDRPPFKYFDKGSMATISRFSAVAKVGKLEISGFIGWVAWLAIHLMYLVGFRSRLSTLLSWTVTFLGRGRAQMASTEQWVFARNAMEQLERHEREKEAAEKSSGGAQRKAAG

SEQ ID NO: 65383 - protein, 484 aa, Arabidopsis thaliana
MDDCSKDIINCLPDNLLCQILSNLSTKEAALTSLLSKRWRYLFALVPNLDFDVLPSLHPEVAMQDQDQTSFIDFVDRVLKLRGKDHINKFSLKCGDGIEDEDVFPWILNTLRHGVSDLSLHVSPSLVYWLPSKVFASKTLVRLKIGPKDGPRVKLRNVCLPKLKTLNLDSVVFEEGKIGFAKLLSGCPVLEELSLLNLAWDRWDSCSVSSKILKRLTLYCAHSSRNPKSVSFDTPNVVYFEYSDNIANKYPKVNFDSLVEASIGIRMTKVQKANARYVSDVDEETEMVGNATDLLMGICNVKTLYLSYDTLETLNLCCQVIPVFNNLTHLTIESHPELGWESLPNLLKSCPNLGTLVFQGLLHKATDRCGDVCMCQGLENSHSCLSSSPVKCLKILKFGETNDDDDMEIEMEQIKNFLEKMPNLEQLIIYYESSIDNDLVRVSSQLQEVPTVASLKCKIQVISDNLSLSSTLPISLSMENGFHL

SEQ ID NO: 65384 - protein, 676 aa, Oryza sativa (indica cultivar-group)
MIDIVVVAAVVLVVGHDHPIVAADPDVWFNCGATNYTARSAYESNLERLIAGLAKNASTPSLFGKGAAGAAPDTVYGVALCRGDLPNASACGDCVAGASRVARRACPLAEDVVVADDAGCQLRFSGHDILNRSSNSTTTTTNADDAMVLMNTENITQPMLPGWDPGNADSVAIITNIIKVLVQETARTAAYNSSPPPPATTTYYATGRMDVSATFPTLYSMAQCTPDLRPGGCWRCLQSINDMTTRYFAGRRGGRILGLWCNFRYETYPFYKGQPMRRIGSSGADAIAPAVAANAAASPPGEKHKRRRRRSKVMAMATIFPLLGSFCCVIFCFGLVRRYKKGEVSLQGDMNMQTDEEALAWGREACSSEFTSFKLSQVLDATNNFSEDNKLGKGGFGPVYKGQFSDGSEIAVKRLVASHSGQGFTEFRNEIQLIAKLQHTNLVKLLGCCYQGEEKILIYEYLPNKSLDFFIFDERRRVTLNWNNRLAIIEGIAHGLLYLHKHSRLRVIHRDLKASNILLDCEMNPKISDFGLARIFSSNDTEENTKRIVGTYGYMAPEYASEGLFSIKSDVFSFGVLILEIVSGKRNSGFHQCGDFFTLLGYMMRCINIALLCVQENAADRPTMSDVVVMLSSENMTLPKPNHPAYFHIRVTKEEASTALESPSLNDVTMSNLCGR

SEQ ID NO: 65385 - protein, 529 aa, Thermoplasma volcanium GSS1
MNGDYQLTIDKMLESGVSSNPNQIINYSGKKTFTYKEFRERVYRLAKALISIGVKKGDTVAVIDWDTYVYLEAYFAVPMIGAVLHTVNVRYPQDLIYYTMDHAEDKYVIVRDEFVPILSKNKEAFYFIKGWIIYSEYGNVPDELSPKYIYDELMSKNYDIELPEISENDLATTFYTSGTTGIPKGVQFTHRQIVLHAISSGLALSDRPISLTADDVIMPLVPMFHVHAWGVPYMTIMSGRQYVLPGRYDFDHIIDLIAQENITVIAMVPSILYMIVTNPNVGKIAGRKIRAIIGGGALPEGLQKAAEKLGIMAISGYGLSETAPILTLATYNSDVKKLPLEEQKKYHLKTGIPIPLVQLRVIDDKWNDVPRDEKTIGEIVVRAPWLTSVYVKNKEGTEALWKGGWMHTGDLAVMDKFGYIKIVDREKDAVKSGGEFIPSLILEDAISACPGVVENAVVGKPHEKWGERPVAFYTGTAKPEEIRKCLEDIVRQGRIAKFWIPDDFINVKEFVKTSTGKIDKKVLREMLKK

SEQ ID NO: 65386 - protein, 649 aa, Oryza sativa
MQLLQQRSQAARGHLQVCNVAVPSRPPAFKAPKRSKVEIIKEKSDYLRHPLMEELVNDKSFITEDAVQLMKFHGSYMQDHREKRSFGEGKFYQFMMRTRQPSGLVTNQLYLVMDELADKYGNGTLRLTTRQAYQLHGVLKHDLKTVFSTVIKNMGSTLAACGDGNRNVMGPAAPYKNKPEYMLAQQYANDIADLLAPQSGAYYDVWLDGEKFVSVYKENPKVTADRAFNGFGTNFNNSPEAIYGAQFLPRKFKVAVTVPGDNSVDILTNDIGMVVMCDANGELQGFNLLVGGGIGRTHRNEDTFPRLADALGYVDKDDIFHAIKAIVATQRDYGRRDDRKQARMKYLVDEWGIDKFRSVVEQYLGKKFEAFRPLPAWKFEDYLGWHEQGDGKLFYGVYVQNGRLKGDAKKALRNVIERYELPVTLSANQNIILRDVEPAWKDDIQATLEAAGLVDAVDLTGIERLSMACPALPLCGLAITEAERGLPDVNKRVLSLLKRVGLGDEAITMRMTGCPNGCARPYMAEIGFVGDGPNSYQLWLGGSPNQTRLAKVYQERVKLRDLEAVLEPLLVAFRARRSPGGAFGDFVARVGFVSLRGYADGYVPADKLDKLPTVSIDEDTFKALEAVAAAEGKSIAHVASEKLQKLGGH

SEQ ID NO: 65387 - protein, 440 aa, Candida albicans SC5314 [sequence omitted]

SEQ ID NO: 65388 - protein, 475 aa, Staphylococcus aureus subsp. aureus MRSA252
MRDYTKQYINGEWVESNSNETIEVINPATEEVIGKVAKGNKADVDKAVEAADNVYLEFRHTSVKERQALLDKIVKEYENRKDDIVQAITDELGAPLSLSERVHYQMGLNHFVAARDALDNYEFEERRGDDLVVKEAIGVSGLITPWNFPTNQTSLKLAAAFAAGSPVVLKPSEETPFAAVILAEIFDKVGVPKGVFNLVNGDGAGVGNPLSEHPKVRMMSFTGSGPTGSKIMEKAAKDFKKVSLELGGKSPYIVLDDVDIKEAAKATTGKVVNNTGQVCTAGTRVLVPNKIKDAFLAELKEQFSQVRVGNPREDGTQVGPIISKKQFDQVQNYINKGIEEGAELFYGGPGKPEGLEKGYFARPTIFINVDNQMTIAQEEIFGPVMSVITYNDLDEAIQIANDTKYGLAGYVIGKDKETLHKVARSIEAGTVEINEAGRKPDLPFGGYKQSGLGREWGDYGIEEFLEVKSIAGYFK

SEQ ID NO: 65389 - protein, 576 aa, Xanthomonas campestris pv. vesicatoria str. 85-10
MSLRLRGHGAARGNALGRARVRQSHTLEVAEQRVPANQVETQLQRLHAAIASARVEMQQLRDRLHGALAREVGEFLELHALLLDDPELLQGLDELIRTHRYSADYALRVQRDRLAAVFDGMEDAYLKSRMDDLDHVIGRIHAFLHKRAPDLKGVAGEILVCDNVAPSELAQLQAQGVVGIVTTAGSTLSHSAILARSLHLPLVVGVSDALQRIEDGDVLIVDAGSGQVIVDPKPEHLRDYRERLRALAKEQRELGRLRSKPTRTRDNVDITLLANAESLEDVANAHALGASGLGLYRTEFLFLQRNELPDEDEQFHTYRDTVLGMSGHPVTIRTLDLGADKADRTGLTLSDEDNPALGLRGVRLSLARPAVAQAQLRAILRASGYGPVRILVPMVSGREEILQLRKQLKKLTAQLRAEGHEIAEHIPLGAMIEVPAAALALDCFIDDIDFLSIGTNDLVQYLLAVDRNNEALGELYSPLHPAVLRLIAQVIATGRTYGKPVAVCGEIAGDPRFVPMLLALGLTEFSLHPATLLEVRRAVRDTHLGELRVHGEKLLRARDRKGIEKWLAGHAQGLLR

SEQ ID NO: 65390 - protein, 267 aa, Thermoplasma volcanium GSS1
MMPPDYVFGLIGHPVSHSIGQIVYNRYFQKKGLNAIYLSIDIFPETLKYFMSYASKMDGFNVTIPHKISIMDYLDQIDWEARSIGSVNLVKTEDGLLKGFNTDYYGIEYMFKKGGVDVSGKSIVVAGSGGIARTVIHYLIKNNAKSVTVKARDVKLAKNKLNAYDVDIKEYANNDYDIYINCTPLGTEAVGDPFPEVQFGKGKIAVDVVYNPPVTPFLKRAGISGSKTLSGLDLYIGQAIKTLDILTSGCDIDTLINSVRVAVNEVR

SEQ ID NO: 65391 - protein, 884 aa, Rhodospirillum centenum
MPDRTTDDFGPFTEQIRGTIDGMGTAEFDALPVGAIQVDGSGVIHRYNRTESRLSGRIPERVIGRNFFTEVAPCTNIPAFSGRFMDGVTSGTLDARFDFVFDFQMAPVRVQIRMQNAGVPDRYWIFVRKLEDLRPPGPAPEAPAAHTASVTGEVVDFSVCEQEDIRRVGAIQPWGAVLAVDPRDWTVCAASDNAQALLDCARPPLGRPLGEVLDAGPLAALRDWLPDRTSRSWRGEMARGRRIDIRAHRSGGCVVLDLEPLTARPGEAPVCSLLAAVEADVAVIRQASSLTGLAQACARSVRVLTGFERAIVYRFDADWHGEVIAEDKVEDWPQSFAGLHFPASDIPRQARELYSQSLSRHVPDRDYVPVPVHRIEGTEPLDLSFSRHRSLSPVHLQYLRNMGVTASMSFSILVEGRLWGMVAAHHRQPHHVAIPRRSAAMTVVEAVALSIAAVERAEAMRGRQVDHAVLTALMVQMASSDAVEPALTQQATRLTDLFGATGAALSIDGHLLTVGDWPPPAEVAALRAWLEPRWGSAGLFRTSSLSSVFPDATAYRQKASGCLALRLSGGDFVMWTRPEEPRQITWGGDPAKALGAAGQRPMPRISFDRWVEERRGHAAPWPTWADEIATSLRHAISDMMLRHLRHVKELSDQLAASNEAKSRFLANMSHELRTPLNAIIGFSDLMMSGMAGTLPPRIQDYVQSIHASGEHLLRMVVNDVLDLSRIEAGRMELSPESLDAGILAAECVGMLLPRAVRGEVLLEVQAESPLPLTADALRLRQILLNIIGNAVKFTPPGGRVDVRARALAGGGAVFTVRDTGPGMTPEEVLTAMEPFRQVAQTRAAVEGTGLGLPIAKSLVDLHAGNLAIETAPGLGTTVTIEIGA

SEQ ID NO: 65392 - protein, 265 aa, Glycine max
AQLDPSGSTFLGLDDNRLCRWDMRDRNGMVQNLADSNAPVLNWAQGHQFSRGTNFQCFATTGDGSIVVGSLDGKIRLYSVNTMRQAKTAFPGLGSPVTHVDVTFDGKWIVGTTDSYLILICTLFTDKNGTTKTGFAGRMGNRIAAPRLLKLNPLDSHLAGANNKFRNAQFSWVTENGKQERHIVATVGKFSVIWNFQQVKDGSHECYRNQQGLKSCFCYKIVLRDDSIVESRFMHDKFAVTDSPEAPLVIATPMKVSSFSISSKR

SEQ ID NO: 65393 - protein, 748 aa, Pseudomonas putida GB-1
MTADNTLADAMERCAQEPIHLPSSIQPHGFLLVLDATDLRVLQASENVEHWLGLPAQELIGCPFANLVSDGFDLHAHLARLPEDEIFPFHIGDVRLRQGAPHSEPLHLLAHCHDEVLIAEFEPPRLPPELAGQGDYYPLVRNFVGSLQLATSLEDLLQQTVVQLKRITGFGRVKAYRFDADGNGQVLAEVADPGYPSYLGLCFPAADIPRQARELYRINRIRVIEDANYQSSPLLPAANPRTGKALDMSFAALRSVSPIHLQYMRNMGTLASMSLSIVVDGELWGLVSCHHHQPRPVDLRTRTACELLASVLSLQIESREAHASTRKLLALRQHIVRMISSMADHDSVSDGLRELPQVLLAFAGAQGAAVISAERCDLIGQTPPEAQVTALVHWLGQRGEDSVFQSDNLRRDITDLPELATHAGGVLAVAISQIHSHYLLWFRPEQVRTVNWAGQPTKQVGPQGNLHPRHSFERWQEELRGYCEPWDPLVIEGVMELRTAVLGIVLRKAEELAQLAGELRRSNKELEAFSYSVSHDLRAPLRHIAGYTELLGEIEGQDLSERGKRFLQHIGEAAHFAGSLVDNLLNFSQMGRSALRLSDVDLNALVEAIRSELTPDYEGRAIVWDIAPLPKVIGDPAFINMALHNLIANAIKYTRGRNPARIGISAVQHPGETEVCIRDNGVGFDMAYANKLFGVFQRLHRMEDFEGTGIGLASVRRIIERHDGRVWATGQIEQGASFHFTLPRNTAT

SEQ ID NO: 65394 - protein, 462 aa, Xanthomonas campestris pv. vesicatoria str. 85-10
MPLPTDSVAETAAPAAPALRHALKPRQLMMMGLGTAIGAGLFLGSGVGIHAAGPAVLISYLIAGALVIIVMNALGEMAAAKPASGAFSVYAADAMGPTAGATVGWLWWFQVVVVIAAEAVGAAGLLATVWPALPVPLLALLFMATFTAINLLGVRNFGEFEFWFAILKVLAIVVFLLIGVALLAGWLPGVASPGLSNFTQNGGFAPKGLAGIGSALLVVVFAFGGTEIVAVAAAETADPGRSLARTIRTVAWRILVFYIGSISVIVAVVPWTSAALSSPFAAVLDVARIPGAATAITLVAVVALLSALNANLYGASRMIFSLAQRGEAPRLLARTSGEQVPLVAVIASVLFGFAAAALELLYPNKVLPMLLNIVGATCLLVWTISLVSQLILRARADRAGLALPFRMRGYPFLTVLALVILGVIFVLLASSADTRAQFLSMVALTAVIAAVSEVARRLRARM

SEQ ID NO: 65395 - protein, 281 aa, Geobacillus kaustophilus HTA426
MVTPFDRKGNLDLAKTTELVNYLLDNGTDALVVAGTTGESPTLTTEEKIALFRHVVSVVNGRAPVIAGTGTNDTRASIELTKKAEEAGVDAVMLVAPYYNKPNQEGLYQHFKAIAESTSLPVMLYNVPGRTSVSLAPETVIRLSEVPNIVAVKEAGGNLDAMAEIIERTPDDFLLYSGDDSLTLPVLAIGGNGVVSVASHIIGNEMQEMIRSFLAGDHQKAAALHRKWLPLMKGLFAAPSPVPVKTALQLRGLDVGSVRLPLVPLTEQERKELSRLLDALS

SEQ ID NO: 65396 - protein, 369 aa, Chlamydomonas incerta
QKSAFTGSAVSSKSGVRAKAARAVVDVRAEKKIRVAINGFGRIGRNFLRCWHGRQNTLLDVVAINDSGGVKQASHLLKYDSTLGTFAADVKIVDDSHISVDGKQIKIVSSRDPLQLPWKEMDIDLVIEGTGVFIDKVGAGKHIQAGAHKVLITAPAKDKDIPTFVVGVNDADYKHEYPIISNASCTTNCLAPFVKVLEQKFGIVKGTMTTTHSYTGDQRLLDASHRDLRRARAAALNIVPTTTGAAKAVALVLPSLKGKLNGIALRVPTPTVSVVDLVVQVEKKTFAEEVNAAFREAANGPMKGVLHVEDAPLVSIDFKCTDQSTSIDASLTMVMGDDMVKVVAWYDNEWGYSQRVVDLAEITAKKWVA

SEQ ID NO: 65397 - protein, 414 aa, Ehrlichia ruminantium
  misc_feature (349)..(349): Xaa can be any naturally occurring amino acid
MIKKAAVELDDQKITLPILYDTEGNEVLDITSLYKNTGVLTYDPGFMSTAACESKITFIDGNKGILRYRGYDIADLVYNNKSFIEVVYLLFYGVFPNAEQLQEFILHISQEYVLPQMVRDVITSFPQNSHPMAILIASFSSLAAYYCDQKTDGELECKLAVAKVASIVALIYRHITNQDFIQADVGLSYSKNFIHMMFDISSYKFTEIVDKALDVIFVLHADHEQNASTATVRMTGSSGPNLFACLAAGAATLWGPAHGGANEAVINMLMNIGKPENVKQFIQKVKDSNKSTKLMGFGHRVYKNYDPRARIMCTICKEILKDFGLNDPLLEVAVELENIALQDDYFIAXNLYPNVDFYSGIVLKTIGIPVKMFTTLFALARTSGWSAQWYEMVSSKNYKISRPRQLYTGNPVQK

SEQ ID NO: 65398 - protein, 434 aa, Heliobacillus mobilis
MEGFCVSVIAEVYAREILDSRGNPTVEVEVVLEDGTVGRAAVPSGASTGAYEAVELRDGDKERYLGKGVLNAVDNVNTEIAPEIIGWDVTRQMEIDSALIELDGTPNKGRLGANAILGVSMACAKAAAQYQGLPLFQYLGGVFARELPVPMMNILNGGKHADNNVDIQEFMVMPVGAQSFSEGLRMGVEVFHSLKKVLQSKGLNTAVGDEGGFAPNLKSNEEALKVILEAVQAAGYKAGEDILLAVDAAASEMYKDGKYHLEGEGKVMTSAEMVDFWEDLVNRYPIISIEDGLNEDDWDGWKLLTDRLGKRAQLVGDDLFVTNTEKLSKGIETGVGNSILIKVNQIGTITETLAAIEMARRAGYTAVISHRSGETEDATIADLAVAVNAGQIKTGAPSRTDRVAKYNQLLRIEEELDEQATYRGKKTFFNLERR

SEQ ID NO: 65399 - protein, 309 aa, Arabidopsis thaliana
SLVLTCASPLFSSPRVISATKKLTTELSISTAKFRRRCSGNNDEVLLEGMPPEYYDDEWQARQREKTKELRRMQREEEEEEERKIEEYREIGTRLKEFPEQDLRKARKLVSSFIRAAEEVEERIEEAAEKGELDELVLMIIWNRLDLARRDDEKDAIRSLDLLYRRVETEILKRQASPAMKLLNDLLNMHDGFEDDAWLKDCRKRMAETFPREDPFSILMPPGFDIDMHQGQLRPPIETETDNTLLRVDFVREVDALLQEVRIEEDATTGSKGEGLDPEAIALKFKQQEKQRTIRQIEAILDLALNLKW

SEQ ID NO: 65400 - protein, 168 aa, Ostreococcus tauri
MESVWCHDCRARVDVAADALDDAADVPSCPSCSSVFLERRPSANEREGSSRGVLSVVFGPTMTLLPLGAFGEIDFTQFDTRNFDAPCAAATVEALPERDARDAGLASGATCSVCLSEYEGDERVKTIPRCSHTFHTKCLCEWLKMRDTCPVCRCKIEETKADGGDANE

SEQ ID NO: 65401 - protein, 306 aa, Arabidopsis thaliana
MEPSSGTGPEKRPTVDLVKDRNGTDQILLQNPRGASVKISLHGGQVLSWKTDKGDELLFNSTKANLKPPHPVRGGIPICFPQFGTRGSLEQHGFARNKMWLVENNPPALPSFDSTGKAYVDLVLKSSDEDTMRIWPYSFEFHLRVSLALDGNLTLISRVRNINSKPFSFSIAYHTYFSISDISEVRLEGLETLDYLDNMHDRERFTEQGDALTFESEIDRVYLNSKDVVAIFDHERKRTFLIKKEGLPDVVVWNPWEKKARALTDLGDDEYRHMLCVDGAAIEKPITLKPGEEWTGKLHLSLVLST

SEQ ID NO: 65402 - protein, 629 aa, Oryza sativa (japonica cultivar-group)
MLLKLCLRLLPLLLVLVAASHGASNDTYDTSMCLQETTTCGDVSIRYPFYFSDKTGYINGSSNSYCGYPGLAIDCDDGKPILQLNGAEKYKVNYINVGSITNVSLVDKEVVDDSSGCPRVDHNVTFAQGSWLFFPAGMSLDYLVFFLGCSFPNLFLPPENIDPITCSFIGLIGPSYVLPKDQVPPGNWSQFCKTFEVPVVKYQQMDPKGDAWRKGGYGQVLRQGFLLSVNDSRRPPNCTQCEESKGRVFKLKGENETFLKKYRHRRISKGTPRIESFLQRNGTLHPKRYTYTEVKRMTKSFAEKLGHGGFGAVYRGNLSDGRQVAVKMLKDSKGDGEEFINEVASISRTSHVNVVTLLGFCLHRSKRALIYEYMPNGSLERYAFRNNSKGELSLTWEKLFDVAVGIARGLEYLHRGCSTRIVHFDIKPHNILLDQEFCPKISDFGMAKLCANKESIVSIAGARGTIGYIAPEVYSKQFGAISSKSDVYSYGMMILEMVGARERNIEANSESSSHYFPQWIYEHLDEYCISSSEIDGETTELVRKMVVVALWCIQVVPTNRPTMTRVVEMLEGSTSGLELPPKVLLSCSNFYKMLYKLETATKIPICAAMQNYGYLNFKLDIAVSESELT

SEQ ID NO: 65403 - protein, 329 aa, Bacteroides thetaiotaomicron VPI-5482
MDKIIGLGNALIDVLATLKDDTLLDELELPKGSMQLIDDAKLQQINTKFSQMKTHLATGGSAGNAILGLACLGAGTGFIGKVGNDHYGDFFRKNLQKNNIEDNLLTSEQLPSGVASTFISQDGERTFGTYLGAAASLKAEDLTLEMFKGYAYLFIEGYLVQDHEMILHAIELAKEAGLQICLDMASYNIVENDLEFFSLLINKYVDIVFANEEEAKAFTGEEPEEALRVIAKKCSIAIVKVGANGSYIRKGTEEIKVSAIPVEKVLDTTGAGDYFAAGFLYGLTCGYSLEKCAKIGSILSGNVIQVIGTTISPERWDEIKLNINKVLAE

SEQ ID NO: 65404 - protein, 428 aa, Neisseria meningitidis FAM18
MSAIVDIFAREILDSRGNPTVECDVLLESGVMGRAAVPSGASTGQKEALELRDGDKSRYSGKGVLKAVEHVNNQIAQALIGIDASEQSYIDQIMIELDGTENKGNLGANATLAVSMAVARAAAEDAGLPLYRYLGGAGPMSLPVPMMNVINGGEHANNSLNIQEFMIMPVGAKSFREALRCGAEIFHALKKLCDSKGFPTTVGDEGGFAPNLNSHKEALQLMVEATEAAGYKAGEDVLFALDCASSEFYKDGKYHLEAEGRSYTNAEFAEYLESLVNEFPIISIEDGMDENDWEGWKLLTEKLGGKVQLVGDDLFVTNPKILAEGIEKGVANALLVKVNQIGTLSETLKAVDLAKRNRYASVMSHRSGETEDSTIADLAVATNCMQIKTGSLSRSDRMAKYNQLLRIEEELAEAADYPGKAAFYQLGK

SEQ ID NO: 65405 - protein, 132 aa, Brassica napus
LYMSTKAQIKPPKAIRGGLPICFPQFGNFGALERHGFARNRFWSFDNDPSPLPPANQQSTVDLVLKSTEDDLKIWPHSFELRVRISISPGKLTIIPRVRNTDPKAFSFMFALRNYLYVSDISEVRVEGLETL

SEQ ID NO: 65406 - protein, 561 aa, Bacillus licheniformis ATCC 14580
MQMKSHLSDIEIAQRTELKPITEIARKLNINDEEIECFGCTKAKISLKIFERLKEKPDGQVILVTSINPTPAGEGKSTVTVGLSQALWQIGKKSIVAMREPSLGPTMGLKGGAAGGGYSQVLPMEDINLHFTGDMHAITAANNALAAFIDNHIHQGNELNIDIRKIVWKRALDLNDRALRETVVGLGGKANGFPREDGFDITVASEIMAVLCLARDLADLKKRLASMIVAYTVDGQPVTAGMLGVQGALALLLKDAIKPNLVQTVEGTPALVHGGPFANIAHGANSLIATKTAAKLADYVVTEAGFGADLGAEKFMHIKTRAGGFTPGAVVIVATVRALKMHGGTPLADLKQKDLEALKRGIANLAKHIETIDAFGLPYVVAVNRFVQDTEDELEAVLGWCRDNGHPAALCNVWEEGGKGGTDLAREVIHVMEQKDNRFSYLYELTDSIEDKLAKISRTVYGAEGVEFTEKAKKQLLELKKNGLDGLPVCVAKTQYSLSDDPGKIGRPQDFSITVRELKPSRGAGFIVALTGSILTMPGLPKHPAALKMDVDESGRAKGLF

SEQ ID NO: 65407 - protein, 543 aa, Medicago truncatula
MAVPFLLRSLYSSTRKSFTSSSPLTQSPSRYFPRFFSSSSAAAATSSPAASLDPNRLRNVAVIAHVDHGKTTLMDRLLRQCGADIPHERAMDSISLERERGITISSKVTSISWKDNELNMVDTPGHADFGGEVERVVGMVEGAVLVVDAGEGPLAQTKFVLAKALKYGLRPILLLNKVDRPAVTQEICDEVESVVFDLFANLGATEEQLDFPVLYASAKEGWASTTYTKDPPADAKNMSQLLDAIVSHVPPPNANIDAPFQMLVSMMEKDNYFGRILTGRVHSGVVRVGDKVHGLRNKDSGAEKIEDGKVVKVMKKKGTTMVVTDCAGAGDIISIAGLSSPSIGHTVTTVEIMSALPTVELDPPTISMTFGVNDSPLAGRDGTHLTGGKIGDRLMAESETNLAINVLPGMSETFEVQGRGELQLGILIENMRREGFELSVSPPKVMYKTDKGQKLEPIEEVTIEVNDEHVGFVMEALSHRRAEITDMGPVAGTVGRTRLCLTCPSSFFLTQKLLLASWLVVDGTSYNFVEISGLLFGLRELIE

SEQ ID NO: 65408 - protein, 747 aa, Arabidopsis thaliana
MHSSSKSQAFSLTFLLFLFLLPSVSESQLISSESRTLLEIQKHLQYPPTLRSWSNWTNFCYLPSSPSFKILCFNGHVTELTVTGNRTVKLPGRFSSDSLFTVLTKLSNLKTLSLVSLGISGPLPSQIIRLSSSLQSLNLSSNFISGNIPKEISSLKNLRSLVLANNLFNGSVPDLRGLSNLQELNLGGNKLGPEVVPSLASNLITISLKNNSFGSKIPEQIKKLNKLQSLDLSSNKFTGSIPRFLLSLPSLQNLSLAQNLLSGSLPNSSLCNSKLRILDVSRNLLTGKLPSCFSSKKQTVLLFTFNCLSINGSPSAKYQRPVTFCENEAKQAVAAVKSDTKDKERKEEDTGIELGLVIGIIIGVILVSAVLAGLVLVRMRKSRSKEEPLEANNVDQVTVCSNTTRSTTSKTVPDLRRVPQTMRSAVIGLSPYRVFSLEELEEATNNFDAENLCGEQLYKGCLREGIAVTVRCIKLKQKNSTQNLAQQMEVLSKLRHMHLVSVLGHCIGTYQDHHPYAGSTIFIVQEYISNGSLRDYLTDWRKKEVLKWPQRMSIAIGVARGIQFLHTGVAPGIFGNNLEIENVLLDETLTVKLSGYSIPLPSKLLIFSLTSHEIYNLLGEFQVGAESPSNEDGEKEDVYQFGVILIQIITGKVIAAASSELGSLKLQLENSLRDEPSVLRSLADPCVRGTYAYESLRTTVEFAINCLCEDQRKRPSIEDVVWNLQYTIQVQQGWTSSENLGLGGSEL

SEQ ID NO: 65409 - protein, 204 aa, Medicago truncatula
MHRAFLKYEKFRGPLGNVRKGVLVSVGFGSITLHALMSLEARGTLFVSPGMEAYDGMIVGEHSRDTDLDVNPVRAKQLTNVRSVNKDDTVKLIPPRLMTLEEAIGYVASDELIESPDDYSVEISVLKSFPLKLGSSSFNQCLSNIDHGGTMADIGGGIWALRHAQFRPIWRDFPDYTAATKQPEWLDFLSSPCPTIRHRQHWIQ

SEQ ID NO: 65410 - protein, 211 aa, Brassica napus
  misc_feature (165)..(165): Xaa can be any naturally occurring amino acid
LFLLTALGIHFFQHATGIEAVLLYGPKIFKRAGITAKDKLFLVTIGVGIMNTTFIFIATFLLDKVGRRKLLLTSVGGMVCALTMLGFGLTMAQNSGGKLAWALVLSIVSAYSFVAVFSIGLGPITWVYSSEVFPLKLRAQGASLGVAVNRVMNATVSMSFLSLTXAITTGGAFFMFAGVAAVAWNFFFFLMPETKGKSLEEIEALFQRDGD

SEQ ID NO: 65411 - protein, 448 aa, Oenococcus oeni PSU-1
MSINNRESQNNLVDNYHSALLGIQHLLAMYSGAVLVPLLIGGALKFSAAQMTYLISIDIFMCGLATFLQLFTNRIFGIGLPVILGCAIQAVAPLEMIGQNFSIGTMYGAIIASAVFVFLIAGLFAKIRKFFPPLVTGTVITVIGLTLIPIGFVNLGGGSATAKSFGSGNNLIVGLFTILVVLVCSVYGRGFISRIAVLIGLLLGTILASLMGMVSFKAVVDASWFHFPQPFYFGTPRFEVSSILTMIAISLVSLVESTGVFFALGDITKKPIGEKDLKKGYRAEALAGILGGIFNTFPYTTFSQNVSLVQLSGIKSRQPIYYAAGFLMLLGLLPKIGALATIIPTPVIGGATVIMFGMIAIQGIRILEKMDFSNNKNILVAAISIGAGLGVSVEPNIFQSLPETVRLIFSNGVVIASLCAVLLNLIIQPDRVTNKIKNPAGSVKQQEN

SEQ ID NO: 65412 - protein, 407 aa, Nocardia farcinica IFM 10152
MSPREGTTAMSAPIVIVGAGLAGLRTAEELRRAGYEGDLVLLGDEARLPYDRPPLSKQFVRGETDDTTLRPAEFFTDKRIELRLGTTATGVDTATRRVLLADGSALAYDHLVIATGLRPRTLPGLPTPAGVHVLRDHADATALRDESASATAALVIGAGFIGCEVAASFRARGLDVVLVEPQPTPLASVLGEQVGGLVARMHRAEGVDLRCGTGVRTLLSDDRGRVRGALLSDGAEVRADLVVLGVGSRPAVEWLADSGIALAEQAAGGGVLADEVGRTSVERVWAVGDVAAWRHETGAQQRVEHWTNAGEQAKLVACALLGAEPPTAARVPYFWSDQYDVKIQALGTPSADDDVSVAADDGRKFLAYYSRAGALTAVVGAGMTAQVMKARAKVAAGAPVADLLATT

SEQ ID NO: 65413 - protein, 175 aa, Cryptococcus neoformans var. neoformans JEC21
MGAAESSMFNSLEKNSNFSGPELMRLKKRFMKLDKDGSGSIDKDEFLQIPQIANNPLAHRMIAIFDEDGSGTVDFQEFVGGLSAFSSKGGRDEKLRFAFKVYDMDRDGYISNGELYLVLKQMVGNNLKDQQLQQIVDKTIMEADKDGDGKLSFEEFTQMVASTDIVKQMTLEDLF

SEQ ID NO: 65414 - protein, 448 aa, Streptomyces coelicolor A3(2)
MATDDAMPAKPMPRFPDGFLWGVSTSAHQIEGAAGLRGPSVWDAFTAEPGRVRDGSTAAVACDHYHRYREDVALLAGLGVDAYRFSVSWPRVDSPGGLDFYDRLVDELCAAGVRPVPTLFHWDLPAGLDWLERDTAARFAEYVSLVAERLGDRVGKWITLNEPAEHTLLGHALGVHAPGRELLFDALPVAHHQLLAHGLAVRALRAAGATDVGIANSHGPTWPASDDPADREAADFYDLLLNRMFADPLLTGRYPEGVGALMPGSAERVEADLEVIAEPLDWYGVNYYAPTRVGAPQGAEIEFGGVTLPAELPFSVRRIEGRPVTDFGWPVVPEGLTELLTGFRDRYGDRLPPVVITENGCSYEGLDDHDRIAYLDGHVRALHRAIEAGVDVRGYFVWSLLDNFEWAEGYARRFGLVHVDFTTLARTPKASYGWFRDLLDGQRRVPVG

SEQ ID NO: 65415 - protein, 232 aa, Streptomyces hygroscopicus
MTRGPEFHAAPTIEQRPPVPRHAVIFDLDGVVVDSFEVMGEAFSLAYAEVVGTGEAPFEEYRRHQGRYFPDIMRIMGLPLEMEEPFVRESYRLADRVQVYDGVVDVLRTLNERGLRLAIATGKAGERARSLLDVLGLLPYFAHVIGSDEVPRPKPAPDIIRRALELLEVPAERAIMIGDAPTDLASAHGADVTAVAALWGCQEGAELLAADPDVVLRWPADLLALCPALPGH

SEQ ID NO: 65416 - protein, 463 aa, Rhodococcus sp. RHA1
MSNPQSPPARHRVVVIGSGFGGLFATKALRRAEVDVTVIDRTTHHLFQPLLYQVATGILSEGEIAPSTRMILKDQANAAVRLGDVTTIDLTERTVTSEHLGQITVTGYDSLIVSAGAQQSYFGNDHFAEHAPGMKTIDDALELRGRILGAFEQAEVTTDPRERARLLTFVVVGAGPTGVEMAGQIAELAHRTLVGAYSNFDPRDARIVLLDAASAVLPPFGDNLGSEAAETLEKLGVEVRLGASVTDVDADGLTVRDADGTEHRIESVCKVWSAGVAASPLGRRLAEQSGADIDRAGRVAVDEDLTLPGNPNVFVVGDMMSRDRLPGVAQVAIQGGRYAAKQIAAEVCAAAKGRPVPERNPFRYRDKGAMATICRFRAVAKIGGLELTGFLAWIMWLAVHVVYVVGFRSRLATLLSWAWTFLGTWRGQLTNTHQQITARNATAQLRHLECRIEDTEADVARAS

SEQ ID NO: 65417 - protein, 600 aa, Gluconobacter oxydans
MTDTPLSLIRNFSIIAHIDHGKSTLADRLIQACGALTAREMKNQVLDSMELEQERGITIKAQTVRLTYPAKDGKVYTLNLMDTPGHVDFAYEVSRSLAACEGSLLVVDASQGVEAQTLANVYQALDANHEIVPVLNKIDLPAAEPERVRAQIEDVVGIPADDAVEISAKTGINIEGVLEALVQRLPAPTGDAEAPLQALLVDSWYDAYLGVIILVRIKDGRLKRGDRIRMMQTGATYHVDQVGVFLPKMQSVESLGPGEMGYINAAIKTVADCNVGDTVTLDKRPAEKALPGFKPSIPVVWCGLFPIDADDFEKLRDSLGKLRLNDASFHFEAETSAALGFGFRCGFLGLLHLEIIQERLSREFNLDLIATAPSVVYKMHMTDGTVEELHNPADMPELSKIEMIEEPWIKATIMVQDEYLGPVLTLCSERRGIQVDLTYVGNRAMAVYRLPLNEVVFDFYDRLKSISRGYASFDYQMDGYEESDLVRISILVNHEPVDALSFISHRTVAEQRGRSICAKLKDLIPKQLFKIAIQAAIGSKVIARETIGALSKDVTAKCYGGDISRKRKLLDKQKEGKKRMRQFGKVEIPQSAFLAALKMD

SEQ ID NO: 65418 - protein, 318 aa, Glycine max
MSFDSSNHPISPDLYCSEVTSEVIHLDSDDEALKFNVLWGDSDHDDSDDESILLNLLESEHNQVQEQTKFLGQQLRKKTWLINAREEAINWILKVHAYYSFKPETAYLSVDYFNRFLLSHTFTQDKAWPLQLLSVTCLSLAAKMEESKVPLLLDLQVIESRFLFKPKTVQRMELLVMASLKWRLRTITPFDFVHLFISKLLCSASTWGDLSYIVSLVSDVIIRTCLVMDFLEFSPSTIAAAALLWVTNQCVDDKKSYCLHKNISIEMVKKCYKLMKQKLIIRRSELYWPKISQLLPRSPTCVLDHAAAMQESSDAHKL

SEQ ID NO: 65419 - protein, 321 aa, Bacteroides thetaiotaomicron VPI-5482
MIIAFICIVLIFNTMETISIHRPKIVVIGSCNTDMVVKANRLPVPGETILGGTFYMNPGGKGANQAIAAARLGAEVTFISKIGYDLFGLQALEIYRSEKINTEYIFTDQKSPSGVALISVDSFGENSIIVAPGASRSLSIEDINKAEEKIKEADIILMQLEIPIDTVEYAATIACKYGKKVILNPAPASSLSNSFLMNVHTILPNRIEAEMLSGIKVMNIESAHRAAQAIGEKGIENVVITLGKDGAYVKEKDEYTMIPAKEVETIDTTGAGDVFCGAFSVCLSEGHSLAKSVKFANAAAAIAVTRIGAQSAIPYKREVVL

SEQ ID NO: 65420 - protein, 461 aa, Mycobacterium avium subsp. paratuberculosis K-10
MSPHSGSTAGPERRHQVVIIGSGFGGLNAAKKLKHANVDIKLIARTTHHLFQPLLYQVATGIVSEGDIAPPTRVVLRRQRNVQVLLGDVTHIDLAGKFVVSDLLGHTYETPYDTLIVAAGAGQSYFGNDHFAEFAPGMKSIDDALEVRGRILSAFEQAERSRDPERRAKLLTFTVIGAGPTGVEMAGQIAELATYTLKGSFRHIDPTKARVILLDAAPAVLPPFGDKLGKRAADRLEKMGVEIQLGAMVTDVDRNGITVKDSDGTVRRIESACKVWSAGVSASPLGRDLAEQSTVELDRAGRVKVLPDLSIPGHPNVFVIGDLAAVEGVPGVAQGAIQGAKYVANTIKAELGGADPAEREPFQYFDKGSMATVSRFSAVAKIGPLEFSGLFAWFAWLVLHLVYLVGFKTKVSTLLSWTVTFLSTRRGQLTITEQQAFARTRLEQLAVLAAETKRPAARRAS

SEQ ID NO: 65421 - protein, 311 aa, Bacteroides thetaiotaomicron VPI-5482
MKVVVIGSSNIDMVAQVNHLPAPGETVGDASFMQSLGGKGANQAVAAARLGGSVTFITSLGNDMYAEILKKHFKKEGITTDYIIDDVNQPTGTALIFVADSGENCIAVAPGANYSLLPGSIIHFSKVIDEADIIVMQAEIPYETIKRIALLAKQKGKKVLFNPAPACLIDEELMKAIDILVVNELEAAFISGIEYTGNNLEEIALSLLQAGARNAVITLGSQGVYMKNDKEIIQLPGYKVNAIDTIAAGDTFCGALAVICAQREIDRDALSFANAAAAIAVTRSGAQPSIPTLDEVKHFMLEKELALSFNF

SEQ ID NO: 65422 - protein, 130 aa, Glycine max
MVRISVLNDALRSISNAEKRGFRQVRVHPSSKVIVKFLEVMLRHGYIGEFEVVDDHRGGKIVVNLIGRINKTGVISPRFDIQLSDLEKWINNLLPSRQFGYLILTTSYGIIDHEEARQKKTGGKILGYVY

SEQ ID NO: 65423 - protein, 587 aa, Oryza sativa (indica cultivar-group)
MATPSRTSWADVADADPAPAPAPAANGPARPDRSSYVPPHLRNRGASSGWAAAVAAEDSVGQGGGTREPNPFGNDGDAAAGAGDEPEVFDAHQNTGINFDAYEDIPVETSGREVPPPVGTFAEIDLGQALNDNIRRCKNVRPTPVQRYAIPISLAGRDLMACAQTGSGKTAAFCFPIISGIMRGPPAQRPQRGGMRTACPLALILSPTRELSMQIHEEARKFSYQTGVRVVVAYGGAPINQQLRDLERGVDILVATPGRLVDLLERARVSLQSIRYLALDEADRMLDMGFEPQVRRIVEQMDMPPPGARQTMLFSATFPKEIQRMASDFLENYIFLAVGRVGSSTDLIVQRVEFVQEADKRSHLMDLLHAQRDSATPGKPTLTLVFVETKRGADSLEHWLCMNGFPATSIHGDRNQQEREYALRSFKSGHTPILVATDVAARGLDIPHVAHVVNFDLPNDIDDYVHRIGRTGRAGKSGLATAFFNENNSSMARSLAELMQESNQEVPAWLSRYAARPSYGGGGGRNRRSGGGSRFGGRDFRRDSSSGRGGGDYYGGGSSGGAGGYGGSSAYGGGGYGGGAGAPSAWD

SEQ ID NO: 65424 - protein, 129 aa, Vibrio cholerae O1 biovar eltor str. N16961
MTKVLHTDAAPAAIGPYIQGVDLGNMVLTSGQIPVNPATGEIPADIAAQARQSLDNVKAVVEASGLTVGDIVKMTVFVKDLNDFGTVNQVYGAFFDEHKVAHYPARSCVEVARLPKDVGIEIEAIAVRK

SEQ ID NO: 65425 - protein, 396 aa, Streptomyces coelicolor A3(2)
MTASTVSTDVPGATDVPVMPADERTHRHVPPEGSHRHPQVDPLAALRTPQDPPWDVYLTGTVFLDVIFTGLDSAPVRGTESWARGMGSSPGGIANMATALARLGLRTSLAAAFGDDHYGDYCWDALAQGEGIDLSPSRTVPGWHSPVTVSMAYEGERTMVSHGHEPPPEEPSPDCPPRARAAVASLTPGVRAPWIAQAAARGTRVFADVGWDDTGAWDLAGLPDLAHCEAFLPNAEEAMRYTGATCPRAAAHALTEHVPLAVVTLGADGAYAVDRRTGESAEVPAIEVEALDPTGAGDVFVAGFVTGTLAGWPLADRLAFAGLTAALSVQEFGGSLAAPGWCEIATWWRKVQSVESQDPTALRRYAFLADLVPDAQPGSWPLRRAVPTIGFRRPTP

SEQ ID NO: 65426 - protein, 539 aa, Gibberella zeae PH-1
MDKQIESIKDKLDECGAVTEEHAGMSMALEPYGPSGFRGLFSSPYVAACAAFSAIGGLLFGYDQGVISVTLVMDHFLERFPEVSDDAPGAGFKKGLMTAMITLGAFIGAINQGWIADWISRKRSLMVAVVIFTVGSTLQTAAINYAMLVVGRFIGGIGIGQLSMVVPLYISEISPPEIRGSLLVFEQLSIVIGIVVAFWITYGTKLPFLLQILPGLLLGFGAIFLPYSPRWLASKDREEEALLNLAKLRALPESDPRVQREILDIIAEARFQASALRERHPNLTQRTDLGGKIRLALFSRADCFKPGCWRRTLVGAGLMFFQQFTGINALIYYSPTLFGTMGLGFEMQLIMSGVLNVTQLVGVLTSLWTMDRFGRRSILLVGSLLMFVPHLIIAILVGVFSKDWPSHTAEGWTSVAFLLCYMFTFGASWGPVPWAMPAEVFPSSLRAKGVAISTCSNWINNFIIGLITPPLVRSTGFGAYVFFAVFCLLSFVWVWFSVPETNGKSLEEMDEVFNDRTGTADIAKKDRIMADLYTERQNR

SEQ ID NO: 65427 - protein, 225 aa, Idiomarina baltica OS145
MNILQASEPVVSEKRINYQTATFITSAPNIRKLPEDSGIEIAFAGRSNAGKSSALNTLTRQRNLARTSKTPGRTQLINVFETATGQRLIDLPGYGFAKVPMEVKEQWQRSLSEYLEKRDSLKGLVVLMDIRHPFRETDQELIYWAVDCGIPVLALLTKADKLKQGARKSTLLKARQAAIAFNGDVQVEVFSSLKKFGIDQLENKLDQWFLGESPVDDNFVQSDDS

SEQ ID NO: 65428 - protein, 438 aa, Synechococcus sp. CC9311
MAPVPVTASNLNTSHSEAIFSAAKALMPGGVSSPVRAFKSVGGQPIVFDRVKGPYAWDVDGNKYVDYIGSWGPAICGHAHPEVISALQEAIEKGTSFGAPCALENTLAEMVIEAVPSVEMVRFVNSGTEACMSMLRLIRAFTGRDKIIKFEGCYHGHADMFLVKAGSGVATLGLPDSPGVPRSTTANTLTAPYNDLESVKQLFAENPDAIAGVILEPIVGNAGFIQPEPGFLEGLRELTKENGALLVFDEVMTGFRISYGGAQAHFGVTPDLTTMGKVIGGGLPVGAYGGRKEIMEMVAPAGPMYQAGTLSGNPLAMTAGIKTLELLKQPGSYEKLTATTERLIQGILDAGREAGLPITGGSVGAMFGFFLCEGPVRNFEEAKATDSVRFGLLHRAMLERGVYLAPSAFEAGFTSLAHSDENIDATIQAFRDSFAAIS

SEQ ID NO: 65429 - protein, 559 aa, Arabidopsis thaliana
  misc_feature (225)..(225): Xaa can be any naturally occurring amino acid
MQQFMSVVRFKFGFTSVRMRDWSVGVSIMVLTLIFIIRYEQSDHTHTVDDSSIEGESVHEPAKKPHFMTLEDLDYLFSNKSFFGEEEVSNGMLVWSRMRPFLERPDALPETAQGIEEATLAMKGLVLEINREKGAYSSGMVSKEIRRICPDFVTAFDKDLSGLSHVLLELPCGLIEDSSITLVGIPDEHSSSFQIQLVGSGLSGETCRPIILRYNVNFSKPSIVXNTWTEKLGWGNEERCQYHGSLKNHLVDELPLCNKQTGRIISEKSSNDDATMELSLSNANFPFLKGSPFTAALWFGLEGFHMTINGWHETSFAYREKLEPWLVSAVKVSGGLKILSVIATRLPIPDDHASLIIEEKLKAPSLSETRIELLVGVFSTGNNFKRRMALRRSWMQYEAVRSGKVAVRFLIGLHTNEKVNLEMWRESTAYGDIQFMPFVDYYGLLSLKTVALCILGTKVIPAKYIMKTDDDAFVRIDELLSSLEERPSSALLYGLISFDSSPDREQGSKWFIPKEEWPLDSYPPWAHGPGYIISHDIAKFVVKGHRQRDLGVSFVVSSP

SEQ ID NO: 65430 - protein, 349 aa, Bacillus cereus
MKALLWHNQRDVRVEEVPEPTVKPGAVKIKVKWCGICGTDLHEYLAGPIFIPTEEHPLTHVKAPVILGHEFSGEVVEIGEGVTSHKVGDRVVVEPIYSCGKCEACKHGHYNVCEQLVFHGLGGEGGGFSEYTVVPEDMVHHIPDEMTYEQGALVEPAAVAVHAVRQSKLKEGEAVAVFGCGPIGLLVIQAAKAAGATPVIAVELSKERQELAKLAGADYVLNPATQDVLAEIRNLTNGLGVNVSFEVTGVEVVLRQAIESTSFEGQTVIVSVWEKDATITPNNLVLKEKEVVGILGYRHIFPAVIKLISSGQIQAEKLITKKITVDQVVEEGFEALVKDKTQVKISCFT

SEQ ID NO: 65431 - protein, 273 aa, Idiomarina baltica OS145
MSDKLGVFGNPIKHSLSPRIHCLFAEQTGRSVDYQRLLVSPHGFPKAVARQFSQGLAGANVTVPFKQVAYQLVTQHMGSAAHSGAVNTLISAPHGGLIGANTDGDGLVAALKSKGVSLAGRRILLLGAGGASRGVMPALNAEKPDVIWVWNRTVERAEQLASLFNSARVLRHWSDAHKPDLIINATSASLFGESLSLPEHVIDADTLGYDMVYSRDATVFQSQFKASGGGVCFDGLRMLVEQAAVSFSLWFSCDKPKTEAIYHQLRNELAKLD

SEQ ID NO: 65432 - protein, 619 aa, Arabidopsis thaliana
  misc_feature (417)..(417): Xaa can be any naturally occurring amino acid
  misc_feature (433)..(433): Xaa can be any naturally occurring amino acid
  misc_feature (435)..(435): Xaa can be any naturally occurring amino acid
  misc_feature (437)..(438): Xaa can be any naturally occurring amino acid
  misc_feature (450)..(450): Xaa can be any naturally occurring amino acid
  misc_feature (460)..(460): Xaa can be any naturally occurring amino acid
  misc_feature (465)..(466): Xaa can be any naturally occurring amino acid
  misc_feature (476)..(476): Xaa can be any naturally occurring amino acid
  misc_feature (485)..(485): Xaa can be any naturally occurring amino acid
  misc_feature (490)..(490): Xaa can be any naturally occurring amino acid
MKQFMSVVRFKFGFTSVRMRDWSVGVSIMVLTLIFIIRYEQSDHTHTVDDSSIEGESVHEPAKKPHFMTLEDLDYLFSNKSFFGEEEVSNGMLVWSRMRPFLERPDALPETAQGIEEATLAMKGLVLEISREKRAYSSGMVSKEIRRICPDFVTAFDKDLSGLSHVLLELPCGLIEDSSITLVGIPDEHSSSFQIQLVGSGLSGETCRPIILRYNVNFSKPSIVQNTWTEKLGWGNEERCQYHGSLKNHLVDELPLCNKQTGRIISEKSSNDDATMELSLSNANSPFLKGSPFTAALWFGLEGFHMTINGRHETSFAYREKLEPWLVSAVKVSGGLKILSVLATRLPIPDDHASLIIEEKLKAPSLSGTRIELLVGVFSTGNNFKRRMALRRSWMQYEAVRSGKVAVRFLIGLHTNXKVNLEMWRESTAYGDXQXMXXCDYYGLLSLKTXALCILGTKVXPAKYXXMSGCDAFVRXDELLSSLEXRPSSXLLYGLISFDSSPDREQGSKWFIPKEEWPLDSYPPWAHGPGYIISHDIAKFVVKGHRQRDLGLFKLEDVAMGIWIQQFNQTIKRVKYINDKRFHNSDCKSKYILVHYQTPRLILCLWEKLQKENQSICCE

SEQ ID NO: 65433 - protein, 461 aa, Bacillus subtilis subsp. subtilis str. 168
MSSLFRKKPLETLSAQSKSKSLARTLSAFDLTLLGIGCVIGTGIFVITGTVAATGAGPALIISFILAGLACALAAFCYAEFSSSIPISGSVYSYSYVTLGELLAFLIGWDLMLEYVIALSAVATGWSSYFQSLLAGFNLHIPAALTGAPGSMAGAVFNLPAAVIILLITAIVSRGVKESTRFNNVIVLMKIAIILLFIIVGIGYVKPDNWSPFMPFGMKGVILSAATVFFAYLGFDAVSNASEEVKNPQKNMPVGIISALAVCTVLYIAVSLVLTGMMPYAKLNVGDPVSFALKFVGQDAVAGIISVGAIIGITTVMLALLYAQVRLTFAMSRDGLLPGLFAKVHPSFKTPFRNTWLTGIVAAGIAGFINLGTLAHLVNMGTLAAFTVISIAVIVLRKKHPEIKASFRVPFVPVVPIISAGICLWFMYSLPGVTWLSFVIWIAVGTLVYFLYSRKHSLLNK

SEQ ID NO: 65434 - protein, 375 aa, Pseudomonas putida GB-1
MAEAKVLSGAGLRGQVAGQTALSTVGQAGAGLTYRGYDVRDLAAGAEFEEVAYLLLYGELPTQAELADYKRKLKGLRDLPQALKEVLERIPRDAHPMDVMRTGCSVLGTLEPELTFEAQRDKTDRLLALFPAVMCYWYRFTHHGVRIDCTSEEDTLGGHFLHLLHGKKPSELHVKVMNVSLILYAEHEFNASTFTARVCASTLSDLYSCITAAIGSLRGPLHGGANEAAMELIERFQSPQEATAELLRMLERKDKIMGFGHAIYKESDPRNEVIKGWSKQLADEVGDKVLYPVSEAIDKTMWEQKRLFPNADFYHASAYHFMGIPTKLFTPIFVCSRLTGWAAHVFEQRANNRIIRPSAEYVGVEQRQFVPIEQR

SEQ ID NO: 65435 - protein, 340 aa, Helicobacter pylori J99
MPNLENLDWKNLGFSYIKTDFRFIATYKNGSWSQGELVSENALQLSEGSPVLHYGQACFEGLKAYRSQKGKALLFRPLENAKRLQTSCERLLMPKVSEELFLKACAEVIKANQKWLAPYKSGASLYLRPFVIGVGDNLGVKPASEYLFIVFCAPVGAYFKGGIEKGGARFITTAFDRAAPKGTGGVKVGGNYAASLLAHKIATEQGYDDCIYLDPTTHTKIEEVGAANFFGITHDDAFITPHSPSILPSVTRKSLMVLAKEHLKLKVEEREILIDELGAFKEAGACGTAAIITPIKEIAHNNKSYSFEAPGNITKQLYDLLLSIQQGEQEAPKDWIFEVG

SEQ ID NO: 65436 - protein, 277 aa, Chlamydomonas incerta
MRRQAVTCLRGLWRAGTASQEVANQAGASSFALQGLLAQQERGLRTSVDAKDAKIAPLSAMPWSLQAARSATAEALAPAKVNNFTLNFGPQHPAAHGVLRLVLEMQGEIIMRADPHIGLLHRGTEKLLEYKTYLQGLPYFDRLDYVSMMCMEHSYVLAIEQLLNLSVPLRGQYIRVLFSEITRVLNHLLAITCHSMDVGALTPFLWAFEEREKLFEFYERVSGARMHAGYFRVGGVSQDLPIGLLRDVYDWARQFGLRLDEMEELLTGNRIWKERTV

SEQ ID NO: 65437 - protein, 273 aa, Streptococcus pyogenes M49 591
MSERLSGHTLLVSLLATPIRHSLSPKMHNEAYAKLGLDYAYLAFEVGTEQLADAVQGIRALGIRGSNVSMPNKEAILPLLDDLSPAAELVGAVNTVVNKDGKGHLVGHITDGIGALRALADEGVSVKNKIITLAGVGGAGKAIAVQLAFDGAKEVRLFNRQATRLSSVQKLVTKLNQLTRTKVTLQDLEDQTAFKEAIRESHLFIDATSVGMKPLENLSLITDPELIRPDLVVFDIVYSPAETKLLAFARQHGAQKVINGLGMVLYQGAEALN

SEQ ID NO: 65438 - protein, 415 aa, Ehrlichia ruminantium
  misc_feature (6)..(6): Xaa can be any naturally occurring amino acid
  misc_feature (321)..(321): Xaa can be any naturally occurring amino acid
MIKKAXVELDDQKITLPILYDTEGNEVLDITSLYKNTGVLTYDPGFMSTAACESKITFIDGNKGILRYRGYDIADLVYNNKSFIEVVYLLFYGVFPNAEQLQEFILHISQEYVLPQMVRDVITSFPQNSHPMAILIASFSSLAAYYCDQKTDGELECKLAVAKVASIVALIYRYITNQDFIQADVGLSYSKNFIHMMFDISSYKFTEIVDKALDVIFVLHADHEQNASTATVRMTGSSGPNLFACLAAGAATLWGPAHGGANEAVINMLMNIGKPENVKQFIQKVKDSNKSTKLMGFGHRVYKNYDPRARIMCTICKEILXDFGLNDPLLEVAVELENIALQDDYFIARNLYPNVDFYSGIVLKTIGIPVKMFTTLFALARTSGWSAQWYEMVSSKNYKISRPRQLYTGNPVQKV

SEQ ID NO: 65439 - protein, 340 aa, Bacillus cereus ATCC 14579
MTKIFILASTLSLSFFSGLNIGNTTTENFQPLTNAIVQNSDHFAEGNSKDNNIPPGNNGSQDDTGSGDNGSGGNGSGGNGSGGSGSGGNGSGGNGSGDNGSGGNGSGDNGSGGNGSGDNGSGGNGSGDNGSGGNGSGDNGSGGNGSGDNGSGGNGSGGSGSDGSGSGGNGSGGNGSGGNGSGDNGSGGNGSGGNGSGGNGSGGNDSGGNGSSGNGSGGNGSGGNGSGGNGSGGNGSGGNGSGGNGSGGNGSGGNGSQGGNRVKGDSSSQGGNGSQGGNRVKGDSNSQEGTGSQGGNVKDNTKKQGDKLPNTATHYPISILMGLSTFLIGMLLFIRRKNVK

SEQ ID NO: 65440 - protein, 309 aa, Bacteroides thetaiotaomicron VPI-5482
MNNKMNIPLSGIIPPLVTPLLDDDVLDVEGLQRLIEHLIAGGVHALFVLGTTGESQSLSYKLRMEMIKNTCRIAKGRLPVLVCISDTSIVESVNLACLAADHGADAVVSAPPYYFATGQPELIEFYEHLLPQLPLPLFLYNMPTHTKVNFAPATIQRIAENPGVIGFKDSSANTVYFQSVMYAMKDNPDFSMLVGPEEIMAESVLLGAHGGVNGGANMFPELYVSLYNAAKNADMEEVRRLQEKVMQISATIYTVGQHGSSYLKGLKCALSLLGICSDYVAAPFHKFEQRERGKIWKALQNLGVDVVLR

SEQ ID NO: 65441 - protein, 381 aa, Gibberella zeae PH-1
MASNFTSIPVLDYPSSLSPSTKPAFLAELRDALVKVGFFQVRDPPIPLKLQQDALRLSAQFFDLPTEKKLDIENVHSKRFLGYSRINSESTASGTDYLESILLGPNLPELGPEEPVYLHLQGPSQWPDEVSVPGFRDVLESYHSQIQDFSIEFARLIAEALEMPLDTLTKLLGQPLFSRLKPTRYLPPSMNPAAEDGSHGIGPHKDIAFMTYLLQGGTHNCLEVQNKLGHWVPVPPVPGALVVNIGRLLEVITGGVCVATTHRVILKRQGFVDGDGKSLGPRISLPFFQFVNPRLTVDDVLVDVPHHIKDLVPDQVATTEAETFFSGLFNNCIGDNIFVNHLTTYPRVGKRWYPDLMQLASEKQAESKRLDEQRRATEGHI

SEQ ID NO: 65442 - protein, 203 aa, Listeria monocytogenes str. 4b F2365
MYKAIIFDVDGTILDTERAVLHSLQAVLAEEGLSYELDELRFVLGITGAAAVEQLNILDPEKVLDKWIEREATFIEEVEVFEGIHKVLHAIPESGVVTSKNALEMEKGFYPFNIQDHFQAIVCASDTENHKPHPDPLLKGLEILGREPHEVLYVGDSSYDMKCAHAAGAHFGLALWGAKTTDGFEKAELVFEKPEDILAYVSK

SEQ ID NO: 65443 - protein, 427 aa, Robiginitalea biformata HTCC2501
MRYKRSSELFRQASRVLPGGVNSPVRAFKSVGGTPVFVREAAGSRFTDEDGNEYIDFIASWGPLLFGHAFPPVVEAVTRRAQKGTSFGMPTALETEVAELAVSMVPGIEKIRFVNSGTEACMSVIRLARGYTGREKIIKFAGCYHGHADAFLIEAGSGAVTFGSPNSPGVTQGTARDTLLARYNDLESVKGLFEANPGEVAAVILEPVAGNMGCIPPEPGFLEGIRQLCTDSGALLIFDEVMTGFRLAAGGAQEALGISADLVAFGKVIGGGLPVGAFGGPAEIMSHLAPEGPVYQAGTLSGNPLAMGAGLAMLRAIEADPEVFSRLESKTAYLHEGLEHVLQEAGHPYRINRFGSMISVHFSDREVRDFESAATGNNDRFRNYFHGMLNRGVYLPPSAFESYFLNDALTAEDLDLAIDAAAGALKD

SEQ ID NO: 65444 - protein, 451 aa, Ostreococcus tauri
MLSASSVLPCSPRKLANSCTGSGDSGSLALARSMSASTCLLVSSSASSAVPRICSASAQHADACCPCASASPSSNNCPRYINFSYPAVGESIAARFSAATASSCPPNSASANPSASAIAASLGFLLEAFRSVARPSSARPESNAAFASSITPSLATATGFVPDDPCDAFARFFTPGFFALTLCRPPIARSSSNAPSCARRLNYALARVARALKPVDVPARCPSDPFAALERALEREGGARRREARQCGGGARVFRTHRRARLWNFHRPVRAPLEFSSTDRWARLWNWHPPTRDDARRRARVVDAPSDAAPGGWREDDRRGRRRARPGAAGARAGKTIEIVDDVLGSGVEPVRGIDVVRVNYETRIAGGGRVDAGKFFVFGVGAGEVVRGFDALVAGDESTPAMRAGGKRRAVVPASMAYGQRGAGCDKDGNNCRIPPGSDLEFYVELLEVK

SEQ ID NO: 65445 - protein, 326 aa, Vibrio cholerae O1 biovar eltor str. N16961
MRMPHSFDYQTVAKQVLATEIHALQQLEQYINDDFARACAMILANQTGKVVVMGMGKSGHIGKKIAATLASTGTSAFFVHPGEASHGDLGMIERGDIVLAISNSGESSEILALLPVLKRLSIRVISMTGNPNSNMAKLADIHLQITVPREACPLELAPTSSTTATLVMGDALAVALMQARGFTAEDFALSHPGGALGRKLLLKLNDIMHSGDALPKVAPQALIRDALLEISQKGLGMTAIVDEQDTLLGIFTDGDLRRILDKRIDIHSTVIADVMTRQPTVAQPNLLAVEGLNLMQAKRINGLMLVENNKLVGALNMHDLLKAGVM

SEQ ID NO: 65446 - protein, 301 aa, Brassica napus
MMSVYGKAKQSTMKRNCRKKQRNYCPQQACKLSVLPDEIVMNCLAFVPRLDHGSLYLVSKLHRSLMLSPELYQARSLMGCTEHCIYLCLSIPSDPFARWFAFYPKAAAVNHPSPLVPIRPHLYQPPEASSVVAHGWGIYVIGGMIGRKRSSRVFFLDCRSHTWTNLPSMGFARASAAAGVVDGKIYVFGGCKKPNWVVEVFDPKTQTWDALSNQPPPPDDLNSLMHEIALIEEEKTEKIFGLNDKGDGLLYIPSQGIWKTGNSDTNQLRKGWHVIDNVIYSCVTGGGYCGVRQVIWSPWVG

SEQ ID NO: 65447 - protein, 206 aa, Malus x domestica
HGSDVAVKILMEQDFHAERFKEFLSEVTIMKRLRHPNIVLFMGAVTKPPNLSIVTEYLSRGSLYRLLHKAGAREALDERRRLSMAYDVAKGMNYLHRRKPPIVHRDLKSPNLLVDKKYTVKVCDFGLSRLKANTFLSSKSAAGTPEWMAPEVLRDEPSNEKSDIYSFGVILWELATMQQPWGNLNPAQVVAAVGFKNKRLEIPRDL

SEQ ID NO: 65448 - protein, 382 aa, Geobacillus kaustophilus HTA426
MAKRDYYEILGVSKNATKDEIKKAYRKLSKQYHPDVNKAPDAAEKFKEIKEAYEVLSDDEKRARYDRFGHADPNETFGGGGFQGGGFDFGGFSGFGGFEDIFETFFGAGPRRRASGPRKGADVEYMMTLTFEEAAFGKETEIEIPREETCDTCQGSGAKPGTSPTSCPHCHGSGQVTSEQATPFGRIVNRRTCPVCGGTGRYIPEKCPTCGGTGRVKRRKKIHVKIPAGVDDGQQLRVAGQGEPGVNGGPPGDLYIIFRVEPHEFFKRDGDDIYCEVPLSFAQAALGDEIEVPTLHGHVKLKIPAGTQTGTRFRLKGKGVPNVRGYGQGDQHVIVRVVTPTKLTEKQKQLLREFERLGGDTMHDGPHGRFFEKVKKAFKGEA

SEQ ID NO: 65449 - protein, 145 aa, Glycine max
  misc_feature (59)..(59): Xaa can be any naturally occurring amino acid
  misc_feature (67)..(67): Xaa can be any naturally occurring amino acid
  misc_feature (103)..(103): Xaa can be any naturally occurring amino acid
  misc_feature (123)..(123): Xaa can be any naturally occurring amino acid
ITLTHDDLKRLVDDMAVYSFKTGVVLGLGAGSNADLVVDNVGDLLALRPLCDIFGVATXKRTEEQAXSFRLHLSVLDYNPRLHLASHGCDNVQPDLKLYTRRXRALLREKIVEATYDKFVVIXGDTKLVDGLCGSGLAMPADGVQ

SEQ ID NO: 65450 - protein, 336 aa, Oryza sativa (japonica cultivar-group)
MARKFRREIERERRTLAAAWEESRARVSRSRVVEGCSRVSLKKKKKKSFYVFAIDGAWAVLGLMCSSYGPRYTGLRIPHCHGPFAVRMAHLSLGGGDVNGPSQKGKLRLSECVGNGRDGGIGKCADDAVPGWSLASLKPSYYHHVFSKAEFHVVILGVHKAGKTTLLEKVKSIYLKEEGLPHDRIVPTVGLNIGRIEDANVKLVFWDLGGQPGLRTIWEKYYEEAHAVIYVIDSAAASSFEDAKSALEKVLHHEDLQGVPLLIFANKQELPAAVTEEELARHLHLKGLDERPYMFQAGSAYDGTGIKAGIDWLVEEMERSKRTEVLMARTETAEKI

SEQ ID NO: 65451 - protein, 152 aa, Synechococcus sp. CC9311
MAVDPIETSVDEATEATSGTTAVAEKPTAKDSKKLGASALIKEFEDAQLKSDLPEIYVGDTVRVGVRISEGNKERVQPYEGVVIAKRHGSLNQTITVRRIFQGIGVERVFMLHSPQVASVKIERRGKVRRAKLFYLRDRVGKATRVKQRFDR

SEQ ID NO: 65452 - protein, 480 aa, Thermoplasma volcanium GSS1
MEYHEVIEKLDFSKVTRFYWLLTLLATIGGFLFGYDTSNIGTALVFIPYPVQGFIEGYLVAGASLGAAVGALIAAGLTDRYGRKYLLIADAAIYAAGAILSAFTIDLAMLLLSRTLIGLAVGADSGIATAYISEYAPKDRRGSLGILQQWMITIGILGAYIVGMATLYAAPGLASVLDWRIMLGVAAIPALIGLGFRFMMPESPRWLMINGKYKEASEAFKKLGLNLSVDELKEVKFRQRAKITNGVKRAFLVVALFFVFQQITGINIPFYYGPIVIEKLHLFGSATQSLVFTQIYAVAAATILAVINVAATYIGFRYIDTVGRRKLALLGYSGMTFFGLLGGLLLYLKFDVGLLIAFAGFIIFFAFGVGGTGWMIQGEYFPTNMRGLYASLGAFVDWIANFAIIEIFPVLEALITIKNVMFVFGILSLIAVLIFYYIMPETKELSVEQISDLFENNGLSSLRKASMSYNKSSSGSSGKK

SEQ ID NO: 65453 - protein, 425 aa, Marinobacter sp. ELB17
MTNKELQALKERYVAAGAASPNEQFADHATNAELWDADGKRMIDFAGGIGVLNIGHRHPKVVEAIRAQLDKLMHTCQTVMPYEGYVRLAQKLSDVVPVRGHAKVMLANSGAEALENAVKIARAATGRTNVICFDGGYHGRTFMTMAMNGKAAPYQTDFGPMPGMVYRAPYPVPYHGVSEDEALRGLAMTMKADSPARNTAAIVIEPVLGEGGFYPAPTSFMKALRTICDDNGIVLIVDEVQSGFGRTGKMFAIEHTGVEPDMMTMAKSMADGMPISAIVGTDKIMDSCGPNSLGGTYAGSPTACAAALAVFEVFETEDILGKSQRLGEKLNQRFSQWQEQFAHVDNVRTLGAMAAFELVENKDTRKPMPELVAAITKLAKAKGLILLGCGLYGNTLRFLMPVTIEDEVLNEGLAILEQCLKEAGA

SEQ ID NO: 65454 - protein, 339 aa, Bacillus subtilis subsp. subtilis str. 168
MTASQQQIQLARRPQGIPVHEDFRFETIPVPEPKQGEVLVKTLYVSVDPYMRGRMQDTKSYVEPFALDKALSGGVIAEVVSDGNHLKKGDIVIGNLSWQEFSAVSESALRKIDTSLAPASAYLGILGMTGLTAYFGLLDIGRPKEGETVVVSGAAGAVGSTVGQIAKIKGARVVGIAGSDEKIDYLKQELQFDEAINYKTADDIQKALQNACPDGVDVYFDNVGGPISDAVMNLLNEFARIPVCGAISSYNAESEADDMGPRVQSKLIKTKSLMQGFIVSDYSDRFSEGAKQLAEWLKAGKLHYEETITEGFENIPDAFLGLFKGENKGKQLIKVSDPS

SEQ ID NO: 65455 - protein, 334 aa, Schizosaccharomyces pombe
SSTITCDGKSLNTLPTPKQEDVEFGVPLQPEDTQDLQRKLKPRHMQMIAIGGCVGTGLFVGSGNALADGGPASILIAFAVIGTYVLFTTSALAELSAIYPVSGSFYTYFSKFIDPAWGFAVGIQYWLSFAVTVPLELTVAPLIINFWNASGPVSIWISVFYVIIIAINIWGTEGYGEVEFFLSIMKVISVIGFVILSIIIAAGGVPTDDRGVIGVSYWKQPLVFNNGFKGLCAVSVIAIFSLSGTELVGLAASEAKNPQKTVPAAVKQIFWRIFLFYIVALFMLTLVVPSDLPGLRTSDNSNVLISPFVIAIQLANIRALPSIMNVVILLSTLS

SEQ ID NO: 65456 - protein, 411 aa, Neisseria meningitidis FAM18
MNRLKEDGMNQLKLAVSGAQILFVAFGAMVLVPLLTGLNPALALLGAGLGTLLFQITTKRKVPIFLGSSFAFIAPIIYSVGEWGLPSTMFGLFAAGFMYFVFAALIRWRGLAAVHKLLPPVVIGPVIMVIGLSVAVAASSMAMGQADGKQVIDYTDSLILSGFTFAVTAIVSVFGSRMMKLIPILIGVASGYVLALLMGLVDTASIAHAPWFAVPHFETPQVNWQAALFMLPVAVAPAIEHIGGIMAIGNVTGKDYTKDPGLDKTLAGDGLGVCVAGLIGGPPVTTYGEVTGAVMITKNSNPVIMTWAAVFAVCMAFFGKFNAFLASIPMPVMGGIMLLLFGTIASLGVKTLIDAKVDLMLPKNLVIVSSVLTTGIGGMTLKLGSFSFAGVGLCAVLAIMLNSLLPDPKES

SEQ ID NO: 65457 - protein, 1590 aa, Magnaporthe grisea 70-15
MSTANGSSPTRISILGEESIIVDYGLWLNYVTHDLLNNIPSSTYVLITDTNLHSLYVPQFETAFTSASAAATSNSSATPPPPRAPRLLTYAIPPGEGSKSRDTKAEIEDWLLEQQCTRDTVIIALGGGVIGDMIGYVAATFMRGVRFVQVPTTLLAMVDSSIGGKTAIDTPMGKNLVGAFWQPRRIYIDLAFLNTLPAREFINGMAEVIKTAAIWDAEEFSALEQNAPAILSAVRTPASAAADPNARLLPISDILKRIVLGSARVKAHIVSADEKEGGLRNLLNFGHSIGHAFEAILTPQVLHGEAVAVGMVKEAELARHLGILRPAAVARLVKCIASYDLPISLEDKRLVRMTGGKSCPVDIVLAKMAVDKKNEGKQKKIVLLSAIGKTHEPKASSVDDRAIRVVLSAAVRVQPGVRPGLKVDVTPPGSKSISNRALILAALGKGPCRIKNLLHSDDTEHMLNAIGKLRGASFSWEDDGEILVVEGRGGQLFAPSEGELYLGNAGTASRFLTTVAALCSPSSDGDATSTVLTGNARMKLRPIGALVDALRSNGINIEYMGKESSLPIRVDAAGGFGGGVIELAATVSSQYVSSLLMAAPYAKEPVTLRLVGGKPISQPYIDMTIAMMRSFGIDVQRSTTEADTYHIPQGIYTNPAEYTVESDASSATYPLAVAAITGTTCTIPNIGSASLQGDARFAVEVLRPMGCTVEQSASSTTVTGPPLGQLKGIPHVDMEPMTDAFLTASVLAAVASGTTQITGIANQRVKECNRIKAMKDQLAKFGVHCNELDDGIEVTGNSWTELTEPREIYCYDDHRVAMSFSVLSVISPHPVLILERECTGKTWPGWWDVLSGVFGVAMDGEEPLSHSTVTGSGPNNRSVFVIGMRGAGKSTAGKWMASTLGRTFMDLDTELERRHNTTIPDMVKSEVGWEGFRKFEVELLREMMETKPEGYIFSCGGGIVETPEAREALISYCRAGGAVLLVHRDTTHVLEYLNRDKSRPAWSEEIEKVYIRRKPWYQECSNFEYHSPHLGVEESAVEMPVDFARFVSLICGKSSHLREVKAKPHSFFVSLTVPNITAHTATIPKAVVGSDAVELRVDLLQDHSPEFVVRQVALLRSLCKMPIIFTVRTVSQGGRFPDADHAGALALYRVALRMGVEYVDVEMTMPEDVIETVTKAKGYTSIIASHHDPKGTLSWRNGAWMQYYNKALHYGDVIKLVGWCRTDEDNFSLLTFKTRMLAAHESTPIIALNMGEQGKLSRVLNGFMTPVTHAALPAAAAPGQLTAAEIRQALSLLSKIPKRKFYLFGKPISKSRSPILHNTLFQQTGLPHTYSRLETDKVAEVETTIRASDFGGASVTIPLKLDIMPMLDEITDAAKTIGAVNTIIPVPVQAGKQRLRGDNTDWCGMVHSLRMAGVTGKRACPASGVVVGSGGTTRAAIFALHSLGFSPIYIIARNATSVETIASSFPAEYDIRNLQGTLAYTEGMARPEVVISTIPATGDVDEGILMAVDSVLTLPMGTSNTGAARVLLEMAYTPTFTNMMARAKDAGWGTVPGFEVLAAQGWFQFQLWTDIKPVYSTASSIVMNGTSDSS

SEQ ID NO: 65458 - protein, 291 aa, Chlamydomonas incerta
MALRAAQSAKAGVRAARPNRATAVVCKAQKVGQAAAAAALATAMVAGSANALTFDEIQGLTYLQVKGSGIANTCPVLESGTTNLKELKAGSYKLENFCIEPTSFTVKEESQFKGGDSEFVKTKLMTRLTYTLDAMSGSFKVGSDGSAELKEDDGIDYAATTVQLPGGERVAFLFTIKQFDGKGTLDNIKGDFLVPSYRGSSFLDPKGRGGSTGYDNAVALPARADAEELLKENVKNTKALKGSAVFSVAKVDPVTGEIAGVFESIQPSDTDLGAKAPKDIKVTGLWYAQLK

SEQ ID NO: 65459 - protein, 343 aa, Gibberella zeae PH-1
MVKILPPTASIDWDQISIATNLGLGHVESTYHMSTGRWSDPVFVNDPYLRVHGLAPGLQYASVELAVTSNSSYVPPHTSRAMLYIRPFAFGSSEMIGLVPPSEYKFCVYVKPVPAYHGLSAQDALILTGFDRAAPHGLGHAKVGGNYAPVIKWSEQAKADGFGMTLHLDSKTRTEIDEFSTSGFLGIKVSDEGAVKVVAPSSPCIIDSTTSDCCLQLARHYGWNVEKRPIKYTELPEFSEVVAVGTAASVVSIRSITLEDSRETVRYLDATTNQGRYARKLSTSLDDIMHCRVEDVFGWCHQVGEAPVEDVPTRKMGSSNKKPAFVDIMTLSCAGQGARFSCH

SEQ ID NO: 65460 - protein, 461 aa, Clostridium difficile 630
MKIVVVGGGPGGYVAAIKASMLGADVTVVEKRRVGGTCLNAGCIPTKALLASSGVLNTVKEAKDFGIEIDGTVKPNFTAIMERKNKVVNQLISGIEFLFEKRGVNLVNGFGKLIDKNTIEVTKDDGTVETIKADKIILANGSVPVVPRMFPYDGKVVITSDEVLGLEEIPESMLIVGGGVIGCEIGQFFRALGTEVTIVEMVDQILLNEDKDVAKQLLRQFKKDKIKVITGIGVQTCEVVDGKAVATLSNGKVIEAQYALVCVGRRPNLDNSGVEDIGIEMERGKVVVNEHLETNVEGIYAIGDIIDTPFLAHVASKEGIVAVENALGKTKVVDYRAIPRCVYTEPEVAGVGKTEKQLEAEGVEYNVGQFDFRGLGKAQAIGHFQGFVKVIADKETDKIIGAAVVGPHATDLLTELSLAVHLGLTVEQVGDAIHPHPSLSEGLMEALHDVHGECVHSVPKL

SEQ ID NO: 65461 - protein, 318 aa, Gibberella zeae PH-1
MASTAVSSDTSTKKFNLDAVAARGTEITGLSIYKDTNEDISPERAQELMSEMNADVPQGGRDIVFGQKETQRLRFWEPTSNSRKAPVVVFVHGGSWTIGTYLDSVGSLKVKYLNDLGYAFASIDYALIPSVTVKEQVQEVADAVAYIMSNSQALDIDPNSVVLMGHSSGAHVVSLIGTDPSYAQKAGFHISHLQGVIALDGSNYNAAASIADNTGSIVTNMLHGLGSDPETLDAMSPTLNVEGPNARGFLLLHVQRKGDIRQAVEFSAALKARGTRVNLHVFEGEGFEGHVALVLRIGDEEYPATVVMKKWLEKYVPV

SEQ ID NO: 65462 - protein, 1558 aa, Cryptococcus neoformans var. neoformans JEC21
MAFSGVGQGIGTYDRTEQTSGASLGRVTSRAHFTDVHPNDNLPAQTGEHCARDVGHLARQLTRQSVAAADDSAAIFSYQEGSDLDPFSEKFNAKKWTKLMFEASQSSGPGRKAGLSFRNLDVHGFGSDADYQKTVGNLPLVGIGALRDLIGNRKRKVQILNSMDGVLEAGEMLVVLGPPGSGCTTMLKTIAGEMNGIYLDESSSLNYRGITPKQIYGQFRGEAIYTAEVDVHFPNLTVGQTLSFAAEARAPRKPPGGISKKEYAKHMRDVVMSVFGISHTLNTIVGNDFIRGVSGGERKRVTIAEASLAGAPLQCWDNSTRGLDSANAIEFCKNLRLNSDYIGISSAVAIYQAPQAAYDCFDKVSVLYEGEQIFFGKATEAKQFFVDMGFHCPSQQTVPDFLTSLTSASERTPREGFEGKIPTTPQEFATRWKQSDKYQELLAQIAEFENKYPVHGEKYQEFLQSRRAQQSKRLRPKSPYTLSYGGQVELCLRRGFDRLRADPSLTLTQLFGNFIMALIIGSVFYNLPATTSSFYSRGALLFFAILMSAFGSALEILILYAQRGIVEKHSRYAFYHPSAEAVASALTDIPYKVVNCIIFSLTLYFMTNLRREPGPFFFFMLISFTLTMVMSMLFRSIASLSRSLTQALAPAALLILALVMYTGFAVNVANMRGWARWMNWLDPIAYGFESLMINEFHGREYECAAFIPMGPGYEGATGQQLVCSTAGAVAGSSVVNGDDYINLSYEYYHAHKWRNFGILIGFFLFFSAIYISATEFITAKKSKGEILVFPRGKIPRALLAQSTHSHGSSDDVEGGKFAGGSKMKKEITGADRADAGIIQRQTAIFSWKDVVYDIKIKKEPRRILDHVDGWVKPGTLTALMGVSGAGKTTLLDVLATRVTMGVVTGEMLVDGRQRDISFQRKTGYVQQQDLHLETSTVREALRFSAVLRQSNTISIKEKYEYVEEVLKLLEMESYADAVVGVPGTGLNVEQRKRLTIGVELVAKPALLLFLDEPTSGLDSQTSWNILLLLRKLTEHGQAILCTIHQPSAMLFEQFDRLLFLARGGKTVYFGEVGKGSHILIDYFEQNGAPKCPEGENPAEWMLAAIGAAPGSHSDVDWHQAWINSPERVEVRRELARIKETQGGKGEAALQNKDQEKSKSEVKAEYAEFASPLWKQFIVVLTRVWQQHWRTPSYIWSKAALCALSALFIGFSFFKAGTSQQGLQNQLFSVFMMFTIFGQLTQQIMPNFTTQRSLYEVRERPSKAYSWKIFILSNIVAEIPWAILMGAVIYFTWYYPIGYYRNAIPTDAVHLRGALMFLYIEMFLIFNATFAIMIVAGIATAETAGNIANLLFSMCLIFCGVLAPPSSLPGFWMFMYRVSPFTYLVEGMLSTAVADTNVVCSDIELLTMNPPSGQSCGDYMSTYISNYGGYLVNENATTACEFCSMSSTNTFLAQFSIYYSNKWRDFGLLWAYVVFNIIAAVGIYWLARVVRTFRLFTQPSLLITSLISPRTLAKNKHLNRRTYRRSWFLHSLLRRNLSRCLEAPSLPRRKIGRQENRRL

SEQ ID NO: 65463 - protein, 410 aa, Mycobacterium avium subsp. paratuberculosis K-10
MASATGFVIIGGGLAAAKAVDALRDNNFDGRIIVFADEEHLPYERPPLSKEFLAGKKSLTDFTVQNSDWYRDNDVDLRLNTRVCALDAAGHTVGLADGTTVAYDKLLLATGSAARRPPIPGSDCAGVHYLRTYEDAVALNSFLGEGKSLAVVGAGWIGLEVAAAARQRGVEVTVVEAARQPLTAALGETVGEVFATLHREHRVDLRLETQVREITRADGSATGLRTTDGSAIPADAVLVAVGAQPNIELAEAAGLSLADGGVLVDASLRTSDPDIYAVGDIAAAEHPLLRTRIRTEHWANALKQPAIAVAGMLSRPGEYDELPYFFTDQYDLGMEYVGHAPRFERVVFRGDVAAREFVAFWLDADDRVLAGMNVNIWDVLDDVKALIRSRAPIDADRLGDPGAPLGELLG

SEQ ID NO: 65464 - protein, 229 aa, Listeria monocytogenes str. 4b F2365
MNKLNEALKKAEHIVFLTGAGVSVPSGIPDYRSKNGLYAGMSSPEYMLSHTCLVREPEKFYQFVTENMYYPDAEPNAIHTKMAEIEAEKDVTIITQNIDGLHEKAGSKKVVNFHGSLYHCYCQKCGMSVTAEEYLKSDIHSGCGGVIRPDVVLYEEAIPESAIDQSLAAIRQADLIVIVGTSFRVSPFCNLTDYRNKKARIFAVNKEQISLPYPFEMMESDAVKVFAEI

SEQ ID NO: 65465 - protein, 693 aa, Arabidopsis thaliana
MSSSREENVYLAKLAEQAERYEEMVEFMEKVAKTVDTDELTVEERNLLSVAYKNVIGARRASWRIISSIEQKEESRGNDDHVSIIKDYRGKIETELSKICDGILNLLDSHLVPTASLAESKVFYLKMKGDYHRYLAEFKTGAERKEAAESTLVAYKSAQDIALADLAPTHPIRLGLALNFSVFYYEILNSPDRACSLAKQAFDEAISELDTLGEESYKDSTLIMQLLRDNLTLWNSDINRDRSIRSGGLKPYSFEAATDARETPTKETGFRPRINPTGAPTHHKTPRKLVSPTSTSTAPDSEEAIRYTGRGSGEDGQLGIGTNEEKEWACVVEALEPYSVRSVVSGSRNSLAICDDGTMFTWGWNQRGTLGHQPETKTENIPSRVKALANVKITQAAIGGWHCLAVDDQGRAYAWGGNEYGQCGEEPLKDEMGRPVRRDIVIPKRCAPKLTVRQVAAGGTHSVVLTREGHVWTWGQPWPPGDIKQISVPVRVQGLENVRLIAVGAFHNLALEEDGRLLAWGNNEYGQLGTGDTQPTSHPVPVQGLDDLTLVDIAAGGWHSTALTDKGEVYGWGRGEHGRLGLGDNDKSSKMVPQKVNLLAEEDIIQVSCGGTHSVALTRDGRIFSFGRGDHGRLGYGRKVTTGQPLELPIKIPPPEGSFNHTDEEEEGKWSAKSIACGGRHTLAIVEWKSDDI

SEQ ID NO: 65466 - protein, 365 aa, Triticum aestivum
  misc_feature (180)..(180): Xaa can be any naturally occurring amino acid
MEVFYYLVFGGLAAVVAALELGKSGKDRVATPTAFNSFKNNYVLVYSLMMSGDWLQGPYVYYLYSQYGFDKGDIGRLFIAGFGSSMLFGTIVGSLADKQGRKRACITYCITYILSCITKHSPQYRILMIGRVLGGIATSLLFSAFESWLVAEHNKRGFDPQWLSITFSKAIFLGNGPSCXIVAGLFANLLADNLGFGPVAPFDAAACFLAIGMAIILSSWGENYGDASEGKDLMAQFKVAAKAIASDEKIALLGAIQSLFEGSMYTFVFLWTPALSPNEEDIPHGFIFATFMLSSMLGSSIASRLLARKMKVEGYMQIVFSISAFTLFLPVVTNVSLLHIATLIVSFVLVLQSKCYYHLSLFNSS

SEQ ID NO: 65467 - protein, 112 aa, Buchnera aphidicola str. Bp (Baizongia pistaciae)
MCQNIFQKIIKGIIPSKIIYQDKEITAFHDINPIAPIHILVVPNLLIKSLNEINENNKHILGNMLYISIKIAKKFKIDKNGYRLIINCNQHGRQEIQHLHLHLLGGKKLNKI

SEQ ID NO: 65468 - protein, 444 aa, Brassica rapa
MATITAVKARQIFDSRGNPTVEVDVHTSSGVKVTAAVPSGASTGIYEALELRDGGSDYLGKGVSKAVGNVNSIIGPASIGKDPTQQTAIDNFMVHELDGTQNEWGWCKQKLGANAILAVSLAVCKAGAVVSGIPLYKHIANLAGNPKIVLPVPAFNVINGGSHAGNKLAMQEFMILPVGASSFKEAMKMGVEVYHNLKSVIKKKYGQDATNVGDEGGFAPNIQENKEGLELLKTAIEKAGYTGKVVIGMDVAASEFYSSDKTYDLNFKEENNNGSQKISGDALKDLYKSFVAEYPIVSIEDPFDQDDWEHYAKMTAECGDNVQIVGDDLLVTNPKGVAKAIAEKSCNALLLKVNQIGSVTESIEAVKMSKRAGWGVMASHRSGETEDTFIADLSVGLSTGQIKTGAPCRSERLAKYNQLLRIEEELGSEAVYAGANFRKPVEPY

SEQ ID NO: 65469 - protein, 424 aa, Marinobacter sp. ELB17
MVTRLKDGIKGAFRIGQTMSVLGRIGFNWVRGDRPPAPRLLRQTFESLGATYIKLGQFIASSPTFFPKEYVEEFQGCLDSTPSLPYRVIRKIIEEELGRPVEEVFTDIDPVALASASIAQVHVARLINGEEVVIKVQKPGVRNILLTDLNFLYVSARILETLAPKLSWTSLSDIVDEIQRTMMEECDFIKEADNLEVFRQFLHNTHNTDATVPKVYEQCSSRRILVMERFYGVPLTDLDSIRGYTNNPEGTLITAMNTWFSSLTQCDFFHADVHAGNLMVLRDGRVGFIDFGIVGRIAPDTWQAVNDFIQTVMVGNFDGMADAMIRIGVTRHTVEASLLANDLRTLYSKMDQMVPDTVAYTADRAEDDVNHLLMDMVKVGESHGLHFPREFALLLKQFLYFDRYVHILAPEMDMFMDDRLKMLH

SEQ ID NO: 65470 - protein, 390 aa, Desulfovibrio vulgaris subsp. vulgaris str. Hildenborough
MNISDRLTRIKPSATLAVNAKALELKARGVKVVSLAVGEPDFGTPAHICEAAKRAIDEGFTRYTPVPGIIELREAVAGYFGRCYGVEAPAEATIVTNGGKQALYNLFQALLNPGDEVLVPAPYWVSYPALVQLAEGVPVFVPSPAERGFKITPAELDAHRTPRTRVLLLNSPSNPTGACYTREEMDALMQWAVDHDIFVIADEIYDRLVYGDMQPVSVSGWWQRFPDRVAVVNGLAKTFAMTGWRVGYVLAHPDLVKAVAKIQGQSTSNICSIAQKAALAALTGPYDAVEEMRCAFVRRRDLAYDIISGWKDVVCPRPDGAFYLFADIHRHYNASMPDSAAVCTRLLEEAQVALVPGSAFGDDKCIRFSYAVADDVLEDALSRVAKVLFG

SEQ ID NO: 65471 - protein, 201 aa, Chlamydomonas incerta
MALRSITRGVSARTACRAATAARRAAVTVRAAHNPAAITKKVYFDINIGANSAGRVVIGLYGNDVPQTVENFRALCTGEKGFGYKGSPFHRVIKQFMIQGGDFTAGNGTGGKSIYGARFNDENFKYKHTGPGVLSMANAGPNTNGSQFFICTVATPWLDGRHVVFGEVVEGQDVVDKVENFPTGRGDRPVEPITVAACGEL

SEQ ID NO: 65472 - protein, 185 aa, Lactococcus lactis subsp. lactis Il1403
MLEKRSTDNSVSNKNMELKDYIATIENYPKEGVVFRDISPLMADGNAYNYAATEIVQYARDKEIDMVVGPEARGFIIGCPVAFALGVGFAPVRKPGKLPREVIEATYEKEYGTDTLTMHSDSIKPGQRVLIVDDLLATGGTIAATIELVEKMGGIVVGCAFLIELDELKGREKIGDYDYKVLMHY

SEQ ID NO: 65473 - protein, 881 aa, Pseudomonas putida GB-1
MQDLDPIETQEWLDALESVLDKEGEDRAHYLMTRMGELATRSGSQLPYAITTPYRNTIPVTHEARMPGDLFMERRIRSMVRWNALAMVMRTNLKDSDLGGHISSFASSATLYDIGFNYFFQAPTEEHGGDLIFFQGHASPGVYARAFMEGRINEDQMNNFRQEVDGNGLSSYPHPWLMPDFWQFPTVSMGLGPIQAIYQARFMKYLEARGFIPAGKQKVWCFMGDGECDEPESLGAIALAGREKLDNLIFVINCNLQRLDGPVRGNGKIIQELEGVFRGGGWNVNKVVWGRFWDPLLAKDTNGALQRRMDEVIDGEYQNYKAKDGAYVRENFFNTPELKAMVEDLSDEEIWKLNRGGHDPYKVYAAYHQAVNHKEQPTVILAKTIKGYGTGAGEAKNTAHNTKKVDVDSLRHFRDRFDIPVKDADLENLPFFKPEEGSAEAKYLAERRAALGGFVPQRRAKSFSVPTPSLETLKAILDGSGDREISTTMAFVRILAQLVKDKEIGQRIVPIIPDEARTFGMEGMFRQLGIYSSVGQLYEPVDKDQVMFYREDKKGQILEEGINEAGAMSSFIAAGTSYSCHNQPMLPFYIFYSMFGFQRIGDLAWAAGDSRTRGFLIGGTAGRTTLNGEGLQHEDGHSHMMAGTIPNCRTYDPTYGYELAVIIQDGMKKMTEEQQDIFYYITVMNESYQQPAMPAGVEEGIIKGMYLLEEDTREAAHHVQLMGSGTILREVREAAKILREEFNVGADVWSVTSFNELRRDGLAVERANRLKPGQKPQQTYVEECLNGRKGPVIASTDYMKLFAEQIRQWVPSKEFKVLGTDGYGRSDSRKKLRHFFEVDRHFVVLAALEALADRGELEPKVVADAIVKFGIDPDKRNPLDC

SEQ ID NO: 65474 - protein, 545 aa, Pseudomonas putida GB-1
MSELIRVPDIGSGEGEIIELFVKVGDRIEADQSLLTLESDKASMEIPAPKAGVIKELKVKLGDRLKEGDELLVLEAEGAAAAAPEAPAAAAAPAAAPAPAAEAAPAPAAAPAAASVQDIHVPDIGSSGKAKIIEVLVKVGDTVEADQSLITLESDKASMEIPSPAAGVVEEVLCKLEDEVGTGDLIFKLKVAGAAPAAAPAPAAAAAPAKAEAAPAAAPAAAAPAAAPAPAATAPAAGSNAKVHAGPAVRQLAREFGVDLGAVAATGPHGRILKEDVQVYVKAMMQKAKEAPAAAGATGGAGIPPIPAVDFSKFGEVEEVALTRLMQVGAANLHRSWLNVPHVTQFDSADITELEAFRVAQKAVAEKAGVKLTVLPLLLKACAFLLKELPDFNSSLAPSGKAIIRKKYVNIGFAVDTPDGLLVPVIKNVDQKSLLQLAAEAAALAEKARTKKLSADEMQGACFTISSLGHIGGTGFTPIVNAPEVAILGVSKATMQPVWDGKAFQPKLMLPLSLSYDHRVINGAAAARFTKRLGDVLGDIRTMLL

SEQ ID NO: 65475 - protein, 538 aa, Geobacillus kaustophilus HTA426
MKTPLNISMMLERAELFFPKKQVVSRMKGGVVRHTYKEIGERTRRLSSVLKRLGVEVGDRVGTFAWNHHRHLEAYFAIPGIGAVLHTINIRLSPQHISYIINHADDRVLLIDDDLLPAIEAIKDEIPNVRAFIVMTDADELPETTLSPVYHYEKLLAEGDPAFPFFKDLDEYQPAGMCYTSATTGNPKGVVYTHRSTVLHAMALGLADTQGLCERDVVMPVVPMFHVNAWGLPFAATWFGSTIVMPGPAFTPKVLAELIDSERVTITAGVPTIWLGLLQELEKGNYDVSSLTRVICGGSAAPKGIIRAFEEKYGIPFIHAYGMTETSPLVLVSRPKSYQDGLSYEEKLDIRAKQGLLAPGLEMKVIGQNGPVRWDGQEMGELCLRGPWIAAEYYNDDRTKDAFRDGWLHTGDVVTVDEEGFVKIVDRTKDVIKSGGEWISSVDLENALMAHEAVFEAAVVAVPHPKWQERPIACVVLKEGKSVTKEELYDFLRPQFTKWWLPDDIVFLDEIPKTSVGKFLKRKLRDEMAARYADAAKE

SEQ ID NO: 65476 - protein, 130 aa, Chlamydomonas incerta
MSLVARPVLSARVAASRPRVAARKAVRVSAKYGENSRYFDLQDMENTTGSWDMYGVDEKKRYPDNQAKFFTQATDIISRRESLRALIALSGVAAIVTYGIKGAKDADLPITKGPQTTGENGKGGSVRSRL

SEQ ID NO: 65477 - protein, 1835 aa, Arabidopsis thaliana
MVRDIVDDPLDEDDIALVKTYGLVPYSAPIKKVEKEIKELTEKINDLCGIKESDTGLAPLSKQMMQEGQPLQVGYVSCFRYIPIDLLMDIFSRVPAKSIARFRCVSKLWESILCRPDFKELFMTMSSIRPPLLLFTFQDDDGNLFFFSSPHPQIPCNENTSLVPTRYHVQHTTDSFSEIGSPLCGFICRRGKRNLDTMVICNPVTGESVSLPKVELKSINTETRPYLGYDPVRKQLKVLCIKSDDIPNTCDEHQVLTLENGNHLWRTIQCKPHYPKSDGICIDGILYYTAGFDMRARVSMVVCFDVRSEKFSFINIHVFMLMNDSCTLINYKGKLGALQFTCLSPKRLRFWVLVNAEKNIWTKCIYALPPLWNNLVQHTELAIVGMTDGGEVVLSQYCLIYAFYIYYFNLESKSLTRVQIQDVEMFKLDKCLSYILLFQGLTMTEDSTHFLLKGGYFKSSLPLKLASLIFVSSPPRSSEDVEAELARVSRWLTVATSIDSELIDDGGSRSIVRMATAVHVMGLGPAVRYGSSGLRDWWLRSRVVGGGCARNRRIRDSLVERISVLFPKNLSQSQQFPVTPRSPSCTFLLSLSGSEVSSRNRVRLLQDRRREPFFSRYLFLRIKYYHQCLIHTVKDFIAKTGDPTGTGTGGDSIYYDEIHAELKHSNTGTVAMASFGENLNASQFYITLCDDLDCLDGKYTITSGFETLTCIAKASVDAKNRPNKDIRIRHTYILTDPFDDPPQLAKMIPDASPKGKPKVEVTDDMQPREDWDIRDAEFDFLELNEAFAEMAANPVEVAINSMIIRDIMEDPENEGPHNMRSDFEPLLSVLRLRDYETGDIIEFDSTEASEEALSDITEFGSTEASEAHFEEPYSARIKKVEKEINELAEKICNLGIKESDTGLAPPNQWDLVSDKQMMQEEQPLLVATCTQIISPNTEDAKYVVDIKKIGKYVVGLGDKASPTDIEAGMRVGVDQKKYQIQIPLPPKIDPSVTMMTVEEKPDATYSDIGGCKEQIEKIREVVELPMLHPEKFVRLGIDPPKGVLCYGPPGSGKTLVARAVANRTGACFIRVVGSELVQKYIGEGARMVRELFQMARSKKACILFFDEIDAIGGARFDDGVGSDNEVQRTMLEILYQLDGFDARGNIKVLMATNRPDILDPALLRPGRLDRKVEFCLPDLEGRTQIFKIHTRTMSCERDIRFELLAGLCPNSTGADIRSVCIEAGMYAIGARRKSVTEKDFLDAVNKVVKVLSVVIWVDGSGLISGNDCVTSSMVKVSSSTTSSSSSSSPDEESDLQNLLEESDSQIDQFRISDEAAEQRPTFDVESLRSRLRRSFKLNLTKKQSIFIFLPIVIILIYLSTDFSNYFSVKVPNSAFRSNTLTGRVHESDLQALYLLRKQESDLFSIWNHTVSNLSTIDDVKSAVFRQISLNRQIQNALLSPHKTGNVDIGGSSDGYFAGGSCRKVDQKLNGRKTIQWKPRPDKFLFAICLSGQMSNHLICLEKHMFFAALLKRVLVIPSHRFDYHYSRIIDIDRINTCLGRTVVVSFEEFWKKDKNRKKHHHVHINRFICYFSKPEPCYVDKEHITKLKALGITVGGKLDTPWEEDIARPSNKTAEEVEANFRSDDDVIAIGDVFYANVEREWVMQPGGPVAHKCRTLIEPNRLILLTAQRFIQTFLGKNYIALHFRRHGFLKFCNAKNPSCFFPIPQAASCITRLIEKVEAPVLYLSTDAAESETGLLQSLLILNGKTVPLVKRPARDSAEKWDALLYRHGLEGDSQVEAMLDKTICALSSVFIGASGSTFTEDILRLRKDWGTASECDEYLCANEQPNFIADHE

SEQ ID NO: 65478 - protein, 402 aa, Pseudomonas fluorescens PfO-1; identical to SEQ ID NO: 1179

SEQ ID NO: 65479 - protein, 132 aa, Arabidopsis thaliana
  misc_feature (77)..(77): Xaa can be any naturally occurring amino acid
  misc_feature (81)..(81): Xaa can be any naturally occurring amino acid
  misc_feature (90)..(90): Xaa can be any naturally occurring amino acid
MDSSYLTKLVFFGRLLLLTFADNLVAGKSRKVNLNLYYESLRPGCQEFIVVDLREIFDYNLYTITGLKLFSFGHAEXTDNXTVTCQPGEXEEVKLNALEACALRTWPDQKSHYFFIQCVQSDTKGWDSLFKT

SEQ ID NO: 65480 - protein, 367 aa, Medicago truncatula
MGYATTDETENKSDRLQELKAFDETKAGVKGLVDQGILKIPALFHHPPDKYGKSTNSTNTEHIIPVIDFLNIGKDPNTRQEIITKIKEASETWGFFQVVNHGIPINVLEDMKDGVIRFFEQDTEVKKEMYTRDQTRPLVYNSNFDLYSSPALNWRDTLALKMAPNAPKPEDLPVVCRDIFLEYGEHVMKLGIVLFELLSEALGLHPNHLKDLDCSEGNLLLCHYYPACPEPHLTMGTAKHSDSSFLTVLLQDHIGGLQVLHKGKWIDVPPIPEALVINIGDVLQLITNDRFKSVEHRVLANTIGPRVSVASFFRAGPRAQEKLYGPIKEILSEDNPPRYRETTFTDFVAYYNAKGLDGISALEHFKL

SEQ ID NO: 65481 - protein, 177 aa, Pseudomonas fluorescens PfO-1
MNHPITALVIMGVAGCGKTCVSEALCQLSGATAIEGDTFHPAANIEKMSAGIPLNDEDRAGWLDSLCDELRRVDALGERPVLTCSALKHSYREVLRSALPGLGFVFLELTPEVAAERVSHRPGHFMPATLIESQFATLESPKGEPLTLALNASIHSVEELAAQAHVWWQAHGLKQAV

SEQ ID NO: 65482 - protein, 126 aa, Buchnera aphidicola str. Bp (Baizongia pistaciae)
MIKEIHTHKSPKPIGPYSQAIQIKNFTFLSGQISQTDNINTNISFQTQSILQNINYILESKEMNVGNIVKTTIFITNLNDLTIVNDVYQKFFLKYTKTFPARSCVEVSKLPKNAKIEIDAIAYKNK

SEQ ID NO: 65483 - protein, 602 aa, Buchnera aphidicola str. Bp (Baizongia pistaciae)
MTHTNMTFSSFGLNSCIITALNDIGYVQPSPIQAACIPYLIKGKDVLGMAQTGSGKTAAFALPLLHNIKLDVRVPQILVLTPTRELAVQVAEAFSNFSKKLIGVHVLALYGGQRYDLQLKSLRKGPQIIVGTPGRLLDHLKRRTLSLSNLHSLVLDEADEMLRMGFIEDVETIMTEIPDRHQTALFSATMPEAIRRISRRFMKNPKEIRIQSNITTRPDIQQSYWMVYGKKTDALIRFLEAEDFSATIIFVRTKNATLEVSEVLERYGYNSAALNGDMNQSLREQTLEKLKDGRLDILIATDVAARGLDVDRISFVINYDIPMDSESYVHRIGRTGRAGRKGKALLFVENRERRLLRNIERAMNISISEVNLPKSDFLSKRRLEKFAQKVQIQLDSKDLHEYRGLLPKLQPNNNSLDIESLAAALLKMAQGERSLIVKPESIVRARHLKIKDTYRNNNYKSLNYVSRYNRDKNVDLYRIDVGRNDGVEVRHIVGAIANEGDISSRKIGNVRLFSNYSTIELPKGLSNTLPKTFIRTKILNKFINIKLLYNSNFKGNYNDIKDVKVYNSNKLRSKKMNNKKFVSSGVRKKIKTNISCNRRRSV

SEQ ID NO: 65484 - protein, 336 aa, Vibrio cholerae O1 biovar eltor str. N16961
MQKMRTLGEFIVEKQHDFPHASGELSSLLASIRLAAKIVNREINKAGLADIIGASGNDNIQGEEQQKLDLYANEKFKAALEARDQVCGVASEEEDEAVAFSKELNKNAKYVVLMDPLDGSSNIDVNVSVGTIFSIYRRVSPVGTPPTQEDFLQPGNKQVAAGYVIYGSSTMLVYTTGNGVNGFTYDPSLGTFYLSHENMRIPENGKIYSINEGNYIRFPTGVKKYIKFCQENVPEEGRPYTSRYIGSLVADFHRNLLKGGIYLYPSTQSHPNGKLRLLYECNPMAFLIEQAGGLASDGARRIMDIKPTELHQRVPFFVGSKNMVHKVETFLETYPD

SEQ ID NO: 65485 - protein, 736 aa, Glycine max
MKMLPPPTAGGASHSGAGDRTVVVGMKMDSHSTELLTWALFKVAQPGDVVLALHVLGNDEIVNREGKSSLFSLVKAFDSILAVYEGFCNLKQVDLKFKICRGSSVRRILVREANAYSATHIIVGSSQGLHIIRPCISVARYCAKKLPKDCWVLAVDNGKIVFKREGSPATRAELKGLDQDHKTRLLGSIHRTISKGSKVLDDDGTGIHEKGCGNGEYSDHSLAKAFLDSKEFVEKKRCSICASEEESCGDASDENNPLAIVPVQTNDAASKPGWPLLRKTIVSDKKCSEKSLLRQISVVQWAMQLPSRDLSYAAHQDHKANNCDQNKDQFLALDSKSGALVPVDAEIGTASSPERNSRSIPKELEGLHEKYSSTCRLFEYQELVLATSNFLPENLIGKGGSSQVYRGCLPDGKELAVKILKPSDDVLKEFVLEIEIITTLNHKNIISLLGFCFEDGNLLLVYDFLSRGSLEENLHGNKKNPLVFGWTERYKVAMGVAEALEYLHNNEGQSVIHRDVKSSNVLLSEDFEPQLSDFGLAKWASTSSSHIICTDVAGTFGYMAPEYFMYGKVNDKIDVYAFGVVLLELLSGRKPISGDYPKGQESLVMWASPILNSGKVLQMLDPSLGENYDHEEMERMVLAATLCIRRAPRARPLMSLISKLLGGDPDVIKWARLEANALEAPEMLDGEACPPSNLQSHLNLALLDVEDDSLSMCSVEQNVSLEDYLRGRWSRSSSFD

SEQ ID NO: 65486 - protein, 168 aa, Zea mays
  misc_feature (23)..(23): Xaa can be any naturally occurring amino acid
  misc_feature (57)..(57): Xaa can be any naturally occurring amino acid
  misc_feature (96)..(96): Xaa can be any naturally occurring amino acid
  misc_feature (104)..(104): Xaa can be any naturally occurring amino acid
  misc_feature (112)..(112): Xaa can be any naturally occurring amino acid
  misc_feature (117)..(117): Xaa can be any naturally occurring amino acid
  misc_feature (139)..(139): Xaa can be any naturally occurring amino acid
MSSLGAVSGKPASMKGIARHGRXLQRRKLDGGRARVRSIRKPREAGAVVKDRRRERXFDLDDVKDTTAQGEPDGSDATTAYNPLEMKFMETVAGPXIKRGMLLXILLLRRRXLLVYXGELVVTDLLSIKKGPDETPQTXPRGKIYGQFLHLHEILVCFVLLSTYGPLK

SEQ ID NO: 65487 - protein, 276 aa, Geobacillus kaustophilus HTA426
MEKVYGLIGFPVEHSLSPLMHNDAFARLGIPARYHLFSVEPGQVGAAIAGVRALGIAGVNVTIPHKLAVIPFLDEVDEHARRIGAVNTIINNDGRLVGYNTDGLGYVQALEEEMNITLDGKRILVIGAGGGARGIYFSLLSTAAERIDMANRTVEKAERLVREGDERRSAYFSLAEAETRLAEYDIIINTTSVGMHPRVEVQPLSLERLRPGVIVSDIIYNPLETKWLKEAKARGARVQNGVGMLVYQGALAFEKWTGQWPDVNRMKQLVIEALRR

SEQ ID NO: 65488 - protein, 372 aa, Oryza sativa (japonica cultivar-group)
MESTLITITRSPILPCPFSRRPASPARCFAGARRSRCAAASASFFSPAGGRGGGDAGAGSSLSSAAAAAALGEAAAAGGGGSDSEAILLSVQGMMCDGCAASVKRILESQPEVTSATVDFKEAKAVVLTTAEVKAAEDWQKQCGEKLANHLGTCGFESRLQGTTADDLSPLFEKYGEVVDIYIPRDRRTGDSRGFAFVRYKYEDEAQKAVDRLDGRVVDGREIMVQFAKYGPNAERIHKGKIMETVPRSRGRSRSRSPRRGYRDDYRERDYRKRSRSRDRYGRDRYRERDYRRRSRSRSYTPDDYRRRGRDSVSPARRSLSRSRSRSYSPDDYRKRGKHRSPSRSPRRTPSSQEGSPVKRYDEPRRSRSPST

SEQ ID NO: 65489 - protein, 311 aa, Magnaporthe grisea 70-15
MASQKFDPDSDIPSLSGKVILVTGGNIGLGQESILQLAKHDPKRIYLAARSEEKARKAMEAIEQKIGAAKSSVITFLPLDLGSFDSVRKAADTVKSQTDELHILLNNAGIMMTPAAKTKDGYEEQFGVNHMGHALLTRLLLPLLEKTAKSGADVRIVNLSSSGEMLAATDCFKDMSRYKTTMEDVQTVKRYGAAKLANVYHAQMLAQKYPSIKAVSLHPGVVKTNLMSRMKESWPILGPIVSSIISNVFCTSVADGVRNQLWAAVSNDVVSGEFYHPVGLLGKGSPATKKVKEAENLWEWTEKELDAYLNK

SEQ ID NO: 65490 - protein, 308 aa, Xylella fastidiosa Dixon
MSLDSALRSRIETLLHSNRVVLFMKGRPGMPQCGFSAKAAGILQALGVEYAHVNVLDDQEIREGIKRYGDWPTIPQLYIDGELIGGSDIVSQMYENGELSTLLGVAAPDLTPPSITITPTAVEMLKGTLANAPGSTLALSIDSRFQPTFELAPINTQAIAAESNGLRVQFDLASARRAEGITIDWVDDIRGQGLVIDNPNVPQPIQELSPGDAAAQVDAGVLTLVDVRPADERAVASVAVPFRTMDGGERAVLEQLPKGTPLAFLCHHGGRSLQAAEHFRSLGFTSIYNIGGGIDAWSTQVDPGVPKY

SEQ ID NO: 65491 - protein, 342 aa, Oryza sativa (japonica cultivar-group)
MTNHAGFAADDAVTAAVPVQAAQGGRHFPPFLAPSSRLTDCKKAAAPRGPRRRGREKHPSALAWFESVAAAAKGKEIVVFLDYDGTLSPIVADPDRAFMSDEMREAVRGVAKHFPTAIVSGRCIDKVFDFVKLEELYYAGSHGMDIRGPTAAASEYNHNMKAKQGDAVTFQPAADFLPVIEEVYHVLKERMASIRGSLVENNKFCLSVHYRCVDEAEWGVLDGKVRAVIEGYPDLRLSKGRKVLEIRPVIDWDKGSALQFLLKSLGYEGRNNVFPIYIGDDRTDEDAFKVLRNMGQGIGILVTKVPKETAASYTLREPSEVKEFLRKLVKIKINGDKGLIGK

SEQ ID NO: 65492 - protein, 558 aa, Streptomyces avermitilis MA-4680
MSPREDTVLSTMQDVPLLISRILTHGSTIHGSSQVITWTGEGEPQRRSYAEIGARAAQLAHALREDFGIVDDDRVATLMWNNAEHVEAYYAIPAMGAILHTLNLRLPAEQLVWIANHAADRVVIANGSLLPLLAPLLPHLKTVEHVVVSGPGDRSLLDGASVQVHEYEELIAGKPVSYDWPELDERSAAAMCYTSGTTGDPKGVVYSHRSIYLHSMQVNMTQSMGLTDQDTSLVVVPQFHVNAWGLPHATFMTGVNLLMPDRFLQPAPLAEMIESERPTHAAAVPTIWQGLLAELHAKPRDVSSLTQVTIGGSACPPALMAAFDKLGMRVCHAWGMTETSPLGTVARPPAHAVGTDEEFAYRLTQGRFPSGVQARLSGPGGERLPWDGESAGELEVRGPWIAGAYYNGPDAEPLRPADKFSEDGWLKTGDVGTISPDGFLTLTDRAKDVIKSGGEWISSVDLENALMAHPDIAEAAVVAVPDDKWGERPLATVVLKEGATADFATLRTFLADEAKIAKWQLPERWTIIESVPKTSVGKFDKKVLRRQYAEGELDITQI

SEQ ID NO: 65493 - protein, 449 aa, Pseudomonas putida GB-1
MANPPSSAPAQLRRVLGLPALVFFGLVYMVPLTIFTTYGIVTELTGGRTAGAYLVTLVAMLFTAASYSFMVKRFPVAGSAYSYTNMAFGPNIGFLAGWSLLLDYLFLPMINYLLIGLFLNIAFPAVPTWAFVLACIALVTVLNVVGINSVAKTSNLIVGAQIVFIGVFVALSCQTLAGQPLDLLSPLLGDGSKPGFGHLMAGAAVLCLSFLGFDAVSTLAEECRDARRDVPRAIILTTLFAGLLFTVLAYVSQLVLPGSSFANADAAANEVMFKAGGQFLTNFFTAAYVAGSLGSALASQAAVSRILFTMGRDNVLPRRSFGYLSPRFGTPVFAIALVSAFSLLALVIDLSTLASLISFGALVAFSAVNLAVVKTHLMDDTSQRNAKNLLRYGVVPLVGLGLTLWLWTSLSALTLVIGLCWFALGLVYLAVLTAGFRRPVHLVDFTEAA

SEQ ID NO: 65494 - protein, 887 aa, Neisseria meningitidis FAM18
MSTQLHDVDPIETQEWLDALSSVLEYEGGERAQYLLENLVKYCRDKGVRMPHGTTTPYLNTVSVENEKGIPGDQNIEHRIRAFVRWNAAAIVLRAGKKDLELGGHIASFQSAATMYEVGFNHFWKAKGEGEEGDLVFFQGHVAPGIYARAFVEGRLTEDQLNNFRQEVDGHGLPSYPHPHLLPDFWQFPTVSMGLGPIMAIYQARFLKYLESRGLAKTKGRKVWCFCGDGEMDEPESQGAIALAAREGLDNLIFVINCNLQRLDGPVRGNGKIIQELEGNFAGAGWNVVKVIWGRRWDRLLAKDKDGILRQRMEECLDGDYQTYKSKDGAYVREHFFNTPELKALVADMTDEQLWALNRGGHDPQKVYNAYDRAANHADGKPTVILAKTIKGYGMGASGEGQNVAHQAKKMDKASLKQFRDRFDIPVTDEQIESGDLPYLTFAPDTEEYKYLHARRDALGGYLPQRKPTQEVLEVPELSAFDAQLKSSGEREFSTTMAFVRILSTLLKDKKIGKRVVPIVPDESRTFGMEGMFRQYGIWNPKGQQYTPQDKDQLMFYKESVDGQILQEGINEPGAMADWIAAATSYANSNFAMIPFYIYYSMFGFQRIGDLAWAAGDMHARGFLLGGTAGRTTLNGEGLQHEDGHSHIQADLIPNCVSYDPTFQYEVAVIVQDGLRRMYANNEDVFYYITLMNENYTHPDMPEGAEQDILKGMYLLKAGGKGDKKVQLMGSGTILQEVIAGAELLKADFGVEADIWSCPSFNLLHRDAVEVERFNRLHPLEAEKVPFVTSKLQGHDGPVIAATDYIRSYADRIRAYIPNDYHVLGTDGFGRSDSRANLRRFFEVDRYNVAVAALSALAEQGKVSKETVQQAIEKYGIKADSAPSWKR

SEQ ID NO: 65495 - protein, 433 aa, Lactococcus lactis subsp. lactis Il1403 [sequence omitted]

SEQ ID NO: 65496 - protein, 444 aa, Geobacillus kaustophilus HTA426
MAKYTRDDILHIVKEENVKYIRLQFTDILGTIKNVEIPISQLEKALNNKIMFDGSSIEGFVRIEESDMYLYPDLDTFVIFPWTSEKGKVARFICDIYNPDGTPFEGCPRYNLKRMLKEMEALGFNAFNLGAEPEFFLFKLDEKGHPTMELNDRGGYFDLAPTDLGENCRRDIVLELEEMGFEIEASHHEVAPGQHEIDFKYADAVKACDDIQTFKLVVKTIARKHGLHATFMPKPIFGINGSGMHCNLSLFRNGENAFFDPNGDLQLSDTARQFIAGVLKHAPNFTAVTNPTVNSYKRLVPGYEAPCYVAWSARNRSPLIRIPASRGMSTRIEVRSVDPSANPYLAMAVLLAAGLDGIRNKLTPPAPVDRNIYVMTKEERLEEGIVDLPATLHEALENLKSDEVMIHALGKHLFEHFVEAKEIEWDMYRTTVHQWELDQYMELY

SEQ ID NO: 65497 - protein, 415 aa, Ehrlichia ruminantium
  misc_feature (52)..(52): Xaa can be any naturally occurring amino acid
MIKKAAVELDDQKITLPILYDTEGNEVLDITSLYKNTGVLTYDPGFMSTAAXESKITFIDGNKGILRYRGYDIADLVYNNKSFIEVVYLLFYGVFPNAEQLQEFMLHISQEYVLPQMVRNVIMSFPQNSHPMAILIASFSSLAAYYCDQKTDGELECKLAVAKVASIVALIYRHITNQDFIQADVGLSYSKNFIHMMFDISSYKFTEIVDKALDVIFVLHADHEQNASTATVRMAGSSGPNLFACLAAGAATLWGPAHGGANEAVINMLMNIGKPENVKQFIQKVKDSNKGTKLMGFGHRVYKNYDPRARIMCTICKEILKDFGLNDPLLEVAVELENIALQDDYFIARNLYPNVDFYSGIVLKTIGIPVKMFTTLFALARTSGWSAQWYEMVSSKNYKISRPRQLYTGNPVQKV

SEQ ID NO: 65498 - protein, 387 aa, Zea mays
MIPSVRISPGYAAFSGSSLRLKLHSIPSISSLKPSKYVVSSLKPLYLAPLDGPHTSELKSWRQPLEFRCAASAADDKESKTQVVPVQLEGAQRLKISIYFATWWALNVIFNIYNKKVLNAFPYPWLTSTLSLACGSAMMLFSWATRLVEAPKTDLDFWKVLFPVAVAHTIGHVAATVSMSKVAVSFTHIIKSAEPAFTVLVSKFLLGETFPVPVYLSLLPIIGGCALAAVTELNFNMVGFMGAMISNLAFVFRNIFSKRGMKGKSVSGMNYYACLSIMSLVILTPFAIAMEGPQMWAAGWQKAVAEVGPNVVWWIAAQSVFYHLYNQVSYMSLDQISPLTFSIGNTMKRISVIVSSIIIFRTPVRPVNALGAAIAILGTFLYFQAKA

SEQ ID NO: 65499 - protein, 431 aa, Shewanella sp. MR-4
MAKIINVIGREIMDSRGNPTVEAEVHLEGGFIGMAAAPSGASTGSREALELRDGDKSRYLGKGVLTAVANVNGPIRAALIGKDATAQAELDQIMIDLDGTENKDKLGANAILAVSLAAAKAAAAFKGMPLYAHIAELNGTPGQYAMPVPMMNILNGGEHADNNVDIQEFMVQPVGAKNFREALRMGAEIFHTLKKVLHGKGLSTSVGDEGGFAPNLSSNADALAVIKEAVELAGYKLGTDVTLALDCAASEFYKDGKYDLSGEGKVFDSNGFSDFLKSLTEQYPIVSIEDGLDESDWDGWAYQTKIMGDKIQLVGDDLFVTNTKILTRGIENGIANSILIKFNQIGSLTETLAAIRMAKAAGYTAVISHRSGETEDATIADLAVGTAAGQIKTGSLCRSDRVAKYNQLLRIEEQLGEKAPYRGLKEIKGQA

SEQ ID NO: 65500 - protein, 305 aa, Cryptococcus neoformans var. neoformans JEC21
MAPPSSVPKEYRPGYLPPSITEQAQKDLPGKQKPLDPTPFNDVMADGSKYKPAGKLEGKNAVVTGGDSGIGRAVAILYALEGANVLFTYHPKEEADAKDTVDDIKKRVPKAKVEAVAVEIQTEKACFELADKIKKWSGNELHVLANNAGTQKEIPNIEDLPSEQWRHVFDVNIHSMFYLIKSLIPIMPWGSSIINNASINPFVGHPKLLDYTATKGAIVGFSRALSNQIVGEKGIRVNCVCPGPIWTPLIVATMGEESLKAFGPGTPIGRAGQPIEVATAFVFLASIDSSYFTAQCFHVNGGSAY

SEQ ID NO: 65501 - protein, 489 aa, Aspergillus oryzae
MDSTGAGVSPSISLSEHGEYAAQISGKDLILHLNPTSSGFQDVEIVKVKESSLKFLKFSRASYTVSPDTYTARGETAPGRRVLHASDARVLVWQLLPLQLHAEIESIEPGALNIDFGSDENEVIVFHAWNTRLTVYALDTGRSQVIKSPKFAHHNGFGYRPKTGQFAILLKPDAVDLLTIHGFRSYELINRAVLPTVDAQGLKWSPDGRWVAVWDAASAGTKVLVFTADGKLFRTYTGPPGFDDSFDLGVRGIEWSPVANESGASEYLAIGKVDGTVDILRCKTFSCSTTLSHVFQIDDNSPSIWRERYATADGTLEYAESSSSSAFSITAETSGPPRGVSIMTFSCDGNLLATVDQTRPNIVWIWNLESTAVLLSALVHEHPVRQAAWHPSKIQLLIVTANNAVAAVRSWTPDGQPSIIYIPTSRSDSGRYDVRWLSSQGDDAKFWFGTTEEYTLGRIESEGDSSRFKVLNTIKGKASTGSHSAGMSR

SEQ ID NO: 65502 - protein, 158 aa, Zea mays
  misc_feature (24)..(24): Xaa can be any naturally occurring amino acid
  misc_feature (74)..(74): Xaa can be any naturally occurring amino acid
  misc_feature (113)..(113): Xaa can be any naturally occurring amino acid
RGGTVCEGLRGVPYCCYPAEDAAXAYCSTDDVMKWEDPRWIGNAEELLQGVRTVEDDLYTTLNNKVSRVYATPXTERKKRVYMNAPFKITSIDHYSGLDFKLVRMGLEDMYLXQPGGMYHKFGKDYYLRTVMAYMNVLDGTNPCEEWNAAHVIEHDNL

SEQ ID NO: 65503 - protein, 668 aa, Geobacillus kaustophilus HTA426
MAHSIEELAITTIRTLSIDAIEKAKSGHPGMPMGAAPMAYTLWTKFMNHNPANPNWFNRDRFVLSAGHGSMLLYSLLHLSGYDVSMDDLKQFRQWGSKTPGHPEYGHTPGVEATTGPLGQGIAMAVGMAMAERHLAAAYNRDGFEIINHYTYAICGDGDLMEGVASEAASLAGHLKLGRLIVLYDSNDISLDGELNLSFSENVAQRFQAYGWQYLRVEDGNNIEEIAKALEEARADLSRPTLIEVKTTIGYGAPNKAGTSGVHGAPLGAQEAKLTKEAYRWTFAEDFYVPEEVYAHFRETVQEAGAKKEAEWNEQFAAYERAHPELAAELKRAIEGKLPDGWEAALPVYEAGKSLATRSSSGEVINAIAKAVPQLFGGSADLASSNKTLIKGGGNFLPDSYEGRNIWFGVREFAMGAALNGMALHGGLKVFGGTFFVFSDYLRPAIRLAALMGLPVIYVLTHDSIAVGEDGPTHEPIEHLASLRAMPNLSVIRPADANETAAAWRLALESTDKPTALVLTRQDVPTLAATAELAYEGVKKGAYVVSPAKNGAPEALLLATGSEVGLAVKAQEALAAEGIHVSVISMPSWDRFEAQPKSYRDEVLPPAVTKRLAIEMGASLGWERYVGAEGDILAIDRFGASAPGEKIMAEYGFTVDNVVRRTKALLGK

SEQ ID NO: 65504 - protein, 347 aa, Magnaporthe grisea 70-15
MSDLPKTMKALQYSKPKEFAVVDVPLPELRDDDVLVKVKACGVCGTDLHIHEGEFIAKFPLIPGHETVGVVAAVGKDVKDFKVGDRVSADNAELCGHCFYCRRGESLLCENWAGHGTTLSGGFAEYCAYPQGKVFKFNNMTDVEATLIEPASCACHGLDKIKPRLGSSVLMFGAGPTGLMLAQLLRQNGCSQVTIAAPAGLKMDLARSLDAADTYVDLSREDSGPQLEQLKKDNPYGFDIVIEATGSVKILEDSINYCRRGGTLVVYGVYGDQDKVSWKPTKIFGDEIRIIGSFSEVFMFPQTIDYLDNGKVKTKGIVNKTFKLEQFGEALESIKNKSAIKAAIVFD

SEQ ID NO: 65505 - protein, 125 aa, Pseudomonas putida GB-1
MSNDIQRFPSSLPFPFSRAVKAGGFLFLSGQVPMSASGEVVRGDIQAQTRAACERIAESLAACGARFDQVVKATVWLSDMSHFAGFNEVYKEFFGAALPVRSTVASALALGVDVEIEVQAFVGDL

SEQ ID NO: 65506 - protein, 245 aa, Glycine max
MRASNSSSSISIAKRYFFFFFLFIFFALRSSSGDCSEYHHHHSPMATIGGLHDSQGSQNSVETEALARFAVDEHNKKQNSLLEFARVVRAQEQVVAGTLHHLTLEAIEAGEKKLYEAKVWVKPWLNFKELQEFKPAGDVPSFTSADLGVKKDGHQPGWQSVPTHDPQVQDAANHAIKTIQQRSNSLVPYELHEVADAKAEVIDDFAKFNLLLKVKRGQKEEKFKVEVHKNNQGGFHLNQMEQDHS

SEQ ID NO: 65507 - protein, 615 aa, Glycine max
MASLSGICSSSPTLKKFPNQSPSLTDPLRKDHVSFPARLADRTLSLAPLRAVAREVSDGALAAAVKKGLEKDPRALWRRYVGWLYQHKELGIYLDVSRVGFSDEFVKEMEPRFQAAFRAMEELEKGAIANPDESRMVGHYWLRDPKRAPNSFLKTQIENTLDAVCKFANDVVSGKIKPPSSPEGRFTQILSVGIGGSALGPQFVAEALAPDNPPLKIRFVDNTDPAGIDHQIAQLGPELASTLVIVISKSGGTPETRNGLLEVQKAFREAGLDFPKQGVAITQENSLLDNTARIEGWLARFPMFDWVGGRTSEMSAVGLLPAALQGIDIREMLAGASLMDEANRSTVLRNNPAALLALCWYWATDGVGSKDMVILPYKDSLLLFSRYLQQLVMESLGKEFDLDGNRVNQGISVYGNKGSTDQHAYIQQLREGVHNFFVTFIEVLRDRPPGHDWELEPGVTCGDYLFGMLQGTRSALYANNRESITVTVQEVTPRTVGALIALYERAVGIYASLVNINAYHQPGVEAGKKAAGEVLALQKRVLAVLNEASCKEPVEPLTLEEVADRCHAPEDIEMIYKIIAHMAANDRALIVEGSCGSPRSIKVFLGECNIDGLYA

SEQ ID NO: 65508 - protein, 565 aa, Shewanella oneidensis MR-1
MSEQKLALNEYLKTDSDYLRGTIKEGLDSSVTGSFSDGDQQLIKFHGFYQQDDRDLRNERKEQKLEPLYSFMLRARVPGGVCTPKQWLGVDEIASTLTSSNSIRLTTRQTFQYHGIPKRNLKTIIQGLDREALDSIAACGDVNRNVMCNPNPVESKLHAQAYEVAKKLSDHLLPHTRAYAEIWLDEEKLLTTEDETVEPVYGKTYLPRKFKMAVAVPPDNDVDVYTNDLGFIAVAENGELVGFNLTAGGGMGSTHGEVETFPRLADDFGFIKTEDVMKFAEAVMTVQRDWGNRTNRKRSRLKYTIVDHGYEKFKAEVEVRAGVKFEPKRDVVIGDRGDRYGWVEGVDGKWHLTLFIESGRIKDMPGKSLQTGMREIAKIHKGDFRMTSNQNMIIAGVAPEDKATIEGLARKRGLLGQVLTQTRGHSIACVALPTCPLAMAEAERYFPEFIDHIDALQAKNGISDQAIVVRMTGCPNGCARPFAAEIGLVGKAPGRYNLYLGANFEGTRLNKMYRENIQEAEILAELDALFARYAIERNAGETFGNFTVRVGVVKAVIDAAKDFHG

SEQ ID NO: 65509 - protein, 338 aa, Oryza sativa
NLEAIQILKKTGGSLKDSFLDEGFILDKKIGLGQPKRIENAKILVANTAMDTDKVKIYGARVRVDSMAKVAEIEAAEKQKMREKVQKIIGHGINCFVNRQLIYNFPEELFADAGILAIEHADFEGIERLALVTGGDIASTFDNPESVKLGHCKVIEEIMIGEDRLIHFSGVEMGQACTIVLRGASEHVLDEAERSLHDALCVLSQTVNDTRVLYGGGWPEMVMAKEVDGLARKTPGKKSHAIEAFSRALQSIPTIIADNAGLDSADLISQLRAEHHKEQSTAGIDVISGGVGDMEKLGISESFKAKQAVLMSATEAAEMILRVDEIVTCAPRRREDRM

SEQ ID NO: 65510 - protein, 481 aa, Glycine max
MAAASRRLRDLQSEAGNKICVDCSQKNPQWASVSYGVFMCLECSGKHRGLGVHISFVRSVTMDSWSDIQIKKMEAGGNDKLNAFLAQYSIPKETDIVTKYNTNAASVYRDRIQAIAEGRPWRDPPVLKENLSAAGKGKPPLTQTRRNNNEGGWDDWGNEASPRSKSKSTGDFRNLNGGGGAPARSRSTEDIYTRTQLEASAAKKEDFFARKIAENESRPEGLPPSQGGKYVGFGSSPQPPQRRNEAQNDYFSVVSQGIGKLSLVAASAANVVQAGTKEFTSKVKEGGYDHKVNETVNVVTQKTSEIGQRTWGIMKGVMAMASQKIEEYTKDDPNWKNDNWQRNENDRNGYYQDFNQENKGWNSSIGREQSSSGQFKTQSSSSWDDWDHNDSRKEVPAKGSSHSSGGLFSTHNSSSWDDWEHRDSRKEEPAKGSAPHNNEDWAGWDNAKDDGFDNYYEGASNKKGVGHNGKSDGTWTEGGFL

SEQ ID NO: 65511 - protein, 124 aa, Oryza sativa (japonica cultivar-group)
MILAGGGGGGADQCIPTPDIDHDTLRVVMQYCDKHAADDADEEDLKEWDEDFVDELDQDALFDVIAAANYLDIDGLLDLTCKRVADTIKGKTPEEIRKEFNIVNDLSKEEEEEIRRENPWAFEQ

SEQ ID NO: 65512 - protein, 599 aa, Oryza sativa (japonica cultivar-group)
MITLKSSDGEPVEVTEASARISKVIGDKIDAGRGGEAIPLPHVDKKTLKKVIEYCDEHANENSDTDEQKEELKNWDKAFIDELDEDDGSFLFLVLLASSYLKIDGLLDLTYQRVADNSKAKTTEEIRKTFSTIEIELSDKEEEEQQQEEEIRPENMKKKTATAMMIVTPRPTVTTVPVAGEEVAGGTTTTTPGLIKTGDAGIETTTIGMNGDETLGVAAANNVRLIKTTAVNAHAPRASATGEGTVTMAAGVITLVPPTWTTSPILSTPSHTWQRSLCLPASRSFTPRKSRRDQLLRLALVADKAMAAPPPTAMEDLAIRSSTGTEAWFSGTAWKPVPVARVFGRIREALPATPAVETPTTYQQIEEALMRLELAAAAARTPGDDTLLPQPMSPAPLAASPPRRLEDLASDAVADKILPAPLPGALLPQEMTHMPATPPLSALEPGSLPERASSPCAIAGLFTSPPPAIIASPLRSTLPCLRPVVLTRKVKLRPRQHSQAIRRSEHLAKQPARPMMERCQRILFRRLGILHDEEDASVERVLSQYMAMFDGPLPPHAIAALTAIFGLDDDDECAMDASLLPLVGEGITDVADEVEETLA

SEQ ID NO: 65513 - protein, 533 aa, Neisseria meningitidis FAM18
MSIVEIKVPDIGGHENVDIIAVEVKAGDTIAVDDTLITLETDKATMDVPADAAGVVKEVKVKVGDKISEGGVILTVETGAAAAEAAPAAAEAQPAPAAAPVAAGGATVQVAVPDIGGHTDVDVIAVEIKVGDTVAEDDTLITLETDKATMDVPCTAAGVVKAVFLKVGDKVSEGSAIIEVETAGSAAAAPAPAAQAAAPAPAAAPVPAAAAAPAPSAPAAAKIDEAAFAKAHAGPSARKLARELGVDLGQVKGTGLKGRIMGDDIKAFVKSVMQGGAAKPAAASASLGGGLDLLPWPKVDFSKFGNVEVKELSRIKKISGQNLSRNWVVIPHVTVHEEADMTELEEFRKQLNKEWEREGVKLSPLAFIIKASVSALKAFPEFNASLDGDNLVLKNYFNIGFAADTPNGLVVPVIKDVDQKGLKQISQELTELSKKAREGKLKPQEMQGACFTISSLGGIGGTGFTPIVNAPEVAILGVCKSQIKPVWNGKEFAPRLMCPLSLSFDHRVIDGAAGMRFTVFLAKLLKDFRRITL

SEQ ID NO: 65514 - protein, 199 aa, Brassica napus
MRPPRGGGSFRGRGGRDGGGRFGGGGGRFGGGGGRFGGGGGRFGGGGYRDEGPPSEVIEVATFLHACEGDAVTKLSQAKIPYFNAPIYLENKTQIGKVDEIFGAINESLFSIKMMEGIVATSYAEGDKFYIDPAKLLPLARFLPQPKGQSMGGRGRGRGASRGRGGFSSRGAPRGRGGFASRGAPRGRGGFRGRGRGGY

SEQ ID NO: 65515 - protein, 595 aa, Neisseria meningitidis FAM18
MSLVELKVPDIGGHENVDIIAVEVNVGDTIAVDDTLITLETDKATMDVPAEVAGVVKEVKVKVGDKISEGGLIVVVEAEGAAASPKAEAPVAAPAQEAPKAAAPAPQAAQFGGSADAEYDVVVLGGGPGGYSAAFAAADEGLKVAIVERYKTLGGVCLNVGCIPSKALLHNAAVIDEVRHLAANGIKYPEPELDIDMLRAYKNGVVSRLTGGLAGMAKGRKVDVIQGDGQFLDSHHLEVSLTAGDAYELAAPTGEKKIVAFKNCIIAAGSRVTKLPFIPEDPRIIDSSGALALKEVPGKLLIIGGGIIGLEMGTVYSTLGSRLDVVEMMDGLMQGADRDLVKVWQKQNEYRFDNIMVNTKTVAVEPKEDGVYVTFEGANAPKEPQRYDAVLVAAGRAPNGKLISAEKAGVAVTDRGFIEVDKQMRTNVPHIYAIGDIVGQPMLAHKAVHEGHVAAENCAGHKAYFDARVIPGVAYTSPEVAWVGETELSAKASGRKITKANFPWAASGRAIANGCDNGFTKLIFDAETGRIIGGGIVGPNGGDMIGEVCLAIEMGCDAADIGKTIHPHPTLGESIGMAAEVALGTCTDLPPQKKK

SEQ ID NO: 65516 - protein, 100 aa, Brassica napus
MKGATLVALAATIGNFLQGWDNATIAGAMVYINKDMNLATSVQGLVVAMSLIGATVITTCSGPISDWLGRRPMLILASVMYFLSGLIMLWSSNVYVLCLA

SEQ ID NO: 65517 - protein, 357 aa, Xylella fastidiosa Dixon
MSKQILILPGDGIGHEIVAEAVKVLEHVNVRHTLNMRLSFDALGGAAYEKYGSPLADETLARAREADAVLLGAVGGPQWDTIDPALRPERGLLKIRAQLGLFANLRPALLYPQLADASTLKPEVVAGLDILIVRELTGGLYFGQPRGSRISKNGEREAFDTLPYCESEIRRILKVGFEMARLRGKKLCSVDKANVLASSQLWRTVAGEMAKDYPDVTLSHMYVDNAAMQLVRHPKQFDVIVTENMFGDILSDQASMLTGSIGMLPSASLDANNKGMYEPCHGSAPDIAGQGVANPLATILSVAMLLRYSMGYIKTADAIEYAVGVVLDSGLRTADIWSEGMTKVGTVAMGDAVVAAL

SEQ ID NO: 65518 - protein, 613 aa, Coccidioides immitis RS
MHELYSIKGHNSTPVRRRPSRAIGRTPKTGDHPRDLEPFFKLKGANGNNLLHSKCTTDGDNSSPGCYLSSFPASPNPAIRTSCPAHAQDIPLQFQPYTEDDDTQCTQFLHIADFGPSTSKLKDKSLLIGKCFVNGEWVDAKSGETFEVTDPSTGKLIGTCPEFTAEETQKAVDAASASFPSFRKTLARERARMLRRWYQLMMDNAEDLATLITWENGKPYADAKGEVVYAANFFEWFSEEAPRVYGDTIPSSVPGNRVMTLKEPIGVCGFITPWNFPAAMITRKIGPALAAGCTVVAKSPGETPFTANAIMELGRRAGIPKGVVNLVTALKNTQELGMCLTTHPDIRKVSFTGSTNVGKLLMKQSSSTVKKLSFELGGNAPFIVFDDCPDVDAAVAGAIASKFRSSGQTCVCANRIYVQKGIYDEFAAKFAEKVRGFKLGYGFDEGVTHGPVIHSRAVDKVTQHVRDAEAKGGKVILGGKPASELGPNFFHPTVVTGMTKDMLMASEETFGPVAGLFPFETEKDVVEWANKAEVGLAGYFYSKDIRRIYRVAEALEVGMIGVNTGIISDTASPFGGVKQSGFGREGSKYGIDEFLSVKTITFGGMGGELQGHL

SEQ ID NO: 65519 - protein, 376 aa, Desulfovibrio vulgaris subsp. vulgaris str. Hildenborough
MSQRDYYEVLGVARDASEDDIKRAYRKLALQYHPDRNPDDPEAEQKFKEAAEAYDVLRDGEKRARYDRFGHAGVGNGGGFGQGFSSNEDIFAHFSDIFGDLFGFAGAAGGRSRGPRPQAGSDLRYNLTISFRQAAKGDEVTLRLPKSVPCDECGGSGAAPGTRPETCRHCGGAGQIRQSQGFFQIAMPCPVCRGEGTVITSPCPKCKGSGQTQQVKELSVRIPAGVDTGNRLRLRGEGEPGIHGGPAGDLYVVISVEDDKTFRRQGQDLVVTREISFVQASLGDRIDVPTLDDDITLDIPAGTQSGEVFRLVDKGLPYLGHGHTGDLLVEIRVVTPTRLTKKQEELLREFALLDEEKPLEKVKKMARKIGKAMGMD

SEQ ID NO: 65520 - protein, 836 aa, Geobacter metallireducens GS-15
MKAVIMAGGFGTRIQPLTSSIPKPMIPLLNRPIMLHIVELLKKYEITDLVMLLYHQPAVIKNFFRDGTDFGVKITYVTPLQDMGTAGAVKCAEKFLDERFLVISGDLLTDFNLQKIIDSHEDNKALATITLTSVKDPLQFGVVITDKEKRITQFLEKPGWGEVISDTINTGIYVFEPEIFAHIPEEENYDFSQDLFPKLLEQQKPLFGYTAKGYWRDIGNTDSYREAHHDIFKGKVNVKIDEAKQDLVGKDLRLGSDVNLDEHVTLEGTVVVGDNSQVFESAHIKDTVIGRNCTIEPGVRLNRCVIWDNVYVKKGAKLNDGVLCSNVRVGHGVVMEEGVIVADDTSIGEEAYIKRDVKIWPRKVIEAGATVTGNLIWGEKWKKSLFEGAMVKGLTNMELTPEFVAKLGCAYGTMLPKGSHIISGRDSYRSCRMLKRSFIGGLLSAGINVRDLTMVPMPVLRYKLRTFGEVGGIYFRQAIDDPASTEIVFLDGDGLDFSSSMGKNVERIFFKENFRRAHHTEPGALSEIPQQVTDFYREGFLHTIGKSPLQKKQFKVVIDFNHSSASQLLPGILTQMGCEVISLNAYVDEERGIQAVAERQQSLAQLSKIVATLEASAGFWLDPGTEGVIVVDETGKVYEGAELLPLMVGLALRSGEKGLFAVPVSAPSAIERMVQERGSAVTRTKSADRAMIEATLSSEVVLAGTMDGRFAFPKFQSAFDGMFAIAKTIELVAKGGLSISRVAAEIPQRVFLQTRVPCVWDMKGGIMRKMSEDSLDKEASFIDGIKVHFGEDWALVLPDQYLPYVHIVAEARDAKTAQKLLDEYKKKVEGWKRELQ

SEQ ID NO: 65521 - protein, 589 aa, Oryza sativa (japonica cultivar-group)
MRTMLPLLVILVVGLRLAGASPPPQPVACTKGTTDCTVTNVYGSFPDRTICRAADASFPRTEAELVAAVAAAAAAGRKAKAATRHSHSFPKLACPGGRDGTIISTRFLNRTVAVDAAARRITVESGVVLRDLIRAAAAAGLALPHSPYWYGLTVGGLLATGAHGSSLWGKGSAVHEYVVGLRIVTPAPASQGFAVVRELVAGDPDLDAAKVSLGVLGVISQVTFELQPQFKRSVRFVTRDDSDFAEKVAVWGGAHEFGDMAWLPRQGKVIYREDDRVDVATPGNGLNDYLGFRAQPTLGLITARAAEERLERNGTDIARCLAARLPPSLFELQAYGFTNDGVFFTGWPVVGFQHRIQASGTCISSPEDGLLSSCTWDPRIRGPFLYNSGFSIALPRAAAFVADMMRLRDLNPRAFCDIDAKLGILMRYVKASSAYLGKPEDCVDFDVTYYRSYDDGEPRPHSDVFDELEQMALRKYGAVPHWGKNRNFAFDGAAAKYPNSGEFIKVKERYDPDGIFSSEWSDQVLGISGSPNIVDKRCAIEGLCVCSDDSHCAPELGYFCRPGKLFKEARVCSKDKSAAAGDDDLLDEL

SEQ ID NO: 65522 - protein, 418 aa, Neisseria meningitidis FAM18
MNAAQLDHTAKVLAEMLTFKQPSDAVLSAYFREHKKLGRQDRHEIAETAFAALRHYQKISTALRRPHAQPRKAALAALVLGRSTNISQIKDLLDEEETEFLGNLKARKTEFSDGLNTAAELPQWLVEQLQQHWNEEEILAFGRSINQAAPLDIRVNTLKGKRDKVLPLLQAESADAEATPYSPWGIRLKNKIALNKHELFLDGTLEVQDEGSQLLALLVGAKRGEIIVDFCAGAGGKTLAVGAQMANKGRIYAFDIAEKRLANLKPRMTRAGLTNIHPERISSEHDSRIARLAGKADRVLVDAPCSGLGTLRRNPDLKYRQSAETVANLLEQQHSILDAASKLVKPQGRLVYATCSILPEENELQVERFLSEHPEFEPVNCAELLQSLKIDLDTGKYLRLDSAKHQTDGFFAAVLQRK

SEQ ID NO: 65523 - protein, 449 aa, Sulfitobacter sp. EE-36
MDRPLPARVALVNQPLGLLRSLAMARRNVLSIIPEIAVKQPMVSGKMGKRWHMVMDPTAIREMLLDRVDDYPKSLVTKNLLRPAIGDSLFIAEGAHWRWQRRAVAPAFSHRNMLNLSPIMTAAAQRSADRIAAAGPRAINMLDEMVTSTFDVISDVTFSGGGGFDRDAVHRAIDDYIAEAGKLSLFDILGLPDWLPRPGRAMSGRALKDMKRIADGAIDARAERGPSDTPDLLDLLLDGTDPKTKRQMNTAELRDNLLTFIVAGHETTALTLSWALYLMGFDQAVQQKARAEAQTVLQGRAATGADVENLPYIRQIIDETLRLYPPAGVISRTAQRNDTLCGREVRPGDTVMVPIYALGRHQQLWDQPDVFDPDRFKDRKAIDRYAYLPFGDGPRICIGASFAQQEAVIILATLLSRFRFTPVAGKSPEPVMILTLRPEGGVWLTATPA

SEQ ID NO: 65524 - protein, 496 aa, Pseudomonas putida GB-1
MPQLRDAVYWRGRSTDLVVEARAFIAGAYVGASEGETFAVCSPIDGRELAQVALCRGTDVERAVAAARGAFERGGWADLVPRQRKAVLLRWAALMREHAEELALLETLDTGKPIADTTAVDIPSSIYCLEWFAELVDKVTGEVPACDPQFLGTVTREPVGVVAAIVPWNYPLLMATWKFAPALAAGNSLILKPSEKSPLSALRIAGLARAAGIPEGVFNVVPGDGETGRLLSLHPQIDCLAFTGSGAVGRQISRNAADSNLKRVWLELGGKSANIVMADCPDLRRAAEAAAAAVFSNMGQVCSAGSRLLVQRPIAGAFIAELLEAARAYLPGDPLDPTSVTGSLIDEAQYQRVRQYIELGKREARLLLGGEDCAAVPGGHYLQPTIFATDATSRIAREEVFGPVLSVIEFDGLDDAIAVANASEYGLAAAFWSADLGAIRRASRRLRAGTVWVNCYDELLDMNFPFGGFKESGNGRDNSVHALDKYSELKSTIIRC

SEQ ID NO: 65525 - protein, 345 aa, Nocardia farcinica IFM 10152
MSTSAVSGSAVSGSSTVVAGVELGDAELAATVRNGLEEVEKLLIAELSDGEDFLQDAALHLAKAGGKRFRPLFTILTGQLGPRPTDPALITAGTVVELVHLATLYHDDVMDEATMRRGAPSVNSRWGNNIAILAGDYLFAHASRLTSTLGPDAVRIIAETFAELVTGQMRETMGARESQDPVEHYLRVVWEKTGSLIAAAGRFGGTFSGADTAHIERLARLGDAVGTAFQISDDIIDISSASEQSGKTPGTDLREGVHTLPVLYALREEGAEADRLRTLLDHPLHSDDEVAEALELLGRSQGMVLAKEKLQSYADQAYAELAALPSGPANDALEQLVRYTIERVG

SEQ ID NO: 65526 - protein, 484 aa, Listeria monocytogenes str. 4b F2365
MEHNKLKPFPKDFLWGSASAAYQVEGAWDEDGKGPSVWDEFVRIPGTTFKETNGDVAVDNYHRYKEDVALMAEQGLKAYRFSVAWSRVIPHGNGEVNEAGLKFYDNLIDELLSYGIEPVVTLYHWDIPQGLQDEYGGWESRKVVEDFTNYAALLFKRFNGRVKYWVTLNEQNVFISHGYKLAYHPPGVSDDKRMFAANHNANLANASAIAKFRELGTSGKIGPSFAYGPSYSIDANPANVLASENSEEFNAHFWMDVYTWGEYPTATWNWLEEHGLAPEILPGDTELLKKGKPDFMGVNYYRSMTHAFNGKDGVGSGKMNTTGEKGTSEETGVPGLYKNTNNPYLEKTNWDWDIDPTGLRIGLRRITNRYKLPIMITENGLGEYDSLTEDHKIHDEYRIEYIRAHALAIQEAITDGVEMLGYCTWSFTDLLSWLNGYQKRYGFVYVDRDENDEKELKRYKKDSFYWYKKTIEANGANLVEEQGK

SEQ ID NO: 65527 - protein, 309 aa, Bacillus cereus ATCC 14579
MQCIETNNLQQLLEQVKPYTKKGKLATYIPELGNANPDDLGIAIFHKETEYIHAGNSQTLFTLQSISKVITLALALLDRGEEYVFSKVGMEPTGDPFNSIIKLETTSPSKPLNPMINAGALAITSMLEGKDNEEKMERILHFVREITDNPTINYSSKVADSELETAYLNRSLCYYMKQNGIIDCDIEELMDLYTRQCAVEVNCIDLARIGLIFAMDGYDPYKKKQIIPKHITKICKTFMVTCGMYNESGEFAIRVGIPAKSGVAGGIFGCVKGDMGIGIFGPALDANGNSIAGFKILELLSAQEGWSIF

SEQ ID NO: 65528 - protein, 329 aa, Chlamydophila abortus S26/3
MRSPTTSIDLCQDIVSKQRESLERFFGAFQCEDTWVLAEKILHHQGSIFFSGVGKSGCIARKIVATLQSFGEHALFLASGDLLHGDLGVVRPGDIVCLFSKSGETRELLECIPYLKERGVFIAGITSATYSSLAVLCDHVVILPMIEELDPFNLVPTTSTTCQLLFGDLLAITLLRSRQISLADYGKNHPGGQIGLKVIGKIRDYMFLKTEVPFCSPEDTIADSLDIFSSYGCGCVCIVNEKFEILGIFTDGDLRRALARHGGDILSQRLQDVMTPNPRVISEDADVLLGLQMMETGSPVTILPVVDAKDQKYVVGLLQMHTLAKAGLI

SEQ ID NO: 65529 - protein, 441 aa, Gibberella zeae PH-1
MKSVVFKGVKQVALEDRPKPMIQDPTDIIVKVKYTAFELHVFRGHQPSGTGFIMGHEFTGVIDQVGSAVKSLEVGDAIVSPFTVSCGECFFCKRGYSSRCDKSLLFGTVLLDGAQAEYVRIPYAQSTVMKAPKEVEDLKLCLMADIFPTGCYAASNGLDSLDKERVQESIVVLIGCGPVGICALIAALEYKPKAILAVDGIESRLSLAKDLGAEPWNYLTQKQDLEKRVKDLSDGRGADVIIEVVGHSSALDMGFKLLRPWGIISSVGVHNGEIPWTGNEAYGKNLTIKMGRCPVRSIFENSLKLLAKKQHLLEFMTATVMPLSNAPEGYELFDSMKVQKVIFDAEKIRSAFLMIKPDVASSDATDIRFEMKRNGDSYILNGILSSGSDDLRCDVYIVVGKIDASNPNTHRRQFVFLVPVRFPGVAVHHILNVFSAGRTLS

SEQ ID NO: 65530 - protein, 384 aa, Ostreococcus tauri
MLSTPRARAAPRAARATPGAGRRGEGSRRIGRARAVSEPKPASEIDWNAIGFGLTPTSHMFVATCDLGGTWSAGEVVPFGNLSLSPAAAVLNYGQGVFEGMKAFRTKDDELLVFRPDENAARCEEGSLRMSMPPVPRDLFQQAVMKTISANADYVPPVGLGSLYLRPLLIGTGAILGLGPAPSYTFLVYCSPVASYFKGGQLTPIDLTVEETYHRAAPGGSGSTKCIGNYSPVLKVQLEAKRQGFSDVMYLDARENKYIEEVSSCNFFCVKGNTISTPALQGSILPGITRKSICEMAAARGFKVEERNVSIEEVMDADECFCTGTAVVVAPVGSITYKGKKAQFCDGKTGPVTQAMYDELTGIQQGRIPDERGWNVKVPKDFHL

SEQ ID NO: 65531 - protein, 118 aa, Buchnera aphidicola str. Bp (Baizongia pistaciae)
MNYIQKYEKKQIKKTIPIFKSGDTIIIKVWIVEGTKKRIQLFEGIVIAIRNRGFNSSFCVRKVSNGEGIERVFPKYSPIIEEIIVKRHGDVKKSKLYYLRNRIGKSAKIRELISKKTS

SEQ ID NO: 65532 - protein, 446 aa, Silicibacter sp. TM1040
MPTEILMPALSPTMEEGTLAKWLVKEGDTVSSGDLIAEIETDKATMEFEAVDEGVVGKILIAEGSEGVKVNTPIAVLLEDGESADDIDTSAATPEAAPAADAAAEEAPAAAEKAAAPAAATPAPAAPAAADGSRIFASPLARRIAADKGLDLSAIKGSGPRGRIIKVDVENATAAPKADAQTDAQAAAAPAASASPAPVAAPAGPSADQVAKMYEGRSFEEVKLDGMRKTIAARLTEAKQTIPHFYLRRDIQLDALLKFRAQLNKQLEGRGVKLSVNDFIIKAVALALQSVPDANAVWAGDRVLKMKASDVAVAVAIDGGLFTPVLQDADMKSLSALSSEMKDLATRARDRKLAPHEYQGGSFAISNLGMFGIDNFDAIVNPPHAGILAVGSGVKKPVVGADGELTVATVMSVTMSVDHRVIDGALGADLLKAIVDNLENPMVMLA

SEQ ID NO: 65533 - protein, 458 aa, Silicibacter sp. TM1040
MATEILMPALSPTMEEGTLAKWLVKEGDTVNSGDILAEIETDKATMEFEAVDEGIVGKILIDEGSEGVKVNTPIAILVEEGESVEDAVSSAAAPAAEAPAAEAAAPAPVAAAAATPAAPEVDESPDYPEGTEMVSQTVREALRDAMAEEMRSSEDVFVMGEEVAEYEGAYKITQGLLDEFGSKRVIDTPITEHGFAGIATGAAFGGLRPVVEFMTFNFAMQAIDHIINSAAKTLYMSGGQMGAPMVFRGPNGAAARVAAQHSQDYAAWYMQIPGLKVAMPYSAADAKGLLKSAIRDPNPVIFLENEILYGKSFEVPKLDDYTVPFGKAKIWRKGDDVTIVSFGIGMTYALDAADKLAEDGINAEVIDLRTLRPMDLPTVIKSVMKTNRLVTVEEGWPQGSVGSYIASEVMQQAFDYLDAPVAVCTGKDVPMPYAANLEKHALITTDEVIEAVKQVTYR

SEQ ID NO: 65534 - protein, 348 aa, Bacillus subtilis
MLNIIRLLAESLPRISDGNENTDVWVNDMKFKMAYSFLNDDIDVIERELEQTVRSDYPLLSEAGLHLLQAGGKRIRPVFVLLSGMFGDYDINKIKYVAVTLEMIHMASLVHDDVIDDAELRRGKPTIKAKWDNRIAMYTGDYMLAGSLEMMTRINEPKAHRILSQTIVEVCLGEIEQIKGKYNMEQNLRTYLRRIKRKTALLIAVSCQLGAIASGADEKIHKALYWFGYYVGMSYQIIDDILDFTSTEEELGKPVGGDLLQGNVTLPVLYALENPALKNQLKLINSETTQEQLEPIIEEIKKTDAIEASMAVSEMYLQKAFEKLNTLPRGRARSSLAAIAKYIGKRKF

SEQ ID NO: 65535 - protein, 175 aa, Glycine max
  misc_feature (121)..(121): Xaa can be any naturally occurring amino acid
MESTFIMIKPDGVQRGLIGEIISRFEKKGFYLKALKLVNVERSFAEKHYADLASKPFFQGLVDYIISGPVVAMVWEGKSVVTTGRKIIGATNPLASEPGTIRGDFAVDIGRNVIHGSDSIXSANKEIALWFPEGPADWQSPHPPGSEKENWEVSPQPGRPKKSGPFWCLKGSKKN

SEQ ID NO: 65536 - protein, 157 aa, Geobacillus kaustophilus HTA426
MNKGLKTALATIALAQFLKIPIKQLETGRWDWRLFFETGGMPSSHSAGVSALATFIALERGVRTIDFALAALFGLIVMYDAQGVRRQAGELALRLNELAEEVKKLEGDPKQTVYHKRQRQLRARLGHEPIEVVGGALLGMATGALSYWACRRRKRMV

SEQ ID NO: 65537 - protein, 415 aa, Ehrlichia ruminantium
MIKKAAVELDDQKITLPILYDTEGNEVLDITSLYKNTGVLTYDPGFMSTAACESKITFINGNKGILRYRGYDIADLVYNNKSFIEVVYLLFYGVFPNAEQLQEFMLHISQEYVLPQMVRNVIMSFPQNSHPMAILIASFSSLAAYYCDQKTDGELECKLAVAKVASIVALIYRHITNQDFIQADVGLSYSKNFIHMMFDISSYKFTEIVDKALDVIFVLHADHEQNASTATVRMAGSSGPNLFACLAAGAATLWGPAHGGANEAVINMLMNIGKPENVKQFIQKVKDSNKGTKLMGFGHRVYKNYDPRARIMCTICKEILKDFGLNDPLLEVAVELENIALQDDYFIARNLYPNVDFYSGIVLKTIGIPVKMFTTLFALARTSGWSAQWYEMVSSKNYKISRPRQLYTGNPVQKV

SEQ ID NO: 65538 - protein, 170 aa, Triticum aestivum
  misc_feature (126)..(126): Xaa can be any naturally occurring amino acid
  misc_feature (145)..(145): Xaa can be any naturally occurring amino acid
MAFSEAQEELVLRSWKAMKPDSESIALKFFLRIFEIAPAAKPMFPFLRDAGEDAPLESHPKLKAHAVTVFVMACESATQLRKTGDVKVREATLRRLGATHVRAGVADAHFEVVKTALLDTIEGAVXPEMWTLEMNAAWEEAYDQXLAAAIKEEMKLAAAGLMWHAWSLLS

SEQ ID NO: 65539 - protein, 490 aa, Pseudomonas putida GB-1
MAGTSLPMPSMRPKCRRSGLLCSGFANGWLRGTDSTDPGQITNPGNDRNRIIRLRNTPPTRLDNKKLEQRPRVPMNQESISQSIAIVHPITLSHGRNAEVWDTDGKRYIDFVGGIGVLNLGHCNPAVVEAIQAQATRLTHYAFNAAPHGPYLALMEQLSQFVPVSYPLAGMLTNSGAEAAENALKVARGATGKRAIIAFDGGFHGRTLATLNLNGKVAPYKQRVGELPGPVYHLPYPSADTGVTCEQALKAMDRLFSVELAVEDVAAFIFEPVQGEGGFLALDPPFAQALRRFCDERGILIIIDEIQSGFGRTGQRFAFPRLGIEPDLLLLAKSIAGGMPLGAVVGRKELMASLPKGGLGGTYSGNPIACAAALASLAQMTDENVATWGERQEQAIVSRVERWKSSGLSPYIGRLTGVGAMRGIEFVNADGSPAPAPLAKVMEAARAKGLLLMPSGKARHIIRLLAPLTIEAEVLEEGLDILEQCLTELN

SEQ ID NO: 65540 - protein, 388 aa, Bacillus cereus ATCC 14579
MIKNPKVLILTAHYGNGHVQVAKTLEQTFRQKGIEDVIVCDLFGESHPFITDITKYLYLKSYTIGKELYRLFYYGVEKIYDKKIASWYANFGRKRLKTLLQVEKPDIVINTFPIIAVPELKKQTGISIPVYNVLTDFCVHKIWIHREVDRYFVATDHVKELMVDIGVPAEQIVETGIPIRSSFELKVNPEIIYTKYQLCKNKKILLIVAGAHGVLGNVKELCQSFMSVPNLQVVVVCGKNEALKQDLLSLQKQNSDALKVFGYVENIDELFRVTSCMITKPGGITLSEAAALQVPVILYKPVPGQENENAMYFERKGAAVVIRDDSEVFAKTEALLQDDVKLLQMKEAMKSIYLPEPAGHIVDAILAENHAEPRHIPIKSPALAQSFT

SEQ ID NO: 65541 - protein, 574 aa, Shewanella oneidensis MR-1
MHESQLTTSAAKPSRLGWFDDVLLLGIMAVLAGCGLIYEYLLSHYAGRILGALEAAIYTMIGLMIVSMGLGAFAARKIKDAFTGFVVLELTVALCGSLAILITAAVIGFGQQLPMLIASTLGLPPDQLPEGGMIGTLQKLSEYLPYFWGVLLGLMIGMEIPLIARVRQSLSDEHLLHNAGTIYGADYIGAGIGAAIWVGFMLAIDIQLAAALTASFNLLAGFVFIWRFWQKIQRPKLLLAAHLVVTGVLLLLAIQGPSWEQQFNNLLYKDKVVYAKATRFQQLTFTERLRGNGLSPVYALYINGRLQFSSSDEHIYHAFLVHPTLAASARHNKVLIIGGGDGLGLKQVLRWEPEQVTLLDLDAALVQLFKSPDPDMPERLSQALLSLNGNAFNDPRVTVIHDDAFNGVDKLIAKGDKYDAIIVDLPDPSHPDLNKLYSDYFYRKLKELISNDGALTVQSTSPYHAQKAFISVAKTLALAGFDVKQYHHNVPSFGEWGWSIATLDGKDAQHRLAQLTKLPIADDWLTLGLVKGAFEFPANFYQDATNIKPNELGSLQLYHYHQQAWSETQGLDLF

SEQ ID NO: 65542 - protein, 882 aa, Methanosarcina barkeri str. Fusaro
MSKFVYFFGKDVTDGKASMRDLLGGKGAGLAEMANLGIPVPPGFTITTEVCVLYLKGKKYSEEVLKQVEEAIDKLETLNNKKLGDPEDPLLVSVRSGARVSMPGMMDTVLNLGLTDKSVLGLANKVNDERFAYDCYRRFISMFGDVVLGIDFDKFESLIEDKKKELKVESDTDLDAKALKDLAERFKGVIKLEKGFEFPQDPKVQLQMAIDAVFDSWNNPRAITYRKLNEIDDSWGTAVNVQTMVYGNRGNTSGTGVAFTRNPSTGERKFFGEYLINAQGEDVVAGIRTPDFIDTLGNKIPEAYNQLVDICRKLEAHFKDMQDIEFTIQEGKLYMLQTRTGKRTAAAAVKLATDMVAEGLIDKETAVTRVKAEHIDLLLHPRIDPNAKLEVVAKGLPASPGAAVGKVVFTAEVAEEMAEKGEKTILVRTETSPEDIGGMAAAQGVITVRGGMTSHAAVVGRGMGKPCVVGCGDISIDTKSNLFMVNGYTVKEHDYVTIDGSTGSVIIGKVELIDAEINEDLKKILQWADEIRTLGVRTNADNPADAGLARELGAEGIGLCRTEHMFLGEERIPVVREMIMAEDEKSRRKALKKLLPMQKEDFLGIFRSMEGLPVTIRLLDPPLHEFLPDKEELDAKLRELEASGDSSGKINEVKKVIQRVVSLKEINPMLGHRGCRLGITYPEIYDMQVRAIMEAACELTNEGMKITPEIMIPLVGLVKELAITREEVCKMAEAVMAEKGVKIDYKVGTMIELPRAAIVADQIAQEADFFSFGTNDLTQTTFGFSRDDVSKFVPIYQKAGIIEHDPFAVLDQEGVGEIMKIGISKGRSVKPDLKMGICGEHGGEPRSIHFAYDIGLNYVSCSPYRVPIARLVAAQSTIESRK

SEQ ID NO: 65543 - protein, 218 aa, Buchnera aphidicola str. Bp (Baizongia pistaciae)
MKTNELKRLVARKVVDYINPGSVIGIGTGSTVSYFIEVLSTIKNLISGAVSSSNFSTACLKRIGIPIYDLSKINSLVLYIDSADEINPQLQMIKGGGAALTREKIIAATAEKFICIADESKQVEILGKVPLPIEIIPMARSYISNEIIKIGGMPKYRKNVITDNGNVIIDVFNLVITDPVCLENKINSFPGVVSVGLFATRKADIALIGTSSGVQVIY

SEQ ID NO: 65544 - protein, 310 aa, Zea mays
  misc_feature (84)..(84): Xaa can be any naturally occurring amino acid
METTEPLQDIMCEFRAGKMSHEGTRVVPDTRKGLVRVGRGEEGLVHFQWLDRGQNIVEDDQIIFPDEAVFEKVTESPGRVYILXKFKQDSRKFFFWMQEPNADGDSQTCMQVNAYINRSLDAEADLRVPIEAEMSEDTADDDISSRAGNLVESMTADLAGEVTSAAGPVRLEDLQRILSAIQSSGAAADPDAGVGLGDILKPDLVLPLIEDLPIEQLASHLPEGGSWSPGDIVELLQSPPLRQQLDAFTHVLRTGQIDLAQFGVDPDKYKFTVVSFLEALEDSVGRGASEAGDKDAEVERGSGNDAMDES

SEQ ID NO: 65545 - protein, 280 aa, Brassica napus
MSHFGRSGPPDISDTYSLLVLNITFRTTADDLYPLFAKYGKVVDVFIPRDRRTGDSRGFAFVRYKYKDEAHKAVERLDGREVDGREITVQFAKYGPNAEKISKGRVVEPPPRSRRSRSRSPRRSRSPYRRRSPRRSRSPRRRSRDDYRERDYRKRSRSRSNERGRDRHHDKDRDYRRRSRSRSASPDDKRRVRGRYDDERRSRSCSLSASPARRSPSPRSASPLKASPERRSKERSLTPASRSRSPRSPSLEKASPERKSNDRSPSPRDTARSQSPNAEE

SEQ ID NO: 65546 - protein, 396 aa, Silicibacter sp. TM1040
MGWKTLDDMDLQGKSVLTRVDINVPMEDGKVTDDTRIRRLVPTISDLLSKGAKPVLLAHFGRPKGKVVPEMSLQPLVPALEAAFGAPVMFVADCRGPAAKGAVDALAPGQILLLENTRFYPGEEQNDADLAKEMAALGDIYCNDAFSAAHRAHASTEALARLLPACAGRLMEAELKALEGSLATPERPVTAVVGGAKVSTKLDLLGNLVAKVDTLVIGGGMANTFLAAQGIDVGKSLCEHDMTGTAKDIMARAEAAGCTILLPSDVVVAREFKAGADNETVPADACPADAMILDAGPASVAAISTVFAESKTLIWNGPLGAFEIAPFDIATNTAAQKAAELTKAGQLISVAGGGDTVAALNQAGAAEAFSYISTAGGAFLEWMEGKVLPGVAALQT

SEQ ID NO: 65547 - protein, 425 aa, Marinobacter sp. ELB17
MKLRLKTQVGKVMSASKQPPYDLLVFGATSFVGQILTQYLYDTHGVGGDVSWAIAGRSQSKLETLRNQLGSGAADLPLLVADATDEPALQALCMRTRVIISTVGPYALYGEPLIKACVETGTDYCDLTGEVQWIGKMVSRYEAAAKESGARIVHCCGFDSIPSDMGVWFLQQQAESAFGSVCLDVRMRLKAAKGTLSGGTVASMINIAKEMAADPELRRSMANPFSISPTGHRSKTRQPSLKGPGFDKTLNSWLAPFVMGAINTRVIHRSNALQNARYGQEFTYDEAVMTGRGVKGRLVAYGITAALAGFFMGSAVKPTRWAIEKFVPQPGEGPSPDAQQAGFFDIRFVGKTADGRTIITRVKGDRDPGYGATSRMLGEAATCLAFDIPKNRDGGFWTPASLLGQPLLERLTSRAGLSFDVLETR

SEQ ID NO: 65548 - protein, 441 aa, Lactococcus lactis subsp. lactis Il1403
MNLLSKEEKMIKNSQIPSEFYKKYNVKKGLRDINGKGVLAGLTNISAIHSFDKEGNQIPGILEYRAYNIKDIINDLRKENRFGFEEMTYLLLFGELPTANELQEFQNLLASRRTLPEFFIRETILTNPSSDVMNSMSRCILALASYDEKVSDISIENVLEQSFGLIADFPLLAIYSYQSYVHYFKKESLYIHYPDPKMTTAENILRMLRPDCHYTEVEAKVLDIALILHMEHGGGNNSTFTTHVVTSSGTDTYATIAAALSSLKGPKHGGANIKAAKMLENIKENISNYEDDAEIEKYLHKILNKEVFDKQGLIYGIGHAIYSLSDPRFEVFKSYVETLVKEKGLEEEFKLYEKVARLAPKVISENRKIYKTICPNVDFYSGFVYRILEIPQELFTPLFAIARIVGWLAHRIEELINMNKIIRPAYESVLESKNYIKLGER

SEQ ID NO: 65549 - protein, 453 aa, Zea mays
MASTAARRLRELQAQTGNKTCVDCAQRNPQWASVSYGVFMCLECSGKHRGLGVHISFVRSVTMDSWTEAQLRKMEAGGNDRLNAFLTARGVPKETSHVAKYNSNAAAAYRDRIAALAEGKPWTDPPVVKETPGSGAPAPARKPPLHASGGGGGWDDWDDDFRSDMRRNQSVGSFAAAGAQSGRQPPRSKSTQDIYTRQQLEASAANKDDFFARRMAENESKPEGIPPSQGGKYVGFGSSPAPSANRNGGAAQGDVLQVVSQGFGRLSLVAASAAQSAASVVQVGTKEIQSKMRDGGYDQKVNETVSVVANKTAEIGSKTWGIMRGVMAMASQKVEEYAKEGGMSGWGEDWQRSEQNGEPYQRFEHATNSNSWNSSQNSSSKNNNSSSWDDWDDQGKKGEPAKPHQSSDSWAGWDDGKDDGFDSPGYNNHNSSNKGSNHNGTSGGSFWREGGFR

SEQ ID NO: 65550 - protein, 398 aa, Neisseria meningitidis FAM18
MQNYLTPNFAFAPMIPERASGSRVWDTKGREYIDFSGGIAVNALGHCHPALVDALNAQMHKLWHISNIYTTRPAQELAQKLVANSFADKVFFCNSGAEANEAALKLARKYARDRFGGGKSEIVACINSFHGRTLFTVSVGGQPKYSKDYAPLPQGITHVPFNDIAALEAAVGEQTCAVIIEPIQGESGILPATAEYLQTARRLCDRHNALLILDEVQTGMGHTGRLFAYEHYGIVPDILSSAKALGCGFPIGAMLATEKIAAAFQPGTHGSTFGGNPMACAVGSRAFDIINTPETLNHVREQGQKLQTALLDLGRKTGLFSQVRGMGLLLGCVLDEAYRGRASEITAAALKHGVMILVAGADVLRFAPSLLLNDEDMAEGLRRLEHALTEFAATSDNP

SEQ ID NO: 65551 - protein, 311 aa, Zea mays
MMVKEEEMMAEAGGGRGYMDLLGLGEEDYLLCLSPPSYFTPSVVSATATTTAAASASTCCAASYLDLDLAPAYHHTLSFGGQDQEQQHHGDDGALGFQHYGGDHAIPAAAAAVQQKSSPTTECSSSLSSMSPSPPATAVSAAVSCPKPQAFKKKKAGSRSSEQREAASAAAPAATTNKRPRVRRERLGERIVALQQLVSPFGKSDTASVLHEALGYIRFLHDQVQVLSTPYMQMQRQPASAHVPESAAGTVVEAQEQPDLRSRGLCLVPVSCTEHIAGNDSHGNGADLWSSVLLPLPLPGGGSHPSQGRLA

SEQ ID NO: 65552 - protein, 146 aa, Glycine max
LNKFKDSLTSSLVAQAIDSRKHEAQTRRLLTFFLWSCKNLSHRLEDKDYNHALRVFAEKKDYTAMDILMGDLKKEGRAMDAETFSLVAENLVKLGKEDEALGIFKNLDKYKCSIDEFTVTAIVNALCSKGHGKRAEGVVWHHNDKI

SEQ ID NO: 65553 - protein, 509 aa, Mycobacterium avium 104
MTLPTADELRARAADALRSLGAHVELGAPDAHGLPASTPITGEVLFTVAPTTPDQAEHAITQAAQAFSEWRRTPAPVRGALVARLGELLRAHRDELAALVTLEVGKITSEAAGEVQEMIDICQFAVGLSRQLYGRTIASERPGHRLSETWHPLGVVGVITAFNFPVAVWAWNAALALVCGDTVVWKPSELTPLTALATQALIARAAADVGAPPGVSAVVLGDRELGELLVDDERVALVSATGSVRMGRAVGPRVAARFGRVLLELGGNNAAVVTPSADLDLAVRAVVFAAAGTAGQRCTTLRRLIVHHSVADEVVARVVSALRRLPIGDPFEPGTLVGPLIHETAYRDMVGALESARADGGEVIDGDRRHPFAVEHPSSYYVAPAVVRMPAQTPIVATETFAPILYVLTYDRLDDAIALNNAVPQGLSSAIFTTDLREAERFLDESDCGIANVNIGTSGAEIGGAFGGEKQTGGGRESGSDSWKAYMRQSTNTVNYSGALPLAQGVEFG

SEQ ID NO: 65554 - protein, 290 aa, Alkalilimnicola ehrlichei MLHE-1
MFHGSMVAMVTPMHPDGAVDEVSLARLVDYHVEHGTDAIVAVGTTGESATLDYDEHCHVMRKVVEAARGRIPVIGGTGANSTWEAIKLTRCAMEGGCDATLLVVPYYNKPTQDGLYRHFAAIADAVAIPQILYNVPGRTACDLLPDTVDRLADISNIVGIKEASTIERVHDLVERCSDRLDVFSGEDGLSREAVLAGAKGVISVTANVAPQQMHDMVAAALRGDEEEASRIDARLAALHSALFLESNPIPVKWAVSQMGLCGPSIRLPLTELSEQHHETVRQAMKLAGSL

SEQ ID NO: 65555 - protein, 318 aa, Pseudomonas fluorescens PfO-1
MKLALVGDIGGTNARFALWKDQQLESVQVLATADHASPEEAISLYLSKLGLAPGAIGSVCLSVAGPVSGDEFKFTNNHWRLSRKAFCQTLQVEQLLLVNDFSAMALGMTRLQPGEFRVVCEGTPEPLRPAVVIGPGTGLGVGTLLDLGEGRFAALPGEGGHVDLPLSSPRETQLWQHIHNEIGHVSAETALSGGGLPRVYRAICAVDGHEPKLDTPEAITAAGLAGDPIALEVLEQFCCWLGRVAGNNVLTTGGRGGVYIVGGVIPRFADFFLESGFARSFADKGCMSDYFKGIPVWLVTAPYSGLVGAGVALEQSGQ

SEQ ID NO: 65556 - protein, 353 aa, Arabidopsis thaliana
MATCWPEPIVSVQSLSQTGVPTVPNRYVKPAHQRPVFNTTQSDAGIEIPVLDMNDVWGKPEGLRLVRSACEEWGFFQMVNHGVTHSLMERVRGAWREFFELPLEEKRKYANSPDTYEGYGSRLGVVKDAKLDWSDYFFLNYLPSSIRNPSKWPSQPPKIRELIEKYGEEVRKLCERLTETLSESLGLKPNKLMQALGGGDKVGASLRTNFYPKCPQPQLTLGLSSHSDPGGITILLPDEKVAGLQVRRGDGWVTIKSVPNALIVNIGDQLQILSNGIYKSVEHQVIVNSGMERVSLAFFYNPRSDIPVGPIEELVTANRPALYKPIRFDEYRSLIRQKGPCGKNQVDSLLLTR

SEQ ID NO: 65557 - protein, 333 aa, Pseudomonas fluorescens PfO-1
MTLRIAINGFGRIGRNVLRALYTQGYRQDLQIVAINDLGDSAINAHLLKYDTVHGTFDAEVAHDNESLTVNGDRISVSAIRNPADLPWAAEKIDVVFECTGLFTDRAKAAAHITAGARKVIISAPAKGADATVVYGVNHDILRQSHQIISNASCTTNCLAPVAQVLHRELGIESGLMTTIHAYTNDQNLTDVYHTDPYRARSATQNMIPSKTGAAEAVGLVLPELAGKLTGMAVRVPVINVSLVDLTVQLKREASADEVNALMKAASQHSKILGFNTLPLVSSDFNHNPLSSIFDANHTKASGKLLKVLAWYDNEWGFSNRMLDNCLALCNAE

SEQ ID NO: 65558 - protein, 156 aa, Glycine max
WIVFDEVHYMRDRERGVVWEESIVLSPKNSRFVFLSATVPNAKEFADWVAKVHQQPCHVVYTDYRPTPLQHYLFPSGGDGLYLVVDEKGKFREDSFQKSLNALIPATEGDKKKENGKWQKGLVLGRSGEESDIFKMVKMIIQRQYDPVILFILAER

SEQ ID NO: 65559 - protein, 431 aa, Buchnera aphidicola str. Bp (Baizongia pistaciae) [sequence omitted]

SEQ ID NO: 65560 - protein, 579 aa, Oryza sativa (japonica cultivar-group)
MAAGRAFLRAAPSSLAAGAGRFAFACPTALPLTAAAAAATGPHRRGRGRCYCSASDAPPPPPYVLTTPLYYRLLDKRVVFITGTDEHGEKIATSAEACGRNPKDHCDTISNSYKMLWADLDIEYDKFIRTTDRKHEAVVNDFYSRVLDSGDIYRADYEGLYCVSCEEYKDEKELGENKCCPVHLKPCVPRKEDNYFFALSKYQHQLEDLLTKNPNFVRPSHRLNEVQGWVKSGLRDFSISRASVEWGIPVPNDTKQTIYVWFDALLGYISALLDDGEKASLQQAVERGWPASLHLIGKDILRFHAVYWPAMLMSAGISVPDAVFGHGFLTKDGMKMGKSLGNTLEPKDLVNRFGVDSVRYFFLREVEFGNDGDYSEERFINIVNAHLANTIGNLLNRTLGLLKKNCKSTLAFDSIAAADGISLKDNVENLVDKAKDQFENLLLSSACETLMEIGNLGNLYIDEQAPWSCFKQGGESAEKAAKDLVIILETMRIIAIALSPITPSLSLRIYTQLGFTEDQFRTLRWEDTKWGGLKAGQVMMEPKPVFARIETETDEKDQSSSKATKGGKKKARSQGLVEA

SEQ ID NO: 65561 - protein, 870 aa, Burkholderia vietnamiensis G4
MRRAEESQLKSSAPDQIVLLAPLSGPIVALADVPDPVFAGGMFGDGIGIDPLAGRLVAPCAGVVSHLARTGHAVTITSPQGAQVLLHIGIDTVELNGQGFTARVEDGAHVAPGDLLIEFDQDVVARSAHSLVSVIAIANSDAFDVVERASGFATAGETPLLTLRANGAAAGQATQAAHATATATSAHEVRRQIVLTQPGGLHARPAARARESVRGFDATVDVQFDGRHASIASVVGLLGLGAGEGATVELIGRGAHAQQAVDAVARELLREAHGEVEETPARLRSPAPPTLRHDDGAARAGAPLDPNTLAGVCAAPGIAVGTLVRLDDADIVPPEPASGTPASESRRLDQALKAVDAELGETVRNASARGAVGEAGIFAVHRVLLEDPTLVDAARDQISLGKSAGFAWRATIRAQIDTLSRLDDALLAERAADLRDIEKRVLRALGHTSGATRALPDEAVLAAEEFTPSDLSSLDRERVTALVMARGGATSHAAIIARQLGIPALVAVGDALYAIPDGTQVVVDASAGRLEHAPSAVDVERARHERERLEGVREANRQHAREAAATADGRAIEVAANIATLDDANTALDNGADSIGLLRTELMFIHRQTAPSVVEHRQSYQSIVDALQGRTAIIRTLDVGADKEVDYLTLPPEPNPALGLRGIRLAQVRPDLLDDQLQGLLAVKPFGAVRILLPMVTDAGELVRLRARIDEFARAQGRTEPIEVGVMIEVPSAALLADQLARHADFLSIGTNDLTQYTLAMDRCQADLAAQSDGLHPAVLRLIDIAVRGAAKHGKWVGVCGALGGDPLAVPILVGLGVTELSVDPVAVPGIKARVRRLDYQLCRQRAQDLLALDSAQAVRAASREVWPLD

SEQ ID NO: 65562 - protein, 1059 aa, Shewanella oneidensis MR-1
MFKASEVLAGRYDSANLDELFKAVTDNYIVDEEQYLSELIKLVPSSDEAIERVTRRAHELVNKVRQFEKKGLMVGIDAFLQQYSLETQEGIILMCLAEALLRIPDAATADALIEDKLSGAKWDEHLSKSDSVLVNASTWGLMLTGKIVSLDKKIDGSSSNLLGRLVNRLGEPVIRQAMMAAMKIMGKQFVLGRTMKEALKNSEDKRKLGYTHSYDMLGEAALTRKDAEKYFTDYANAITELGAQSYNESESPRPTISIKLSALHPRYEVANEDRVLTELYDTVIRLIKLARGLNIGISIDAEEVDRLELSLKLFQKLFNSEATKGWGLLGIVVQAYSKRALPVLVWLTRLAKEQGDEIPVRLVKGAYWDSELKWAQQAGEAAYPLYTRKAGTDVSYLACARYLLSDATRGAIYPQFASHNAQTVAAISDMAGDRNHEFQRLHGMGQELYDTILSEAGAKAVRIYAPIGAHKDLLPYLVRRLLENGANTSFVHKLVDPKTPIESLVVHPLKTLTSYKTLANNKIVLPIDIFGSDRKNSKGLNMNIISEAEPFFAALDKFKSTQWQAGPLVNGQPLTGEHKTIVSPFDTTQTVGQVAFADKAAIEQAVSSAHAAFGSWTRTPVEVRASALQKLADLLEENREELIALCTREAGKSIQDGIDEVREAVDFCRYYAVQAKKLMSKPELLPGPTGELNELFLQGRGVFVCISPWNFPLAIFLGQVSAALAAGNTVVAKPAEQTSIIGYRAVQLAHQAGIPTDVLQYLPGTGATVGNALTADERIGGVCFTGSTGTAKLINRTLANREGAIIPLIAETGGQNAMVVDSTSQPEQVVNDVVSSSFTSAGQRCSALRVLFLQEDIADRVIDVLQGAMDELVIGNPSSIKTDVGPVIDATAKANLDAHIDHIKQVGKLIKQMSLPAGTENGHFVAPTAVEIDSIKVLEKEHFGPILHVIRYKASELAHVIDEINSTGFGLTLGIHSRNEGHALEVADKVNVGNVYINRNQIGAVVGVQPFGGQGLSGTGPKAGGPHYLTRFVTEKTRTNNITAIGGNATLLSLGDSDA

SEQ ID NO: 65563 - protein, 236 aa, Buchnera aphidicola str. Bp (Baizongia pistaciae)
MILSYIFIMYLVDTIDYQKICCIIKTFEDNILFQKNYHSTWFLKSIANIQKEKYNYGLEVAFVGYSNSGKSSIINALTNQKKLAKISRTPGRTRLINIFSVTSEIRLVDFPGYGYAQVSRSISKKWKEMIFQYLNIQKCLQGLVIITDIRCPIKEIDELVINLAVSLNIPILLLLNKMDKVTRSIQKSKLFSTREKMLNFSNNINVELFSSFKKIGIHKLQFVLNNWFSSDKKLCQ

SEQ ID NO: 65564 - protein, 514 aa, Zea mays
MAGGVVVNAAGGKTYPGRMTPFVFFTCLVASSGGLIFGYDIGISGGVTSMASFLKEFFPSVYAKAAANKDTNQYCKFDSQLLTLFTSSLYLAALATSFVAASVTRVFGRKWSMFCGGVTFLAGSALNGAATDVMMLIMGRILLGVGVGFANQSVPLYLSEMAPAKLRGMLNIGFQLMTTIGILAANLINFWTAGIEGGWGWRIGLGLAGVPALIITLGALVLPDTPNSLIARGFNDDAKAVLVKIRGTDDVQDEYDDMVAASEEANAIEHPWRNILERRYRPQLTVAALIPFFQQLTGINVIMFYAPVLFLTIGFGDDASLMAAVITGLVNMFATVVSIVCVDRLGRRALFLQGGTQMFVSQIVVGTLIALQFGTAGVGEMSRSNAWLLVLFICLYVAGFAWSWGPLGWLVPSEVFALEVRSAGQSIAVCVNMLLTFIIGQAFLSMLCSLKFGLFYFFAGWMFIMTTFIALFLPETKGVPIEEMNLVWSRHWFWGKYVNVDTQHGGASPRSNGV

SEQ ID NO: 65565 - protein, 368 aa, Xylella fastidiosa Dixon
MSKRDYYQVLGVPRTASEDDLKKAYRRCAMKYHPDRNPGDAAAEAAFKECKEAYEVLADTKKRKLYDTHGHAAFEHGVGGGNAPDMNDIFGDIFGNIFGGARASRRGADVGYMVELDLEEAVAGVERQIQIPTLVECTHCNGSGSEDGHVETCGTCRGSGQVRIQRGIFAMQQTCPHCGGRGVIIRNPCKVCNGAGRVEDHKTLSVKIPAGVDNGDRIRLSGEGEQGPDGVPPGDLYVEVRVREHPIFQRDGDDLHCEVPVRISQAALGDIVRVATLDGEAEIRIPAETQSGKLFRLRGKGVRSVRSRTEGDLYCRIVVETPVNLTAEQRKLLEQFEMTFAGEDARKHSPKSATFLDGVKSFWDRMTS

SEQ ID NO: 65566 - protein, 157 aa, Zea mays
  misc_feature (128)..(128): Xaa can be any naturally occurring amino acid
  misc_feature (136)..(136): Xaa can be any naturally occurring amino acid
MARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLXARRIRGEXGVSLSTGGRLCARFVCRSLTL

SEQ ID NO: 65567 - protein, 418 aa, Buchnera aphidicola str. Bp (Baizongia pistaciae)
MSGLLKKKQRFSCNDILKIVSKYGTPLWVYDSNIIVKKIKELSQFDVIRFAQKSCSNIHILNLFYKYNVKIDAVSLGEIERALISKYRFTMDQDVVFTSDIIERETLNKVVQYKIPINIGSIDMLEQVGKISPGHNIWLRINPKFGHGHSKKTNTGGENSKHGIWDINLAFPYITKYNFKLIGLHMHIGSGVDYCHLKRVCKAMIDQVLQCKFKIHVISAGGGLTVPYHCNDEPVNVKNYFFLWNKARKIISNYLNRPIRLEIEPGRFLVAESGILVSEIRVIKKTNNRTFILVDSGFNDLIRPAMYGSYHHISVIPRDGRCVNYDDTIEAVVCGPLCESGDVFTQNEYGDIKTRILPNVQIGDFLVFHDTGAYGASMSSNYNSRPLIPEILFKDNEFHIIRRRQTMKELLELEINCI

SEQ ID NO: 65568 - protein, 225 aa, Candidatus Kuenenia stuttgartiensis
MKYTKFFIIAAIVGLFVVFYMLGYNKYLSLEALQANREALNTLYHEHRVAFTGAFMLIYIISAAISLPGATILTLTGGFIFGPLPGSGIVIVSATIGASLAFLVARFILRNTLEKKYERNLKKFNEGIAKNAWSYLLFLRLVPLFPFFLINIVMGLTRVPLRTFALVSFIGMYPGTFVYTLAGGQLATIHSVKDIASPRLIGAFTLLGCFALIPGIYKKFRGAKK

SEQ ID NO: 65569 - protein, 223 aa, Triticum aestivum
  misc_feature (72)..(72): Xaa can be any naturally occurring amino acid
  misc_feature (84)..(84): Xaa can be any naturally occurring amino acid
  misc_feature (88)..(88): Xaa can be any naturally occurring amino acid
  misc_feature (141)..(141): Xaa can be any naturally occurring amino acid
  misc_feature (161)..(161): Xaa can be any naturally occurring amino acid
  misc_feature (168)..(168): Xaa can be any naturally occurring amino acid
  misc_feature (197)..(197): Xaa can be any naturally occurring amino acid
  misc_feature (216)..(216): Xaa can be any naturally occurring amino acid
  misc_feature (220)..(220): Xaa can be any naturally occurring amino acid
MDVPLASKTFPSPSPSKREQCNVDGHKSSSKHADLNPHANDSVLGIILGGGAGTRLYPLTKKRAKPAVPLGXANYRLIDIPVKXICLXNSNISKILCAHASSTQASSLIRQSSSTNLMGSNIGGYKNEGFVESLLHKQSPXDNPDGFKGTADAVRHTVGIXKEHNVMXEYLILARRSPVPEWDYEKLFQAHKRNRCXIYCCCVPMDEELQLHLALXKPIXKGR

SEQ ID NO: 65570 - protein, 512 aa, Geobacter metallireducens GS-15
MTRPLMLMILDGWGINPSAEHNAVAQARTPNLDTLLATYPTTEIQTSGMAVGLPDGQMGNSEVGHLNIGAGRVVYQDLTRITKAIQDGDFFTNPVLLECIAKTKAAGGRLHLAGLLSDGGVHSHNTHLYALLELARRQGLTDVFIHAILDGRDTPPKSGADYLAQLEAEIARIGVGAIATVMGRYWAMDRDNRWERVERAYNAMVQGEGVQRASSAEAIEASYAADVTDEFVEPSVMVRDGAPVGQLRDGDGFIFLNFRSDRAREITRALALPDCEGFARQARPNLASYVCMTEYDATFGLPIAFGPEELKNILGDVLAHAGIRQLRIAETEKYAHVTFFFNGGVEEPFPLEERCLIPSPKDVATYDQKPEMSAYPVTDELLKRIDSDAYDVVIVNFANADMVGHTGILEAAARAVEAVDSCVGRIVAKVREKGGAVIITADHGNAEKMVDETGGPHTAHTSEPVHLVLVDDSRKGIRLRAGTLADIAPTMLEILGLSQPAEITGKSLIAQS

SEQ ID NO: 65571 - protein, 316 aa, Candida albicans SC5314
MAFGAPRGRGGPARGGRGGFGGGRGGRGGARGGGRGGARGGSRGGARGGARGGARGGARGGRGGARGGARGGAKVVIEPHRHAGVFIARGKEDLLVTRNIAPGESVYGEKRISVEEPAKEEGAAPTKIEYRVWNPFRSKLAAGIMGGIDELGIAPGKKVLYLGAASGTSVSHVADVVGPEGLVYAVEFSHRPGRELIGMAKKRPNVIPIIDDARHPQKYRMLIGMVDCVFADVAQPDQARIIALNSHLFLKDGGLVVISIKANCIDSTVDAETVFAREVQKLREERIKPLEQLTLEPYERDHCIVVGRYMRSGIKK

SEQ ID NO: 65572 - protein, 628 aa, Oryza sativa (japonica cultivar-group)
MLRAVHVLAIAAAVLTLAPLAASYPWQACNGSSNYTANSAFQRNLGVLAAALPGNASTSPDLLANATVGGAPDTVYALAFCPPIDNQNASGCRACVASAFADARSLFPEQQGRKHHLRRLRPHLLRPGLPRRPQQTRRTWRGSSETPRTSTSPTSASSTGPSTSMAWCTPDMAPGRCRACLADTIAQMHAYFNPNAQGARLVGVRCAARYEDLPVQNRPRHGAGAGKKSKTGKILAIVLPIVAALLASAMICFCCWRRRTKATKLSLSYSSRSEDIQNIESLIMDLPTLRIATDNFAENNKLGEGGFGEVYKGSFPGGQTIAVKRLSQSSGQGIGELKNELVLIAKLQHKNLVRLVGVCLEQEEKLLVYEYMPNKSLDTFLFDPEKRKQIDWAKRFMIIKGITGGLQYLHEDSQLKIIHRDLKASNVLLDANMNPKISDFGLARLFGDDQSQETTNRVVGTYGYMAPEYALRGQYSIKSDVYSFGVLLLEIITGRKNSDSYNSEQAVDLLSLVWEHWAMKTITEMVDPYLRSDSSSLDEILRCIHVGLVCVQEDPMDRPTLSMINIMLDGNTVSAKAPSRPAFFTEMLGNINIGSSMYSQPYPVTDSTAKHSTAMSLNDVTVTEPEPR

SEQ ID NO: 65573 - protein, 464 aa, Silicibacter sp. TM1040
MAAASYDVIVIGAGPGGYVAAIRASQLGLKTCVVEREHLGGICLNWGCIPTKALLRSSEVFHLMERAKDFGLKAENIGYDLGAVVKRSRGVAKQLSSGVKGLLKKHKIDVIMGEATLPAKGKVAVKTDKGSEELTGKNIILATGARARELPGLEADGDLVWTYKHALDPKRMPKKLLVIGSGAIGIEFASFYNTLGADTTVVEVMERVLPVEDEEISKFAKKAFEKQGMKIMQKAMVKQLDRASGKVTAHIEVGGKVEKHEFDTVISAVGIVGNVEGLGLEGLGVKIDRTHVITDEYCRTGVDGLYAIGDIAGAPWLAHKASHEGVMVAELIAGKHAHPVKPESIAGCTYCHPQVASVGYTEAKAKELGYKVKVGRFPFIGNGKAIALGEPEGLIKTVFDEKTGELLGAHMIGAEVTELIQGYVVGRQLETTEEDLMNTVFPHPTLSEMMHESVLDAFDRVIHI

SEQ ID NO: 65574 - protein, 372 aa, Candida albicans SC5314
MSAPKVATQVFLKTCPSGFIHTKVNEDDSTFEVKEVPVPELKEGQVLAKVLYLSNDPTQRTWLRKAGDNSPSYMPPVHEGTPMASLGLAEIIESKSEKYQKGDIASGRIYWADYAVVPDVVFFNKIDKSLGLPLEFFLSILGMTTLTAFFGLTEVGKLKKYLDGPKEGEKGPVVCVSAASGATGSSVVQIAKHLLGASKVIGISGSDEKCKWVESLGADLCVNYKNSEWKQQVSDYLAKDNEGIDVYFDCVGGEILSFILTKMNKFGHVAACGAISGYNDNKAFAVTSWPFIITNSLNVQGFIVGNFAAQFPEAIKILGAAVKEGKIKVQGAYHVEKLSGDEPSKRLADIPRIWNMLFEDNKPNGKLLIKVD

SEQ ID NO: 65575 - protein, 332 aa, Marinobacter sp. ELB17
MVLQFPSVIKGLKGMTPVRHWFLNIVRWFDSDAGADNLDSDSRALNLVRVIPFIALHLSCLLVYFTGTSTFAVMFALAFFWLRMFAITGFYHRYFAHKTFKTSRKTQFIFGILGASSAQRGPLWWAAHHRHHHQHSDQEQDLHSPQQGGFWWAHAGWFTCDAGFAMNERKVRDWLKFPELRFINRFDALVPAIAALMIYGIGEGLAAWAPGLGTNGLQLLVWGFFISTVVLFHATVSINSLSHVWGKRRFETGDDSRNNFWLALLTLGEGWHNNHHRWPQSVRQGFRWYEIDITWYGLWLLARLGIIWDLNPIPKNVQEETRKLDSIRRMQS

SEQ ID NO: 65576 - protein, 333 aa, Bacillus subtilis subsp. subtilis str. 168
MKLLKREGLSLTEEKALWMYQKMLEIRGFEDKVHELFAQGVLPGFVHLYAGEEAVAVGVCAHLHDGDSITSTHRGHGHCIAKGCDLDGMMAEIFGKATGLCKGKGGSMHIADLDKGMLGANGIVGGGFTLACGSALTAKYKQTKNVSVCFFGDGANNQGTFHEGLNLAAVWNLPVVFVAENNGYGEATPFEYASACDSIADRAAAYNMPGVTVDGKDILAVYQAAEEAIERARNGGGPSLIECMTYRNYGHFEGDAQTYKTKDERVEHLEEKDAIQGFKNYLLKETDANKLSDIEQRVSESIEKAVSFSEDSPYPKDSELLTDVYVSYEKGGM

SEQ ID NO: 65577 - protein, 342 aa, Bacillus subtilis subsp. subtilis str. 168
MARVISMSDAINEAMKLAMRKDENVLLIGEDVAGGAAVDHLQDDEAWGGVLGVTKGLVQEFGRTRVLDTPISEAGYMGAAMAAASTGLRPIAELMFNDFIGTCFDQVINQGAKFRYMFGGKAQVPITVRTTYGAGFRAAAQHSQSLYGLFTSIPGLKTVVPSNPYDAKGLLLAAIEDNDPVFFFEDKTSYNMKGEVPEDYYTIPLGKADIKREGNDVTLFAVGKQVNTALEAAAQLSERGIEAEVLDPRSLSPLDEDAIFTSLEKTNRLIIIDEANPRCSIATDIAALVADKGFDLLDAPIKRITAPHTPVPFSPVLEDQYLPTPDKIVSVTLELLGEPALN

SEQ ID NO: 65578 - protein, 398 aa, Bacillus subtilis subsp. subtilis str. 168
MAVKVVMPKLGMAMKQGEVSIWNKKVGDPVEKGESIASIQSEKIEMEIEAPEKGTLIDIKVKEGEEVPPGTAICYIGDANESVQEEAGAPVAEDNMPQAVQPVKQENKPAASKKDRMKISPVARKIAEKAGLDLKQLKGTGPGGRIVKDDVTKALAEQKKDQAKPVSEQKAQEIPVTGMRKVIAARMQESLANSAQLTITMKADITKLATLQKQLSPTAEERYGTKLTITHFVSRAAVLALQAHPVLNSFYQNERIITHPHVHLGMAVALENGLVVPVIRHAEKLSLIELAQSISENAKKAREGRAGSEELQGSTFSITNLGAFGVEHFTPILNPPETGILGIGASYDTPVYQGEEIVRSTILPLSLTFDHRACDGAPAAAFLKAMKTYLEEPAALIL

SEQ ID NO: 65579 - protein, 210 aa, Pseudomonas putida GB-1
MEPFSPNDFAELVMVERKASVERNTLETQVKCSINLDGSGKARFDIGVPFLEHMLDQIARHGLIDLDIECKGDTHIDDHHTVEDVGITLGMAFAQAIGDKKGIFRYGHAYVALDEALSRVVIDFSGRPGLQMHVPYTRASVGGFDVDLFQEFFQGFVNHALVTLHIDNLRGHNTHHQIETVFKAFGRALRMAITLDERMAGQMPSTKGCL

SEQ ID NO: 65580 - protein, 113 aa, Pisum sativum
MAEEGQVIGVHTVDAWKEQLEKGKASKKLIVVDFTASWCGPCRFIAPILAEIAKKLTHVTFLKVDVDELKTVSEEWGIEAMPTFLFLKDGELVDKVVGAKKEELQLKIDKHAA

SEQ ID NO: 65581 - protein, 458 aa, Bacillus subtilis subsp. subtilis str. 168
MTLAIIGGGPAGYAAAVSAAQQGRNVLLIDKGKLGGTCLNEGCIPTKSLLESANVLDKIKHADSFGIELPAGAISVDWSKMQSRKQQVVSQLVQGVQYLMKKNQIQVVKGTASFLSERKLLIEGENGKEIREADQVLIASGSEPIELPFAPFDGEWILDSKDALSLSEIPSSLVIVGGGVIGCEYAGLFARLGSQVTIIETADRLIPAEDEDIARLFQEKLEEDGVEVHTSSRLGRVDQTAKTAIWKSGQREFKTKADYVLVAIGRKPRLDGLQLEQAGVDFSPKGIPVNGHMQTNVPHIYACGDAIGGIQLAHAAFHEGIIAASHASGRDVKINEKHVPRCIYTSPEIACIGMTERQARSIYGDVKIGEFSFSANGKALIKQQAEGKVKIMAEPEFGEIVGVSMIGPDVTELIGQAAAIMNGEMTADMAEHFIAAHPTLSETLHEALLSTIGLAVHA

SEQ ID NO: 65582 - protein, 130 aa, Zea mays
MVRVSVLNDALKSMYNAEKRGKRQVMIRPSSKVIIKFLTVMQRHGYIGEFEYVDDHRAGKIVVELNGRLNKCGVISPRFDVGVKEIEGWTARLLPSRQFGYIVLTTSAGIMDHEEARRKNVGGKVLGFFY

SEQ ID NO: 65583 - protein, 451 aa, Mycobacterium avium 104
MTTSTVVPRVSGGEEEHGHLEEFRTDPIGLMQRVRDECGDVGWFQLVDKHVILLSGAQANEFFFRSADEDLDQAEAYPFMTPIFGKGVVFDASPERRKEMLHNSALRGEQMKGHASTIEGEVKKMIADWGDEGEIELLDFFAELTIYTSTACLIGLKFREQLDHRFAEYYHDLERGTDPLCYVDPYLPIESFKRRDEARVKLVALVQEIMDQRLANPPKDKADRDMLDVLVSIKDEDGKPRFSADEITGMFISLMFAGHHTSSGTSAWTLIELIRHPDVYAEVLAELEELYADGQEVSFHALRSIPKLDNVVKETLRLHPPLIILMRVAKGEFEVEGFPIHEGDYVAASPAISNRIPEDFPDPDAFKPDRYNKPEQADIVNRWTWIPFGAGRHRCVGAAFAQMQIKAIFSVLLREYDFEMAQPADSYRNDHSKMVVQLARPAKVRYRKRNA

SEQ ID NO: 65584 - protein, 332 aa, Aspergillus nidulans FGSC A4
MGSINETQTTSIPTVDIGPFLDGQAAQEAKDAVVAAMRHACSTFGFFYLVGHGIPEEDRLQILKCTKRYFDLPMEEKMETWIGKAIGRSFRGYEPPALQVHQEGLLPDTKEGFILGRETPADAPEAGTFHTGPNQWPKTLPDEEFRVPIMRYHAKMIEMVKVILKILALGLPAEWNCPSDVFDELTINPSAPLRLLYYAPQPVKHENQFGVGAHTDFGNVSVLLQEEDSEGLEVFYPPTQTWVPVPAKPHSYVINMGDMMQKWTAGYYRSALHRVVNSNTKPRYSAPFFMNGNLDVKCYALDGSGEVTTIGEHIRKRLMETIGGEEGKKLGL

SEQ ID NO: 65585 - protein, 564 aa, Xanthomonas oryzae pv. oryzae KACC10331
MCSIFGIFGLQPGDDLQALRRQALECSQRQRHRGPDWSGVYVDAGAILVHERLAIVDPAGGSQPLLSEDGQLALAVNGEIYNHRELKAELLQPYAFQTGSDCEVINALYREDVPALYLNRLNGIFAFALWDKTEGRVIIARDPIGVVPLYWGHDREGRLRVASELKSLVDDCADAAQFPPGHWYDSATGALSRYYERAWREYAEVEGVQVQLQELREAFERAVHRQLMTDVPYGVLLSGGLDSSLVAAVAARYARHRVEENDTTEAWWPRLHSFAIGLKGSPDLAAAEVAAAALGTVHHGFEYTFEEGLDALPDVIRHIETYDVTTIRASTPMFLLARRIKAMGVKMVLSGEGSDEIFGGYLYFHKAPNAREFHEELVRKLDALNNYDCLRANKSMMAWGVEPRVPFLDREFLDVAMRMDASFKMIDKTSSGAARMEKGVLREAFAGYLPESILWRQKEQFSDGVGYGWIDGLKAHAAANVSERELAAADRRYPVNPPQTKEAYFYRTLFEQFFPGQSAAETVPGGKSIACSSPTAIAWDASFAAMADPSGRAIAGVHAQAMDS

SEQ ID NO: 65586 - protein, 415 aa, Ehrlichia ruminantium
MIKKAAVELDDQKITLPILYDTEGNEVLDITSLYKNTGVLTYDPGFMSTAACESKITFIDGNKGILRYRGYDIADLVYNNKSFIEVVYLLFYGVFPNAEQLQEFMLHISQEYVLPQMVRNVIMSFPQNSHPMAILIASFSSLAAYYCDQKTDGELECKLAVAKVASIVALIYRHITNQDFIQADVGLSYSKNFIHMMFDISSYKFTEIVDKALDVIFVLHADHEQNASTATVRMAGSSGPNLFACLAAGAATLWGPAHGGANEAVINMLMNIGKPENVKQFIQKVKDSNKGTKLMGFGHRVYKNYDPRARIMCTICKEILKDFGLNDPLLEVAVELENIALQDDYFIARNLYPNVDFYSGIVLKTIGIPVKMFTTLFALARTSGWSAQWYEMVSSKNYKISRPRQLYTGNPVQKV

SEQ ID NO: 65587 - protein, 389 aa, Arabidopsis thaliana
MVIAAAVIVPLGLLFFISGLAVNLFQAVCYVLIRPLSKNTYRKINRVVAETLWLELVWIVDWWAGVKIQVFADNETFNRMGKEHALVVCNHRSDIDWLVGWILAQRSGCLGSALAVMKKSSKFLPVIGWSMWFSEYLFLERNWAKDESTLKSGLQRLSDFPRPFWLALFVEGTRFTEAKLKAAQEYAASSELPIPRNVLIPRTKSFVSAVSNMRSFVPAIYDMTVTIPKTSPPPTMLRLFKGQPSVVHVHIKCHSMKDLPESDDAIAQWCRDQFVAKDALLDKHIAADTFPGQQEQNIGRPIKSLAVVLSWACVLTLGAIKFLHWAQLFSSWKGITISALGLGIITLCMQILIRSSQSERSTPAKVVPAKPKDNHHPESSSQTETEKEK

SEQ ID NO: 65588 - protein, 374 aa, Oryza sativa (japonica cultivar-group)
MEGAHKLNAKLGDNGDTQFSLDEKQEVVDSFRGTRMWWKLSKASDDYSLYGRKIQRRNYMLVFHKRHRQLVQDSYLPEILQQGRALTAKNRQRRLYTHHENHMSTWTHVPWKHPATFDTLAMDPGKKDELIEDLKMFQKGKEYHSKVGKAWKRGYLLYGPSGTGKSSTISAMANFLKYDVYDLDLTTVTNNTDLRNLFLQTTEQSIIVIEDIHAMELEDKRMSTDFQWYYERKKITLSGLLNFIDGLWSACGGERIIVLTTNHVDKLDPGLIRRGRMDKHIEMSYCRFEAFKVLANNYLDITEHPLFTKIQRLLDETDMTPADVAHNLMPQGKRKRNTNKCLTGLIQKLKKAKLESGTRLSRGRVLPTGHQGII

SEQ ID NO: 65589 - protein, 107 aa, Glycine max
HKVNLCQKIAYIALKVQDDSCEFCQDTVSTLLEKLKESDTKLEIIETLLKVCNSPILLYKCKRMVFEYGHLIFDHAEKILETTDICTIIHACRSSDVAGQQAFLSVS

SEQ ID NO: 65590 - protein, 186 aa, Triticum aestivum
TRPRTRGANFVLGYCSIYIFMQTFMIPGTIFMSLLAGALFGVIKGGVLVVFTATAGASSCYFLSKLIGRPLVCWLWPERLRYFQSEIAKRKDKLLNYMLFLRITPTLPNTFINMASPIVDIPFHIFFAATLIGLIPASYITVKAGRALGDLRSVRELYDFKTLVVLFLIGSVAVVPTILKRKRTYE

SEQ ID NO: 65591 - protein, 761 aa, Ostreococcus tauri
  misc_feature (1)..(1): Xaa can be any naturally occurring amino acid
XASGDGRRRLLRGGFGQTLDTIFGSGILAMCAGGSDGSELWWSTGGQFARLHAYDMFIQGQREIARPRLNEDAAGVGIRCLTGSSAGAPTLNAPIVTMSSSTSNDSVLLWAGLRNGVVMAWDCDLGKLLSTDIVLASRDKAVTAIAPIDATRAWVGCEDGTIVEVHAPATKPDSSWSYSGKCFKTRDVFPADAHERPSFGEPRENSKGVRCMIHNANEGSDGFMFIACERDLFLEIWDIADATCVRVEALDDLGAVVSLMQHPTVRDLIVSVHETGAVQLWGGDKCAVKTGDRVMTITPGFKQVEKWSLAPFSKYFGKTVIGAVPVENVLVIGHASGKLTIWSLPGAQELHDTTLHSETLASSPASASVTVRWGKRVAHESGLVHLTKIDGGGSLGVVTVGRFGSIMYWPLAQLESGLGKGRKPRPMLGTPSKMNEDRLKPKTPESGTLSDTARIAYEHIKLVQKIGEGSFGRVYKAKWNHIDVAVKFIGPSDIDVTASGLGRSLEELEKEVSIMTKLRHPNIVLLLGVVMSPRPAIVQEFCVRGSLYTVLQRHAKSGAPELTWRLRLQMALGAAAGMLYLHECTPTVLHRDLKSANLMVDRYYRVKVGDFNLSRAEIVASSESAEFSGNLHSPSWMAPEVLCDSQYSKASDVYSFAVVMWEIQSLQTPWKDLHIYQIVTAVPDGERLDPTATHGVVFHEAKAYQDLMMQAWQQDPAVRPCFEQLVEEVTTLLSAEIARDPQLKKDAKIQFFQRERFHQTA

SEQ ID NO: 65592 - protein, 321 aa, Methanosarcina barkeri str. Fusaro
MTLVDEIKKRSVHVDAAIDELLPVAHPEELYKASRYLVDAGGKRLRPAVLILAAEATGSDLKSVLPAAVAVELVHNFTLIHDDIMDKDDIRRGMPAVHTIWGDAGAILAGDTLYSKAFEILSKVQNEPARILKCMDVISKTCTEICEGQWLDMDFEKREKVSKAEYIEMVEKKTSVLYAAAAKIGALLGGASDEIAAALSEYGRFIGIGFQMYDDVLDMVTPEEVLGKVRGSDLMEGKHTLIVIDAFEKGVKLDIFGKGEATQEETDEAVRILTECGSIDYVKDLAISYINEGKAKLDVLRDCPEKELLLQIADYMISRNY

SEQ ID NO: 65593 - protein, 89 aa, Candidatus Kuenenia stuttgartiensis
MVVDLHSVLLEGGVYFYPEDAGHEGWKLRLLYECAPLAFLVEQAVGLSSTGTRRIPDIKAESIHQRALLVIGSTEEVSLYEKFFMNGSP

SEQ ID NO: 65594 - protein, 548 aa, Neisseria meningitidis FAM18
MKHFHDLPAWPKLWNHFDDSKTLHMREMFEQDPQRAERYWLQVGGLTLDYSKNRINDETMSLLFELAREAGVPERMRQMFHGEKINTTENRAVLHVALRNRTNSPIVVDGEDVMPKVNRVLQRMGEFAHEVRSGSWLGYTNQVITDVVNIGIGGSDLGPLMMCTALKPFGHPRLNMHFVSNVDGSQLRDVLSKVHPETTLFIIASKTFTTQETLTNALTAREWFLNHAGDESAVAKHFVAVSTNQKAVAEFGIDTANMFEFWDWVGGRYSLWSAIGLPIMLYLGEENFIEMLNGAHLMDQHFINTPLERNLPAILALIGIWYINYYGGGSHVIAPYDQHLHRLPKFIQQLDMESNGKQVTLDGKAVGHETSPIIWGETGINGQHAFFQLLHQGTHITPIDLIASLEKRSNLPGHHEILLANVFAQAEAFMRGKTPDEVRAELKAQGMDEARIEELVPHKTFSGNRPTNLILMDKVNPRNMGSLIAMYEHKTFVQGIIWGINSFDQWGVELGKQLAKTILGELTGETGPQKHDSSTERLIRLYLQTNRK

SEQ ID NO: 65595 - protein, 292 aa, Oryza sativa (japonica cultivar-group)
MMRLKKKGTMDNTGTPKRTRWSENKAQQDGKDETTKLTYSIERDALECPICFVPFEDRVYMCKNGHAACGSCYAKMNTMCPCCIEPIGNIRCRPLEKVLAAMSAPCRFSTSAYMRLIRASGCTEIVAYTERRNHEASCPHAPCVCPFDGCNYQGHLLYSHIQDEHATDAAVVATGCLRGTGTTVTLHKSKPFHVLLHRGGSRVFLLLNGDNVLSGRSLSLVCISPPPPLPNCELLYKIELGAVSRAPGELGLSMSGTVPCVRRLEGFDAKAFLFVPDSYWGSSGTISVTVHL

SEQ ID NO: 65596 - protein, 584 aa, Streptomyces avermitilis MA-4680
MSLEGARERWVRTGGIELCVAELGDETQPTVVLVHGYPDSKEVWSEVAGRLSERFHVVLYDVRGHGRSTAPQPLRGGFTLEKLTDDFLAVADAVSPDRPVHLVGHDWGSVQSWEFVTVKRTEGRIASFTSMSGPSLDHFGHWIKRRVKRPTPRRVGQLLGQGAKSWYVYLLHTPVLPELAWRGPLGRRWPKILQRVEKVPADGYPTPSLPSDAAHGAWLYRDNVRARLSRPRTDAYAHAPVQLVTPLGDAFLSEKLYDELELWAPQLVRRTLPAKHWIPRTRPDQLASWITEFVIASEGGRPAPVASGPYADRFGGQLVLVTGAGSGIGRATAYAFAEAGARVVAVDRNAEGAARTAEMSRLIGAPDAWAETVDVSDEQAMEKLAEKVATEYGVVDVLVNNAGIGLSGSFFDTTAEDWRKVLDVNLWGVIHGCRLFGKQMAERGQGGHIVNTASAAAYQPSKALPAYSTSKAAVLMLSECLRAELAGQGIGVSAICPGFVHTNITSTARFAGVAAEEEKRRQKRAARLYRLRGYPPEKVADAVLRAVVRNQAVVPVTPEARGAHLMSRFAPRALRAIARLEPPL

SEQ ID NO: 65597 - protein, 449 aa, Saccharophagus degradans 2-40
MTFDYDFFVIGAGSGGVRASRIAAGLGAKVAVAEDTFMGGTCVNVGCVPKKLFVYASEFAEHFEAAKGFGWQQVDGSFDWPTLRDNKTKEIERLNGIYERMLGGANVEVIHGRATLLGNNKVGIGDKVVTAKHILIATGGTPKWPTFEGAEHCITSDQIFYLETLPKRVLVQGGGYIAVEFAGILNGLGCATELAYRGPLFLRGFDSEVREFVATQMAEKGVQLSFNTDIESIAKNDDGSLTVRLNNGEVREVDAVLSAIGREPRINGLGLENTQVKTAKNGFIEVDNNFLTADPSIYAVGDVVGRMPLTPVALAEGMALARYLFDNKPIELNYSNIPTAVFCQPNIATVGLTQQQAEEQFGEVLVFKSDFKALKHTLSGLAERTLMKLIVDKTTDKVVGCHMVGPDAAEIMQGIAVAIVAGATKQDFDNTIGIHPSAAEEFVTMRSPV

SEQ ID NO: 65598 - protein, 144 aa, Silicibacter sp. TM1040
MLVKSILKSKDIAEVVTITPEATIEAAAQLLSEHGIGTVVVSPDKSKPVGILSERDIVRQLAKVGSVCLNHKVEDYMTRDVVTCTQDSVAEQALSTMTEGRFRHMPVVEDGALVGIISLGDVVKAQLNEVAMEKTALEGMIMGH

SEQ ID NO: 65599 - protein, 292 aa, Escherichia coli
MFTGSIVAIVTPMDEKGNVCRASLKKLIDYHVASGTSAIVSVGTTGESATLNHDEHADVVMMTLDLADGRIPVIAGTGANATAEAISLTQRFNDSGIVGCLTVTPYYNRPSQEGLYQHFKAIAEHTDLPQILYNVPSRTGCDLLPETVGRLAKVKNIIGIKEATGNLTRVNQIKELVSDDFVLLSGDDASALDFMQLGGHGVISVTTNVAARDMAQMCKLAAEEHFAEARVINQRLMPLHNKLFVEPNPIPVKWACKELGLVATDTLRLPMTPITDSGRETVRAALKHAGLL

SEQ ID NO: 65600 - protein, 380 aa, Lactococcus lactis subsp. lactis Il1403
MAIEMLGLILAGGQGTRLGKLTKDVAKPAVPFGGRYRIIDFALSNCANSNVKNVGVITQYQPLTLNAHIGNGAPWGLNGINSGVTILQPYSSQEGSKWFEGTSHAVYQNISYIDQQNPEYVLILSGDHIYKMDYEAMLESHKEREASLTVSVMEVPLEEASRFGIMNTDDNDRIIEFEEKPKEPKSNLASMGIYIFNWKRLREVLVNGYSKGNPMEDFGGDVIPAYIEAGENVFAYRFKGYWKDVGTIDSLHQSSMEFLDLNNELNITDKSWRIYSHNDISAPQFITEKSNVKNALVGDGCYVDGTVLHSILSQNVHVQEGTVIEDSFIMSGTFIGENVTIKNAIIGENAKIGDNVEIIGENEVAVIGHGEIKGENKNEQ

SEQ ID NO: 65601 - protein, 110 aa, Chlamydophila abortus S26/3
MTIFEKIIEGAIDCEKVFENENFIAIKDRFPQAPVHLLIIPKKHIEKLQDMQDEDFSLLAEAGKIIQQLAEAFGIAEGYRVVINNGVDGGQSVFHLHIHLLGGSSLGAIA

SEQ ID NO: 65602 - protein, 431 aa, Legionella pneumophila str. Lens
MDMDIKHKPLKRELSLFGATMMGLGSIVGTGVFVSIGIAAGVTGPSVILAIALAALVATCNAFSSAQLAANHAVSGGTYEYGYRYLHPAFGFTAGWMFLCAKSASAATAALGFAGYFIHLSGLETVPVIPIALAASITLILLVLSGLRRTNTVNIIIVMITLITLTVFIISGLPDFMQRGTANLRPFFPVSKQEGLSHFFYATALMFVAYTGYGRIATLAEEVKNPGKFIPAAIIITLMVSAALYILVGLVAIGAVGVEKLAQVTETNATPLESAARAIGIPGLSVLVSIGACTAMLGVLLNLILGLSRVALAMGRKGDLPKMFCYVSETRHVPVFAVIGVGVVIIALVLTGSVETTWTFSAFTVLIYYAITNLAALRLPKEEQLYPPLFAIGGLLSCLFLAFWVPIGVWITGISLLVLGLLWKVVANRFL

SEQ ID NO: 65603 - protein, 134 aa, Triticum aestivum
  misc_feature (100)..(100): Xaa can be any naturally occurring amino acid
MAGWYRSGIRERSSTHACRDWSTIIGTHLLLFQHLPNPNHAVRSTPRGERSDMPATPTIIGALLGLGTQMYSNALRKLPYMRHPWEHVLGMGLGVVFVNXQLVKFDEKVKVDLDKMLERAKHANEQRYFDEDDD

SEQ ID NO: 65604 - protein, 393 aa, Buchnera aphidicola str. Bp (Baizongia pistaciae)
MSIIKITDLNLLNKKVLIRSDLNVPIKNNKISSYARIHASLPTIKFALKNLAKVIVTSHLGRPTEGIYKKKFSLFPVFKYFKKILPETNIYFSQNLTECSSIKSGELIILENVRFNQGEKENSKILSKKYATLCDIFVMDAFGAIHRNEASTNGIIKYAKLACSGLLLESELKTLNSALTNPVRPMVAIVGGAKVSTKFKTLTTLAKISDTLIVGGGIANTFISIDHNIGKSLHDPKFIEQAKILKEKYNIFIPTDSRVSTTFTYDSIATIKSTSDIHANEEIMDFGDISIKNMINIIKKAKTILWNGPIGVFEFKNFSKGTEQLSKAIASSDAFSIAGGGDTLSVVEMFKVQNNISYLSTGGGSFLKFLEGNKFRIIELLEKHFNKFKNNNF

SEQ ID NO: 65605 - protein, 398 aa, Methanosarcina barkeri
KLGVPQPEGGYATSQKEAIEVAKRIGFPVLVRPSYVLGGRAMEIVYDEMDLERYMKEAVRVSHEHPILIDDFLEAASEIDVDAVCDQKDVIIGAIMEHIEEAGVHSGDSACVIPPQSLSPEVLDQVRDYTRKIALALRVKGLINIQMAEKGGKVYVLEANPRSSRTIPFVSKAVGIPLAKIAAKVIVGHSLKSLGYMDEPKPKHVSIKEVLLPFDKLPGADPVLGPEMKSTGEVMGIDYDFGRAYYKAELAADNVLPLTGKVFLSIRNADKTELVDVAKKLQAAGLELMGTEGTVNYLAQHGVFMDVVKKVHDGSPNVIDMMRRDEVNLIINTPTSKQSRRDGSRIRRAAVDFKVPYITTMQAAIAAAAAIETMKKGEELTIKSINEYHKEMEEENKV

SEQ ID NO: 65606 - protein, 1028 aa, Zea mays
  misc_feature (600)..(600): Xaa can be any naturally occurring amino acid
SSQARILAQTTLDAELNAEYEESGDSFDYSKLVEAQRSTPPEQQGRSGKVIAYLQHIQRGKLIQPFGCLLALDEKSFRVIAFSENAPEMLTTVSHAVPNVDDPPKLGIGTNVRSLFTDPGATALQKALGFADVSLLNPILVQCKTSGKPFYAIVHRATGCLVVDFEPVKPTEFPATAAGALQSYKLAAKAISKIQSLPGGSMQALCNTVVKEVFDLTGYDRVMAYKFHEDEHGEVFAEITKPGIEPYLGLHYPATDIPQAARFLFMKNKVRMICDCRARSVKIIEDEALSIDISLCGSTLRAPHSCHLQYMENMNSIASLVMAVVVNENEDDDEPESEQPPQQQKRKKLWGLIVCHHESPRYVPFPLRYACEFLAQVFAVHVNKEFELEKQIREKSILRMQTMLSDMLFKESSPLSIVSGSPNIMDLVKCDEVHGDSTGLSTDSLQDAGYPGAASLGDMICGMAVAKITSKDILFWFRSHTAAEIKWGGAKHDPSDEDDSRRMHPRLSFKAFLEVVKMKSLPWSDYEMDAIHSLQLILRGTLNDALKPAQSSGLDNQIGDLKLDGLAELQAVTSEMVRLMETATVPILAVDGNGLVNGWXQKVADLSGLRVDEAIGRHILTLVEDSSVPIVQRMLYLALQGREEKEVRFELKTHGSKRDDGPVILVVNACASRDMHDHVVGVCFVAQDMTVHKLVMDKFTRVEGDYRAIIHNPNPLIPPIFGADQFGWCSEWNAAMTKLTGWHRDEVIDRMLLGEVFDSSNASCLLKSKDAFVRLCIIINSALAGEEAEKAPIGFFDRDGKYIECLLSVNRKVNADGVVTGVFCFIHVPSDDLQHALHVQQASEQTALRRLKAFSYMRHAIDKPLSGMLYSRETLKGTDLDEEQMRQVRVADNCHRQLNKILADLDQDNITDKSSCLDLDMAEFVLQDVVVSAQILSDFLFVSVKFSPAGGSVDISSKLTKNSIGENLHLIDFELRIKHQGAGVPAEILSQMYGEDNREQSEEGLSLLVSRNLLRLMNGDIRHLREAG

SEQ ID NO: 65607 - protein, 673 aa, Silicibacter sp. TM1040
MDLTALRSENPDHWNKAAAIRALTLDAVAGANSGHSGMPIGMADVATVLFEKHMKFDVSAPKWADRDRFILSAGHGSMLIYSLLYLMGDAQVTLEQIKNFRQSGALTAGHPENFLLDAVEVTTGPLGQGISNAVGFAMAEESLRAQYGKKVVDHYTYVIAGDGCLMEGVSQEAIGLAGRHQLGKLVVFWDNNNITIDGTVDLSDRTNQVQRFKASGWHVQEIDGHNPAEIDAAIEAAKKTKKPSMIACKTHIALGHAAQDTSKGHGALTDADQLKAAKEAYGWTGGAYEVPAEIKSQWEAIGQRGATARAEWEARFAEISKQKQDRFNRAFALEAPKKLSATVKALKKQISETKPKVATRKASEMALEVINPIMPETIGGSADLTGSNNTKTGDLGVFDTDNRKGRYVYWGIREHGMAAAMNGMALHGGIRPYGGTFFCFTDYARPAMRLAALSKIPTVFVMTHDSIGVGEDGPTHQPVEHLAICRATPNTYTFRPADAVETAEAWEIALTAKETPSVIALTRQGLPTVRTEHKLANLTEKGAYVLAEAESKRQVILMASGSEVSVAMAAKDILEGQGIGTRVVSVPCMELFHAQDEAYRRKVLPAGPVRVAIEAAVRDGGWDRLLLGERGQEKKAGFVGMQGFGASAPAGELFEKFGITAEGTVAKVKELLG

SEQ ID NO: 65608 - protein, 120 aa, Silicibacter sp. TM1040
MTDAKTRIDETVKANDVVLYMKGTKDMPQCGFSSRVAGVLNYIGVDYTDVNVLADEDIRQGIKDYSDWPTIPQLYIKGEFVGGCDIITEMTLSGELDGMFEQNGISFDKDAADKIREANA

SEQ ID NO: 65609 - protein, 379 aa, Lactococcus lactis subsp. lactis Il1403
MNNSNKMAAILSNISSSKHLSPLTEVRPIATLPFDCKYHLIDFPLSSLSNAHVDNIFMTFNEGETQSVFDHLGSGGEWGLDGFNSRYFVYIQQDFDRLREQGKDYFAQQLNFLRKSKAPYTVLLGSKFICNVDLTAVLKIHKLAGKEITTVYKKVSPDLASEYDTILRFDESGKMSNCYVNQLENPQEKEALCLNLFIVNTDWLINFIKEMQDIGELTSIARLIRVYMKNYDVNTYEYTGYMSNITNIKSFYDANMVMLDPQNFTSLLYSSQPVYTKIKNEVPTYFSENSKVENSQLGSGCIINGKVKNSLISRGVKIQDDALIEESLVFTNSEVKSGAQVKFAIIDKGVVVENNVKIIGSSEKPVVIPKGTVVTADIL

SEQ ID NO: 65610 - protein, 482 aa, Bacillus subtilis subsp. subtilis str. 168
MSTKKKEAVIGKESLAHKGLLRTITLVSTFGGLLFGYDTGVINGALPFMATAGQLNLTPVTEGLVASSLLLGAAFGAMFGGRLSDRHGRRKTILYLALLFIAATLGCTFSPNASVMIAFRFLLGLAVGCASVTVPTFLAEISPAERRGRIVTQNELMIVIGQLLAYTFNAIIGSTMGESANVWRYMLVIATLPAVVLWFGMLIVPESPRWLAAKGRMGDALRVLRQIREDSQAQQEIKEIKHAIEGTAKKAGFHDFQEPWIRRILFIGIGIAIVQQITGVNSIMYYGTEILREAGFQTEAALIGNIANGVISVIAVIFGIWLLGKVRRRPMLIIGQIGTMTALLLIGILSIVLEGTPALPYVVLSLTILFLAFQQTAISTVTWLMLSEIFPMHVRGLGMGISTFCLWTANFLIGFTFPILLNHIGMSATFFIFVAMNILAILFVKKYVPETKGRSLEQLEHSFRQYGRRADQEIQNQTTHLS

SEQ ID NO: 65611 - protein, 673 aa, Methanocaldococcus jannaschii
MEFKIVNTICPYCGVGCGLGLVVKDGRVIGIHPNKRHPINEGKLCAKGNYCYQFIHSKDRLTKPLIKKESGFVETTWNKALEVIAENLKTYKDEIGFFSSARCTNEDNYILQKFARVALKTNNIDHCARLCHSATVTGMSACFGSGAMTNSIEDIELADCILIIGSNTFEQHPLIARRIMRAKDKGAKIIVIDPRRTITAKNSDIYLQIIPGTNVALINAMINVIIKENLIDKEFIKNRTEGFEKLKEIIKKYTPEYASKICGVDKELIIESAKIYGNAERASIIYCMGVTQFTHGVDAVKALCNLAMITGNIGKEGTGVNPLRGQNNVQGACDMGALPNVFPGYQKVEDGYKLFEEYWKTDLNPNSGLTIPEMIDESGKNIKFLYIMGENPIVSDPDVKHVEKALKSLDFLVVQDIFLTETAKLADVVLPAACWAEKDGTFTNTERRVQLIRKAVNPPGEALEDWIIIKKLAEKLGYGDKFNYNKVEDIFNEIRKVTPQYRGITYKRLKIDGIHWPCLDENHSGTKILHKDKFLTDNGRGKIFPVEYREVAELPDKDYPFILTTGRIIFHYHTGTMTRRCKNLVEEINEPFIEINPDDAKSLKIENGDLVKVISRRGEITAKARITEDIKKGVVFMPFHFVEANPNVLTNTALDELCKIPELKVCAVKIERI

SEQ ID NO: 65612 - protein, 348 aa, Bacillus subtilis
MLNIIRLLAESLPRISDGNENTDVWVNDMKFKMAYSFLNDDIDVIERELEQTVRSDYPLLSEAGLHLLQAGGKRIRPVFVLLSGMFGDYDINKIKYVAVTLEMIHMASLVHDDVIDDAELRRGKPTIKAKWDNRIAMYTGDYMLAGSLEMMTRINEPKAHRILSQTIVEVCLGEIEQIKDKYNMEQNLRTYLRRIKRKTALLIAVSCQLGAIASGADEKIHKALYWFGYYVGMSYQIIDDILDFTSTEEELGKPVGGDLLQGNVTLPVLYALENPALKNQLKLINSETTQEQLEPIIEEIKKTDAIEASMAVSEMYLQKAFEKLNTLPRGRARSSLAAIAKYIGKRKF

SEQ ID NO: 65613 - protein, 873 aa, Corylus avellana
MLQNIINAVTGDDDGNKKMKRETAAAEKCRKIEGSVVLMKKNVLDFNDFNASVLDRVHELLGQKVSLQLISAVNADPSANGLQGKLGNLAYLEHWISTITPLIAGESAFKVTFDWDEDIAIPGAFLIRNNHHSEFYLKSLTLEDVPGQGRIHFVCNSWVYPADQYKKDRVFFSNKTFLPNETPGPLLKYREEELVNLRGDGTGELQEWDRVYDYAYYNDLGNPDKGPKYVRPVLGGSSEYPYPRRGRTGRPPSETDPNSESRMKLLKSLNIYVPRDERFGHLKMSDFLAYALKAVAQFLKPELESLFDSTPSEFDSIQDVLKLYEGGVKLPDGLLQNIREDIPAEMLKEIFPTEGEGLLKYPMPQVIKEDKSAWRTDEEFGREMLAGVNPVNIRRLQEFPPASKLDPKVYGDQASTITKEHIENNIDGLSIDEAINKKKLFILDHHDAIMPYLRRINSTSTKTYASRTILFLKNDGTLKPLVIELSLPHPEGDQFGAISKVFTPAEEGVESSIWQLAKAYVAVNDSGYHQLISHWLNTHAAIEPFVIATNRQLSVLHPIHKLLHPHFRDTMNINAFARQILINAGGVLEATVFPAKYSMEMSSVVYKNWVFPEQALPADLIKRGMAVKDSNSPHGLRLLIEDYPYAVDGLEIWSAIKTWVEDYCSFYYKSDDRVQNDSELQSWWKELREVGHGDKKDEPWWPKMQTREELVETCTIIIWIASALHAAVNFGQYPYAGYLPNRPTFSRRFMPEKGTPEYDELKSDPDKVFLKTITAQLQTLLGVSLIEILSTHSSDEVYLGQRDTPEWTLDAEALEAFERFGQKLAGIEDRIIKMNNDKKWKNRVGPVKVPYTLLYPTSEGGITGKGIPNSVSI

SEQ ID NO: 65614 - protein, 248 aa, Burkholderia vietnamiensis G4
MYKLVLIRHGESTWNKENRFTGWVDVDLTEQGRNEAYQAGALLKEAGYTFDIAYTSVLKRAIRTLWHVQDKMDLMYLPVVHSWRLNERHYGALSGLNKAETAAKFGDDQVLVWRRSYDTPPPALEPTDERAPFSDPRYAKVPREQLPLTECLKDTVARVLPLWNESIAPAVRAGKQVLIAAHGNSLRALIKYLDGISDSDIVGLNIPNGVPLVYELDENLKPIQHYYLGDQDAIAKAQAAVAKQGKAG

SEQ ID NO: 65615 - protein, 202 aa, Hypocrea jecorina
MNPEYDYLFKLLLIGDSGVGKSCLLLRFADDTYTESYISTIGVDFKIRTIELDGKTVKLQIWDTAGQERFRTITSSYYRGAHGICVVYDVTDMDSFNNVKQWLQEIDRYATEGVNKLLVGNKSDMSDKKVVEYTVAKEFADSLGIPFLETSAKNASNVEQAFLTMARQIKERMGTTTANNTKPSVHVGQGQGVGNSSSSSCC

SEQ ID NO: 65616 - protein, 350 aa, Arabidopsis thaliana
MVMETESKFHVLAVDDSLFDRKMIERLLQKSSCQVTTVDSGSKALEFLGLRVDDNDPNALSTSPQIHQEVEINLIITDYCMPGMTGYDLLKKVKESAAFRSIPVVIMSSENVPARISRCLEEGAEEFFLKPVKLADLTKLKPHMMKTKLKKESEKPVAIEEIVVSKPEIEEEEEESSVIEILPLHQEIESEQLEPMLSSNKRKAMEEVVSTDRSRPKYNDITTSNLSVEDLLTLASEANNNGLQGGLTQPEKPLQDLYGECQQNLSVEDLLTLEYEANNNGLLGVIPQQHRYHQEKETMQTQGDPLNRIPIQSEASNHSDSGDSTLTMAQNQDGLGHSSCFILCQFTSLP

SEQ ID NO: 65617 - protein, 208 aa, Brassica napus
MEGVIVRRVIPSDNSCLFNAIGYVMDKDKKKAPELRQVIAAAVASDKEKYNEAFLGKPNEEYCTWILNPEKWGGAIELSILADYYGREIGAYDIQTSRCDLYGQTKNYSERVMLIYDGLHYDALALSPFEDAEEDFDMTIFPVGKDRSIGSIEGLVLNLVKDQQRKRSYTDTANFTLRCGVCQIGVIGQKEAVEHAQATGHVNFQESH

SEQ ID NO: 65618 - protein, 288 aa, Medicago truncatula
MNVPATRKDLMIVNMGPQHPSMHGVLRLIVTLDGEDVIDCEPILGYLHRGMEKIAENRTIIQYLPYVTRWDYLATMFTEAITVNGPEQLGNIQVPKRMKLADIITILVQDINYFSGLESFKEVYGILWILVPILILVLGITISVLAIVWLEREISAGIQQRIGPEYAGPFGILQALADGTKLLFKENLIPSRGDIRLFSIGPSISVISILISYSVIPFGYNFVLSDFNIGVFLWIAISSIAPIGLLMSGYGSNNKYSFLGGLRAAAQSISYEIPLTLCVLSISLRAIR

SEQ ID NO: 65619 - protein, 927 aa, Alkalilimnicola ehrlichei MLHE-1
MTRPASDTTRAITFTLDGETVTAGPGETLLQVARRQGQALPTLCHQPGYRPAGNCRACMVEIEGERVLAPACVRQPSPGMVVHSTSGRAARARRMVLELLQSDMPAAARTPDNELQQWCDRLGVDAPRFPARSQPAPDASHPAMSVRLDACIQCTRCLRACREEQANDVIGMAHRGDRTAVVFDLADPMGRSSCVACGECVQACPTGALLPAGDRPPEAPDRRVDSVCPWCGVGCLLTYELKGERILRVQGRPDGPANRGRLCVKGRFGQDYVRHPGRLTRPLIRRKDAPKTLPVDFDPGAPLRYFREADWEEALDRAADGLLRIRDRHGPRALAGFGSAKGSNEEAYLFQKLVRTGFGSNNVDHCTRLCHASSVAALMEGLGSGAVSNPVSDVAHCELILVIGANPTVNHPVAATFMKNAARAGKHLVVMDPRRTELAREADRFLQFRPDTDVALLNAMMHTIIEEGLTDEGFIAERTEGFEALRDRVMADYSPEAMAPVCGIPARTIREVARQYARSRSMIFWGMGVSQHVHGTDNARCLIALALMTGNLGREGTGLHPLRGQNNVQGASDAGLIPMFYPNYAPVGDPDTRRWFERFWGVAALDPEPGLTVVEVVDAIHAGGVRGMYILGENPAMSDPDLNHAREALARLDHLVVQDIFLTETAAFADVVLPASAFPEKSGSFTNTDRRVQIGRQALDPPGDARQDWWLIQAIARRMGLDWQYDGVAAVFEEMRRAMPAIRGITWTRLQREDSVTYPCDTEADPGQPVLFRDRFPRGRGRFVPAPFSRADELPDQAYPWVLITGRQLEHWHTGAMTRRSRVLDALEPAPTVCLHPEDLAALGASPGEAVTLHSRRGRLTAYARADDGLQRGEVFLPFAYVEAAANLLTNAALDPWGKIPEFKFCAVRISAGGQVPAARFGIAPTA

SEQ ID NO: 65620 - protein, 421 aa, Mesorhizobium loti
MSQSQVWHPFTQHALEPAIPEIVRTEGAYLYKADGTRILDAISSWWVVTHGHRHPRIIRAIETTASSLDQIIFAGFTHEPAERLARALVGLAPTGLDWVFYSDSGSTSVEVALKMALGYFRNIGAPRSRIVVMEHSYHGDTIGTMSVGARGVFNAAYEPLLFEVDTIPFPASGREQETLDRFEAVSRDRRAAALIVEPLVLGAGGMLMYPASVLTELKKIAETSGTLLIADEVMTGWGRTGTMFACEQASISLDILCTSKGLTGGAIPLAATLATDAIFQAHYSEDRTKTFFHSSSYTANPIACAAALANVEIWRDEPVAERIATLSAKQAAGLQRFRDNPYFTDCRATGTIAALDLRTGSAGYLAEIGPKLRAFFLERGLLVRPLGNVLYLLPPYCITGEELDGLHDAIEEAGERFGTKP

SEQ ID NO: 65621 - protein, 149 aa, Coccidioides immitis RS
MADSLTEEQVSEYKEAFSLFDKDGDGQITTKELGTVMRSLGQNPSESELQDMINEVDADNNGTIDFPEFLTMMARKMKDTDSEEEIREAFKVFDRDNNGFISAAELRHVMTSIGEKLTDDEVDEMIREADQDGDGRIDYNEFVQLMMQK

SEQ ID NO: 65622 - protein, 554 aa, Spirochaeta thermophila
MTRISPLQKARYGYVPKLPPVLQDEIARIQAELGQPTEAVADREDLKRLFANTYGKPIATLTRGSNPEAGRRRTVGVILSGGPAPGGHNVICGLFDALKKANRESTLIGFKGGPSGILDDEWIEFTDSLINQYRNTGGFDIIGSGRTKIETPEQFAKALENAKKHGLDALVIIGGDDSNTNAALLAEYFVQQGAPIQVIGIPKTIDGDLKNEYIEASFGFDTATKVYAELIGNIARDAISSRKYWHFIRLMGRSASHIALECALQTHPNVCIVSEEVREKNMTLSQIVDQIVDAVVKRAAKGENFGVVLVPEGLIEFIPEVGALIDELNTLLAKEAEVFNRIDDPRERISWVKGKLSGNNQHVFSSLPETIQAQLLMDRDPHGNVQVSRIETEKLLIEMVSSRLKALKEEGAYKGKFSALNHFFGYEARCAFPSNFDADYCYALGFTAFVLIANGLTGYIAAIKNLARPAVEWKPMGIPLTMMMNMEKRHGKMKPVIRKALVDLEGAPFKRFATQRDAWATESAYVFPGAIQYYGPDDVCNQPTMTLKLEQGLE

SEQ ID NO: 65623 - protein, 385 aa, Zea mays
  misc_feature (65)..(65): Xaa can be any naturally occurring amino acid
  misc_feature (93)..(93): Xaa can be any naturally occurring amino acid
NQTLNPSDLPLETLNPSDLPLAPPPPCRRRSHHTRVPRETVASAVASLTTWMKKRAAEARPDLLXADERDDIVVLQLSLRRIPASRSTKPRLXLPMPHPVVGHDGASVCVISDDRTKSRSPSASDLHASMSLHRFPVSEVIPLSTLRTDYRPYESRRRLAASHDLFVADRAILPLLPRVLGKAFYSTKKAPIGVDFTRIGWPEQVRRVLGSAFLYLRSGTCSGIKVGRLDMEEEDIVDNVMAAVEEAVEKVPKKWGNVRALHLKAVDSVALPIYQVVPELGMKIEVPEPDIVGSGEVIEKKANAGADGREVFANVSSKRKRNKKEQIEEGVVMQEEVQVDTEKKKKTKSIMVDDSQEVGKKGRVKGKRATEEGKKRKKSIKGDRL

SEQ ID NO: 65624 - protein, 252 aa, Shigella dysenteriae
MKTVTVKDLVIGAGAPKIIVSLMAKDIARVKSEALAYRETDFDILEWRVDHFADLSNVESVMAAAKILRETMPEKPLLFTFRSAKEGGEQAISTEAYIALNRAAIDSGLVDMIDLELFTGDDQVKETVAYAHAHDVKVVMSNHDFHKTPEAEEIIARLRKMQSFDADIPKIALMPQSTSDVLTLLAATLEMQEQYADRPIITMSMAKTGVISRLAGEVFGSAATFGAVKKASAPGQISVNDLRILLTILHQA

SEQ ID NO: 65625 - protein, 158 aa, Triticum aestivum
MAFSEAQEELVLRSWKAMKPDSESIALKFFLRIFEIAPAAKPMFPFLRDAGEDAPLESHPKLKAHAVTVFVMACESATQLRKTGDVKVREATLRRLGATHVRAGVADAHFEVVKTALLDTIEGAVPGMWTLEMNAAWEEAYDQLAAAIKEEMKLAAAA

SEQ ID NO: 65626 - protein, 392 aa, Legionella pneumophila str. Lens
MDIALAKRVQKVKPSPTLAVAAKAAQMKAQGLDIIGLGTGEPDFDTPQHIKLAAISAIEAGDTKYTAVDGIVELKEAVKNKFKRDNELDYQLNQILVSVGGKQSCYNLCQAYLNPGDEVIIPAPYWVSYPDMVLLADGVPVIIETTPAQRYKINAQQLEQAITPKTRMIFLNSPSNPSGIAYTQQELKELGEVLKKHPQILIATDDMYEHILWSQAFTNILNACPELYDRTIVLNGVSKAYAMTGWRIGYAAGPAPLINAMKTIQSQSTSNPCSIAQRAAVAALNGSNESIEEMVNAFHQRHDYVADRLQSIDGIEVIPADGTFYIFPSVQAIIEKRGYANDIEFSEKLLNEVGVALVPGSAFGTEGCIRISFATGIDTLKDALNRLQRFCS

SEQ ID NO: 65627 - protein, 431 aa, Silicibacter sp. TM1040
MTDTQKTAQLSLNGETYELPIFSPTAGPDVLDIRKLYAQSGVFTYDPGFTSTASCDSTITYIDGNEGVLLHRGYPIDQLAGKSHYLEVCYLLLYGELPTATQLEDFETRVTRHTMVHEQMHNFFRGFRRDAHPMATLVGVVGAMSAFYHDSTDISDPWQREVAAIRLIAKLPTIAAMAYKYSIGQPFVYPRNDLDYAANFLHMCFSVPAENYTVDPILSRAMDRIFTLHADHEQNASTSTVRLASSSGANPFACIAAGIACLWGPAHGGANQACLEMLKEIGSVDRIPEFIARAKDKNDPFRLMGFGHRVYKNTDPRAKVLKQSADEVLELLGVEDNPLLQVAKELEQTALNDPYFIEKKLFPNVDFYSGIILEAMGFPTSMFTPIFALSRTVGWISQWKEMIGDPQNKIGRPRQLYLGETQRDYVDIENR

SEQ ID NO: 65628 - protein, 581 aa, Oryza sativa
MVVREPVAMEIPAVESSAAGRMPPRIRRRLLEGSRVGGGAPTSAEEIEAKLKEAELRRQQFHEWVSCKARKKPRSPSWSSQEEDQGQRLEAKLQAAEQKRLSLLAKAQNRLAKLDELRQAAKNIVEMRIEKEREELGTRVESRVRQAEANRMRLLHAHMQKRAAMKERTARSLVRKQTSERKYTERVKSLILQKRNAAEKKRLALLEAEKRKAQARILHIQRAAKTVCSKRESERRQLQEQLESKLQKAKRQRAEYLKQRVSPRSSAHADYIKHAEFLSTKLARCWKRFLKSNKTTYALVQAYDALGINEMSVKSMPFENLAMLMESPTTLQTTKAVLDRFEKRLLLSQPTGSSSAENIDHLLKRLGSPKRKAPASRSRVAAKKPAKGSETSKLSRYSLRVVLCSYMILAHPGAVLSGQGEKENLLMESAENFVKEFELLVKTVLDRPGGASMQSTDAASQKKFRTQLAAFDKAWCAYLYHFVVWKLKDAKSLEQDLVRAACKLELSMMQTCKLSSDGQSHDLSHDMKAIQKQVTDDQKLLREKIQHLSGDAGIERMNSALSDTRSKFFEAKENRFRTRQS

SEQ ID NO: 65629 - protein, 127 aa, Sulfitobacter sp. EE-36
MNLIAQIEAEQIAELGKEIPDFRAGDTIRVGFKVTEGTRTRVQNYEGVCIARNNGHGIAGSFTVRKISFGEGVERVFPLHSTNIESITVVRRGRVRRAKLYYLRSRRGKSARIVENVHYKPKSGANA

SEQ ID NO: 65630 - protein, 311 aa, Arabidopsis thaliana
MDTSLLLPIIDLSSPGKISTAKLIRQACLEHGFFYVKNHGISEELMEGVFKESKGFFNLPLEEKMALLRRDLLGYTPLYAEKLDPSLSSIGDSKESFYFGSLEGVLAQRYPNQWPSEGILPSWRQTMETYYKNVLSVGRKLLGLIALALDLDEDFFEKVGALNDPTAVVRLLRYPGEVISSDVETYGASAHSDYGMVTLLLTDGVPGLQVCRDKSKQPHIWEDVPGIKGAFIVNIGDMMERWTNGLFRSTLHRVMPVGKERYSVVFFLDPNPDCNVKCLESCCSETCPPRFPPILAGDYIKERFRLTYATS

SEQ ID NO: 65631 - protein, 393 aa, Arabidopsis thaliana
MAEEFKATASICGGGGGAWWNSPRSVMSPSDHFLSPCFGAAITSNDFSSQENHLKSRMTCTDNNNIVFGQREADSDSGGSTVTMDSTLQMMGLGFSSNCSSDWNQTILQEDLNSSFIRSSQDQDHGQGFLSTTTSPYILNPACSSSPSTSSSSSLIRTFYDPEPSPYNFVSTTSGSINDPQLSWANKTNPHHQVAYGLINSFSNNANSRPFWNSSSTTNLNNTTPSNFVTTPQIISTRLEDKTKNLKTRAQSESLKRAKDNESAAKKPRVTTPSPLPTFKVRKENLRDQITSLQQLVSPFGKTDTASVLQEAIEYIKFLHDQVTVLSTPYMKQGASNQQQQQISGKSKSQDENENHELRGHGLCLVPISSTFPVANETTADFWTPTFGGNNFR

SEQ ID NO: 65632 - protein, 376 aa, Xanthomonas oryzae pv. oryzae KACC10331
MSKRDYYEVLGVARGASDEELKKAYRRCAMKHHPDRNPGDAAAEAAFKECKEAYEVLSDGNKRRAYDAHGHAAFEHGMGGGGGGPGSPDMGDIFGDIFGNIFGGGAAGPRAARRGADVGYVLELDLEEAVAGIERRIEIPTLIECVSCHGSGSEDGKVQTCGTCHGRGQVRIQRGIFAMQQSCPHCDGRGTLIQNPCKTCHGAGRVEENKVLSIKVPAGVDTGDRIRLAGEGEAGPAGTPPGDLYVEVRVREHAIFQRDGDDLHCEVPIRISQAALGDTVRVATLGGEAEIRIPAETQTGKLFRLRGKGVRSVRSRSEGDLYCRVVVETPVNLTADQRELLQQFEATFTGEDARKHSPKSATFIDGVKGFWDRMTS

SEQ ID NO: 65633 - protein, 150 aa, Brassica napus
  misc_feature (102)..(102): Xaa can be any naturally occurring amino acid
  misc_feature (121)..(121): Xaa can be any naturally occurring amino acid
MEQTFIMIKPDGVQRGLIGQIICRFEQKGFTLKGLKLITVDRPFAEKHYQDLSAKPFFSGLVDYIISGPVVAMIWEGKNVVLTGRKIIGATNPAASEPGTIXRGDFAIDIGRNIIHGSDSXVESANKECALWFPDGPVNWQSSLHSWIYE

SEQ ID NO: 65634 - protein, 301 aa, Glycine max
  misc_feature (247)..(247): Xaa can be any naturally occurring amino acid
MARNEEKAQSMLNRFITMKAEEKKKPKDRRPFLASECRDLSEADKWRQQIMREIGRKVAEIQNEGLGEHRLRDLNDEINKLIREKSHWERRIVELGGPNYAKHSAKMTDLDGNIVDVPNPGGRGPGYRYFGAAKKLPGVKELFEKPPDLRKRRTRYDIYKRIDASYYGYRDEEDGVLERLEGPAEEAMRWEAAEEWRRLDEVRKEARKGVLSGEVAEVTAVAREVLKEEEEEVVEEERAREREKEDXRERREFVVHVPLPDEKEIERRVLEKKKKDLLSRYASEGLVEEQIEAKDMLNIQR

SEQ ID NO: 65635 - protein, 525 aa, Salmonella enterica subsp. enterica serovar Paratyphi A str.
MTENIHKHRILILDFGSQYTQLVARRVRELGVYCELWAWDVTEAQIRDFNPSGIILSGGPESTTEENSPRAPQYVFEAGVPVFGVCYGMQTMAMQLGGHVEGSNEREFGYAQVEVLTDSALVRGIEDSLTADGKPLLDVWMSHGDKVTAIPSDFVTVASTESCPFAIMANEEKRFYGVQFHPEVTHTRQGMRMLERFVRDICQCEALWTPAKIIDDAVARIREQVGDDKVILGLSGGVDSSVTAMLLHRAIGKNLTCVFVDNGLLRLNEAEQVMDMFGDHFGLNIVHVPAEERFLSALAGENDPEAKRKIIGRVFVEVFDEEALKLEDVKWLAQGTIYPDVIESAASATGKAHVIKSHHNVGGLPKEMKMGLVEPLKELFKDEVRKIGLELGLPYDMLYRHPFPGPGLGVRVLGEVKKEYCDLLRRADAIFIEELRKADLYDKVSQAFTVFLPVRSVGVMGDGRKYDWVVSLRAVETIDFMTAHWAHLPYDFLGRVSNRIINEVNGISRVVYDISGKPPATIEWE

SEQ ID NO: 65636 - protein, 133 aa, Triticum aestivum
  misc_feature (34)..(34): Xaa can be any naturally occurring amino acid
  misc_feature (70)..(70): Xaa can be any naturally occurring amino acid
  misc_feature (91)..(91): Xaa can be any naturally occurring amino acid
  misc_feature (100)..(101): Xaa can be any naturally occurring amino acid
  misc_feature (103)..(104): Xaa can be any naturally occurring amino acid
MAPAVMASSATTVAPFQGLKSTAGLPVGRRSSGXLSSVSNGGRIRCMQVWPIEGIKKFETLSYLPPLSTXALLKQVDYLIRSKWVPCLEFXAKVGFVLRXXHXXSPGYNERGEYWDNVESWMRHLTPIHATER

SEQ ID NO: 65637 - protein, 451 aa, Gibberella zeae PH-1
MATQAAYGVEKIVGHSDNAITAQDVTSYQETGDHSQTMKALAWMGKNKVQMVDAPKPKVIEDRDVILRVTGSTVCGSDLHLLHGTVIQLSEGDILGHEFCGVVDEVGAGVTGIDVGGRYVASFQIACGDCFFCKQKLSSQCEKTNSNTTERAMYGGRTAGMFGYSHFTGGFAGGQAEYVRVPLGDVNLLKIPDDVPDEKALYLSDVLATSYNAVKDTAVYPNDSVAVFGAGPIGQMAGIFALKEGASKVIFVDTEPRLSFVRERWPAEHKDKLELVDFKQLSHGVTNKPTVVSRLKELTGNRGPDCAIECVAGEYPKGWMHTIELAIGAETDTSEIINEMIEGVRNYGRCGVTGVYVGYTNHFNIGSLMERGIRLIGNGQAPVHKYWDELLEMIQRGELDPAQMLSHRVRLEDLDKVYYKFEKKEDGMQKVFVETKFSFPRDPSTPALTTY

SEQ ID NO: 65638 - protein, 540 aa, Gibberella zeae PH-1
MSQEYKLKGLSSLSLSPGSKQEVEVEGIEGGKVLLVNTGGTTQALGAKCTHYGAPMAKGVLTSDGRITCPWHGACFNAKTGDIEDAPALDHLPVFKVAERDGAVYVTGEESAIKSSKRQPNVKCAGSSSAQDEHVVVVGGGSGTLGVVESLREKGWKGGITIVSNEGNYPIDRTKLSKALLTDLDKLTWRNKDFYESGSIKFVDGHVNNVDFSGRFVTTEGGEKISYTKLVLATGGTPRRLPLEGFKNLHNIFTLRTVNDTKKIVDQIGNKGKKIVVVGSSFIGMECAVATASDNDVTVIGMENVPLERVLGEKVGAGLQKALEGKGVKFYMGASVDKAEPSSSDSSKVGAVCLKDGTRLEADLVVLGVGVAPATQYLQNNSSITLEKDGSVKVNDDYSVAGLKDVYAIGDIATFPYHGPGGEGKPVRIEHWNVAQKAGRIAANHIANPGGKTEHFIPIFWSALGAQLRYCGNTMASGWDDLVLDGSPAENQFIAYYCKGETVVAMASMGRDPAMAQSAELMRVNKMPTKTELQEGISVI

SEQ ID NO: 65639 - protein, 329 aa, Fusobacterium nucleatum subsp. nucleatum ATCC 25586
MRVKIKKMEKKLAILTSGGDAPGMNAAIRATAKIAEYYGFEVYGIRRGYLGMLNDEIFPMTGRFVSGIIDKGGTVLLTARSEEFKEARFREIAANNLKKKGINYLVVIGGDGSYRGANLLYKEHGIKVVGIPGTIDNDICGTDFTLGFDTCLNTILDAMSKIRDTATSHERTILIQVMGRRAGDLALHACIAGGGDGIMIPEMDNPIEMLALQLKERRKNGKLHDIVLVAEGVGNVLDIEEKLKGHINSEIRSVVLGHIQRGGTPSGFDRVLASRMAAKAVEVLNKGEAGVMVGIEKNEMVTHPLEEACSVDKRKSIEKDYELALLLSK

SEQ ID NO: 65640 - protein, 424 aa, Methanosarcina barkeri str. Fusaro
MTSEATLEKSRQMYEKAKTLIPGGVSSPVRAIKPYPFYTASANGSKIKDLDGNEYIDYCLAYGPALLGHNHPVIKEAIKAQLDKGWLYGTPTELEVNLAEKIAGYYPSIDMLRFVSTGTESTMSALRLARGFTGRNKFIKIEGGFHGAHDAVLVKAGSGATTLGEPDSLGIPADFTKYTLQAPYNDIEAMTGLVEKNRDELAAVIIEPVLGNIGPITPLPGYLEELRKLTLENDVLLIFDEVITGFRLAMGGAQEYFGIVPDMTTLGKIVGGGLPIGVFGGKREIMEMISPSGPVYQAGTFSGSPCSIAAGIAVLDYLEQEKIHEKVNSKGDYIRAVLTEIVEDEGIDYSVCGIASMFKIFFGAEPHNYQEALKCDKEGYLAFFHRMLASGIFLPPSQFETNFVSAAHSEEDIEKTLKAYTENL

SEQ ID NO: 65641 - protein, 288 aa, Zea mays
MSFNKVPNIPGSPALSALLKVSVIGGLGVYAITNSLYNVEGGHRAVMFNRLTGIKEKVYPEGTHFMLPWFERPIIYDVRARPYLVESSTGSHDLQTIKIGLRVLTRPMGDRLPHIYRTLGENYSERVLPSIIHETLKAVVAQYNASQLITQREAVSREIRKILTERASNFDIALDDVSITTLTFGKEFTAAIEAKQVAAQEAERAKFIVEKAEQDKRSAVIRAEGEAKSAQLIGQAIANNEAFITLRKIEAAREIAQTIAKSANKVYLSSNDLLLNLQAMNLEPSSKK

SEQ ID NO: 65642 - protein, 508 aa, Glycine max
  misc_feature (192)..(192): Xaa can be any naturally occurring amino acid
  misc_feature (194)..(194): Xaa can be any naturally occurring amino acid
MMELFLSCMVLFVLTLATLGAHWIWVVSSSRAGSKLPPGPFPLPIIGNLLALGKKPHQSLAKLAETHGPIMTLKFGQVTTIVVSSADMAKEVLLTHDHSLSSNRVIPQAVQVHNHHNHSITFLPVSPLWRDLRKICIANLFSNKTLDASQDLRRSKLHQLLHDIHRSSLAGEAVDVGKAVFNTSMNLLSNTXFXSLDLVHSSSSAAAVDFKDLVLKIMEESGKPNLADFFPVLKFMDPQGIKTRTTVYAGKIIDTFRALIHQRLKLRENNHGHDTNNDMLNTLLNCQEMDQTKIEHLALTLFVAGTDTITSTVEWAMAELLQNEKAMSKAKQELEETIGRGKAVEESDIGRLPYLQAVIKETFRLHPAVPFLIPRKANADVEISGGYTIPKDAQVFVNVWAIGRNSSIWKNNANVFSPERFLMDSEDIDVKGHSFELTPFGAGRRICLGLPLAMRMLYLVLGSLINCFNWKLVEDDDVMNMEDSFGITLAKAQPVILIPEKVHGVIVS

SEQ ID NO: 65643 - protein, 451 aa, Alkalilimnicola ehrlichei MLHE-1
MEPHYDLLVIGGGSGGMATARRAASYGAKVALVERSRLGGTCVNVGCVPKKVMWSAAHTADALHRAADYGFRVGPATLDWAELKRRRDAYIRRLNGIYERNIDKSGITLLTGEARLADARTVEVNGERYTASHILLATGGRPSRPDIPGQELGIDSDGFFELAQQPRRVAVVGAGYIAVELAGVLHHLGTQTDLVVRREAALRSFDPLVRDSLLEAMDQDGITLQTHSVPKALERADDGTLTLALEDGRHIGGYDQVIWAIGRDLCTDGLGLEAAGVARNADGSIPVNAYQETNVQGVYAVGDIIGHHPLTPVAIAAGRRLADRLFGGQADRHLDYRYVPTVVFTHPPIGTVGLTEPEARAEYGDDEVEVFTTRFVAMDYALGEDKRRSAMKLVTVGDNRRVVGAHLFGVGSDEMLQGFAVAIRMGATKQDLDDTVAIHPTAAEELVTLPG

SEQ ID NO: 65644 - protein, 525 aa, Xanthomonas oryzae pv. oryzae KACC10331
MIGCSLTPFRSGSLHIGNTGQATTAHPHPALRATFSRWRRERQRTLEMAENYDVVVIGAGPAGYHAAIRAAQLGMKVACIDAALGKDGKPALGGTCLRVGCIPSKALLDSSRQFWNMGHLFGDHGISFNDAKMDVPTMIGRKDKIVKQFTGGIAMLFKANKITPYYGFGQLQPGNIVKVTQHEGGEIALKGTNVILAAGSESIELPFAKFDGDTIVDNVGGLDFTAVPKRLAVIGAGVIGLELGSVWKRLGAEVTILEALPDFLALTDAEVAKTALKEFKKQGLDIKLGAKVGKTEITGSGDAKQVLLSYTDAAGEQTLTVDKLLVAVGRKAATKNLLAEGTGVKVTDRGQIEVDGHCHTGVDGVWAIGDCVRGPMLAHKGFEEGIAVAELIAGLPGHVNFDTIPWVIYTEPEIAWVGKTEQQLKAEGVAYKAGSFPFAAIGRAVAMGEPAGFVKVIADAETDRVLGMHLVGVGVSELVHEGVLTMEFNGSADDLARICHAHPTLSEAIHDAAMAVSKRAIHKAN

SEQ ID NO: 65645 - protein, 400 aa, Xanthomonas oryzae pv. oryzae KACC10331
MATEVKVPVLPESVSDATIASWHKKPGEAVKRDENLVDLETDKVVLEVPSPVDGVLKEIKFEAGSTVTSNQILAIIEEGAVAAAAPADEKKAAAPAAAAPAAAPAAAAAPAPASKSAADSLPPGARFSAITQGVDPSQVEGTGRRGAVTKEDIVNFAKAGGVGKASGARPEERVPMTRVRKTIAKRLMESKNSTAMLTTFNEVNLAKVSAARKELQDEFQKAHGIKLGFMSFFVKAAANALQRFPLVNASIDGDDIIYHGYSDISIAVSTDKGLVTPVLRNVERQSFADVEQGIADYAAKARAGKLGLDDLQGGTFTITNGGTFGSLLSTPIINPPQSAILGMHTIKERPIAENGQVVIAPMMYLALSYDHRIIDGKDSVQFLVDIKNQLENPGRMLFGL

SEQ ID NO: 65646 - protein, 215 aa, Bartonella henselae str. Houston-1
MTEYSSLSGIFFHNWVFIRGVPTIRFLPPEGPPEIAFAGRSNVGKSSLINALVRQKSLARTSNMPGRTQELNYFVPDGFSGRPEDLPPIALVDMPGYGFAKAPKNLVDAWTDLIYSYLRGRTTLKRVYVLIDSRHGIKKNDAEILELLDKAAVSYQIVLTKSDKIKSSVLEQRIITTKTKLLKRPAAYPEILATSSEKAFGLEELRAAILQTIAV

SEQ ID NO: 65647 - protein, 216 aa, Legionella pneumophila str. Lens
MSELKIKAAKAAIAYIEDDMVIGVGTGSTVNFFIKELAAIKHKIEACVASSKATEALLRAEGIPVIDLNSVQDLPIYVDGADEVNERGEMIKGGGGALTREKIVANVATQFICIVDESKVVKRLGEFPVAVEVIPMARSFVARQIVKLGGDPEYREGFITDNGNIILDVFNLNFSTPMALEDSLNVIPGVVENGVFAKRLADKVLVASASGVNNLK

SEQ ID NO: 65648 - protein, 413 aa, Burkholderia pseudomallei K96243
MSTADPYLIAGGGHAARRAAETLRERDAAARIVMIGAEPELPYDRPVLSKEALVGGDAGERRAFVRDAAWYRERDIELRLGVRVEAIERGARRVRLSDGARLGYARLLIATGSRVRRFAGPVDAGVHVHYVRTLADTRALRAALAPGKRVAVLGGGFIGLEVAASAVRLGCRATVVDPAPRLLQRGMPEAVGAFALALHARHGVDVRLGALPERIRRAANGSAVVETSAGGIVADVVVAGIGVVPNVELAQAAGLDVDDGVCVDEMCRTTDPAIFAAGEVTRHFNPLVGRALRIESWQIAENQPAVAAANMLGAAETYAQWPWLWSDQYDCNLQTLGLFGGEQTLVLRGSPERDRAFCVFALNARRELAAVAAVNAGREIAVCRRLMTAGVALDPARLADPSDALRAMLPRGV

SEQ ID NO: 65649 - protein, 206 aa, Bartonella henselae str. Houston-1
MERTLVLIRHGQSEWNLKNLFTGWKDPGLTEKGRTEAIAAGKKLKETGLKFDIAYTSALQRAQKTAQNILEQMEQSDLELIKTPALNERNYGDLSGLNKDEVRQKWGEQQVQIWRRSYTIAPPNGESLRDTGARVWPYYLHHIQPHILRSQTVLIAAHGNSLRALIMALEGLNSEEIISQELATGIPIVYTFNSDSTISSKTIITP

SEQ ID NO: 65650 - protein, 220 aa, Zea mays
  misc_feature (153)..(153): Xaa can be any naturally occurring amino acid
MEADTNARPAKENGRAPAVAEVVAQEAAADPRLQGISDAIRVVPHFPKHGIMFNDITTLLLRPRVFKDAVDLFVERYRGMRIDAVAGIEARGFIFGPAVALAIGAKFIPLRKPRKLPGEVISEKYVLEYGTDCLEMQSEPIDRLGERVLITDXLVATGGTLCAAIRLLLSICFPERAEADVVECACLIGLPKFKRKAGGSFLAVVIEQWRDIDKPTMGVL

SEQ ID NO: 65651 - protein, 316 aa, Pseudomonas aeruginosa UCBPP-PA14
MADFEILCFGETMAMFVAEQPGELDRVEQFGKRIAGADSNVAIGLARLGFAVAWLSRVGDDSLGRFVLDSLTREGLDCRFVEVDAQAPTGFQMKSREVDGADPRVEYFRRGSAASRLGLAHIREEMLGARHLHATGIPPALSASACELSHELMRRMRGKGASLSFDPNLRPSLWPSERRMIAEINALAAHAHWVLPGLEEGRLLSGWQEPADIAAFYLDMGVDAVAIKLGPSGAYYRDAHGEGLVPGVPVATVVDTVGAGDGFAVGVVSALLEGLPLPDAVARGNWIGSRAVQVRGDMEGLPKRSQLLDREHRKSA

SEQ ID NO: 65652 - protein, 1063 aa, Fusobacterium nucleatum subsp. nucleatum ATCC 25586
MGVRLMPKRKDIKTILVIGSGPIIIGQAAEFDYAGTQACLSLREEGYEVILVNSNPATIMTDKEIADKVYIEPLTVEFLSKIIRKEKPDALLPTLGGQVALNLAVSLHESGILDECGVEILGTKLTSIKQAEDRELFRDLMNELNEPVPDSAIVHTLEEAENFVKEIDYPVIVRPAFTMGGTGGGICYNEEDLHEIVPNGLNYSPVHQCLLEKSIAGYKEIEYEVMRDSNDTAIVVCNMENIDPVGIHTGDSIVVAPSQTLTDREHHMLRDVSLKIIRALKIEGGCNVQIALDPNSFKYYIIEVNPRVSRSSALASKATGYPIAKIAAKIAVGMTLDEIINPVTKSSYACFEPAIDYVVTKIPRFPFDKFGDGDRYLGTQMKATGEVMAIGRTLEESLLKAIRSLEYGVHHLGLPNGEEFSLEKIIKRIKLAGDERLFFIGEALRRDVSIEEIHEYTKIDLFFLNKMKNIIDLEHLLKDNKGNIELLRKVKTFGFSDRVIAHRWEMTEPEITELRHKHNIRPVYKMVDTCAAEFDSNTPYFYSTYEFENESTRSDKEKIVVLGSGPIRIGQGIEFDYATVHAIMAIKKLGYEAIVINNNPETVSTDFSISDKLYFEPLTQEDVMEILDLEKPLGVVVQFGGQTAINLADKLVKNGIQILGSSLDSIDTAEDRDRFEKLLIGLKIPQPLGKTAFDVETALKNANEIGYPVLVRPSYVLGGRAMEIVYNDEDLTKYMEKAVHINPDHPVLIDRYLIGKEIEVDAISDGENTFIPGIMEHIERAGVHSGDSISIYPPQSLSEKEIETLIDYTKKLASGLEVKGLINIQYVVSKGEIYVLEVNPRASRTVPFLSKVTGVPVANIAMQCILGKKLKDLGFTKDIADIGNFVSVKVPVFSFQKLKNVDTTLGPEMKSTGEVIGTDVNLQKALYKGLTAAGIKIKDYGRVLFTIDDKNKEAALNLAKGFSDVGFSILTTEGTGIYFEEYGLKVKKVGKIDNSDYSVLDAIQNGDVDIVINTTTKGKSSEKDGFRIRRKATEYGVICFTSLDTANALLRVIESMSFRVQTL

SEQ ID NO: 65653 - protein, 325 aa, Oryza sativa
MQDFPGVFPRIFGHEAFGVVESVGEHVEGFAAGDPVVPTFLGQCTECVDCASERSNVCSTYRFAVRPGMPRDGTARFRDRHGAPIHHFLGVSSFSEYTVVDANQVVRVDPAVPPATASLLSCGATTGVGAAWKLAKVEPGSSVAIFGLGAVGLAVAEGARICGASTIIGVDLNPEKHELGKKFGVTHFINPQELGDKPVSQAIIEMTDGGADYCFECIGLASVMSDAFRSSREGWGKTIILGVEMHGAPLSIPSLEILNGKCVMGSLFGGVKPKQDIPILADKYLNKELELDKFITHEVPLKDINTAFDLLLQGKSLRCTIWMDK

SEQ ID NO: 65654 - protein, 256 aa, Brassica napus
  misc_feature (236)..(236): Xaa can be any naturally occurring amino acid
  misc_feature (247)..(247): Xaa can be any naturally occurring amino acid
MYGGDEVSAIVVDLGSHTCKAGYAGEDAPKAVFPSVVGAVDGVEAMDVDADSAKNNSNSEDSKTNESDKEKGKRKLYVGSQALNYRRDHMEILSPIKDGIVSDWDLVDNIWEHAFRGCLMIDPKEHPMLLAEPPLNTQQQREKAAELMFEKYKVPALFMAKNPVLTSFATGRATSLVVDCGGGSTTISPVHEGYVLQKAVVSAPIGGEFLTDCLLKSLESKGIKIRPRYSFKQREXRPGEFQVEDVXCPDTTESYK

SEQ ID NO: 65655 - protein, 442 aa, Oryza sativa (japonica cultivar-group)
MASPAKAQRRPEGASVLETLPALPLAIIIAKAGPRCAAALACASSTLRAAASGEALWRHFCSDDFALDAPLAPGDLPLPSFKDAYKAWFQSFGMYPLPLVKRVKIFWSSFRAWLCEYFPEGLRTLGEGVSEAEIAVAECNLGLVLPMPTKLLYRFCNGQLHIGRGEEVSYGVMGGYDYVHQRYTVRLLPLAHHAVQKNSNYIVVATSCFGEKIFLLDCASGRLYVGTKYWNEEREIMACVPKATIRLAVDDDHGMPQDGFLLWLEEHLSRLQDGLIKVQSCKFPMLARHISLYPVQLPYCSSASMHGIKVRASAVFAPENSAFADYRCRYSYYFSIRLSLPEAFVVDGKWYSSFQLQSCHYTIQIGDEVLPYTCNYGGHGKCPLLRCGEELFVYGCSISAALEPGSVMGNLTLVPWRCGQPRGSPFIADIAPFPLHPPDYIF

SEQ ID NO: 65656 - protein, 429 aa, Salmonella enterica subsp. enterica serovar Paratyphi A str.
MTRRAIGVSERPPLLQTIPLSLQHLFAMFGATVLVPVLFHINPATVLLFNGIGTLLYLFICKGKIPAYLGSSFAFISPVLLLLPLGYEVALGGFIMCGVLFCLVSFIVKKAGTGWLDVMFPPAAMGAIVAVIGLELAGVAAGMAGLLPAQGQSPDTKTIIISMVTLAVTVFGSVLFRGFLAIIPILIGVLAGYALSFALGVVDTTPIAQAHWFALPTFYTPRFEWFAILTILPAALVVIAEHVGHLVVTANIVKKDLVRDPGLHRSMFANGLSTIVSGFFGSTPNTTYGENIGVMAITRVYSTWVIGGAAIFAILLSCVGKLAAAIQIIPLPVMGGVSLLLYGVIGASGIRVLIESKVDYNKAQNLILTSVILIIGVSGAKVHIGAAELKGMALATIVGIGLSLIFKLISLLRPEEVVLEANDAESPHQ

SEQ ID NO: 65657 - protein, 295 aa, Zea mays
RLLRLDELQLSEAEKARVYQFYIPVFLWCEDQVIEHRAKYSEGDDIPPLVIGVSAPQGSGKTTLVFALDYLFQVAGRKSATLSIDDFYLTAKEQNELRDRYPGNALLELRGNAGSHNLQFSVETLESLMKLTKEGIKMKVPRYDKSAFGGRGDRADPSVWPEVEGPLEVVFFEGWMLGFKPLPNEVVKAVDPQLEVVNNNLEAYYDAWDRFIDSWIVIKIREPSSVYQWRLQAEIAMRADGKPGMSDEEVMDFVSRYLPAYHAYLPKLYKEGPNGSKPDHLLVIDINEGRNPIWG

SEQ ID NO: 65658 - protein, 495 aa, Oryza sativa (japonica cultivar-group)
MGVDSHPNNINDGRLLLSPPPLLPILISDTAAAISPISMAAPPQPQPEPEPAAGGAGLEALEGLALDTVIAKAGARQAAALACASTRLRDAAGDDALWRRFCADDLALHAPLAPDGRALPSFKDAYKVWLESFGMYPLPLVRRVKIFWSSLKSWLSENFPEAHKTLNKGVSEAQIQSAEDDLGFKLPLPTKLLYRFCNGQLPLSEHHHENMRMAHLGIIGGYVFYDHLINVHLSPLEQIVEETKEFYREFYDQGVFNMTNLIIVATSWYRPKTFFLNCSDDQLYVGTINLQDGEMLPCVPKSLIRPTNTDMPQDGLLLWLEEHLRRLQNGMIKIRMLKTSRYISLFPEASPSCTSAMTNGVKVRASAVFAPEHPESRRPGAKCLYAYSIRLSVPEACMLGGVYYSSCQLYSRHWIIRWRDRVVSDVNGEGVIGKYPLLTTGQEEFVYESCTPLPDSPGSVEGSFTFVPGKLSRPEGKPFEVTVAAFPLEIPEYIF

SEQ ID NO: 65659 - protein, 1175 aa, Haloarcula marismortui ATCC 43049
MATAENTELIDRFEEFYRNYYRNEIGELAQKYPNDQKSLYIDWDDLYRFDPDLADDYRTKPEQIQEYAEEALRLYDLPVDVSLGQAHVRVRNLPESEDIRDLRHEHHGNLVAVRGIIRKATDVRPKVIEAAFECQRCGTLTRIPQTAGDFQEPHDCQGCERQGPFRLNTDQSQFIDAQKLRVQESPEGLRGGETPQSIDINIEDDITGHVTAGDHVRVTGILKLDQRGNDNEKSPMFDIYMEGVSVEIEDEQFEDMEITDADKTEIVELSSEPDIYDKMVGAIAPSIYGYEKEKLAMMLQLFSGVTKELPDGSRIRGDLHMLLIGDPGTGKCVHGDTRVTLADGHERPIREVVESNLDDPKPVDDGVWDTVDFDVPSLQSDGTVATQNATKVWKRKAPETLYRIRTATGRELDVTPSHPLFVQSDGRFQARKAEELESGTHVAVPRKVSTNACNELDVTFRQSQAHNRIDLDLPPQWTPELARLIGYIVAEGYVEQRPDNTGYVSITNNDREVLDDAKSVLETLNLNVTERSSHEGKTARELLCSAGEFVSFLASLDETLLQSSAERRVPQDIMRASDNVVTGFIRGYIEGEGHVSTSQREITVASMSKPLLEDVRTLLVTQGITAQLQPRNNGSYRLRISGQSFHDYAEQIGFITARKTEACRQFEGTHGNTNLDIVPNLGPELRRIREALGLTQSECGLPRSTYQHYERGRRNPSRDSLESVLDAFETRLAEMNNDTPISDTARSDGGGTGSLRQDLNGLAALVEGDIAWDRIESIEPIEHDEKWVYDLEIEGTHNYLTNGVVSHNSQMLSYIENIAPRSVYTSGKGSSSAGLTAAAVRDDFGDGQQWTLEAGALVLADQGIAAIDELDKMSPEDRSAMHEALEQQRISVSKAGINATLKSRCSLLGAANPKYGRFDQYEPIGEQIDLEPALISRFDLIFTVTDKPDEEKDRNLAEHIIQTNYAGELHTHRTENPTSNFSEEEVGTVTEEVAPTIEPDLLRKYVAYAKRNCFPTMTEEAKSRIEDFYVDLRLKGQDEDAPVPVTARKLEALVRLAEASARIRLSDTVDEADADRAVDIAHYCLKEIGVDPETGEFDADVVETGQSKTQRDRIQNIKGIISDIEDEYDEGAPADVVIERAEEVGIDESKAEHEIDKLKQKGEVYEPRTDHLRTT

SEQ ID NO: 65660 - protein, 663 aa, Oceanobacter sp. RED65
MTDRRHLANAIRALSMDAVQKAKSGHPGAPMGMADIAEVLWNDHLKHNPSNPDWADRDRFVLSNGHGSMLIYSLLHLTGYDLSLDELKNFRQMHSKTPGHPEYGYAPGIETTTGPLGQGIANGVGMALAEKVLAAQFNKPGHEIVDHNTYVFLGDGCMMEGISHEACSLAGTLGLGKLVAFYDDNGISIDGEVEGWFTDDTVKRFESYGWHVIPAVDGHDSAAIEAAIQAAKAESDKPTLICCKTIIGFGSPNKEGKEDCHGAPLGDDEIVATKERLGWKYGSFEVPQDVYDAWDAKGTGASAEQAWNEKFDAYQAAYPELAAEFKRRMAGDLPADFEAQADAYIAACQEKGEDVASRKASQNTIKEFAPKLPEILGGSADLAGSNLTLWPEAKGVEAKDANGNYIYYGVREFGMSAIMNGIALHKGFVTYGATFLMFMEYARNAVRMAALMKQRAIHVYTHDSIGLGEDGPTHQPVEQLTALRSTPNLNTWRPCDTVETAVAWKSAVMRDNGPTALIYSRQGLPHQDRMPAQVDAIAKGAYVLKDSADAKAILIATGSEVGLAMEAAEQLEAKGTAVRVVSMPCAEVFMQQDADYIESVLPSAITARVAVEAAHKDYWYKFVGLKGAVVGMETFGESAPIKDLMQHFGFTAENVVATVESVL

SEQ ID NO: 65661 - protein, 141 aa, Aspergillus oryzae
MSSPRAVHTTRAPAPPAFLSQAIRFGSIIFCSGQIGCDPETGRLIEGTIQERTKQILSNISSILLAGGSGLDNIVKCNIYLTDMGDFGPMNEVYTTFFSDPMPARTCVCVKELPLGTDVEIECIAAVKGDQKEDLVMSALL

SEQ ID NO: 65662 - protein, 116 aa, Fusobacterium nucleatum subsp. nucleatum ATCC 25586
MKEKLIELVEKEYLRSDIPQFKAGDTIGVYYKVKEGNKERVQLFEGVVIRVNGGGVAKTFTVRKVTAGIGVERIIPVNSPNIDRIEVLKVGRVRRSKLYYLRGLSAKKARIKEIVK

SEQ ID NO: 65663 - protein, 117 aa, Alvinella pompejana epibiont 7G3
MCIFCKIIKGEIPSNRVLESDKFLAFHDINPVAPVHILIIPKEHIGSFHETPKELMGEMTPFIQEVAEKLGLDGSGYRLITNIGDDGGQEISHLHFHLVGGGRLSFPPLYEDYKKSI

SEQ ID NO: 65664 - protein, 465 aa, Oryza sativa (japonica cultivar-group)
MVDRIGAAWWCACAVGMLVVGACLAGETSEYRRQLGSAVDMPLDADVFRAPPGRNAPQQVHITQGNHDGTAMIISWVTTIEPGSSTVLYGTSEDNLNFSADGKHTQYTFYNYTSGYIHHCTIKKLEFDTKYYYAVGIGQTVRKFWFRTPPKSGPDVPYTFGLIGDLGQSYDSNITLAHYESNSKAQAVLFVGDLCYADNYPYHDNVRWDTWARFVERNVAYQPWIWTAGNHEIDFAPELGETKPFKPYSYRYPTPYKASGSTAPFWYSVKRASAYIIVLASYSSYGKYTPQYKWLEAEFPKVNRSETPWLIVLLHAPWYNSYNYHYMEGESMRVMYEPWFVKYKVDLVFAGHVHAYERTHRISNVAYNIVNGQCTPVHDQSAPVYITIGDGGNQEGLATNMTAPQPGYSAFRESSFGHAILDIKNRTHAYYTWHRNQDGNAVAADSMWFTNRYWQPTDESLDDSQ

SEQ ID NO: 65665 - protein, 880 aa, Medicago truncatula
MNFRFQNLLGAPYRGGNAVISNNTLLLSPVGNRVSVTDLRKSQTTTLPIQSSSNISRIAVSPDGTFLLAIDENNRCLFINLRRRALLHRITFKHRVGAVKFSPDGKLIAVAAGKLVQIWRSPAFRKEYFPFELIRTFADFHAKVTAFDWSSDSNYLLVASKDLTARILCLKKVYGGVKYKPFLFLGHRDSVVGSFFGVDSKTSKVSKVYTVTRDCYILSWGFTEDEELSEPPSPGTPDRDVEGDLMVEDDGDVKKRKEREFEDGGYLCKGKWELLRKDCFNQAPAKVSACDYHRGLDMVVVGFSNGVFGLYQMPDFVCIHLLSISKAKITTAMFNDLGNWLSFGCAKLGQLLVWEWRSESYILKQQGHYFDVNCVAYSQDSQLLATGADDNKVKVWTVSSGFCFVTFSEHTNAVTALHFMASNNCLLSASLDGTIRAWDLVRYRNFRTFTTPSSRQFVSLAADQSGEVICAGTSDSFEIFVWSMRTGRLLDVLSGHEAPVHGLVFSPTNAVLASSSWDKTVRLWDVFDGKGAVETWPHTHDVLTVVFRPDGKQLACSTLDGQIYFWDPVDGLLMYTIEGSRDIAGGRLMTDRRTAANSSTGKCFTTLCYSADGSYILAGGSSRYICMYDVADQVLLRRFQITHNLSLDGVLDFLNSKNMTEAGPLDLIDDYNSDVEEGVETQTRGKLGLDLPGSVSNRGRPIIQTKCLRIAPTGRSFVAATTEGVLVYSVDESFIFDPTDLDIDVTPEAVDKALNENQPSRALILSLRLNEDSFIKKCIFTVSPADIPAVATSIPYKYLQRLIEALASLLENCPHLEFILRWSQELCKAHANSIQQNSRNLLPSLKSLQKSITSIHQDLADTCSSNEYMLRYLCSSSASK

SEQ ID NO: 65666 - protein, 926 aa, Klebsiella aerogenes
DVVVRLPDDAFRAAFGVALADAHWVDKTTLLWPGGENKPIVRLYYSHSSKVAADSNGEFSDKYVKLTPTTVNQQVSMRFPHLASYPAFKLPDDVNVDELLQGETVAIAAESDGILSSATQVQTAGVLDDTYAAAAEALSYGAQLTDSGVTFRVWAPTAQQVELVIYSADKKVIASHPMTRDSASGAWSWQGGSDLKGAFYRYAMTVYHPQSRKVEQYEVTDPYAHSLSTNSEYSQVVDLNDSALKPEGWDGLTMPHAQKTKADLAKMTIHESHIRDLSAWDQTVPAELRGKYLALTAQESNMVQHLKQLSASGVTHIELLPVFDLATVNEFSDKVADIQQPFSRLCEVNSAVKSSEFAGYCDSGSTVEEVLTQLKQNDSKDNPQVQALNTLVAQTDSYNWGYDPFHYTVPEGSYATDPEGTARIKEFRTMIQAIKQDLGMNVIMDVVYNHTNAAGPTDRTSVLDKIVPWYYQRLNETTGSVESATCCSDSAPEHRMFAKLIADSLAVWTTDYKIDGFRFDLMLYHPKAQILSAWERIKALNPDIYFFGEGWDSNQSDRFEIASQINLKGTGIGTFSDRLRDAVRGGGPFDSGDALRQNQGVGSGAGVLPNELTTLSDDQARHLADLTRLGMAGNLADFVLIDKDGAVKRGSEIDYNGAPGGYAADPTEVVNYVSKHDNQTLWDMISYKAAQEADLDTRVRMQAVSLATVMLGQGIAFDQQGSELLRSKSFTRDSYDSGDWFNRVDYSLQDNNYNVGMPRSSDDGSNYDIIARVKDAVATPGETELKQMTAFYQELTALRKSSPLFTLGDGATVMKRVDFRNTGADQQTGLLVMTIDDGMQAGASLDSRVDGIVVAINAAPESRTLQDFAGTSLQLSAIQQAAGDRSLASGVQVAADGSVTLPAWSVAVLELPQGESQGAGLPVSSK

SEQ ID NO: 65667 - protein, 406 aa, Haloferax volcanii DS2
MMTDTVDDVDLPYDKDSASQQEKITALQERLEVLETQNEEMRDKLLDTNAENNKYQQKLERLTHENKKLKQSPLFVATVQEITDEGVIIKQHGNNQEALTEVTDEMREELEPDARVAVNNSLSIVKRLDKETDVRARVMQVEHSPDVTYEDIGGLEEQMQEVRETVEMPLDRPEMFAEVGIDPPSGVLLYGPPGTGKTMLAKAVANQTNASFIKMAGSELVHKFIGEGAKLVRDLFEVARENEPAVIFIDEIDAIASKRTDSKTSGDAEVQRTMMQLLAEMDGFDERGNIRIIAATNRFDMLDPAILRPGRFDRLIEVPKPNEDGREIIFQIHTRKMNVSDDVDFVELAEMADNASGADIKAVCTEAGMFAIRDDRTEIFMQDFVDAWEKIQQEASDETEVSRAFA

SEQ ID NO: 65668 - protein, 386 aa, Oceanobacter sp. RED65
MSVLRMLDQDLKGKRVLIREDLNVPVKDGKVTSDARLRASMPTIKHALEAGAKVIVMSHLGRPTEGEYAEEFSMQPVANYLADALGKDVPVVKDFREGVDVAEGELVLLENVRFNKGEKKDEDDLAKAYAELCDVFVMDAFGTAHRAQASTHGVAKFAPVACAGPLLAAELDALGKALDKPERPLVAIVGGSKVSTKLEVLESLSDICDQIIVGGGIANTFLAAAGKPVGKSLCEEDLIPNAKALMEKVSIPVPTDVVCGKEFSESAEATLKDAADVAEDDMIFDIGPDSAKALAEQLKEAKTIIWNGPVGVFEFDQFGEGTKALSLAIAESQGFSIAGGGDTLAAVDKYEIADKVSYISTGGGAFLEFVEGKTLPAVAILEQRAK

SEQ ID NO: 65669 - protein, 288 aa, Brassica napus
ARRYVVALAGAGNAVDYLPFSRWVSDYEKRAMKLASRLDEFLQGLVDEKRDAKEKGNTMVDHLLSLQETQPDYFTDRIIKGNMVALILAGTDTSAVTLEWALSNLLNHPDVLKKARDEIDCKVGLDRLIDESDISNLPYLQNIVSETLRLYPSVPMLLPHVASEDCKVGAYDMPSGTILLTSAWAIHRDPQLWEDPTSFKPERFEKEGESQKLMPFGLGRRACPGSGLAHRLINLTLGSLIQCLEWERIGEEKVDMSEGKGGTMPKAKPLEAMCRARASVGKIFYEGA

SEQ ID NO: 65670 - protein, 302 aa, Burkholderia pseudomallei K96243
MIRRAIEEQAMLAGMMLIGSAVTFGVWAGRNPLVVLNAAARRPTFVGRFGLTYGAGPRRALDVYLPAAREPQPAGGGAPLVVFFYGGSWQRGRRGDYRFVGEALASRGCVVAIPDYRLYPDAVFPGFVEDAAAAVRWARDHAAALGADPRRIHVAGHSAGAQIATLLATDSRFLRAHGLDKRDLAGVVGLAGPYDFLPLEDAALKRIFPEPVRDASQPIRFVDGREPPMLLASGLRDATVKPGNTVRFASRVAAAGGAVQVRLYPGIGHALLVGALGLPMRRFLPVLDDVAAFVRAAPRAPA

SEQ ID NO: 65671 - protein, 102 aa, Oryza sativa (japonica cultivar-group)
MESPTKVDDEQWLAYWILYSFITLLEMVAEPVLYWIPVWYPVKVLFVAWLVLPQFKGASFIYKKLVREQLRKYRARGGAAATVTAGEDHKVHIAKAEHDHGH

SEQ ID NO: 65672 - protein, 480 aa, Haloarcula marismortui ATCC 43049
MSKCRRKRRNLCANQQGFSSSTAPIGCPKMTSELSEAAQEVLDEIDEKNVDFLRLQFTDILGTIKNVSITADQAEKAFTEGIYFDGSSINGFVRIQESDMRLDPDPSTFSVLPWRENVEGGSSARLICDVIDTSTGEPFSGDPRGVLKRAIERANDMGYTVNAAPEPEFFLFEEDEEGRATTKTNDAGGYFDLAPKDLASDVRRDIIYGLEDMGFDIEASHHEVAQGQHEINFTYDDALSTADNVATFRSVVRAIAAEHDLHATFMPKPIPKINGSGMHTHLSLFTEDGENAFHDEDDEFNLSETAKSFTAGILKHAPAITAVSNPTVNSYKRLVPGYEAPVYVAWSDRNRSALIRKPAARTPAASRIEARFPDPSCNPYLAFAALIHAGLDGVEQDLECDDPVRENIYDFDEEKREEYGITTLPSNLGEAVEALEDDEVIQDALGEHVYENFVEAKTQEHKEYLVDVSDWELDRYLEKF

SEQ ID NO: 65673 - protein, 148 aa, Glycine max
MKNGIMECRVCHSKLVSPSAKTISRAYDRHKSRISSKQRALNVFLVVGDCVLVGFQPILVYMSKVDGKFNFSPISVNFLTEITKVFFAIVMLLLQARHQKVGEKPLLSISTFVQAARNNVLLAVPALLYAINNYLKFIMQLYFNPATV

SEQ ID NO: 65674 - protein, 341 aa, Triticum aestivum
  misc_feature (197)..(197): Xaa can be any naturally occurring amino acid
MAAKTKAPAGTPVGPVPFADVETDPGLVSPVPEQLPEEHAALPSASAFNGRMNIRCYQGFWLPDYFAAAAVALQRRFEPCRNDVIVASFPKSGTTWLNALAFATMARRAYPAADAGHPLLRLNPHQCIPFLENLFRSRAEAAKLEALPSPRLMNTHMPLGMIMPGAGGCKVVYVCREPKDMVVSLWHFLQHVHPDLXLADVLDSVCSGAVPYGPVWDHILGYWRASIARPDAVLFLRYEELLRDPAGNVRDLARFVGLPFSDEEEDAGVVQDIVKLCSFGHLKPLEANSTGQLDPLVPVPREALFRKGVAGDWANHMTPEMARRLDEIVADKFHATGLTFQ

SEQ ID NO: 65675 - protein, 491 aa, Fusobacterium nucleatum subsp. nucleatum ATCC 25586
MENILKKSYKMFINGEWIDSSNGVMVKSYAPYNNELLSEFPDASESDIDFAIKSAKEAFKTWRKTTVKERARILNKIADIIDENKDLLATVETMDNGKPIRETKLVDIPLAATHFRYFAGCILADEGQATVLDEKFLSLILREPIGVVGQIIPWNFPFLMAAWKLAPALAAGDTVVLKPSSTTTLSLLVLMELIQDVIPKGVVNLVTGKGSTAGEFLKNHPDLDKLAFTGSTAVGRDIALAAAEKLIPATLELGGKSANIILDDADIEKALEGAQLGILFNQGQVCCAGSRIFVQEGIYDEFISKLVKKFENIKIGNPLDPTTIMGSQIDARQVKTILDYVEIAKQEGGVILTGGVKYTENGCDKGNFVRPTLITNVNNGCRVSQEEIFGPVAVVIKFKTDDEVIAQANDSEYGLGGAVFTKNINRALKLAREIQTGRVWINTYNQIPEHAPFGGYKKSGIGRETHKVILEHYTQMKNILIDLEEGTSGLY

SEQ ID NO: 65676 - protein, 261 aa, Capsella bursa-pastoris
MAEENKNNVPEHETPKVATTEEPSTTTTTPEVTDRGMFDFLSKKKEEVKPQETTTLESEFDHKAQISEPALAAEHEEVKENKITLLEELQEKTEEDEENKPSVIEKLHRSNSSSSSSSDEEGEEKKKKKTVEGEEEKKGAMDKIKEKLPGHHDKETEDHDVPVVSTIQVPVSESVVEHHETEGEEKKGVMDKIKEKLPGRNDKETEDSPVPTSTPLVVTEHPVGHSTEQPAEKKGIIEKIKEKLPGYHAKTEEEKKEKESA

SEQ ID NO: 65677 - protein, 480 aa, Arabidopsis thaliana
MNKFALVFVPFPILGHLKSTAEMAKLLVEQETRLSISIIILPLLSGDDVSASAYISALSAASNDRLHYEVISDGDQPTVGLHVDNHIPMVKRTVAKLVDDYSRRPDSPRLAGLVVDMFCISVIDVANEVSVPCYLFYTSNVGILALGLHIQMLFDKKEYSVSETDFEDSEVVLDVPSLTCPYPVKCLPYGLATKEWLPMYLNQGRRFREMKGILVNTFAELEPYALESLHSSGDTPRAYPVGPLLHLENHVDGSKDEKGSDILRWLDEQPPKSVVFLCFGSIGGFNEEQAREMAIALERSGHRFLWSLRRASRDIDKELPGEFKNLEEILPEGFFDRTKDKGKVIGWAPQVAVLAKPAIGGFVTHCGWNSILESLWFGVPIAPWPLYAEQKFNAFVMVEELGLAVKIRKYWRGDQLVGTATVIVTAEEIERGIRCLMEQDSDVRNRVKEMSKKCHMALKDGGSSQSALKLFIQDVTKYIA

SEQ ID NO: 65678 - protein, 463 aa, Glycine max
GLLGSIFPKPFGTTSKFPHCPLPQRNNSTVPYDKGFLRAGAMSSPYLPATTDSLALATEAKDPSEAISILYRVLDDPSSSPDALRMKEQAITNLTKLLTDENRGEDLRSLLTQLRPFFSLIPKAKTAKIVRGIIDSVAKIPGTSDLQIALCKEMVLWTRAEKRTFLRQRVEARLAALLMESKEYSEALTLLSGLVKEVRRLDDKLLLVDIDLLESKLHFSLRNLPKAKAALTAARTAANAIYVPPAQQGAIDLQSGILHAEEKDYKTAYSYFFEAFESFNALDDPKAVFSLKYMLLCKIMVNQADDVGGIISSKAGLQYLGPDLDAMKAVADAHSKRSLKLFEIALRDYKAQLEEDPIVHRHLSSLYDTLMEQNLCRLIEPFSRVEIAHIAELIELPTDHVERKLSQMILDKKFAGTLDQGAGCLVIFDDPKTDAIYPATLETISNVGKVVDSLYVRSAKIMA

SEQ ID NO: 65679 - protein, 352 aa, Xanthomonas oryzae pv. oryzae KACC10331
MLPVHRVLRYLGLAFARCTGGGTRMSAAKHQVVCFGEALIDMLALPQASPAEARTFAQYAGGAPANVAVAVARLGGAAHFVGMLGRDMFGDFLLQSLQQSGVVTDGIVRTDQAKTALAFVALDEAGERSFSFYRPPAADLLFRPEHFAADGFMQAAVLHVCSNSMTEPEIAQCTLDGMRRARADGAIVSLDLNLRPMLWPQDVDPAPLLWDALALADVVKLSREELDYLAGTLDSDASAVTQKLWQGSASWLLVTDGGGPVHWQTRTDSGQVPAFRVQVRDSTAAGDAFVGGLLYQLAARASSLEQLCGDPAAINEVIRFAAAVGALAVTRKGAFAAMPSVDEVHTLIQEQS

SEQ ID NO: 65680 - protein, 412 aa, Haloferax volcanii DS2
MSRSPSLPERPHLDLDPEMSDAERLSALRQHFERMVDVNRELDQRLQNADDRHAELVDEVDQMKARNEALKTASYYIATVEELTDDGVIIKQHGNNQEVLTEFAPSLNIDDIEPGDRVAINDSFAVQTVLDDETDARAQAMEVVESPTVTYDDIGGIDEQVREVREAVEQPLENPEMFAEVGIDPPSGVLLYGPPGTGKTMLAKAVANETNASFIKMAGSELVQKFIGEGARLVRDLFKLAAEREPVVVFIDEIDAVASKRTDSKTSGDAEVQRTMMQLLSEMDGFDDRGDIRIIAATNRFDMLDEAILRPGRFDRLIEVPKPAVEGRRHILDIHTRDMNVADDVDLDALAEELDDYSGADIASLTTEAGMFAIRDGRTEVTGADFDAAHEKLSNVDESGTGPISGFTDYQY

SEQ ID NO: 65681 - protein, 666 aa, Salmonella enterica subsp. enterica serovar Paratyphi A str.
MSRKDLANAIRALSMDAVQKANSGHPGAPMGMADIAEVLWNDFLKHNPTDPTWYDRDRFILSNGHASMLLYSLLHLTGYDLPLEELKNFRQLHSKTPGHPEIGYTPGVETTTGPLGQGLANAVGLAIAERTLGAQFNRPDHEIVDHYTYVFMGDGCLMEGISHEVCSLAGTLGLGKLIGFYDHNGISIDGETEGWFTDDTAKRFEAYHWHVVHDIDGHDPEAVKKAILEAQSVKDKPSLIICRTVIGFGSPNKAGKEESHGAALGEEEVALTRQKLGWHHPAFEIPKEIYRAWDGREKGEKAQRQWQEKFAAYEKAYPELAAKFTRRMSGGLPETWESATQKFINDLQANPAKIATRKASQNTLNAYGPLLPELLGGSADLAPSNLTIWKGSTSLKEDPAGNYIHYGVREFGMTAIANGIAHHGGFVPYTATFLMFVEYARNAARMAALMKARQIMVHTHDSIGLGEDGPTHQAVEQLASLRLTPNFSTWRPCDQVEAAVGWKLAIERQHGPTALILSRQNLAQVERTPEQVKAIARGGYILKDSGGKPDIILIATGSEMEITLQAAEKLTGEGHNVRVVSLPSTDIFDAQDEAYRESVLPAHVTARVAVEAGIADYWYKYVGLKGAIIGMTGYGESAPADKLFPYFGFTVENIVEKARRVLNIKG

SEQ ID NO: 65682 - protein, 1012 aa, Candidatus Pelagibacter ubique HTCC1002
MSEKLLVPDIGEFEKVEVIELLVKVGDQINLNDPVVTIESDKSSVEIPATVSGKVESVNIKVGDKVSKGDLLLSIESSKESPSEKPIPKDTENIIKQAESVLKNEKKEETIQQNPAPEKKQTIIQVTNENDIDPLETQDWLESLSAVVEKDGNQRAHFLIKELINKAYREGANIPYTQHTPYINTIPPEAEVKSNGDQNIERRIRSLIRWNAAAMVVRANKKFPELGGHIGTFASAATLYDVGMNHFWRAKNNKFGGDLVYFQGHSAPGVYARAFLEGRLNEKQLDSFRQEVKPGGLSSYPHPWLMPKFWQFPTVSMGLGPMLAIYQARYMKYLINRGLIKDEGRKVWAFLGDGEMDEPESLGAIGLASREKLDNLIFVVNCNLQRLDGPVRGNGKIIQELEGSFRGAGWNVIKVIWGSYWDSLIANDKTGHLVKAMNETVDGEYQAMKARDGAYVREKFFGKYPETQELVSSLSDKDIWRLNRGGHDPHKVYAAYDRASKNQGSPTVIIAKTIKGYGMGKTGESVNTTHQTKKLDVDDLLYYRDRFDVPLTDDQVKNVEYFKPDEKSPEIKYIKERRMNLGGSLPERTTYAKPIKAPAKDIFDFMKVSTGEKEMSTTMALVRMFTNLLRDKNVSPRLVPIIPDEARTFGMEGFFQKIGIYAHEGQKYEPEDSAQLSSYREDKSGQVLEEGINEAGAMSSWIAAATAYTNHDIEMIPIYIFYSMFGFQRIGDLAWAAGDSQARGFLIGATAGRTTLAGEGLQHQDGHSHLIASTIPNCVTYDPTFHYELAVIFREGLRRMHEKNENVFYYITTMNENYSHPSMPEDKNCEEGILKGMYKIKEFNKYKKTKIQLLGSGTILREMMAAAEILQSEYQIDSEIWSVTSFNELRKDGMEVERYNLLNPDKEQKVSFVEQCLGKTEGPIMAASDYMRMNSDQIRPYTNKSFYSLGTDGYGRSDTRKNLRKFFEVDKEHIVAYGLSVLAKEQLIASKYAKEAIKKYNIDGNKPMPTKL

SEQ ID NO: 65683 - protein, 316 aa, Salmonella enterica subsp. enterica serovar Paratyphi A str.
MNQLDGIKQFTTVVADSGDIESIRHYQPQDATTNPSLLLKAAGLEQYGHLIEDAIAWGKKHGGTQEQQVAAASDKLAVNFGAEILKSIPGRVSTEVDARLSFDKEKSIEKARHLVGLYQQQGIDKSRILIKLAATWEGIRAAGQLEKEGINCNLTLLFSFAQARACAEAGVYLISPFVGRIYDWYQARSPLEPYVVEEDPGVKSVRNIYDYFKQHRYETIVMGASFRRTEQILALTGCDRLTISPNLLKELKEKEEPVIRKLVPSSQMFHRPTSMTEAEFRWEHNQDAMAVEKLSEGIRLFAVDQRKLEDLLAAKL

SEQ ID NO: 65684 - protein, 163 aa, Arabidopsis thaliana
MVEHQMKPVASFLLVLNFCMYAIVLGIGAWSMNKAINHGFLIGADYSLPAHFSPIHFPMGNAATGFFIMFALIAGVAGAASVISGISHLQSWTTTSLPAAVSAATIAWSLTLLAMGFGCKEIELGMRNARLVSKPLMRTMEAFLIILSATQLLYIAAIYGVRK

SEQ ID NO: 65685 - protein, 133 aa, Zygosaccharomyces rouxii
HTGVGFLDHMIHALAKHSGWSLIVECIGDLHIDDHHTTEDCGIALGDAFKQALGQVRGVKRFGFGFAPLDEALSRAVVDLSNRPYSVIELGLKREKIGDLSCEMIPHFLESFTEAARLTVHVDCLRGFNDHHR

SEQ ID NO: 65686 - protein, 200 aa, Legionella pneumophila str. Lens
MPINLYSKAVFLKSAARVNQLPEDSGYEVAFAGRSNAGKSSALNCLTNNKNLARTSKTPGRTQLINLFSLDEQRRLVDLPGYGYAKVAMEVKLEWQKNLAHYLEARQCLRGLILLMDVRHPLKDLDQILVNWALHRELPVHILLTKADKLSRSEVKNAVLKVRQYYELAEHLVSVQAFSSVKKDGVEELISVLDRWYEWN

SEQ ID NO: 65687 - protein, 131 aa, Zygosaccharomyces rouxii
GFLDHMIHALAKHSGWSLIVECIGDLHIDDHHTTEDCGIALGDAFKQALGQVRGVKRFGFGFAPLDEALSRAVVDLSNRPYSVIELGLKREKIGDLSCEMIPHFLESFTEAARLTVHVDCLRGFNDHHRSE

SEQ ID NO: 65688 - protein, 577 aa, Streptococcus thermophilus
MTKMLKGIAASDGVAVAKAYLLVQPDLSFETVTVEDTSAEEARLDAALAASQDELSVIREKAVESLGEEAAAVFDAHLMVLADPEMTGQIKETIRAKQVNAEAALTEVTNMFIAIFEGMDDNPYMQERAADIRDVTKRVLANLLGKKLPNPATIDEESIIVAHDLTPSDTAQLNKKFVKAFVTDIGGRTSHSAIMARTLEIPAVLGTNNITELVKDGDILAVSGITGEVVINPTEEQIAEFKAAGEDYAKQKAEWAQLKDAPTVTADGKHFELAANIGTPKDVEGVNDNGAEAVGLYRTEFLYMDSQDFPTEEDQYEAYKAVLEGMNGKPVVVRTMDIGGDKELPYFDLPKEMNPFLGYRALRISISETGNQMFRTQLRALLRASVHGKLRIMFPMVALLTEFRTAKGILEEEKAKLVAEGVAVANDIEVGIMIEIPAAAMLADQFAKEVDFFSIGTNDLIQYTMAADRMNEQVSYLYQPYNPSILRLINNVIKAAHAEGKWAGMCGEMAGDQTAVPLLVGMGLDEFSMSATSILRTRSLMKKLDTAKMEEYANRALTECSTMEEVLELSKKYVNVD

SEQ ID NO: 65689 - protein, 259 aa, Gibberella zeae PH-1
MASKTFEWRPAKLLQDYNIGQDFALLILNQPLKNGVNLRKLWKNSSVRVAADGGANRLHKLSSFHGKYSNLQLIIGDLDSLTPTVRDFYSSQPSPAQIIRDADQESTDFSKAVNWIRKEHSGIDIVALGGIGGRVDQGLSQLHHLYLFQTDPEYASGRVFLLSGSSLTFLLKAGTHHIQVREDGEEDAFGKHIGIIPLKEAANITTKGFEWDVEDWHTEIGGKLSTSNHILPDSQIVTVTTNKDVLFTVALKEGDGDDE

SEQ ID NO: 65690 - protein, 639 aa, Oryza sativa
  misc_feature (533)..(533): Xaa can be any naturally occurring amino acid
  misc_feature (581)..(581): Xaa can be any naturally occurring amino acid
MRSSWADSVANAEESAPATGAAPTPVANHQNSRPTRSAYVPPHLRGQAPTTTAAPAPAPGPAAVQPSASVQPSGYAAIVGGSRWAGPASGDGTGAVGGPRQSVGGRGGGGGGGGGWNSRPGWDRRDREPNPFANSEAEEATEVDFDTANTGINFDAYEDIPVETSGHDVPPPVNTFAEIDLGDALNENIRRCKYVKPTPVQRYAIPISIAGRDLMACAQTGSGKTAAFCFPIISGIMSSRPPQRPRGSRTAYPLALILSPTRELSVQIHEEARKFAYQTGVRVVVAYGGAPIHQQLRELERGVEILVATPGRLMDLLERARVSLQMVKYLALDEADRMLDMGFEPQIRKIVEQMDMPPRGVRQTMLFSATFPKEIQRMASDFLADYIFLAVGRVGSSTDLIAQRVEFVLEADKRSYLMDLLHAQKANGTHGKQALTLVFVETKRGADALENWLYTNGFPATSIHGDRTQQEREYALRSFKSGATPILVATDVAARGLDIPHVAHVINFDLPNDIDDYVHRIGRTGRAGKSGLXATAFFNEGNLSLARPLCELMQEANQEVPQWLERYSARSSFGGGGGRNXRRSGGARFGGRDFRRDNRGGGGGGYGGGGGGYGGGGYGGGGGYGGGYGGGQGSTSSWD

SEQ ID NO: 65691 - protein, 920 aa, Klebsiella aerogenes
DVVVRLPAFGVALADAHWVDKTTLLWPGGENKPIVRLYYSHSSKVAADSNGEFSDKYVKLTPTTVNQQVSMRFPHLASYPAFKLPDDVNVDELLQGETVAIAAESDGILSSATQVQTAGVLDDTYAAAAEALSYGAQLTDSGVTFRVWAPTAQQVELVIYSADKKVIASHPMTRDSASGAWSWQGGSDLKGAFYRYAMTVYHPQSRKVEQYEVTDPYAHSLSTNSEYSQVVDLNDSALKPEGWDGLTMPHAQKTKADLAKMTIHESHIRDLSAWDQTVPAELRGKYLALTAQESNMVQHLKQLSASGVTHIELLPVFDLATVNEFSDKVADIQQPFSRLCEVNSAVKSSEFAGYCDSGSTVEEVLTQLKQNDSKDNPQVQALNTLVAQTDSYNWGYDPFHYTVPEGSYATDPEGTARIKEFRTMIQAIKQDLGMNVIMDVVYNHTNAAGPTDRTSVLDKIVPWYYQRLNETTGSVESATCCSDSAPEHRMFAKLIADSLAVWTTDYKIDGFRFDLMLYHPKAQILSAWERIKALNPDIYFFGEGWDSNQSDRFEIASQINLKGTGIGTFSDRLRDAVRGGGPFDSGDALRQNQGVGSGAGVLPNELTTLSDDQARHLADLTRLGMAGNLADFVLIDKDGAVKRGSEIDYNGAPGGYAADPTEVVNYVSKHDNQTLWDMISYKAAQEADLDTRVRMQAVSLATVMLGQGIAFDQQGSELLRSKSFTRDSYDSGDWFNRVDYSLQDNNYNVGMPRSSDDGSNYDIIARVKDAVATPGETELKQMTAFYQELTALRKSSPLFTLGDGATVMKRVDFRNTGADQQTGLLVMTIDDGMQAGASLDSRVDGIVVAINAAPESRTLQDFAGTSLQLSAIQQAAGDRSLASGVQVAADGSVTLPAWSVAVLELPQGESQGAGLPVSSK

SEQ ID NO: 65692 - protein, 922 aa, Klebsiella aerogenes
DVVVRLPDAAFGVALADAHWVDKTTLLWPGGENKPIVRLYYSHSSKVAADSNGEFSDKYVKLTPTTVNQQVSMRFPHLASYPAFKLPDDVNVDELLQGETVAIAAESDGILSSATQVQTAGVLDDTYAAAAEALSYGAQLTDSGVTFRVWAPTAQQVELVIYSADKKVIASHPMTRDSASGAWSWQGGSDLKGAFYRYAMTVYHPQSRKVEQYEVTDPYAHSLSTNSEYSQVVDLNDSALKPEGWDGLTMPHAQKTKADLAKMTIHESHIRDLSAWDQTVPAELRGKYLALTAQESNMVQHLKQLSASGVTHIELLPVFDLATVNEFSDKVADIQQPFSRLCEVNSAVKSSEFAGYCDSGSTVEEVLTQLKQNDSKDNPQVQALNTLVAQTDSYNWGYDPFHYTVPEGSYATDPEGTARIKEFRTMIQAIKQDLGMNVIMDVVYNHTNAAGPTDRTSVLDKIVPWYYQRLNETTGSVESATCCSDSAPEHRMFAKLIADSLAVWTTDYKIDGFRFDLMLYHPKAQILSAWERIKALNPDIYFFGEGWDSNQSDRFEIASQINLKGTGIGTFSDRLRDAVRGGGPFDSGDALRQNQGVGSGAGVLPNELTTLSDDQARHLADLTRLGMAGNLADFVLIDKDGAVKRGSEIDYNGAPGGYAADPTEVVNYVSKHDNQTLWDMISYKAAQEADLDTRVRMQAVSLATVMLGQGIAFDQQGSELLRSKSFTRDSYDSGDWFNRVDYSLQDNNYNVGMPRSSDDGSNYDIIARVKDAVATPGETELKQMTAFYQELTALRKSSPLFTLGDGATVMKRVDFRNTGADQQTGLLVMTIDDGMQAGASLDSRVDGIVVAINAAPESRTLQDFAGTSLQLSAIQQAAGDRSLASGVQVAADGSVTLPAWSVAVLELPQGESQGAGLPVSSK

SEQ ID NO: 65693 - protein, 376 aa, Zea mays
MAEEDVQPLVCDNGTGMVKAGFAGDDAPRAVFPSIVGRPRHTGVMVGMGQKDAYVGDEAQSKRGILTLKYPIEHGIVGNWDDMEKIWHHTFYNELRVAPEEHPILLTEAPLNPKANREKMTQIMFETFNCPAMYVAIQAVLSLYASGRTTGIVLDSGDGVSHTVPIYEGYTLPHAILRLDLAGRDLTDNLMKILTERGYSFTTTAEREIVRDIKEKLAYVALDYEQELETARTSSSVEKSYELPDGQVITIGAERFRCPEVLFQPSFIGMESAGIHEATYNSIMKCDVDIRKDLYGNVVLSGGSTMFPGIGDRMSKEITALAPSSMKVKVVAPPERKYSVWIGGSILASLSTFQQMWISKEEYDESGPGIVHMKCF

SEQ ID NO: 65694 - protein, 792 aa, Streptococcus pyogenes MGAS315
MKTKKVIILVGLLLSSQLTLIACQSRGNGTYPIKTKQSRKGMTSNKIKPIKKSKKTNKTHKGVAGVDFPTDDGFILTKDSKILSKTDQGIVVDHDGHSHFIFYADLKGSPFEYLIPKGASLAKPAVAQQAASQGTSKVADPHHHYEFNPADIVAEDALGYTVRHDDHFHYILKSSLSGQTQAQAKQVATRLPQTSSPVSTATANGIPGLHFPTSDGFQFNGQGIVGVTKDNILVDHDGHLHPISFADLRQGGWAHVADQYDPAKKAEKPAETHHTPELSEREKEYQEKLAYLAEKLGIDPSTIKRVETQDGKLGLEYPHHDHAHVLMLSDIEIGKDIPDPHAIEHARELEKHKFGMDTLRALGFDEEVILDIVRTHDAPTPFPSNEKDPNMMKEWLATVIKLDLGSRKDPLQRKGLSLLPNLETLGIGFTPIKDISPVLQFKKLKQLLMTKTGVTDYRFLDNMPQLEGIDISQNNLKDISFLSKYKNLTLVAAADNGIEDIRSLGQLPNLKFLVLSNNKISDLSPLASLHQLQELHIDNNQITDLSPVSHKESLTVVDLSRNADVDLATLQAPKLETLMVNDTKVSHLDFLKNNPNLSSLSINRAQLQSLEGIEASSVIVRVEAEGNQIKSLVLKDKQGSLTFLDVTGNQLTSLEGVNNFTALDILSVSKNQLTNVNLSKPNKTVTNIDISHNNIPLADLKLNEQHIPEAIAKNFPAVYEGSMVGNGTAEEKAAMATNAKESAQEASESHDYNHNHAYEDEEGHAHEHRDKDDHDHEHEDENEAKDEQNHAH

SEQ ID NO: 65695 - protein, 1083 aa, Klebsiella aerogenes
CDNSSSSSTSGSPGSPGNPGNPGTPGTPDPQDVVVRLPDVAVPGEAVQASARQAVIHLVDIAGITSSTPADYATKNLYLWNNETCDALSAPVADWNDVSTTPTGSDKYGPYWVIPLTKESGCINVIVRDGTNKLIDSDLRVSFSDFTDRTVSVIAGNSAVYDSRADAFRAAFGVALADAHWVDKTTLLWPGGENKPIVRLYYSHSSKVAADSNGEFSDKYVKLTPTTVNQQVSMRFPHLASYPAFKLPDDVNVDELLQGETVAIAAESDGILSSATQVQTAGVLDDTYAAAAEALSYGAQLTDSGVTFRVWAPTAQQVELVIYSADKKVIASHPMTRDSASGAWSWQGGSDLKGAFYRYAMTVYHPQSRKVEQYEVTDPYAHSLSTNSEYSQVVDLNDSALKPEGWDGLTMPHAQKTKADLAKMTIHESHIRDLSAWDQTVPAELRGKYLALTAQESNMVQHLKQLSASGVTHIELLPVFDLATVNEFSDKVADIQQPFSRLCEVNSAVKSSEFAGYCDSGSTVEEVLTQLKQNDSKDNPQVQALNTLVAQTDSYNWGYDPFHYTVPEGSYATDPEGTARIKEFRTMIQAIKQDLGMNVIMDVVYNHTNAAGPTDRTSVLDKIVPWYYQRLNETTGSVESATCCSDSAPEHRMFAKLIADSLAVWTTDYKIDGFRFDLMLYHPKAQILSAWERIKALNPDIYFFGEGWDSNQSDRFEIASQINLKGTGIGTFSDRLRDAVRGGGPFDSGDALRQNQGVGSGAGVLPNELTTLSDDQARHLADLTRLGMAGNLADFVLIDKDGAVKRGSEIDYNGAPGGYAADPTEVVNYVSKHDNQTLWDMISYKAAQEADLDTRVRMQAVSLATVMLGQGIAFDQQGSELLRSKSFTRDSYDSGDWFNRVDYSLQDNNYNVGMPRSSDDGSNYDIIARVKDAVATPGETELKQMTAFYQELTALRKSSPLFTLGDGATVMKRVDFRNTGADQQTGLLVMTIDDGMQAGASLDSRVDGIVVAINAAPESRTLQDFAGTSLQLSAIQQAAGDRSLASGVQVAADGSVTLPAWSVAVLELPQGESQGAGLPVSSK

SEQ ID NO: 65696 - protein, 735 aa, Medicago truncatula
MSSSSSTSLYLTNPHLTRHTSSPSTTRLSSLPSTITLNRTPTPTTHLSQSHHLRHTAIHASVSAPPSTTTDSSLVEKSVNTIRFLAVDSVEKANSGHPGLPMGCAPMGHVLYDEVMRYNPKNPFWFNRDRFVLSAGHGCMLQYALLHLAGYDSVKVEDLKQFRQWESRTPGHPENFETPGIEVTTGPLGQGIANAVGLALAEKHLAARFNKPDNEIIDHYTYCILGDGCQMEGIANEACSLAGHWGLGKLIAFYDDNHISIDGDTEIAFTESVEKRFEGLGWHVIWVKNGNTGFDEIRAAIKEAKAVKDRPTLIKFTTTIGYGSPNKSNSYSVHGSALGAKEVDATRNNLGWPYEPFHVPEDVKKHWSRHIREGAALESEWNAKFADYEKKYKEEAAVLKSIISGDLPAGWEKALPTYTPEIPADATRNLSQQNLNALANVLPGLIGGSADLASSNMTLLKKFGDFQSDSPAERNVRFGVREHGMGAICNGIALHSRGLIPYCATFFVFTDYMRGAIRLSALSEAGVIYVMTHDSIGLGEDGPTHQPIEHLASFRAMPNILMLRPADGNETAGAYKVAVLNRKRPSILALSRQKLPNLAGTSIEGVEKGGYIVSDNSTGNKPDVILIGTGSELEIAYKAGEDLRKEGKAVRVVSFVSWELFDEQSQAYKESVLPTAVTARVSIEAGSTFGWEKIVGSKGKAIGIDRFGASAPAGTIYKEFGITKEAVIAAAKELI

SEQ ID NO: 65697 - protein, 515 aa, Triticum aestivum
MASERNGDGGKARAAENGNGGGSGVPLEMPEIRHTKLFINGAFVDAVSGKTFETRDPRTGDVIASIAEGDKKDVDLAVKAAREAFDHGKWPRMPGSERGRIMMKYADLVEGHADELTLLESLDAGKPCTVTRAVDMATAVRSLRYFAGAADKIHGETLKMSRQFQGHTLREPMGVAGLIIPWNFPAIMFFSKVAPALAAGCTMVVKPAEQTPLSALYFAHLAKQAGVPDGVINVITGFGPTAGAAIASHMDVDMVSFTGSTAVGRLIMEASARSNLKPVSLELGGKSPLIIFDDADVDMAVGLAIAANFFNKGEACIAASRVYLQEGIYDRFVKKLAQRMESWVVGDPFDPRVNQGPQVDKAQYERVLGFIDHGKREGATVLTGGKPFGQRGYYIEPTVFTDVKDDMIIAKEEIFGPVMCLMKFTSVEEAIARANDTRYGLAAGVVTKDIDVANRMARSIRAGVVWVNCYFAMDSDCPFGGRKMSGFGKDDGMHALDKFLAVKSVVTPVYDSPWL

SEQ ID NO: 65698 - protein, 541 aa, Glycine max
  misc_feature (519)..(519): Xaa can be any naturally occurring amino acid
MDISVSFSKTRPPPFSPSLCRQLSLRPNAPQLLRFSRNNGTFRRKPPPTISRPNKLAVTAIQISNLSENEDDFVLEDVPHLTDFLPNLPSYPNPLQKSQGYSIVKKTFVSPEDVVAENVVIQKGSPRGVHFRRTGPREKVYFKPEEVRACIVTCGGLCPGINTVIREIVCGLNNMYNVEDILGIEGGYKGFYSKNTMMLTPKVVNHIHKCGGTFLRTSRGGHDTHKIVDNIEDRGINQVYIIGGDGTHKGTALIYEEVKKRGLQVAVAGIPKTIDNDIAVIDKSFGFDTAVEEAQRAINAAHVEVESVENGVGIVKLMGRYSGFIAMYATLASRDVDCCLIPESPFYLEGRGGLFEFIEQRLKENGHLVIVVAEGAGQEYIAAEVHAADKKDASGNKLLLDIGPWLSDKIKDHFSMSRKMAVNMKYIDPTYMIRAIPSNASDNIYCTLLAHGAVHGAMAGYTGFTVGPVNSKHAYIPIARVTEKQNKVKLTDRMWARLLASTNQPSFVASDQERVEKEXNEYINNMNIASLSRFKCLMGID

SEQ ID NO: 65699 - protein, 131 aa, Zygosaccharomyces mellis
GFLDHMIHALAKHSGWSLIVECIGDLHIDDHHTTEDCGIALGDAFRQALGQVRGVKRFGFGFAPLDEALSRAVVDLSNRPCSVIELGLKREKIGDLSCEMIPHFLESFTEAARLTVHVDCLRGFNDHHRSE

SEQ ID NO: 65700 - protein, 377 aa, Triticum aestivum
  misc_feature (91)..(91): Xaa can be any naturally occurring amino acid
MADGEDIQPLVCDNGTGMVKAGFAGDDAPRAVFPSIVGRPRHTGVMVGMGQKDAYVGDEAQSKRGILTLIYPIEHGIVSNWDDMEKIWHHXFYYELRVAPEEHPVLLTEAPLNPKANREKMTQIMFETFNAPAMYVAIQAVLSLYASGRTTGIVLDSGDGVSHTVPIYEGYALPHAILRLDLAGRDLTDSLMKILTERGYSFTTTAEREIVRDIKEKLAYVALDYEQELETAKSSSSVEKSYELPDGQVITIGAERFRCPEVLFQPSLIGMEAPGIHETTYNSIMKCDVDIRKDLYGNIVLSGGTTMFPGIADRMSKEITALAPSSMKIKVVAPPERKYSVWIGGSILASLSTFQQMWISKGEYDESGPSIVHRKCF

SEQ ID NO: 65701 - protein, 121 aa, Zygosaccharomyces rouxii
LDHMIHALAKHSGWSLIVECIGDLHIDDHHTTEDCGIALGDAFKQALGQVRGVKRFGFGFAPLDEALSRAVVDLSNRPCSVIELGLKREKIGDLSCEMIPHFLESFTEAARLTVHVDCLRG

SEQ ID NO: 65702 - protein, 130 aa, Zygosaccharomyces bailii
  misc_feature (104)..(104): Xaa can be any naturally occurring amino acid
  misc_feature (113)..(113): Xaa can be any naturally occurring amino acid
GFLDHMIHALAKHSGWSLIVECIGDLHIDDPTEDCGIALGEAFKQALGQVRGVKRFGCGFAPLDEALSRAVVDLSNRPYAVIDLGLKREKIGDLSCEMIPHFLXSFIEAARLXVHIDCLRGFNDHHRSES

SEQ ID NO: 65703 - protein, 396 aa, Legionella pneumophila str. Lens
MNLIKMSDIDLSGKRVLIREDLNVPIKDGMITSDQRLQAALPTIKSALDSGAAVIVLSHLGRPEEGKYEKKFSLEPVADYLRKNLEYPVRFVKDYLSGVDVNPGELAVCENVRFNPGEKSNDESLAKKLANLCDVFVMDAFGTAHRAQASTYGVAQYAPVAVSGPLLIRELEALNQVLKAPKKPIVAIVGGAKVSSKLSLLKQLVGMVDVLIPGGGIANTFLKAQGFEIGISLYEPDLLDEARHILILAKEKGCQIPLPTDVVVGKTFSETCPAFNKSLSNVAADDMILDIGPETIRDYVDLIHEANTIIWNGPVGVFEFPQFAYGTRAIAIAIAESNAFSIAGGGDTLAAVDLYDLNQQISYISTGGGAFLECLEGKTLPAVAILQERAKHVKTN

SEQ ID NO: 65704 - protein, 559 aa, Zea mays
MGSSGFSWTLPDHPKLPKGKSVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFESGTLHLIGLLSDGGVHSRLDQLQLLLKGVSERGAKKIRVHILTDGRDVLDGSSIGFVETLENDLLELRAKGVDAQIASGGGRMYVTMDRYENDWDVVKRGWDAQVLGEAPYKFKSALEAVKTLRAQPKANDQYLPPFVIVDDSGNAVGPVLDGDAVVTINFRADRMVMLAKALEYADFDNFDRVRVPKIRYAGMLQYDGELKLPSRYLVSPPEIDRTSGEYLVKNGIRTFACSETVKFGHVTFFWNGNRSGYFDATKEEYVEVPSDSGITFNVAPNMKALEIAEKARDALLSGKFDQVRVNLPNGDMVGHTGDIEATVVACKAADEAVKIILDAVEQVGGIYLVTADHGNAEDMVKRNKSGKPLLDKNDRIQILTSHTLQPVPVAIGGPGLHPGVKFRNDIQTPGLANVAATVMNLHGFEAPADYEQTLIEVADN

SEQ ID NO: 65705 - protein, 335 aa, Rosa hybrid cultivar 'Kardinal'
MGVERVQDIASATSKDTIPVEFIRSENEQPGITTVPGTVLECPIIDFSDPDEEKLLKQIFEASTDWGMYQIVNHDISNEAIAKLQAVGKEFFELPHEEKEVYAKDPNSKSVEGYGTFLQKELEGKKGWVDHLFHKIWPPSAINYCFWPKNPASYREANEEYAKNLHKVVEKLFKLLSLGLGLEAQELKKAVGGDDLVYLLKINYYPPCPRPDLALGVVAHTDMSALTILVPNDVQGLQACRDGQWYDVKYIPNALVIHIGDQMEVMSNGKFKAVLHRTTVSKDKTRISWPVFLEPPPDHIIGPHPKLVNDKENPPKYKTKKYSEYVYNKLNKIPQ

SEQ ID NO: 65706 - protein, 376 aa, Synechococcus elongatus PCC 6301
MAADYYQLLGVARDADKDEIKRAYRRLARKYHPDVNKEPGAEDKFKEINRAYEVLSEPETRARYDQFGEAGVSGAGAAGFQDFGDMGGFADIFETFFSGFGGMGGQQASARRRGPTRGEDLRLDLKLDFRDAIFGGEKEIRVTHEETCGTCQGSGAKAGTRPQTCTTCGGAGQVRRATRTPFGSFTQVSVCPTCEGSGQMIVDKCDDCGGAGRLRRPKKLKINIPAGVDSGTRLRVANEGDAGLRGGPPGDLYVYLFVSEDTQFRREGINLFSTVTISYLQAILGCSLEVATVDGPTELIIPPGTQPNAVLTVEGKGVPRLGNPVARGNLLVTIKVEIPTKISAEERELLEKVVQIRGDRAGKGGIEGFFKGVFGG

SEQ ID NO: 65707 - protein, 387 aa, Oryza sativa (indica cultivar-group)
MSSCFNGGAGWPEPVVRVQAVSDSCGATIPERYVKAPSERPSSLDGGGGLNNIPVVDMSMPDGEETARAVAAACREWGFFQAVNHGVRPELLRRARAAWRGFFARPAEAREAYANSPATYEGYGSRLGTAKGGPLDWGDYYFLHLLPAALKSHDKWPTSSVPAGGGGLREATEEYAEEVVRLCRRVMRLLSRGLGLDDGRLQAAFGGVGGEGACLRVNFYPRCPQPELTLGVASHSDPGGMTMLLVDDHVRGLQVKNAGHWITVDPVPDAFIVNIGDQIQVLSNAVYKSVEHRVTVSAAEERLSLAFFYNPRSDLPLAPMPELVAPPARPALYPPMTFDEYREHIRRCGLSGKAQLQSQQMATAICGAPPAATASSSSSSSASSLAR

SEQ ID NO: 65708 - protein, 467 aa, Streptococcus pyogenes MGAS315
MNGEWKLSENEITIYAPATGEELGSVPAMTQAEVDAVYASAKKALSDWRALSYVERAAYLHKAADILVRDAEKIGAILSKEVAKGHKAAVSEVIRTAEIINYAAEEGLRMEGEVLEGGSFEAASKKKIAIVRREPVGLVLAISPFNYPVNLAGSKIAPALIAGNVVALKPPTQGSISGLLLAEAFAEAGIPAGVFNTITGRGSVIGDYIVEHEAVNFINFTGSTPIGEGIGKLAGMRPIMLELGGKDSAIVLEDADLVLAAKNIVAGAFGYSGQRCTAVKRVLVMDKVADQLAAEIKTLVEKLSVGMPEDDADITPLIDTSAADFVEGLIKDATDKGATALTAFNREGNLISPVLFDHVTTDMRLAWEEPFGPVLPIIRVTTVEEAIKISNESEYGLQASIFTTNFPKAFGIAEQLEVGTVHLNNKTQRGTDNFPFLGAKKSGAGVQGVKYSIEAMTTVKSVVFDIQ

SEQ ID NO: 65709 - protein, 574 aa, Streptococcus pyogenes MGAS315
MLKGIAASDGVAVAKAYLLVQPDLSFETVTVADTNAEEARLDVALQAAQDELSVIRENAVESLGEEAAAVFDAHLMVLADPEMISQVKETIRAKQTNAETGLKEVTDMFITIFEGMEDNPYMQERAADIRDVAKRVLAHLLGVKLPNPATINEESIVIAHDLTPSDTAQLNKQFVKAFVTNIGGRTSHSAIMARTLEIAAVLGTNDITKRVKDGDVIAVNGITGEVIIDPSEDQVLAFKEAGAAYAKQKAEWSLLKDAHTETADGKHFELAANIGTPKDVEGVNDNGAEAVGLYRTEFLYMDSQDFPTEDEQYEAYKAVLEGMNGKPVVVRTMDIGGDKELPYFDLPKEMNPFLGFRALRISISETGDAMFRTQMRALLRASVHGQLRIMFPMVALLKEFRAAKAVFDEEKANLLAEGVAVADDIQVGIMIEIPAAAMLADQFAKEVDFFSIGTNDLIQYTMAADRMNEQVSYLYQPYNPSILRLINNVIKAAHAEGKWAGMCGEMAGDQQAVPLLVGMGLDEFSMSATSVLRTRSLMKKLDSAKMEEYANRALTECSTAEEVLELSKEYVSED

SEQ ID NO: 65710 - protein, 559 aa, Blastopirellula marina DSM 3645
MPEKITIVIVGGVAGGASAATRARRMNEAAEIILLEKDEHVSFANCGLPYYIGGEIAERQKLLVATADLLRKRFRIDVRANQEATRIDRAAKQLDVRDHLKNEDYTLAYDKLILSPGAAPLVPPIENANAPGVFTLRNLADADKIREHAVKTSARKAVVVGAGFIGLEMVEQLHRLELKIVLAELQPQVLPPLDPEMTYPLEKALRDREVQLYLGDGIAGILTDERGNASGVKLQSGEVTTGDLVILGLGVRPNSQLAQEAGLEIGATGGIAVNRFSQTADPDIYAVGDAAEYPYGPTGKQQRVPLAGPANRAGRLAGEHAASGASAEMPDVQGTAIVRVFQQAAATTGLSVKMARKLGIDAWSVTIAANHHAGYYPGAKQLVLKLVFAPETGKILGAQCVGVAGVDKRIDVIATAMQFGGTVRQLAGVDLSYAPPFGSAKDPVHMAAFSACNYLDGVDLFLDSDANLSGQQVVDVRTEKEVSAKPLAGADDAIAIPLDDLRERLGELDQDRPTVVSCGVGVRAHVAARILRQNGFADVQNLSGGALVREWAIAQRTAE

SEQ ID NO: 65711 - protein, 404 aa, Candidatus Pelagibacter ubique HTCC1002
MKYINKNLTIEKVNVQKIAKKFGTPTYCYSHKRLTENIKKFKKNFSSFSPLICFAVKSNTNVNLIREIRKLGLGADVVSMGELMMAIKAGIDPKKIVFSGVGKTSKEISYAIDKKILLINAESKSEIIEIEKIAKSKKKIVNIGIRLNPNTDAKTLKQISTGKKENKFGVDEKTFFELVNFTNHSKNINLKCLSVHIGSQILDHKPYEKMLNVVNKIIKKSGHIFEFIDLGGGMGISYEKNSKKLNYQKYNIAIQKFLKGQKTKIIFEPGRSIVGNIGFLISQVIYIKENTKKDFIILDAAMNDLMRPALYGANHQTIPVVKNNRISNKTYEFVGPICESTDKFTTIKGFQKLKEKDLVIMCDVGAYGMSLSSNYNVRPKPAELIIKGSKINIIKKRQKLKDLI

SEQ ID NO: 65712 - protein, 359 aa, Schizosaccharomyces pombe
RMRVAIIHVGAPAGGMNSATRAAVRYCLNRGHTPLAIDNGFSGFLRHDSIHELSWIDVDEWCIRGGSEIGTNRDTPDLDMGFTAFKFQQHKIDALIIIGGFEAFTALSQLESARVNYPSFRIPMAIIPATISNNVPGTEFSLGCDTCLNAVMEYCDTIKQSASASRRRVFVCEVQGGRSGYIATVGGLITGASAIYTPEDGISLDMLRKDIDHLKATFALEAGRNRAGQLILRNECASKVYNTKVIGNIISEEVISASPLVPLFPSRPTRCNPTPMDRARAARLAMRAIRFFETCRANDLGNDPSSAVVIGIRGTGVSFSSVADVENNETEIEMRRPKNAWWRDMHNLVNILAGKTFAD

SEQ ID NO: 65713 - protein, 370 aa, Cucumis sativus
MADVGQNNPADFPALPTHGGQYVQYNIFGNPFEITSKYRPPIMPIGRGAYGIVCSVLNSETNEMVAVKKIANAFDNHMDAKRTLREIKLLRHLDHENVIGIRDVIPPPLRREFNDVYISTELMDTDLHQIIRSNQSLSEEHCQYFLYQILRGLKYIHSANVIHRDLKPSNLLLNANCDLKICDFGLARPTSENECMTEYVVTRWYRAPELLLNSDYTAAIDIWSVGCIFLELMNRRPLFPGRDHVHQMRLLTELLGTPSESDLGFIRNEDSKRYLRQLPPHPRQPLATVFPHVHPLAIDLVDKMLTFDPTKRITVEEALAHPYLERLHDIADEPVCSEPFSFEFEQQYLDEEQMKEMIYREALALNPEFA

SEQ ID NO: 65714 - protein, 474 aa, Glycine max
FGSSVKIMHLENNKLTGPLPSYLGSLPSLQALFIQNNSFSGVIPSGLLSGKIIFNFDDNPELHKGNKKHFQLMLGISIGVLVILLILFLTSLVLLLILRRKTSQQKRDEKGVSGRSSTKPLTGYSFGRDGNIMDEGTAYYITLSELKEATNNFSKNIGKGSFGSVYYGKMKDGKEVAVKTMTDPSSYGNQQFVNEVALLSRIHHRNLVPLIGYCEEEYQHILVYEYMHNGTLREYIHECSSQKQLDWLARLRIAEDAAKGLEYLHTGCNPSIIHRDVKTSNILLDINMRAKVSDFGLSRLAEEDLTHISSVARGTVGYLDPEYYANQQLTEKSDVYSFGVVLLELLSGKKAVSSEDYGPEMNIVHWARSLIRKGDVISIMDPSLVGNLKTESVWRVAEIAMQCVEQHGACRPRMQEVILAIQDASNIEKGTESQLKLSSSGGNSKPQSSRKTLLASFLEIESPDLSNSCLPSAR

SEQ ID NO: 65715 - protein, 575 aa, Coccidioides immitis RS
MSGPASRLRSLTAQLLHRSPESQHNFNKHTLSPTSFLPRAAAIEPDAEAIYHVTVNNKVLRRSYIETADRARGLAYYIKKHGYKRVGILCPNTPAFLESIYGIAAAGAVNVAVNYRLKSEDIAYIFTHSEVDIIIVDQEYVHLLDEFRKTRPDFPVVIDTDTDATEGELSGPFDASVLEGLQYDSQLGNHGWNGLETHAADEESLIALAYTSGTTARPKGVEYIHRGCYLAALANIIESGLNYHQGRCRYLWTLPMFHAMGWTFPWAITAVRGTHYCLRKIDYSQIWRLLKEEKITHFNAAPTVNTILCNSKEAERLPSPVRVTVAASPPTPHLFEQMLSLNLHPVHVYGMTETYGPITKGYYMPEWDNLPAKDKYQKMARQGHGFVTSLPVRVIKTEVPEGTVIDVERNGKEIGEIVFVGNICARGYYKDPEATKKLFAGGVLHSGDLAVCHPDGAIQILDRAKDIIISGGENISSVALEAMLATHPDILEVGIVAVADSHWGERPKAFITVQPGKTLKGEDVIEWAKQTSGISRFMVPREVEVLAELPKTSTGKVKKNVLREWAKGADRTLVR

SEQ ID NO: 65716 - protein, 211 aa, Medicago truncatula
MSYAYLFKYIIIGDTGVGKSCLLLQFTDKRFQPVHDLTIGVEFGARMITIDNKPIKLQIWDTAGQESFRSITRSYYRGAAGALLVYDITRRETFNHLASWLEDARQHANANMTIMLIGNKCDLAHRRAVSTEEGEQFAKENGLIFMEASAKTAQNVEEAFIKTAGTIYKKIQDGVFDVSNESYGIKVGYGGIPGPSGGRDGPSAAGGGCCS

SEQ ID NO: 65717 - protein, 589 aa, Coccidioides immitis RS
MFRSRGHLRQSLGAASESSSSTSPERVIDDDTDFFNQPNDSQSSVGVGTLRDLRVDAGQDIVLPPISRLPPELLIAIFAKLNSPTDMLNCMMVCQRWATNCVAILWHRPSCNTWENLKRVAGAITTQGSYFPYYDMVKRLNLSSLSTRVNDGTIISFAQCKRIERLTLTNCSMLTDTGVSDLVNGNGHLQALDVSELKSLTDHTLFIVARNCPRLQGLNITGCVKITDDALVALAENCRQLKRLKLNGVMQVTDRAIRAFADNCPSILEIDLHGCRLITNFTVTNLLCTLRFLRELRLAHCADITEQAFLDLPEGIIFDSLRILDLTACENVRDDAVERIINSSPRLRNLVLAKCRFITDRSVQAICKLGRNIHYVHLGHCSNITDNAVIQLVKSCNRIRYIDLACCNRLTDASVQQLATLPKLRRIGLVKCQAITDRSILALAKPRIPQHPLVSSLERVHLSYCVNLSTYGIHQLLNHCPRLTHLSLTGVHAFLREELTAFCREAPPEFTPQQREVFCVFSGAGVSQLRDFLNQAAIAYHRELEEGTMFNDTDELDEDEGQVTGLMNATGLNDDNDGTPDGGTAPVQS

SEQ ID NO: 65718 - protein, 613 aa, Oryza sativa (indica cultivar-group)
MATASWGVWWLLWLSLFMYFCLFVRGSHRNRKDMRQLKHRGPDWSGLYQCEGNFLAQQRLAIVSPLSGDQPLYNADRTIVVVANGEIYNHKKIRKQFASKHTFSTGSDCEVIIPLYEEYGEDFVDMLDGVFAFVLYDTRTKTYMAARDAIGVNPLYIGRGSDGAVWISSEMKALNEDCVEFEIFPPGHLYSSAAGGLRRWYKPQWFAENVPATPYQPLLLREAFEKAVIKRLMTDVPFGVLLSGGLDSSLVAAVTKRHLIKTEAAEKFGAELHSFVVGLEGSPDLIAAREVADHLGTIHHEFHFTVQDGIDAIEEVIYHDETYDVTTIRASTPMFLMARKIKALGVKMVLSGEGSDELLGGYLYFHFAPNKEEFHKETCRKVKALHQYDCLRANKATSAWGLEVRVPFLDKEFINVAMSMDPEWKMYNADLGRIEKWVMRKAFDDEEHPYLPKHILYRQKEQFSDGVGYNWIDGLKAFTEQQVSDEMMKNAAKVYPHNTPVNKEAYYYRMIFERLFPQESARETVPWGPSIACSTPAAIEWVEQWKASHDPSGRLIASHNSASASANHTNHANANANGNSNGKANGNCAMAANGTNGVGLVVANGTANGKMEA

SEQ ID NO: 65719 - protein, 255 aa, Pseudomonas putida KT2440
MQPNLARLFALDGRRALVTGASSGLGRHFAMTLAAAGAEVVVTARRQAPLQALVEAIEVAGGRAQAFALDVTSREDICRVLDAAGPLDVLVNNAGVSDSQPLLACDDQTWDHVLDTNLKGAWAVAQESARRMVVAGKGGSLINVTSILASRVAGAVGPYLAAKAGLAHLTRAMALELARHGIRVNALAPGYVMTDLNEAFLASEAGDKLRSRIPSRRFSVPSDLDGALLLLASDAGRAMSGAEIVVDGGHLCSSL

SEQ ID NO: 65720 - protein, 174 aa, Zea mays
  misc_feature (80)..(80): Xaa can be any naturally occurring amino acid
  misc_feature (114)..(114): Xaa can be any naturally occurring amino acid
  misc_feature (155)..(155): Xaa can be any naturally occurring amino acid
  misc_feature (161)..(161): Xaa can be any naturally occurring amino acid
  misc_feature (163)..(163): Xaa can be any naturally occurring amino acid
MAPELMTAKMTAKAAAVSAAAVSSKTATRAYVTFLAADGDYCKGVVWLHKDLRRVRSAYHLMVSVLPDVSESHRRILVSXGCVLQEIEPVYPPEKQTHFSMADYVINYSQLRIXWEYVEYDRMMYLDAYIHVVQEIDDLYELERGLLRGDGLVLXQTWSHXPXDGIGYCQRARK

SEQ ID NO: 65721 - protein, 459 aa, Pseudomonas putida KT2440
MSTHSSTVQNDLAALIHPNTNLAQHREVGPLVIARGDGVRVFDEQGNAYIEAMSGLWSAALGFSEQRLVDAAVEQFKQLPYYHSFSHKTNAPAAALAAKLAALAPGDLNHVFFTNSGSEANDSVVKMVWYVNNALGRPAKKKFISRQQAYHGATVAAASLTGIPSMHRDFDLPAIPVHHLTCPNFYRFARPGESQEAFTVRLANELERYILAEGPETIAAFIGEPVIAAGGVIPPPTGYWAAIQAVCKRYDILVVIDEIITGFGRLGTMFGSQLYGIQPDIMVLSKQLTSSYQPLAAVVVSDAMNDVLVSQSQRLGAFAHGLTCTGHPVATAVALENIRIIEERDLVGHVQHLAPVFQRHLRAFEDHPLVGNVRGVGLMGGIELVADKATRQPFAQPGTLGGYVFKQAHKHGLIIRAIYDTIAFCPPLITTQDDIEAIFSAFERTLADATDWARSQHLL

SEQ ID NO: 65722 - protein, 342 aa, Glycine max
MTQVRNKQVVLRDYVTGFPKESDMNIVEGTIILKVPEGSNDVLLKNLYLSCDPYMRLLMAKDRSFGDGSFTLASPLKGYGVSQVLESGRPDYKKGDLVWGITKWEEYSLVPSSLIHFKIEHTDVPLSYYTGILGMPGMTAYAGFFEVGSPKKGDTVFVSAASGAVGQLVGQFAKLTGCYVVGSAGSKEKVDLLKNKLGFDEAFNYKEEPDLNAALKRYFPEGIDIYFENVGGKTLDAVLPNMKFHGRIPVCGMISQYNLTQFDGVTNLANLIFKRVKMEGFIATDFYHLYPKFLEFVLPHIREGKVVYVEDIAEGLEKGPAALVGLYTGRNVGKQVVVVTHE

SEQ ID NO: 65723 - protein, 103 aa, Zea mays
MSGRGKGGKGLRKGGAKRHRKVLRDNIQGITKPAIRRLARRGGVKRISGLIYEETRGVLKVFLENVIRDAVTYTEHAKRKTVTAMDVVYALKRQGRTLYGFGG

SEQ ID NO: 65724 - protein, 185 aa, Arabidopsis thaliana
YPYIAGMGIYVVSRDVMLDLLRNQFPGANDFGSEVIPGAPFLGLRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETATEKSLLSAKGSVPIGIGKNSHIKRAIIDINARI

SEQ ID NO: 65725 - protein, 183 aa, Arabidopsis thaliana
YPYIAGMGVYVFRKEGLLKLLRSSYPTSNDFGSEIIRARRKLHNVQAFLFNDYWEDIGTIGSFFDANLALTEQPPKFQFYDQKTPFFTSPRFLPPTKVDKCRILDSIVSHGCFLRECSVQHSIVGIRSRLESGVELQDTMMMGADFYQTEAEIASLLAEGKVPVGVGQNTRIKNCIIDINARI

SEQ ID NO: 65726 - protein, 324 aa, Gibberella zeae PH-1
MAPFTPRGGARGGRGGARGGGRGGFGGDRGGFGGGRGGARGGRGGGRGGFGDRGGRGGRGGRGGAPRGGRGGATGAKGGAKVIVEPHRHPGVFVVRGGKEDGLATRNTTPGESVYGEKRISVDEVVKNDDGTTTTTKIEYRMWNPFRSKLCAAIAGGADEIYIKPGSRVLYLGGASGTSVSHVADIVGPTGYVYAVEFSSRSGRDLITMASKRPNVVPIVEDARQPARYRMIVPMVDVIFADVAQPDQARIVAMNANWFLKVNGGVLISIKANCIDSTAPAAEVFAAEVQKMRAESIKPKFQLTLEPFERDHCLVAGEYLRYKS

SEQ ID NO: 65727 - protein, 173 aa, Pseudomonas aeruginosa UCBPP-PA14
MHPSLQALVIMGVAGCGKSSVSQALCQRSGAHGIEGDSFHPAANIRKMSAGIPLTDDDRAGWLDTLAEQLRQAVAAGKLPVLTCSALKRAYRDRLRRAVPGLGIVYLELTPAVAAERVAQRPGHFMPATLIDSQFAALEPPLDEPLTLRLDATLPVECLAQATHAWWLEHAAA

SEQ ID NO: 65728 - protein, 578 aa, Zea mays
MAMEVRRRVPPPHGSAPRRQQATGGEGQRVRVQAGDALPLPIRHTNLIFSALFAASLVYLMRRWREKIRSSTPLHVVSLAEIFAICGLVASLIYLLSFFGIAFVQSVVSNSDDEEDFIIDSRHGQARAPPPPAPAAPCALLGSPAAAPEKMPEEDEEIVAAVVAGKIPSYVLETRLGDCRRAAGIRREALRRITGREMDGLPLDGFDYASILGQCCELPVGFVQLPVGVAGPLLLDGRRLYVPMATTEGCLVASTNRGCKAIAESGGASSVVLKDGMTRAPAVRFPSARRAAELKAFLEDPANFDTLAMVFNRSSRFGRLQGVKCAIAGRNLYMRFSCSTGDAMGMNMVSKGVQNVLDYLQADFPDMDVISISGNFCSDKKSAAVNWIDGRGKSVVCEAVIKEEVVKKVLKTNVQALVELNVIKNLAGSAVAGALGGFNAHASNIVAAIFIATGQDPAQNVESSQCITMLEAINDGKDLHISVTMPSIEVGTVGGGTQLASQSACLDLLGVKGANRESPGSNARLLATVVAGAVLAGELSLISAQAAGHLVKSHMKYNRSSKDMSKTLAEETDKPKKC

SEQ ID NO: 65729 - protein, 501 aa, Glycine max
MGSAAKYELPFKLNNPDLLHNESFVHGKWVKSKSGKTFEVADPGTGKTWIDCPTNDASDVDEAVKSSHECFLEYKKISPRQRAQMLYKWDALIKENREDIATILVYETGKPRAEAYGEIDYSTGFTWWFAGEAERIQGSVFTPALPNRRIFTIKQPLGVAAALVPWNFPIAMILRKAGAALAAGCTMIVKPSPETPITVLALAYLADKAGFPKGALNVLTTDLDKTPELSEALCRHPLVNKVTFTGSTRVGKLVAKICSDNLKKVTLELGGNCPVLIFDDANIEQAMSQVFALKFRHAGQACITANRIYVQSGIFDKFLERWNAEAQKIVVGHGSDEKTTMGPVTTPRAVDKALSLVEDARKKGAKIHTGGNKVEKNGGYFFEPTVITGVTPDMDIAKEEVFSPISTFIKFETEDEVVKAANDTSMGLASYLFTKNVDRMWRLFENLEAGMIGLNTGNSSAAESPFGGIKQSGYGKESGKDVAVNEYMITKTGTFTLEDQS

SEQ ID NO: 65730 - protein, 225 aa, Oceanobacter sp. RED65
MNQDQLKQAVGQAAVDYIKPHLQKDSIIGVGTGSTANCFIDALAELKNDFDGAVASSEATAERLKSHGIPVYDLNSSGTLDFYIDGADETNDHLQLIKGGGGALTREKIVAACAKEFICIADESKWVDLLGTFPLPVEVIPMARSYVARELVALGGDPVYRQGFVTDNGNVILDVHNMSIQSATALEERINNIVGVVTNGLFACRPADVLLMGTADGVKTIKAKN

SEQ ID NO: 65731 - protein, 671 aa, Methanosarcina acetivorans C2A
MESLIFIAPLAGVISLVFAAFFAKSILKEDAGNKRMKEIAGAIQEGAMAYLNRQYKTIAVVSIILSFLILFLLDDGLKIAIGFLAGAISSAAAGYIGMSVSVRANIRTAHAASSGLEKAMSVAFRGGAVTGLAVVGLALLGTSSFYILYGDVDLVVGFGFGASLISLFARVGGGIFTKAADVGADLVGKVEAGIPEDDPRNAGVIADNVGDNVGDCAGMGADLFETYVVTSLAAMLLGSLIIGTYENAILYPLVLGSVAIFASIISVFFVKIGKEGKIMQALYKGVGGSAIISLIAFYFVTNSLMGDIRLFYATVVGIIITVLMVIITEYYTSTDYRPVKTIAASSETGAATNIISGLSIGFESTLVPTVVIVIGILISYFIVGGAADAGIGLYGIAIAAVAMLSTTGMIVALDSYGPITDNAGGIAQMANLPAQVRKVTDALDAVGNTTKAVTKGYAIGSAALGALALFADYRSKVNLGGQSLNLDDPVVLAGLLLGALLPFVFSAVTMSAVGKAAFEVVNEVRRQFREIPGIMEGTAKPEYGRCVDIVTKAALHEMAMPGFLAVLVPLLVGLILGPKALAGLLIGLIVVGFMLALMMDNGGGAWDNAKKLIEDGNHGGRGSEAHKAAVVGDTVGDPFKDTAGPALNALIKVVNMVAILFSSLIIHSGLF

SEQ ID NO: 65732 - protein, 366 aa, Oryza sativa (indica cultivar-group)
MDSGAAAVCAEKASEIIKIGQVDDVQELQRRLCSATTVPERYIRDGDDRPDHAVVDDERAQERIPVIDVGELQRGSEDELDNLRLACEQWGFFQVVNHGVEEETMEEMEKAAREFFMLPLEEKEKYPMEPGGIQGYGHAFVFSDDQKLDWCNMLALGVEPAFIRRPNLWPTTPANFSETLEKYSVEIRELCVRLLEHIAAALGLAPARLNGMFGEAVQAVRMNFYPPCPRPELVLGLSPHSDGSAVTVLQQDAAFAGLQVLRGGGGWVAVHPVPGALVVNVGDTLEVLTNGRYKSVEHRAVASGEHDRMSVVTFYAPAYDVELGPLPELVADGEPRRYRTYNHGEYSRHYVTSRLQGKKTLEFAKI

SEQ ID NO: 65733 - protein, 393 aa, Prochlorococcus marinus subsp. pastoris str. CCMP1986
MSEVNLSKRALSIEPSLTLQISAKANQLAKEGKDICNLSAGEPDFDAPNEILKATSEAIFDGYTKYGPASGDLELRKAIAEKLQTQNNLNVEYENVMVTNGAKQSIYNLFQVLLNDGDEVIIPAPYWLSYPQMVRLAGGKPVFLNSSAEDGFKINIQDLKSKISPKTKFIIINSPNNPTGRVMPKEELLQIAELVRENKNINILSDEIYELILKKEFKHLSLASLATDLKERIFIINGFAKGWAMTGWRVGYLVGQKDVIKASSALQSQSTSNVCSFVQRGALEALKINREFFLEINSHYDLRREVLYKGLKNIEGLFISPPNGAFYAFPRLPNNSMTSVEFCKRILNDYGLVVVPGKPFGDDQCIRISCASSKEKILDGLTRLEKGILNYYF

SEQ ID NO: 65734 - protein, 187 aa, Arabidopsis thaliana
MEDRREAATTIYYEAQARRQDPIYGCVSHIFSLQQQVVNLQTQLEILKQQATQSMMAIDSPSIENPNYYQDTKPQYLQESHDLHHHHLTTSNCQTEQNSDLKNIMTSCYHQMEIETTPFTGAGGDTMAGSYYYNSSSGCSEELKSVSTNGEFSKYSELDQHLTNTFNQYRHGGNNLISESLGYITYS

SEQ ID NO: 65735 - protein, 95 aa, Oltmannsiellopsis viridis
MSLALLVKDIEDRQLKEGLPEVKVGDTVKLNVFFPGAKDKTSKSKKRTQAYTGTIVAKRGAGVNTTITVRRVSRGVGVERIFPLHSPELESITLV

SEQ ID NO: 65736 - protein, 474 aa, Pseudomonas putida KT2440
MQTKLLINGALVAGEGDHVDVYNPSLGRVLVQTHEASHAQVHAAVQSADAAFEAWSQTPPKDRAALLLTLADRIDAQAAVFARLEADNCGKPFTAVLQDELPAVSDVFRFFAGAVRCLQGSAAGEYIPGHTSMIRRDAVGVVASIAPWNYPLLMAAWKLGPALAGGNTVVLKPSEHTPMSTLKLGELLADIFPAGVVNIVHGRGATVGEPLTSHALVRMVSLTGSVRTGSRIIEGTADSVKRMHMELGGKAPVLIFDDADIDAAVEGIRAFGFYNAGQDCTAACRLYVQKAVYPEFVRKLGEAVSSIKCGLQDDPATEMGPLITQEHLQRVEGFVNRAREQPHIEVVTGGKRAAGAGFFFEPTVLAGTRQEDEVVCREIFGPVVTVSPFEDEAQVLAWANESDYGLASSVWTADVGRAHRLAARLQYGCTWVNTHFMLVSEMPHGGVKLSGYGKDLSMYGLEDYTLVRHVMFKH

SEQ ID NO: 65737 - protein, 625 aa, Ustilago maydis 521
MSWRSNAQRTGMNAQPLQGARRWGGAGGAGEGPSSSGSPPSSYHQPSHPYQSSYSHQSQPYNAAPAPPTSSSSSSSNPRDAALAAAAAVAASIGIKRDRDRSSDAPGSNSYAAPSLLTSASTADGSGADAGPRKRKSRWGDANDKITIPTAIGANVSAQELDKYAIQVRLDEISRKLRSGDFVPPDRERSPSPPPTYDNQGRRTNTREVRYRKKLEDERVALVDRQLKLDPNFRPPSDYHAIKRNQRPTEKVYLPIKEFPEIKFFGLLVGPRGNTLKTMERQSGAKISIRGKGSVKTGKGKMDADEDEEEMHCVVTADDEASVKKCIKLINQVIETAASTPEGENDHKRNQLRELAALNGTLRDDENQLCKNCGNKGHRAFECPEQRNWTAHIICHRCGGQGHLARDCTQGRAGAFNGAPPGAAGTGNRQFDSEYANLMAELGEPAAAVDGAATAAGGAVGGAAVGPDGKKIPPWRNPEVWSQPGFGAPRGGDAGRGGWGHRGGYNNRGDRAGYNQHQQQQHPHAYHQQQQAYPAYDQSAPTAAPGGAENADQQHRDYSAEWAAYYAAQAAAGGAQGADPSAAAAGTTAAAEGAVDYSKEWEEYYRMQAAAAAQDGSAYAAGTQA

SEQ ID NO: 65738 - protein, 129 aa, Zea mays
RARSHKSSCSSSPQPNSSHSGETLGDVWRVARAYKGLGKGGAKRHRKVLRDNIQGITNPAIRRLARRGGDKRISGLIYEETRGVLKIFLENVMRDAVTYTEHARRKTVTVMDAVYAPKRQGRTLYGFGG

SEQ ID NO: 65739 - protein, 508 aa, Pseudomonas putida KT2440
MSSHTALPVEPLDVLIMGAGVSGIGAAAYLRRNQPNKTFAILESRERMGGTWDLFRYPGIRSDSDLYTFGFDFKPWTKAKSLADAADILEYLSEAIDEHQLAPFIQYQQKVISANWQSDKGLWSVRVEDGRTAQIRTVECRWLFSAGGYYRYDQGFSPRFEGSEQFKGQIIHPQHWPEDLDYTGKRVVVIGSGATAVTLIPAMADKVASITMLQRTPSYIINQPANDGVAAFLRKVLPAQTAYSLTRYKNAKITLAFWGFCQRFPKLSKKLLLWLTRKELPKDYPVDVHFNPPYNPWDQRLCSVPEGDLFKAISAGNADIVTDHIERFTEHGVLLKSGKMLKADIIVTATGLNVQLFGGITLHKDGKPVVLSETLAYKGMMLSGVPNFAFAVGYTNSSWTLKVCLLCDHFCRLLGLMEREGYNVCEPKAPEGVETRPLLDFGAGYVQRALDSMPRQGPREPWVMSMDYFRDVKLLRRGAVTDKCLKFTAVPNAPLHADVQLQQQGSRR

SEQ ID NO: 65740 - protein, 181 aa, Arabidopsis thaliana
YPYIAGMGVYVFKKEILLNLLRWRFPTANDFGSEIILLAKEFYVNAYLSNDYWEHIGTIRSFFEANLALTEHPGAFSFYDAAKPIYTSRRNLPPSKIDNSKLIDSIISHGSFLTNCLIEHSIVGIRSRVGSNVQLKDTVMLGADYYQTEAEVAALLAEGNVPIGIGENTKIQECIDKNARI

SEQ ID NO: 65741 - protein, 377 aa, Oryza sativa
  misc_feature (183)..(183): Xaa can be any naturally occurring amino acid
MADEDIQPIVCDNGTGMVKAGFAGDDAPRAVFPSIVGRPRHTGVMVGMGQKDAYVGDEAQAKRGILTLKYPIEHGIVNNWDDMEKIWHHTFYNELRVAPEDHPVLLTEAPLNPKANREKMTQIMFETFNCPAMYVAIQAVLSLYASGRTTGIVLDSGDGVSHTVPIYEGYTLPHAILRLDLAXGRDLTDHLMKILTERGYSLTTSAEREIVRDIKEKLAYVALDYEQELETSRSSSSVEKSYEMPDGQVITIGSERFRCPEVLFQPSLVGMESPGIHEATYNSIMKCDVDIRKDLYGNVVLSGGSTMFPGIADRMSKEITSLAPSSMKVKVIAPPERKYSVWIGGSILASLSTFQQMWISKGEYDESGPGIVHMKCF

SEQ ID NO: 65742 - protein, 1558 aa, Cryptococcus neoformans var. neoformans B-3501A
MAFSGVGQGIGTYDRTEQTSGASLGRVTSRAHFTDVHPNDDLPAQTGEHCARDVGHLARQLTRQSVAAADDSAAIFSYQEGSDLDPFSEKFNAKKWTKLMFEASQSSGPGRKAGLSFRNLDVHGFGSDADYQKTVGNLPLVGIGALRDLIGNRKRKVQILNSMDGVLEAGEMLVVLGPPGSGCTTMLKTIAGEMNGIYLDESSSLNYRGITPKQIYGQFRGEAIYTAEVDVHFPNLTVGQTLSFAAEARAPRKPPGGISKKEYAKHMRDVVMSVFGISHTLNTIVGNDFIRGVSGGERKRVTIAEASLAGAPLQCWDNSTRGLDSANAIEFCKNLRLNSDYIGISSAVAIYQAPQAAYDCFDKVSVLYEGEQIFFGKATEAKQFFVDMGFHCPSQQTVPDFLTSLTSASERTPREGFEGKIPTTPQEFATRWKQSDKYQELLAQIAEFENKYPVHGEKYQEFLQSRRAQQSKRLRPKSPYTLSYGGQVELCLRRGFDRLRADPSLTLTQLFGNFIMALIIGSVFYNLPATTSSFYSRGALLFFAILMSAFGSALEILILYAQRGIVEKHSRYAFYHPSAEAVASALTDIPYKVVNCIIFSLTLYFMTNLRREPGPFFFFMLISFTLTMVMSMLFRSIASLSRSLTQALAPAALLILALVMYTGFAVNVANMRGWARWMNWLDPIAYGFESLMINEFHGREYECAAFIPMGPGYEGATGQQLVCSTAGAVAGSSVVNGDDYINLSYEYYHAHKWRNFGILIGFFLFFSAIYISATEFITAKKSKGEILVFPRGKIPRALLAQSTHSHGSSDDVEGGKFAGGSKMKKEITGADRADAGIIQRQTAIFSWKDVVYDIKIKKEPRRILDHVDGWVKPGTLTALMGVSGAGKTTLLDVLATRVTMGVVTGEMLVDGRQRDISFQRKTGYVQQQDLHLETSTVREALRFSAVLRQSNTISIKEKYEYVEEVLKLLEMESYADAVVGVPGTGLNVEQRKRLTIGVELVAKPALLLFLDEPTSGLDSQTSWNILLLLRKLTEHGQAILCTIHQPSAMLFEQFDRLLFLARGGKTVYFGEVGKGSHILIDYFEQNGAPKCPEGENPAEWMLAAIGAAPGSHSDVDWHQAWINSPERVEVRRELVRIKETQGGKGEAALQNKDQEKSKSEVKAEYAEFASPLWKQFIVVLTRVWQQHWRTPSYIWSKAALCALSALFIGFSFFKAGTSQQGLQNQLFSVFMMFTIFGQLTQQIMPNFTTQRSLYEVRERPSKAYSWKIFILSNIVAEIPWAILMGAVIYFTWYYPIGYYRNAIPTDAVHLRGALMFLYIEMFLIFNATFAIMIVAGIATAETAGNIANLLFSMCLIFCGVLAPPSSLPGFWMFMYRVSPFTYLVEGMLSTAVADTNVVCSDIELLTMNPPSGQSCGDYMSTYISNYGGYLVNENATTACEFCSMSSTNTFLAQFSIYYSNKWRDFGLLWAYVVFNIIAAVGIYWLARVVRTFRLFTQPSLLITSLISPRTLAKNKHLNRRTYRRSWFLHSLLRRNLSRCLEAPSLPRRKIGRQENRRL

SEQ ID NO: 65743 - protein, 308 aa, Agrobacterium tumefaciens str. C58
MILCCGEALIDMLPRQTTLGEAGFAPYAGGAVFNTAIALGRLGVPSAFFTGLSDDMMGDILRETLRASKVDFSYCATLSRPTTIAFVKLVDGHATYAFYDENTAGRMITEAELPALGADCEALHFGAISLIPEPCGSTYEALMTREHETRVISLDPNIRPGFIQNKQSHMARIRRMAAMSDIVKFSDEDLAWFGLEGDEDTLARHWLHHGAKLVVVTRGAKGAVGYSANLKVEVASERVEVVDTVGAGDTFDAGILASLKMQGLLTKAQVASLSEEQIRKALALGAKAAAVTVSRAGANPPFAHEIGL

SEQ ID NO: 65744 - protein, 531 aa, Oryza sativa
MAAPPLPLVLAAAAIASLVILVLVVFACRRWRRAVVAAAPQPPPRAAADVVAASPVRSQNEDLNKPLLEILDDHSSQSNTFPGNVVGESSKVQTSRSDTSPRSHGISDSGRTYPADSCTPQGSNLDVEVIAGPSHGISCSRQSTSPTIPITLGRVPPSDLVLKDSEVSGKHARINWNAKTLKWEIVDMGSLNGTFVNSRAVHHPNVGSRHWGEPAELADGDIITLGTSSKLSVQISLQNQRVPAGIGMASDPMVGRRSGKKLAMEDISFCQCPLQGVEQFGLFGIFDGHGGDGAARAVSKIFPENVATLLSHHETKEKVLSYSDASDVLRYAFTMTEAAIDHEYEGCTATVLLIWFDQKKDCFAQCANLGDSACVMSVNGKMIEMTEDHRVASVTERARIARAGQALKAGEVRINGLNLARMFGDKFLKEQDSRFSSEPYVSQAVHITKACTAFAVIASDGLWDVISTKRAVQLVVEGRERNSGDSASADKVRLQKPPVVSLTEMEYCGICQGLESSGVTLKFSVLIQQDA

SEQ ID NO: 65745 - protein, 205 aa, Zea mays
MADVDEYRCFIGNLSWSTTDESLKDAFSKFGNLTEAKVVLDKFSGRSRGFGFVTFDEKQAMEDAIEGMNGLDLDGRNITVDKAQPQGPGRDRNGDRDYDRERGSRYERGRDYGGGRAPRGGGGGGGGGDCFKCGKPGHFARECPSGDGGRGDRYGGRDDRYGGGGGGGGGRYGSDRGGDRYSGRSRDGGSYGGGDRYSRDRSGPY

SEQ ID NO: 65746 - protein, 405 aa, Azoarcus sp. BH72
MVIVGAGQSGLQVAESLRSEGYASVIVMIGDEPCPPYHRPPLSKAYLAGEASEAQLTIRAPEALAKKQIEFVAGVGVESIDRANTVLTLTDGRKLAYAALALATGSRARPLPVPGADLANVFALRTLEDTRRIAAALAAAQRVVVIGGGFIGLEFAAVAAKQGKQVTVLEAAGRLMARVVAPPVSDFYAALHRGHGVAIELGAAVSALRGKAGPAQDAVAAVCTADGREFPADLVIVGIGILPNSELAEAAGLACERGIVVDGCSRTADPRIVASGDCTARRLEDGSLLRLESVQNAVEQGKSAAAALLGKERRFDAAPWFWSDQYDVKLQMVGLSAGYDQVVSRGEVESQRFSVFYFRTGKLVAIDSINQPQVHMLGRKLLDKGNSLTAAQAADPAFDLAGAAA

SEQ ID NO: 65747 - protein, 631 aa, Salmonella typhimurium LT2
MSTTTLTRREQRAKAQHFIDTLEGTAFPNSKRIYVTGSQHDIRVPMREIQLSPTLIGGSKDNPQFEENEAVPVYDTSGPYGDPEVAINVQQGLAKLRQPWIDARNDSEELDDRSSAYTRERLADDGLDDLRFTGLLTPKRAKAGKRVTQLHYARKGIVTPEMEFIAIRENMGRERIRSEVLRHQHPGMNFGARLPENITPEFVRDEVAAGRAIIPANINHPESEPMIIGRNFLVKVNANIGNSAVTSSIEEEVEKLVWSTRWGADTVMDLSTGRYIHETREWILRNSPVPIGTVPIYQALEKVNGIAEDLTWEAFRDTLLEQAEQGVDYFTIHAGVLLRYVPMTAKRLTGIVSRGGSIMAKWCLSHHKENFLFEHFREICEICAAYDVSLSLGDGLRPGSIQDANDEAQFSELHTLGELTKIAWEYDVQVMIEGPGHVPMHMIQRNMTEELESCHEAPFYTLGPLTTDIAPGYDHFTSGIGAAMIGWFGCAMLCYVTPKEHLGLPNKEDVKQGLITYKIAAHAADLAKGHPGAQIRDNAMSKARFEFRWEDQFNLALDPFTARAYHDETLPQESGKVAHFCSMCGPKFCSMKISQEVRDYAAAQTIEIGMADMSEDFRAKGGEIYLKREEA

SEQ ID NO: 65748 - protein, 336 aa, Zea mays
MAEHLLSTAVHDTLPGSYVRPEPERPRLAEVVTGARIPVVDLGSPDRGAVVAAVGDACRSHGFFQVVNHGIHAALVAAVMAAGRGFFRLPPEEKAKLYSDDPARKIRLSTSFNVRKETVHNWRDYLRLHCHPLDEFLPDWPSNPPDFKETMGTYCKEVRELGFRLYAAISESLGLEASYMKEALGEQEQHMAVNFYPPCPEPELTYGLPAHTDPNALTILLMDPDVAGLQVLHAGQWVAVNPQPGALIINIGDQLQALSNGQYRSVWHRAVVNSDRERMSVASFLCPCNHVVLGPARKLVTEDTPAVYRNYTYDEYYAKFWSRNLDQEHCLELFRT

SEQ ID NO: 65749 - protein, 162 aa, Kluyveromyces lactis NRRL Y-1140
MSKVFFDVEADGQPLGRIVFQLYNDVVPKTTENFRALATGEKGFGYAGSVFHRVIPDFMLQGGDFTHGTGVGGKSIYGAKFPDENFVKKHEKPGLLSMANAGPNTNGSQFFITTVPCPWLDGKHVVFGEVADGFDVVKKVESLGSGSGATKARIVIAKSGEL

SEQ ID NO: 65750 - protein, 197 aa, Gibberella zeae PH-1
MAALRSQSAARMLRSAAVPRVALSAAPRRFQSNITSATGTITGPVANEPDYNIQADKATSTYTPVPRSIQDGSEEILPAAIMSGAPMELQARTVRIYQEAKPATQSGDWRGRRWRMDWDILPKGHRWENPLMGWQSSGDFMQGTHINFESKEDAIHFAEKQGYEYFVQEPNSRKFAPKAYANNFLYSARKLKHIRTK

SEQ ID NO: 65751 - protein, 136 aa, Zea mays
  misc_feature (61)..(61): Xaa can be any naturally occurring amino acid
  misc_feature (112)..(112): Xaa can be any naturally occurring amino acid
  misc_feature (121)..(121): Xaa can be any naturally occurring amino acid
LPSQPWRLGVGGLPSPTTPPPFPWDGGGHAAGGSCVGEDCLVWPSYHCRPPYSHDPGGGPXYFNKRVPPLVAPYFDVLAFSVGIVRPIGTWKTGLVLPLCLLLLYKDILAAXVIYDLFTKXDGEFLIKHGTLTDEP

SEQ ID NO: 65752 - protein, 159 aa, Kluyveromyces lactis NRRL Y-1140
MLRGTRRPANSTLNTPVVVHTVGTPTYLSKDEVLQFLASFIAEKESVPGVTLASSGASTTQGAVTSGGISADEMALDTQLSSALAQLKRVERDFKGLPPQVMEMEPSSTSSTGNTEEDTVAKSATGGKKIKFADVPESSQTSSDSKQTSSSSESSSDSE

SEQ ID NO: 65753 - protein, 365 aa, Zea mays
YHLRKQKNLRYPFTSLSHVYVRARMGSDPAEGEDHFDRVPDSLVLLIFNKLADARSLGRCSAVSRRFSALVPLVDDACLRIDRVIPADAADAGAPRPRAALSHLLKSVLLAVLKPFAHCDAKSASPQKHAQQQQQQHHSPAQVLRNFSSIRSLRMELPVSDVGTDDGVVLRWKAVFGSTLQSCVILGGTRVDRAAAAAAGPPHADDGGSIPESLYTNGGLKLRVVWTISSLIAAATRHYLLREIVKEHPTLERVALTDAGGQGTLSMGRDQLREFRDRPLAAAPAAAANRTQVPACNMKLRYAPLLELSDGTRIHGATLVVIKPVGDAGGKDLDELGAGAFDGPLREAVAALGKRRAYLLEMNGF

SEQ ID NO: 65754 - protein, 128 aa, Ralstonia solanacearum GMI1000
MNLIEQIEQEEIKRLTANKTIPPFAPGDTVIVNVNVVEGNRKRVQAYEGVVIAKRNRGLNSSFIVRKISSGEGVERTFQLYSPLLASIEVKRRGDVRRAKLYYLRERSGKSARIKEKLSFKRKEVAAQ

SEQ ID NO: 65755 - protein, 487 aa, Bacillus cereus ATCC 10987
MGVLLPVNAGQISKLRLEGDVQELEKNLKKDLKIRHITMISIGGVIGAGLFVGSGAVVHSAGPGSIISYALAGLLVIFVMRMLGEMAAINPTSGSFATYAREAIGPWAGYTIGWLYWFFWVIVIAIEATAGAGIIQYWIPEIPLWLLSLILTILLTLTNVFSVKSFGEFEYWFSFIKVISIVLFLCLGLAVILGFVPGTEAPGTSNLVGQGGFMPNGISSVLLGITVVIFSFMGSEIVAVAAGESAEPVKAVKTATNSVIWRILVFFIGSIAVVVTLLPWNSANILKSPFVAVLEHIGVPAAAQIMNFIVLTAVLSCLNSGLYTNSRMLFSMAERGDAPKAFLKLNNSGVPVRAVLFGTFFAYIGVVFSYISPDKVFLFLVNASGGIALLVYLVIAVSHLKIRKKMGKVEQQNLKVKMWFFPYVTYVTIAAIIAVLVAMLAIESLRSQALLTMLVTVLIILSYFIFNRNKNSTVSNTTSKNEESVRF

SEQ ID NO: 65756 - protein, 310 aa, Pseudomonas aeruginosa UCBPP-PA14
MYLVCGEALFDVFSLESAARSNELGFTAIAGGSPFNVAVGLRRLGVEAALFGGLSSDYLGARLRRVLEEEGVDCGFLVPSDAPTTLAMVGLDASGSAQYQFRGEGCADRQVRLEHLPTLDGRIRGLHVGSYTLVVTPVADTLLALVRRESGRRLVSLDPNVRLDPQPDIDLWRRRVEAFASHAHLIKASEEDLALLYPDRDPGEVARGWLNPRCRLVFVTHGGAGASVHCTHGSWSRPADTALALRDTVGAGDTFQAATLAYLRRLDADSPAGLAALSREAIDAMLAFAIRAAAVTCSRVGPDLPFAHEL

SEQ ID NO: 65757 - protein, 435 aa, Clostridium acetobutylicum ATCC 824
MEEKIKKETQIELSYGVEDKPELLSRILLAFQHIFAAFGGIIVVPIIVASSLKLDAKTSTALLSAAILMAGVATLIQSKGVYSVGARVACIMGTDITFVAPAAVVGKKFGLAGIFGATILGAVIVVILSFFIKYIMKFFPPIVTGIVVCLIGLTLLPVSIDWAAGGSGTKNYGSLQNISIALIVMVITLLINHYGRGLVSSASILIGMVVGYIICIPLGMVNFSTISNLKIISIPSIFQYGVKFNISALLPFIPAYFVSVISTVGNLRAINEISGIKDDSKISKGVLSDGIGSILAGMFGAMPNTSFSQNVGLIPLTKVASRYVTLVAGIILMVLGLVPKFSGIINIMPQPVLGGVGIVMFGTVAAAGIQTLSHVNLNNRNILIIATSIGLGLGVTFRPEILSSLPESLKMIFSSGISTGTIAALVLNLILKEKK

SEQ ID NO: 65758 - protein, 693 aa, Gibberella zeae PH-1
MPVPTMMAARLARAGQTRAINSSRCIKPSLIPRPLYSSQSRSFVKLTGASPSITKGSPVTSRVTRQLPSQFFVRNLSGKPLPQGKSWILNFCYRAAAWVGISISVIGVGVVGFFIYDASTYSEHPNHSDIDVSKIALQPRSGGEKNLPIAEVYIDDDDTEEHRRLKDKPRLVILGGGWGGVALLKELNPEDYHVTVISPTNYFLFTPMLPSATVGTLELRSLVEPIRRILSRVNGHFIRAKAEDVDFSHKMVEVSQVDASGKDIRFYVPYDKLVIAVGSTTNPHGVKGLENAFFLKDINDARKIRNQVIQNFELANLPTCSDEERKRLLSFCVSGGGPTGVEFAAELFDLLNEDLTRHFPRLLRNEISVHLIQSRSHILNTYDETVSRYAEDRFARDQVDVQTNSRVKEVLPDKIIFTQKQEGGGTITKELPIGFCLWSTGVSQTQFCQTLAAKLRKSQTNRHALETDTHLRLNGSPMGDVYAIGDCSTVQNNVADHVVTFLRSLAWKRGKDPETLQLSFADWRGVADDVKKRFPQAVGHLKRVDKLFEEFDKDKSGTLDFDELTQLLRNVDNKLTSLPATAQRAHQQGQYLARKFNRMTRLHEGLDANDIRDGDVDAAVYKAFEYKHLGSLAYVGNSAIFDWGEGRSIAGGLWAVYAWRSVYFAQSVSLRTRLLMAMDWTKRGLFGRDLMSF

SEQ ID NO: 65759 - protein, 830 aa, Yersinia pestis biovar Microtus str. 91001
MKLSRRDFMKANAAVAAAAAAGMTIPTVAKAVGETTNAIKWDKAPCRFCGTGCGVLVGTQNGRIVASQGDPDSPVNRGLNCIKGYFLPKIMYGKDRLTQPLLRMKDGQYDKEGDFTPISWEKAFDIMELKFKNALKEKGPTAVGMFGSGQWTVWEGYAALKLLKGGFRSNNLDPNARHCMASSVVGFMRTFGMDEPMGCYDDIEEADAFVLWGSNMAEMHPVLWSRMTSRRLTNAHVRIAVLSTYEHRSFELADNPIVFTPQTDLVIMNYIANYIIQNNAVDKDFLAQHVNFRRGATDIGYGLRPTHPLEKAAKNPGSDASEPMSFEDFKTFVAEYTLEKTAKMSGVPEDQLESLAQLYADPKVKLVSYWTMGFNQHTRGVWANNMCYNLHLLTGKISTPGSGPFSLTGQPSACGTAREVGTFSHRLPADMVVTNEKHRQIAETTWQLPAGTIPEKVGLHAVAQDRALKDGTLNAYWVMCNNNMQAGPNINEERMPGWRDPRNFIVVSDPYPTISALSADLILPTSMWVEKEGAYGNAERRTQFWRQQVPSPGEAKSDLWQIVEFAKRFNVEEVWPAELVNQKPEYRGKNLYEVLFANDVVSKYPLSEIPDDQLNDEARDFGFYIQKGLFEEYASFGRGHAHDLAPFDVYHQVRGLRWPVVDGKETLWRYREGFDPFVPKGEEVRFYGKPDGKAVIFALPYEPAAESPDQEYDLWLSTGRVLEHWHTGSMTRRVPELHRAFPEAVLFIHPLDAKARGLHRGDKVKVISRRGEVISLVETRGRNRPPRGLVYMPFFDAAQLVNNLTLDATDPLSKETDFKKCAVKLERVVA

SEQ ID NO: 65760 - protein, 172 aa, Ustilago maydis 521
MAAQAQQIQQKVEYFVAQIDKELSRYPALKKFEQTVPVPKAYAALGAFGIFTLFVFFNIAAGFLTNLLGFFVPAYFSLKALESPQPQDDIQWLTYWVVFGLFTFLETFINIVLYYIPWYYTIKTLAIVWLMLPQTQGAKMVYSRIIRPVFLTTQKTVHQANASTPAAPAETH

SEQ ID NO: 65761 - protein, 504 aa, marine gamma proteobacterium HTCC2207
MSDSLAQQPDAELTREHRDVIIVGAGLSGIGAACHLAEKCPERDYLLLESREAMGGTWDLFRYPGIRSDSDMHTLGYSFKPWEGAKAIADGPSILDYVRETAAEHKIDQHIRYCHRLISASWSSEQSIWTLEVHQSDSDQTVQMTCNFLYMCAGYYSYDKPHDPQFPEVASFKGKVIHPQFWPDDLDYQDKTVVIIGSGATAMTLVPAMAKKAKQVTMLQRSPTYVFSRPSEDWFANSLRKILPSTWAYAITRTRNTLFQEFIFKQARNYPAVAKRFLIHQLHKQLGKDYDVEKHFTPNYNPWEQRLCLVPDDDLFKAISNGSADIVTDHIERFTETGIELKSGQHLSADIIVGATGLELEVMGGAQFSVDGQVVDFAKLTTYKGFMVSDVPNMVSTFGYVNASWTLRADLISEWVCRALNHMRETKTRKVVPVLPQSLRDMPTKDWIADFPAGYLKRGMHLQPKQGNQAPWVNSQDFRSERALFSLPIETDKALHFSGAEKSV

SEQ ID NO: 65762 - protein, 773 aa, Hordeum brevisubulatum
MVVAAAILPELATQLVVPVAAAVGIAFAVLQWFLVSKVKVAPERRGEGSGSAGAGGGKDGASEYLIEEEEGLNDHNVVLKCAEIQTAISEGATSFLFTEYKYAGGFMTVFAVLIFVFLGSIEGFSTKSQPCHYSVGKTCKPALANAAFSTIAFVLGAVTSLVSGFLGMKIATYANARTTLEARKGVGKAFIVAFRSGAVMGFLLAASGLFVLYVAINLFGLYYGDDWEGLFEAITGYGLGGSSMALFGRVGGGIYTKTADVGADLVGKEERNIPEDDPRNPAVIADNVGDNVGDIAGMGSDLFGSYAESSCAALVVASISSFGINHEFTPMMYPLLISSVGIIACLITTLFATDFFEVKEVDQIEPALKKQLIISTAVMTVGIALVSWLGLPYTFTIFNFGAQKTVHSWQLFLCVAVGLWAGLVIGFITEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAGITTVDVLTPNVFIGLLVGAMLPYWFSAMTMKSVGSAALKMVEEVRRQFNTIPGLMEGTAKPDYATCVKISTDASTKEMIPPGALVMLTPLIVGTFFGVETLSGVLAGALVSGVQIAISASNTGGAWDNAKKYIEAGASEHAKSLGPKGSDCHKAAVIGDTIGDPLKDTSGPSLNILIKLMAVESLVFAPFFATYGGILFKYL

SEQ ID NO: 65763 - protein, 203 aa, Gibberella zeae PH-1
MAQAGGSYNNPLKKFKLVFLGEQSVGKTSLITRFMYDSFDNMYQATIGIDFLSKDRTVRLQLWDTAGQERFRSLIPSYIRDSSVAVVVYDISNAKSFQNTKKWIDDVRAERGNDVIIVLVGNKTDLNEKREVTTQQGEEEAKKNNLMFVETSAKLGHNVKNLFKRIAQALPGMEGSDAAAQASNQMIDVKTNNTQQSQEGCAC

SEQ ID NO: 65764 - protein, 735 aa, Ustilago maydis 521
MAARKLQTEIDKTLKKVAEGVESFEDMFELLQRATNATQKEKMESDLKTQIKKLQRLRDQIKTWLQSNDIKDKKPLLDNRKLIETQMEKFKAIEKEMKTKAFSKEGLIAAAKMNPKDREKAEISEWLSTQVDELSRQVESAEAEIETISGSGKKKKGSAKDERASTLENANDRRNWHISRLEILLRMLENGNLETERVTDIKEDISYFVESNMEEDFEEDEGIYDDLNLDDGEEAFGLKETDDMHSNVDSNAGMDDLSFRDTKDTPTKPRRDSLVDINSSGFNSNSNNNSNNNNAPTTTTTTTSSSSSSNNNNVATSSSNKKEESAPSPVSAAPAQSAPSPVAATSANRKTTRKTSQEPVAVPKEKTVPTANFAQAKAPASSQSAVLSPPKVPSAAPLPPIRYAAAAAAAVAASATASANEATASSPSTTTGSIATDAVSDSVNASSTASAAPGSQTQPSSGATQTVGAPVTPAKSSVEALKNEGADKARSASPAPPGHGKVEPNSNAGAAASAGGGSAQDGASTLSGFQPAQLAASSAAASVVQPAGGGAGTAAQQAAAQKEAGTEARLPTSLTDLVSSFESAKQKSLRRDANLGLVYKSLESSFMTVPEAVDSDKPKYYVAKNPFPTPSYYPQTPASVFDNPALYSKFDVDTLFYIFYYQQGTYHQYLAAKELKKQSWRFHKQYLTWFQRHSEPQAITDEYEQGVYVYFDWEGSWCQRKKSDFRFEYRWLEDN

SEQ ID NO: 65765 - protein, 408 aa, Zea mays
MALPRQHLALVAVLVSAAVAAQTTTDELSASPPSDNNSALVAGVGIKVSFRPRVAIVVGIFTMIFSLTFLVLMYAKFCHPSGSSSNNGAAAAAVCSVGVPKQVIQSLPFFRFATLRGARQGMECSVCLARFDDADLLRLLPRCRHAFHLHCVDRWLQSNASCPLCRTSVDADHATLGLKYPSSARIVFGGDALSSGRFDDAAGAGTGSGRDLLDIFVERVPGPYIKKTISSSPPPPGLDRHKHRIIVSDVLFRSRWSELNSADLIALDTEMLRSVSSGRFVFPPEYNNEMIAAAAAEEEEEEDDGIMPTAMGRKRLLEPVDDVVDDDLLGDGCRSGFAVSASASAARMISSGVRSMSEIVSLSRERLSEEDNRRWLTIARRTARWFAAGRASRGNEEEHRAVHVVDDV

SEQ ID NO: 65766 - protein, 281 aa, Gibberella zeae PH-1
MSSSANLVESAKKLAAYQAVNDHLDASYKFVGIGSGSTVVYVVDAIVSKGPEFYKGMTFIPTGSQSKGLIRAAGLNLVNLDERPMVDGLPVPLDVAFDGADEVDEDLNLIKGGGACLFQEKLVAIAAKKFIAVADYRKQSPKLCTTWKTIPIEVLPLSAPDVLVRLRAMGSPKPAIRSGLPAKAGECVTDNGMWLIDAPFSPLLLPKDINSENKGRGENGAWEVNALAEELVRTPGIVEIGLFHGFNGNEAVKLGKESQAQKPIAAYFGLANGEVQVQNAA

SEQ ID NO: 65767 - protein, 373 aa, Oryza sativa (indica cultivar-group)
MPKKGTKSRKGTDDEPKQEEKNKLPEHLEVQRTRVVCKGDAPTEGFQYAGAFAAMGIDNSVSADKFCKNFKVVVNRLTEDDMEFDMIGIDASMANAFRRILIAEVPTMAIEKVLMADNTSVIADEVLSHRLGLIPLDADPRLFEYISENDVPTERNTIVYKLHVSCKKGSPRLTGVSGCQKVANYLWHLLAQSGDKQKTYTSFSQSQKDILEKPLGVKFKDITIARLGPGQAIELEVHAVKGIGKVHAKWSPVATAWYRMLPEVVLREEIKDADAEMLVAKCPVNVFDIEDLGNGEKRAVVARPRACTLCRQCVMGPTGEVMGPTVEQVELRRVRDHFIFTIESTGALPPEMLFTEAVRILEEKCERVISELS

SEQ ID NO: 65768 - protein, 202 aa, Arabidopsis thaliana
MAELENPSVMSKLIAFLSSLLERVAESNDLTRRVATQSQRVSVFHGLSRPTITIQSYLERIFKYANCSPSCFVVAYVYLDRFTHRQPSLPINSFNVHRLLITSVMVAAKFLDDLYYNNAYYAKVGGISTKEMNFLELDFLFGLGFELNVTPNTFNAYFSYLQKEMTLLQPLSLVVVPSSRSLITFNDDEASHQKQQQQQLAV

SEQ ID NO: 65769 - protein, 559 aa, Glycine max
MVEDGDEVAVDARSTEDWLLHAQELVPVVIDKAREVKGFAGRWKMIVAKLEQIPLRLSDLSSHPCFSKNALCKEQLQAVSKTLGEAIELAELCLKEKYEGKLRMQSDLDSLSGKLDLNLRDCGLLIKTGVLGEATLPLAVSSSVAESDVATYNNIRELLARLQIGHLEAKHRALDSVVEAMKEDEKSVLSVLGRSNIAALVQLLTATSPRIREKTVTVISSLAESGSCENWLVSEGVLPPLIRLVESGSTVGKEKATISLQRLSMSAETARAIVGHSGVRPLVELCQIGDSVSQAAAACTLKNISAVPEVRQALAEEGIVRVMINLLNCGILLGSKEHAAECLQNLTASNENLRRNVISEGGVRSLLAYLDGPLPQESAVGALRNLVGSVPEESLVSLGLIPRLAHVLKSGSLGAQQAAAAAICRVCSSTDMKKMVGEAGCIPLLVKMLEAKSNSVREVAAQAIASLMVVSQNRREVKKDDKSVPNLVQLLDHSPQNTAKKYAVTCLGSLSSCKKCKKLMISYGAIGYLKKLTEMDIPGAKKLHERLERGKFRSLFSKK

SEQ ID NO: 65770 - protein, 258 aa, Oryza sativa (indica cultivar-group)
MAAIRLFRPALLLAAILLLAAGAVEGKKGGKVDVALYYESLCPYSAMFVVGSLAKVFRDGLLDAVDLSLVPYGNARVKDGKISCQVEHGSEECFLNTVEACAIDAWPDLRVHFRFIYCVEDLVVNHKQREWESCFGKLNLDPKPVTDCYKGERGHQLSLKYGRQTDALQPPHKYVPWVVVDGQPLYEDYENFEAYICKAYKGHPPKVCEGLARPPTPTVLEVAEAVNRVSYYDSGDIRLKPDEDGHAKIKKVVPDDDD

SEQ ID NO: 65771 - protein, 237 aa, Blastopirellula marina DSM 3645
MCDSQPTSRREFVQSVGLAVGAASMGAYSTLRAAEPAAAMDPSDVLAKLVAGNERFANGKTKVMPRTPADFARDAKGQAPPAIILACADSRVAPELVFDQPIGGLFVLRVAGNIVGSGPTLMGSIEYAVAVLGSSLIMVMGHSSCGACEAAIEHIENNESLPGSIEGLVDYIRPVVRQVKGKPGDKLVNVTKANAVQTAMSLETSGPILPERVKSGALKIVSSYYELSNGQVQLLKS

SEQ ID NO: 65772 - protein, 95 aa, Oryza sativa (indica cultivar-group)
MAAGPRGRLLLVALVSAAAVVAGALLPGCAAAAAAGEKVPLALYYETLCPYCSRFIVNHLAGIFEDGIVDAVDLRLVPYGNAHVVGANNTISCQV

SEQ ID NO: 65773 - protein, 597 aa, Synechococcus sp. RS9917
MSQLDVDASQSPLGSGSGDGAQALPKAEQRKIDSDYLREPLLTELANDRPQFSEDALQILKFHGSYQQDDRDRREKGKDKQWQMMLRLRSPGGRIPASLFLALDDLSNRLGDGSLRATTRQAFQMHGVAKADLKEVIGTIVRHMGSTLAACGDINRNVMAPAAPFDKDGYPAARQLADDIADLLSPETAEGSYLDLWVDGDLSYRIKPSRIVKAARQRQRDGAVFSGDPQEPLYGDTYLPRKFKVAVTVPGDNSVDLLTQDIGLVAFSEPSGALRGCNVYVGGGMGRTHNKEETFARIADPLGYVAADQVLDLVQAILALQRDHGDRTLRRHARMKYLIHDRGIDWFRDELLARYFHGELGALRHEAKPKLTDYLGWHRHRPGMWFVGIPLLCGRLEGELKAGLRRIVETYQLEIRLTPNQDLLLCNIGTPQRAGIRQALADLGIETPDAPAPLARHAIACPALPTCGLAITESERILPDVLERLNTQLEQLAINKPILVRMTGCPNGCARPYMAELALVGSGVNQYQLWLGGSANLQRLARPFLQRMPLDQLEATLEPLLISWRDAGGRRSLGDHVEKLGDQVVATLLGDPAVAPT

SEQ ID NO: 65774 - protein, 140 aa, Brassica napus
APGTRVLYLGAASGTTVSHVSDIVGPDGLVYAVEFSHRSGRDLVNMAKKRTNVIPIIEDARHPARYRMLVGMVDVIFSDVAQPDQARILALNASYFLKNGGHFVISIKANCIDSTLPAEAVFAAEVEKLKADQFKPAEQV

SEQ ID NO: 65775 - protein, 399 aa, Candida albicans SC5314
MSSTNSTENHAVEEKYEDPQQQQQQQQQQQQQQQQKDALAKKPMSAYIGISIMCVLIAFGGFVFGFDTGTISGFINMSDFLERFGGTRADGTLYFSNVRTGLLIGLFNVGCAIGALFLSKVGDMYGRRVGIMTAMIIYIVGIIVQIASQHAWYQVMIGRIITGLAVGTLSVLCPLFISEVSPKHLRGTLVCCFQLMITLGIFLGYCTTYGTKTYSDSRQWRIPLGLCFAWALCLLGGMVRMPESPRYLVGNDRIEDAKISLAKTNKVSPEDPALYRELQLIQAGVERERLAGSASWKSLITGKPRILERVFVGAMLQSLQQLTGDNYFFYYSTTIFKSVGLNDSFQTSIIIGVINFASTFVGIYAIEKLGRRHCLLIGFRCDVHLFLNLLIDWYSTSLH

SEQ ID NO: 65776 - protein, 240 aa, Bacillus cereus ATCC 10987
MVKLVLIRHGQSEWNVENRFTGWTDVDLSSKGLEEAREAGVMLKASGFSFDIAYTSVLRRAMRTLWITLEEMDLMWIPVYKTWKLNERHYGALQGLNKEETARKYGDEQVTLWRRSTNVRPPALTKDDERYEAAHPKYRDIKDYEFPLTEDLEDTEKRVVSYWNEEIAPNVKAGKQVIIAAHGNTIRALVKHLDQISDKDIENVNIPTGTPLVYELDNDLKPIGHYYLNREIETLEEKQV

SEQ ID NO: 65777 - protein, 546 aa, Candida albicans SC5314
MSQDNVSSTSTAEAVNNEIKVKDEFRQEEQAHTSLEDKPVSAYIGIIIMCFLIAFGGFVFGFDTGTISGFINMSDFLERFGGTKADGTLYFSNVRTGLMIGLFNAGCAIGALFLSKVGDMYGRRVGIMTAMIVYIVGIIVQIASQHAWYQVMIGRIITGLAVGMLSVLCPLFISEVSPKHLRGTLVCCFQLMITLGIFLGYCTTYGTKSYSDSRQWRIPLGLCFAWALCLVAGMVRMPESPRYLVGKDRIEDAKMSLAKTNKVSPEDPALYRELQLIQAGVERERLAGKASWGTLFNGKPRIFERVVVGVMLQALQQLTGDNYFFYYSTTIFKSVGMNDSFQTSIIIGVINFASTFVGIYAIERMGRRLCLLTGSVAMSVCFLIYSLVGTQHLYIDKPGGASRKPDGDAMIFMTSLYVFFFASTWAGGVYSIISELYPLKVRSKAMGLANASNWTWGFLISFFTSFITDAIHFYYGFVFMGCLVFSIFFVYFMVYETKGLTLEEIDELYSTKVLPWKSAGWVPPSEEEMATSTGYAGDAKPEEEHV

SEQ ID NO: 65778 - protein, 425 aa, Burkholderia xenovorans LB400
MQNEALLQRKNNATPRGVGVMCPFYADTALNAELWDVEGRRYIDFAAGIAVLNTGHRHPKVMAAVREQLDRFTHTCWQVVPYPSYVELAEQLNRLAPGDFQKKASLFSTGAEAVENAIKIARAFTGRAAVIAFSGSFHGRTMMGMALTGKVAPYKVGFGPFPGEVYHAPYPNTLHGVTTTNALDSVRALFKTDVDPLRVAAIIFEPVQGEGGFYEAPADFVKGLRDICDQHGILLIADEVQTGFARTGKLFAMQHHAVAADLTTVAKSLAGGLPLSGVIGRADVMDAAAPGGLGGTYAGNPLSVAAALAVLDVIESENLCERATQLGNRLKSHLTSMRESLPHIAEIRGPGAMIAAEFFEPGTLIPDADFAKRFQARALELGLILLVCGVHSNVIRFLFPLTIEEAVFEEALVLIETAMKDAAAA

SEQ ID NO: 65779 - protein, 191 aa, Blumeria graminis
MSLRCVVVGDGAVGKTCLLISYTTNKFPSEYVPTVFDNYAVTVMIGDEPYTLGLFDTAGQEDYDRLRPLSYPQTDVFLVCFSVTSPASFENVREKWFPEVHHHCPGVPCLIVGTQTDLRDDLSVREKLNKQKMQPVKREDGERMAKDLGAVRYVECSALTQYKLKDVFDEAIVAALEPPAPKKKHRNCLIL

SEQ ID NO: 65780 - protein, 143 aa, Solanum lycopersicum
MERVNKLCVAFFVINMMMAVAAAQSATNVRATYHLYNPQNINWDLRTASVYCATWDADKPLEWRRRYGWTAFCGPAGPTGQASCGRCLRVTNTGTGTQETVRIVDQCRNGGLDLDVNVFNRLDTNGLGYQRGNLNVNYEFVNC

SEQ ID NO: 65781 - protein, 496 aa, Burkholderia xenovorans LB400
MTNHPTAMPSLQEPSLFRQECYIAGEWIESDPMARIDVVNPANGLKIGTVPRATLADVRTCIDAAERALPAWSGKTGKERAAILRRWYELMLQHQEDLAVIMTCEQGKPLAESRGEIVYAASFLEWFAEEAKRVYGDTIPTPASDRRIVVLKQPIGVCAAITPWNFPAAMLTRKIGPALAAGCTMVLKPASQTPFSALALCVLAERAGVPAGVLSCVTGKASMIGDEFCRNPAVRKLSFTGSTEIGKLLLQQCASTVKKTSMELGGNAPFIVFDDADLDAAVVGAIAAKFRNAGQTCVCVNRFLVQDTVHDAFVEKLSTAIAALKVGDGLDAGTRIGPLIDSKAVEKAREHVDDAIARGATVVTGGSGHALGGNYFEPTLLTGASKDMKIFREETFGPVAPVFRFRTEEEAIQLANDTEFGLASYFYGRDIGRVWRVAEALEYGMVGINEGLISTEVAPFGGVKESGLGREGSKYGIEDYLEVKYLCMGGLAARPV

SEQ ID NO: 65782 - protein, 528 aa, Synechococcus elongatus PCC 6301
MTAQQLWQRYLDWLYYDPSLEFYLDISRMGFDDAFVTSMQPKFQHAFAAMAELEAGAIANPDEQRMVGHYWLRDPELAPTPELQTQIRDTLAAIQDFALKVHSGVLRPPTGSRFTDILSIGIGGSALGPQFVSEALRPQAALLQIHFFDNTDPAGFDRVLADLGDRLASTLVIVISKSGGTPETRNGMLEVQSAFAQRGIAFAPQAVAVTGVGSHLDHVAITERWLARFPMEDWVGGRTSELSAVGLLSAALLGIDITAMLAGARQMDALTRHSDLRQNPAALLALSWYWAGNGQGKKDMVILPYKDSLLLFSRYLQQLIMESLGKERDLLGKVVHQGIAVYGNKGSTDQHAYVQQLREGIPNFFATFIEVLEDRQGPSPVVEPGITSGDYLSGLLQGTRAALYENGRESITITVPRVDAQQVGALIALYERAVGLYASLVGINAYHQPGVEAGKKAAAGVLEIQRQIVELLQQGQPLSIAAIADDLGQSEQIETIYKILRHLEANQRGVQLTGDRHNPLSLIASWQR

SEQ ID NO: 65783 - protein, 197 aa, marine gamma proteobacterium HTCC2207
MTDRTATVTRNTLESQITVTVNLDGTGVANFNTPVPFLNHMLDQIARHGLVDLDIQAVGDTHIDDHHTVEDIGITLGMAIAEAIGDKKGLTRYGHAYVPLDEAMSRVVLDFSGRPGLIMKADFVRSHVGTFDVDLTREFFQGFVNHALVSMHIDNLRGANAHHQVETIFKAFGRALRIAASADPRMAGVMPSTKGTL

SEQ ID NO: 65784 - protein, 188 aa, Gentiana triflora
MASTAAAAAANFLSTAMDVGALRSLAPQAPGFNCVSMVGATFSPASSFRSKPFPCLAIATDAGIKEAVKTEKAPAALGPYSQAIKSNNLVFVSGVLGLIPETGKFVSDSVEEQTEQVMKNMGEILKASGASYSSVVKTTIMLADLNDFKKVNDIYAKYFSSPAPARSTYQVAALPLNARIEIECIAVL

SEQ ID NO: 65785 - protein, 521 aa, Solanum tuberosum
MAASIGALKSSPSSNNCINERRNDSTRAVSSRNLSFSSSHLAGDKLMPISSLRSQGVRFNVRRSSLIVPPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPDWFQGTADAVRQYLWLFEEHTVLEYLILAGDHLYRMDYEKFIQAHRETDADITVAALPMDEKRATAFGLMKIDEEGRIIEFAEKPQGEQLQAMKVDTTILGLDDKRAKEMPFIASMGIYVISKDVMLSLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKSCKIHHSVVGLRSCISEGAIIEDSLLMGADYYETDADRKLLAAKGSVPIGIGKNCHIKRAIIDKNARIGDNVKIINKDNVQEAARETDGYFIKSGIVTVIKDALIPSGIII

SEQ ID NO: 65786 - protein, 149 aa, Mougeotia scalaris
MADQLTEEQIAEFKEAFSLFDKDGDGSITTKELGTVMRSLGQNPTEAELQDMINEVDADGNGTIDFPEFLNLMARKMKDTDSEEELKEAFKVFDKDQNGYISAADWRHVMTNLGEKLTDEEVDEMIREADVDGDGQVNYEEFVKMMMAK

SEQ ID NO: 65787 - protein, 522 aa, Coccidioides immitis RS
MTLLSRSNLSGLTLITPTTNRSVSDSIAIMTSPAPLLKIPTPGNRKPPKLTVGIPPSPNARPVNQVGTTSQNDPQAQHLPSRQLPPELRIATPMGSRGMIQQEDTSYHNGRPIPQPYSNSSNDLSAHSRSGSFTMHDGKNSGPASATSSSFSTLSFAMGMRDPLGGAGDPSSAISSVYSDRGGGLPMERENSMNGVLPDLDKLSQELGRPLDVEDLDDEKWAAASEQRKIIELDSLGEGAGGAVTRCILKGGKTVFALKVITTDPNPDVKKQIFRELNFNKDCASEHICRYYGAFMDRSSSTISIAMEFCEGGSLDSVYKEVKKLGGRTGEKVLGKVAEGVLNGLTYLHGRKIIHRDIKPSNILLCRTGQVKLCDFGVSGEFGTKGDANTFIGTSYYMAPERITGQSYTITSDVWSLGVTLLEVAQHRFPFPADGTVMQPRAGLIDLLTYIVRQPIPKLKDEPENGIYWSDNFKYFIECCLEKEPPRRATPWRMLEHPWMLEMKNKKVNMAHFLKQVWDWKE

SEQ ID NO: 65788 - protein, 413 aa, Trichoderma atroviride
MADLQGRKVFKVFNQDFVVDERYTVTKELGQGAYGIVCAAVNGQTNEGVAIKKVTNVFSKKILAKRALREIKLLQHFRGHRNITCLYDMDIPRPDNFNETYLYEELMECDLAAIIRSGQPLTDAHFQSFIYQILCGLKYIHSANVLHRDLKPGNLLVNADCELKICDFGLARGFSVDPEENAGYMTEYVATRWYRAPEIMLSFQSYTKAMDVWSVGCILAELLGGRPFFKGRDYVDQLNQILHILGTPNEETLRRIGSPRAQEYVRNLPFMPKKPFPALFPDANPDALDLLDKMLAFDPSQRISVEQALEHPYLHIWHDASDEPDCPTTFNFDFEVVEDVGDMRKMILDEVLRFRQLVRTAPASGNQAAAQQIQVPMPQAGGQWTAEDPRPQEYMGHANGLEQDLAAGMDIRR

SEQ ID NO: 65789 - protein, 390 aa, Bradyrhizobium sp. BTAi1
MEQRIASLTAPSARSNVPPFMVMDVMAAAERIEASGGHVIHMEVGQPAAPAPRTALAAAHAALDQARIDYTSALGLPSLRGRIARHYRETYGCDIDPGRIVITTGSSAGFILAFLAMFEPGDRVAVTVPGYPPYRHILTALGCEPVLIETTAETRHALTGEALLAAHRKTPLKGVLVASPANPTGTMMSRAALGDVIAAARDAGIRFISDEIYHGLDYAFPAVTAAQLTADALIINSFSKYFCMTGWRVGWMVVPDALVRPIERLQQNLAISVPTLSQIAAEAAFDGRPEMDGIKHGYQENRRILIEGFPKAGLSRFLPADGAFYLYADVSDFTKDSLDFAKRMLEETHVAATPGVDFDPIHGRNFVRFSYARSAEDMREAVARIARWLG

SEQ ID NO: 65790 - protein, 356 aa, Arabidopsis thaliana
MEWWKKKSLRAIIKRERLVRGHERGGTLLEEIIKSCNGKANPIKIFSADQILEATDTFSESNRVSELFDEIPYDWYYSGKNNNHHHHHKLLLIKKWRYRFSEHNGGNFCRDIAISSIVSGHKNFMQLVGCCLESEHPVLVYRASKKPTSLDLKMVVSWRQRLKIAEEIATALAYLHTAFPRPFVYRILRLEDILLDDEDGVAKLCNFSYCVSIPQGETFVKLGNGCIGGDYDYMDDNYLINGIVSEKTDAFGFGIFMQKLLMGEERFHELCYDRSDLTTFENRRKFAKCIDEIVDSNMLEKIGDVTEEERCRMEAFIVLSERCIGLRGEVPKMVEVAKELERFLRDSSSSCGETSL

SEQ ID NO: 65791 - protein, 154 aa, Synechococcus sp. RS9917
MSVSVSRLSTAWVSMLCLSALAPGLRAQPLASTQPQQPAQQGGLITIESDTQSADNITGVVTALGNVRIVYPARGMVATSRQAQYYSKEGRLVLSGDVDVIQEGGNALRAERVVYSLDDERAVAEPAQGGQVFSQMVIRQDQGQPRPAVTPLLP

SEQ ID NO: 65792 - protein, 113 aa, Bacillus anthracis str. A2012
MPKPLYGVNGSGMHCNLSLFKNGENVFFDQNGDLQLSDDARHFIAGILKHAPAFTAVANPTVNSYKRLVPGYEAPCYVAWSAQNRSPLVRIPASRGISTRVEVRSVDPAASHI

SEQ ID NO: 65793 - protein, 428 aa, Roseovarius nubinhibens ISM
MAVGGDGCFLIDASGKRYFDGSGGAAVSCLGHSNERVVAAIKAQVERLAFAHTGFFTSEPAEALADLLIAHAPGDLDRVFFVSGGSEAVESAIKLARQYHLERGEGQRRHLIARKQSYHGNTLGALSAGGNAWRRAQFAPLLTEMSHIDACYEYAERREGESLETYGQRTADALETEILRLGPETVMAFIAEPVVGATLGAVPAAPGYFARIREICDKYGVLLILDEVMCGMGRTGHLFACEAEGIAPDILCIAKGLGAGYQPIGAMLCSKAIYDAIAGGSGFFQHGHTYLGHPVAAAAGLAVLQELLDRDLVAQVQARGAYFETALRARFAQHPHVGDIRGRGLFWGIEFVAERDGKTPFDPALGVAGKLKKAAFDEGLVCYPMAGTRDGRQGDHVLLAPPFIASEAELDGALDALGRAVDRVLASV

SEQ ID NO: 65794 - protein, 431 aa, Synechococcus sp. RS9917
MKRVLAIILGGGAGTRLYPLTKMRAKPAVPLAGKYRLIDIPISNCINSNITKMYVLTQFNSASLNRHLSQTYDLSAGFGQGFVEVLAAQQTPESPSWFEGTADAVRKYQWLFQEWDVDEYLILSGDQLYRMDYSLFVEHHRQSGADLTVAALPVDPQQAEAFGLMRTDAHGTIQEFREKPKGDSLKEMAVDTSRFGLSPESAEQKPYLASMGIYVFSRKALIDLLNDHPQHKDFGKEVIPEALAGGMTLKSYVFDDYWEDIGTIGAFYEANLALTQQPSPPFSFYDEDFPIYTRPRYLPPSKLVDAQITESIIGEGTILKSCSIHHCVLGVRSRVENDVVLQDSLLMGADFFESSTERSVLRERGGIPVGVGQGTTVKRAILDKNTRIGSNVTIVNKDHVEEADRPELGFYIRNGIVVVVKNASIPDGTVI

SEQ ID NO: 65795 - protein, 798 aa, Catharanthus roseus
DEMLKGISGGQKKRLTTGELLVGPSRVLLMDEISNGLDSSTTYQIIKYLRHSTHALDGTTVISLLQPAPETYELFDDILLLSEGHVVYQGPREAALDFFAFMGFQCPQRKNVADFLQEVASRKDQKQYWAVPDRPYRYIPVGKFAESFGSYRLGKNLTEEMNIPFDRRYNHPAALSTSQYGVKRRELLKTNFDWQLLIMKRNSFIYVFKFIQLLFVALITMSVFFRTGLHHDSIDDGGLYLGSLYFSMVIILFNGFTEVSMLVAKLPVLYKHRDLHFYPCWAYTLPSWLLSIPTSVIESGFWVAVTYYVIGYDPNIVRFFRQFLLFFFLHQMSLALFRLIGSLGRNMIVSNTFGSFALLIIMGLGGYVISRDRIPGWWIWGFWISPLMYAQNAASVNEFLGHSWDKSSGLNPEFPLGEAILRARSLFPQSFWIWGYWISPMMYAQNAIAVNEFLGTSWQKVPPGMSEPLGVLVLKSRGISTNARWYWIGVGALAGFMFLYNLLYALALSCLKPLHKSQAILSEEALAERRPSSKGELTELSSRGKNLPERRNDMQSVSSSLLSSQEGEQKRKRGMVLPFKPLSLNFEDLTYSVDMPQEMKARGFTEARLELLKGVSGSFRPGVLTALTGVSGAGKTTLMDVLAGRKTGGYIKGTITISGYPKKQKTFARVAGYCEQNDIHSPHVTVYESLQYSSWLRLPAEVDAATSKMFVEEVMHLVELMPLKDALVGLPGVNGLSTEQRKRLTIAVELVANPSIIFMDEPTSGLDARAAAIVMRTVRNTVNTGRTVVCTIHQPSID

SEQ ID NO: 65796 - protein, 147 aa, Desulfitobacterium hafniense Y51
MSVLSEILDNHILISAMIAWFIAQTLKLIINFSIHRTFDVAFLFSSGGFPSSHSATVSALAIGVGKYYGWSSPTFAIAAIFGMIVMYDAAGVRRAAGKQAEVINQLVEGLYQQMTHLSQERLKELIGHTPFEVFAGAIVGIIVGVLM

SEQ ID NO: 65797 - protein, 494 aa, Burkholderia xenovorans LB400
MADQVEVFSMYIDGEFVQAEGGRTLDSINPWSGSVWAKVPDATAADVNRAVEAAHRAFTSGPWPKMTPTERAVLLQKLADKLVEHKERLGYVETQDTGKLLKETTWQAGHTARAYTYFAGLADKLQGDIPPSGASMLNLVLHEPVGVVAAIIPWNSQLQLSAYKIAPALATGNTIVVKASEDASTPLLTLAKLVHEVGFPPGVINFVSGGANPCAITLTSHPLVRRIAFTGGADTARRLIPNSAHNIAKLSLELGGKSPVIVFDDADLDSCVNGIVAGIFGASGQSCAAGSRLLAHESIHDVLVERLVERCKTIRVGDPFDAATNMGPLATARQVDRIETLLASSVEQGARVVSGGKRIGGLPFNQCFEPTIALCDRSDYPIVQEELFGPVLSVLKFRDDDEAVALANDSKYAFAGGIFSRDFARAMRTARVVNAGRLWINTYRVTGVNVPFGGFKQSGYGREAGIDALKDYTETKAVMIEVGGEAVADPFVMR

SEQ ID NO: 65798 - protein, 1060 aa, Streptococcus agalactiae 2603V/R
MPKRTDIRKIMVIGSGPIVIGQAAEFDYSGTQACLSLKEEGYQVVLVNSNPATIMTDKDIADKVYIEPITLEFVTRILRKERPDALLPTLGGQTGLNMAMALSKNGILEELNVELLGTKLSAIDKAEDRDLFKQLMEELNQPIPESEIVNSVEEAIQFAEQIGYPLIVRPAFTLGGTGGGMCDNQEQLVDITTKGLKLSPVTQCLIERSIAGFKEIEYEVMRDAADNALVVCNMENFDPVGIHTGDSIVFAPAQTLSDVENQLLRDASLDIIRALKIEGGCNVQLALDPNSFKYYVIEVNPRVSRSSALASKATGYPIAKLAAKIAVGLTLDEVINPITKTTYAMFEPALDYVVAKMPRFPFDKFESGDRKLGTQMKATGEVMAIGRNIEESLLKACRSLEIGVDHIKIADLDNVSDDVLLEKIRKAEDDRLFYLAEALRRHYSIEKLASLTSIDSFFLDKLRVIVELEDLLSKNRLDINILKKVKNKGFSDKAIASLWQINEDQVRNMRKEAGILPVYKMVDTCASEFDSATPYFYSTYAVENESLISDKASILVLGSGPIRIGQGVEFDYATVHSVKAIRESGFEAIIMNSNPETVSTDFSISDKLYFEPLTFEDVMNVIDLEKPEGVILQFGGQTAINLAKDLNKAGVKILGTQLEDLDRAENRKQFEATLQALNIPQPPGFTATTEEEAVNAAQKIGYPVLVRPSYVLGGRAMKIVENEEDLRHYMTTAVKASPDHPVLIDAYLIGKECEVDAISDGQNILIPGIMEHIERSGVHSGDSMAVYPPQTLSETIIETIVDYTKRLAIGLNCIGMMNIQFVIKDQKVYVIEVNPRASRTLPFLSKVTHIPMAQVATKVILGDKLCNFTYGYDLYPASDMVHIKAPVFSFTKLAKVDSLLGPEMKSTGEVMGSDINLQKALYKAFEAAYLHMPDYGNIVFTVDDTDKEEALELAKVYQSIGYRIYATQGTAIYFDANGLETVLVGKLGENDRNHIPDLIKNGKIQAVINTVGQNNIDNHDALIIRRSAIEQGVPLFTSLDTAHAMFKVLESRAFTLKVLD

SEQ ID NO: 65799 - protein, 203 aa, Solanum tuberosum
MNPEYDYLFKLLLIGDSGVGKSCLLLRFADDTYLESYISTIGVDFKIRTVEQDGKTIKLRIWDTAGQERFRTITSSYYRGAHGIIVVYDVTDQESFNNVKQWLSEIDRYASDNVNKILVGNKADLTANRVVSYETAKAFADEIGIPFLETSAKDATNVEQAFMAMTGAIKNRMASQPASNSAKPPTVNIRGQPVTQSGGCCSS

SEQ ID NO: 65800 - protein, 731 aa, Glycine max
MRILKVATCNLNQWAMDFDCNAKQIKESIAKAKEAGAAIRLGPELEIPGYGCEDHFLELDTVNHSWECLKDLLIGNWTDGIVCSFGMPVIKASERYNCQVLCLNRKILIIRPKMCLANDGNYRELRWFTAWKQRDQLIDFQLPPQISKAIGQNSVPFGYGFVKFQDTAIADEICEELFTPTPPHSELALNGVEVFMNASGSHHQLRKLDVRLRAFIGATHTRGGVYIYSNHQGCDGSRLYYDGCASVVVNGDVVAQGSQFSLKDVEVVVAQIDLDVVASLRGSLSSFQEQASCKTKVPSVEVPYSLCLPFNLKTRLSLPLKIKYHTPEEEIAFGPGCWLWDYLRRSGASGFLLPLSGGADSSSVAAIVGCMCQLVVKEIANGDEQVKADAIRIGNYKDGLYPTDSREFAKRIFYTVFMGSENSSEMTRSRAKVLADEIGSWHLDVSIDVVVSAFLSLFQTLTGKRPRYKVDGGSNVENLSLQNIQARIRMVLAFMLASLLPWVHSKPGFYLVLGSSNVDEGLRGYLTKYDCSSADINPIGSISKQDLRAFLQWAAIHLGYSSLADIEAAPPTAELEPIRSNYSQLDEVDMGMTYEELSVYGRLRKIFRCGPVSMFQNLCYRWGARLTPSQVAEKVKHFFKYYSINRHKMTVLTPSYHAESYSPEDNRFDLRQFLYNARWPYQFRKIDELVSELDVKDVKDSGDHEAMAATSDGVGGMGVAAAGSGNPNVGL

SEQ ID NO: 65801 - protein, 965 aa, Arabidopsis thaliana
MALTLTPTSSVHLLSSISVARPRIFAADFNLRSRWRRRRPVTSISNFRLRLPSKTSLHCLCSSSSASSPMSLEVSSPNSQFLDCLIYSRAYWVTQGVIAWNVDVGEGSCYFYASKSAGLSFSEDGIDGYDLRIKLEAESGSLPADVIEKFPHIRNYKSFKVPKDLDIRDLVKSQLAVVCFDAEGRLIQGTGLQLPGVLDELFSYDGPLGAHFTPEGVSLHLWAPTAQAVSVCIYKNPLDKSPMEICPLKEANGVWSTEGACSWGGCYYVYKVSVYHPSTMKLETCYANDPYARGLSADGRKTFLVNLDSDDLKPEGWDNLADKKPCLRSFSDISIYELHVRDFSANDETVEPENRGGYLAFTSKDSAGVKHLQKLVDAGLTHLHLLPTFQFGDVDDEKENWKSVDTSLLEGLRPDSTEAQARITEIQNDDGYNWGYNPVLWGVPKGSYASDPTGPCRIIEFRKMVQALNCTGLNVVLDVVYNHLHASGPHDKESVLDKIVPGYYLRRNSDGFIENSTCVNNTASEHYMVDRLIRDDLLNWVVNYKVDGFRFDLMGHIMKATIVNAKSAIGSLRKETDGVDGSRIYLYGEGWNFGEVAENGRGINASQFNLGGTGIGSFNDRIRDATLGGSPFGHPLQQGFITGLLLQPNAHDHGSEATQELMLSTAKNHIQTGMAANLKDYMLTNHEGKEVKGSEVLMHDATPVAYASLPTETINYVSAHDNETLFDIISLKTPMEISVDERCRINHLASSMIALSQGIPFFHAGDEILRSKSLDRDSYNSGDWFNRLDFSYSSNNWGVGLPPKGKNEHNWPLIKPRLQDPSFKPKSSHIVATLHNFLDLLRIRYSSPLFRLDTARAIKERVRFHNTGPSSIPGAIVMSIEDGHRGIPSVSQIDPIYSLIVVIFNARPSEFSYPSPALKDRKLELHPVQVMSADEIVKKSVYDSFSGGFTVPARTTTVFVESRNG

SEQ ID NO: 65802 - protein, 724 aa, Solanum tuberosum
MASAAIFSSLRRQRSPTLEAFLAPVDLTDVGLLQTLTALSSELISAYSGKKLPFYQRKNCKSLLRKIQVFSVLLECLLENNLNRSRGSSDLPFTAFLCFKELYLLLYRSKILLDYCSHSSKLWLLLPNHSISGHFHDLNQEISTLLDVFPLKDLKSLPEDVREQVELLKKQARKSPLFVDKHDEMLRLKLFSFLNEFENGGVPDYAQLYSFFVEKLGISNPRSCRVEIEFLEEQIVNHEGDIEPTTSVLNGFVALMRYCRFLLFGFEEDDMGLRLGKHKKPKRGLISQEIADTFISVPKDFCCPISLDLMRDPVIVATGQTYDRASISRWMEEGHCTCPKTGQLLDHTRLVPNRALRNLIMHWCAARKIPYDPLESGDPCIECFPSASPSRAALEANKATAALLIKQLENGTQIAKTIAAREIRLLAKTGKENRAYIAEAGAIPHLKNLLSSPDAVAQENSVTAMLNLSIFDKNKGRIIDEVGCLALIVGVLRFGHTTEARENAAATLFSLSAVHDYKRQIAKEDGAVEALAGLLREGSPRGKKDAVTALFNLSTHTDNCARMIECGAVTALVGALGSEGVAEEAAGALALIVRQQVGATAVGNEETAVAGLIAMMRCGTPRGKENAVAALLELRRGGGAAATERVLKAPSLASLLQTLLFTGTKRARRKAASLARVFQRCEHASVHYSGFGVGYAFSGNSAAARDSTFPGDVSVSRSISVPVL

SEQ ID NO: 65803 - protein, 383 aa, Bacillus licheniformis ATCC 14580
MNTNKNILILTANYGNGHVQVAKTLYQECERLGFKNVTVSNLYQESNPIVSEITQYLYLKSFSIGKQFYRLFYYGVDKIYNKRKFNIYFKMGNKRLDQLVKKHQPDIIINTFPMIVVPEYRRRMGKVIPTFNVMTDFCLHKIWVHEHIDKYYVATDYVKEKLLEIGTHPSNVKITGIPIRRQFEEEMDKDKIYEKYQLSPDKKILLIMAGAHGVLKNVKELCESLVTKEDVQVVVVCGKNTMLKSSLEDIEALYPNKLRTLGYIERIDELFRVADCMITKPGGITLTEATAIGVPVILYKPVPGQEKENALFFEDRGAAIVVNRHEEILESVSSLLADEKKLNEMKKNIKSLHLSNSSEVILTDIIEQSEIIMNKKQTVRALS

SEQ ID NO: 65804 - protein, 172 aa, Lactobacillus plantarum WCFS1
MALDLKKYVASIPDYPEPGIIFRDISPLMADGEAYREATDQIVQFARDKHVDMIVGPEARGFIVGCPVAYELGVGFAPARKKGKLPRETVKATYDLEYGQSALYLHKDAIKPGQNVLVTDDLLATGGTISATIQMVEELGGNVVGTAFLVELKELHGRDKIKDYDMLSLMQF

SEQ ID NO: 65805 - protein, 467 aa, Kluyveromyces lactis NRRL Y-1140
MLPYGTRAAVRSVGRFGTRSVPMGLTYRFVSQTNATKSTMAPATAIHDMAASQHTVPAPDAHLRTLSKSELFSLGMIGVCTINKPMLDLVIKLFPYVPLFMVKLFISPLYCGGDTPAEVVETGKRLQNRGINNMMLSLTIEDAEGTKNVDINYIVSETIKSVHTILKPLLVEQLESGKDINSIPPGYIALKPSALVANPAQVLLNFNNPEWKTQRDELVNNCSKITQEVYNLNQELLAKYPERKSPFFVSTIDAEKYDLQKAGVYELQRILFSKFNPASSPLISCVGTWQLYLVDSAADLAKDYERAKKEGYKLGLKLVRGAYIHSEPNRSVVYATKEGTDANYNKVMTTAIKDLLVNGEKSYYGHLVVASHNYDSQMLATKLLADQKNSVGKANVTLAQLLGMSDNVTHDLITNHKVENIIKYVPWGPPLETKDYLLRRLQENGDAVRADNGIPLIKAVLKTALHL

SEQ ID NO: 65806 - protein, 263 aa, Lactobacillus plantarum WCFS1
MTNLVGKTVLVTGASSGLGEQLALAVASQGANVVLAARRRERLTQVADQCRLLSKGQAVAITCDVGHVADVDHVFTTIDELFGQLDVVINAAGFGDMTTVITMDAPVMAKMLRVNTLGTMYVSQLAAQRMVKQHAGEIVNIASMAGKIATPKSAVYAASKAAIIAYDNALRLELKDAHVNVLTVNPGPIKTDFFKIADPTGHYLDRVDQLALNPVKFAELIVSKLGHQRRELNRPWVMSAANLGYQLAPKLGDWLTGTVFNFK

SEQ ID NO: 65807 - protein, 229 aa, Oryza sativa (indica cultivar-group)
MPCIPASSPGIPHQHQHQHHRALAGVGMAVGCAAEAAVAAAGVAGTRCGAHDGEVPMEVARHHEHAEPGSGRCCSAVVQHVAAPAPAVWSVVRRFDQPQAYKRFVRSCALLAGDGGVGTLREVRVVSGLPAASSRERLEILDDESHVLSFRVVGGEHRLKNYLSVTTVHPSPSAPTAATVVVESYVVDVPPGNTPEDTRVFVDTIVKCNLQSLAKTAEKLAAGARAAGS

SEQ ID NO: 65808 - protein, 221 aa, Yersinia aldovae
MNSHSTDKRKKITRIGIGGPVGSGKTAIIEVITPILIKRGIKPLIITNDIVTTEDAKQVKRTLKGILDEEKILGVETGACPHTAVREDPSMNIAAVEEMEERFPESDLVMIESGGDNLTLTFSPALADFYIYVIDVAEGEKIPRKNGPGLVQADILVINKIDLAPYVGASLDVMESDTKVVRGERPYILTNCKTGQGIEELVDMIMRDFLFTHVQPQGANA

SEQ ID NO: 65809 - protein, 588 aa, Thiobacillus denitrificans ATCC 25259
MCGIAGELRFDDRAPDAATMTRMLARLARRGPDAEGQHAAGPLRLGHRRLAIIDLSPRSAQPMVDAATGTALVFNGTIYNYPELRAELIALGHAFHSDGDTEVILRAYLEWGERCVERLHGMFAFAIWHRDELFLARDRLGIKPLYYSENAGSLRFASTPQALLAAGEVDTGLDAVALHHLFTLHAVVPAPRTILNGVRKLAPGTTLTVNLRGELRHRSYWSLHAQRPAETRSEAEWTDAIHDALRRAVQKRIEIADVKVGVLLSGGLDSSLLVALLAELGVSDLMTFSVGFEDHPEERGNEFEYSDPVAAMYGTRHHKYLIPNSEVLRRLPEAVGEMSEPMFAQDAVAFYLLAEQVSRTVKVVQSGQGADEVFGGYFWYPRMAAEAEGSALDRFRRHYFDRDHAEFLELADPRYHGPDYTGELIAARLAEPFADEFIDQVLRTDTTMLITDDPVKRVDNMTMAWGLEARVPFLDHTLVELAATMPPAMKLASEGKHVLKRIARGRVPDAVIDRKKGYFPMPALKYVRGEFLDFMRDILDSQACRQRGLYRRAYVEHLLDAPEQHHTRIQGSKLWHLALLEYWLQTHV

SEQ ID NO: 65810 - protein, 207 aa, Pseudomonas putida KT2440
MQSYQQPLRVGVGGPVGSGKTALLEALCKAMRDHYQIAVVTNDIYTKEDQRILTEAGALEPERIVGVETGGCPHTAIREDASMNLAAVEALARKFGNLEVIFVESGGDNLSATFSPELADLTIYVIDVAEGEKIPRKGGPGITKSDFLVINKTDLAPYVGASLEVMERDTQRMRPQRPWTFSNLKKGEGLQAVIDFIVERGMLGVRG

SEQ ID NO: 65811 - protein, 464 aa, Xanthobacter autotrophicus Py2
MSPSPVWPALPVATGGSSGRRVQYAALPYRVRRDGEVQIRLITSRETRRWVIPKGWPMKGLSPPKAAAREAYEEAGLVGVISREPLGMYTYEKRLGTRSVLCDVLVFPLKVKRLLEKWPERFQRYGFWFSIDSAAAAVQEEDLSELIRSFGEIMARKWEAERLEAEQKTKAKAAKDKPASAERGDEVPTGERESAVNPAKAKGTKAKPDKARSQKTAQVGADVATGPAVEPQAASKAKPDKIKADKSKPDKVKAEKANPTKGVKAKSEKAAKAKARAGGGATVAAAPAGHDAGMASEPISTAKKAAKGKGGKAARKGAQASLPATPDEPPPVVVKAGRDAATVAVAKARGRPIRKAAVPKKAETVTKPGWMPEKQAPSAKKVTASKKASAVKKGATVRKAAPAKAAAAKSAAKASAAKASAAKAPAGEAAKGGAAKGGSRSLPKGASAGKRKAKAPPPSEKPGS

SEQ ID NO: 65812 - protein, 568 aa, Xylella fastidiosa Ann-1
MSSSSIEDIKGQSHRLRGSLLESLANPTTGALGESDQTLIKYHGSYQQDDRDLREERRRQKLEPAYQFMIRTRTPGGVITPQQWLQLDAIATRYANHSLRVTTRQAFQFHGVIKRELKTTMQAINAALIDTLAACGDVNRNVQVAANPLISRAHADLYTDAAHLSEHLLPNTRAYYEIWLDEKKVAGAGEEEEPIYGPHYLPRKFKIGFAAPPINDVDVFANDLGFIAVIVDNTLLGYNVTIGGGMGTTHGDPDTWPRIGNIIGFITRADLIIISTAIVTTQRDFGNRTLRKRARFKYTIDDRGLDCIVGEIQQRAGIILQPARPFVFEHNGDRYGWIEGEDGHWHLTLSLPAGRIADTESSPLLSGFRAIAQLGIGQFRMTPNQNVVIAGISPGQRAAIDALVTQYGLDTGNRAPTALARHAMACVALPTCGLAMAEAERYLPDFNAKLQPILEKYGLAETPILLRISGCPNGCSRPYLAEIALVGKAPGRYNLMLGGDQRGQRLNTLYRENITETEILTALEPLLGRYQQERIPSEGFGDFLHRTGIIALPPYPTHRHVISSTLQA

SEQ ID NO: 65813 - protein, 421 aa, Thermoanaerobacter tengcongensis MB4
METREIASQRRKNLYLGIELKKFLKYLGPAFIVSVAYVDPGNFATNISGGSLFDYHLIWVILWSNVIAIFLQIQSAKLGIATGYNLPEMCSIIFPRKWNWFLWITAELAAMATDLAEFLGGTMGLYLLFHIPMTYAAFLTGVVTFAIVYMEKYGQKVVEGIIFGLVAVISLAYAFELFIARPDWSKVLYHTFIPSIPNKDAMLIAVGILGATVMPHVIYLHSQLVQYRNKDGSLQAKKEHLKMEKIDILVAMNTAFIINAAMLIVSAAVFYKNGIVIESIEEAHKTLEPLLGVFSSWAFGIALLASGFSSSAVGTMAGQTIMKGFVGLNIPLNVRRLVTMVPAITIIALGIDPLKSLIVSQVVLSFELPMAIIPLLLITSNKKFMKEFADTPLERIMGVLVASFVMILNGLLLYLTLKGEV

SEQ ID NO: 65814 - protein, 278 aa, Zea mays
MFRRKHASHSNSTDAEQQEAKINELKSALGPLSAHGEKYCSDTCLRRYLEARNWNVTKSRKMLEESLKWRATYKPEDIRWPDVSVEAETGKMYKANFRDREGRTVIIMRPTKENAILDQREGQEKMVWLIDFTGWTMAHATPIKTARECTSILQNHYPERLAIAFLLNPPKVFEAFYRAVKYFLDPRSIEKLNFVYLKDEESMKVLYKCIDPVVLPVEFGGKNSVVYNHEDYSKLMLQEDIETSSFWEDDAKTVNHAINGTLVPDVASQLSRIAAKAS

SEQ ID NO: 65815 - protein, 394 aa, Thermoanaerobacter tengcongensis MB4
MDLKKEALKLHRENKGKIEVVSKVPVKNEEDLSLAYTPYVAEPCKEIEKDKDLVYEYTVKGHMVAVVTDGSAVLGLGNIGPYAALPVMEGKAVLFKEFGGIDAIPICLATQDVDEIIRTVLNIAPTFGGINLEDISAPRCFEIEKRLDEMLDIPVFHDDQHGTAIVTFAALVNALKIVKKSLYEIVAVVNGAGAAGVAISKFLVNAGVKDVIVCDRSGIIYEGRKDLDSSKQKIAKITNKKKIKGTLKEALEGADVFIGVSGPNLLTKEMVKKMAKKPIVFALANPVPEIHPEEAKEAGAYVVGTGRSDFPNQVNNVLAFPGVFKGALRVRATTINERMKLAAAYAIANTISEEELSSEYILPKPFDKRVAENVAYAVAKEAINTGVSRITKFD

SEQ ID NO: 65816 - protein, 303 aa, Rhizobium leguminosarum bv. viciae 3841
MSAQPPVPTEKGILQFLAICDAFYPPDAVQASIEQQRDWYDALCARFDRPLPPEMIFADGMLQRMPIRRYRPRKISTRTILLYLHGGGFVVGSLESHHAICAEIADFAGAELVSVDYRLAPEYRWPAQTDDGFTVLKHLLSANSKVVLIGDSAGGNLAAGLALRARDEGLSGVVGQVLIYPTLSGNLDAGSYAEMAAAPGLTTADVAYYREMLQAPAGNEIAEPLQASSLAGLPPAFITVAHFDPLRDDGRHYAARLAAEGVEVWFREEPQMVHAWLRARNMSEGARDGFRAVCEAIRRFAAS

SEQ ID NO: 65817 - protein, 367 aa, Clostridium acetobutylicum ATCC 824
MKELEEIRKEIDEVDKIITELFEKRMNLVMEVAEYKEKNSIPVSDSKREKKVIDKNIGYLKNKEYSEVLKEFYINFMNLSKKLERKRIYNEEKTSVNTSIYGLIGEKLGHSHSSYIHKLIFEKVGIKGIYNLFEVPKEKLKESVDTFKIIKCGGLNVTIPYKVEVMKELYEISEKARKIGAVNTLKFSREGISGFNTDYIGFGKMLSKFRVEIKNNICVVLGSGGAARAVLQYLKDNFAKDIYVVTRNPEKTSEIYGEFKVISYDELSNLKGDVIINCTPKGMYPKEGESPVDKEVVAKFSSAVDLIYNPVETLFLKYARESGVKAVNGLYMLVSQAAASEEIWNDISIDEIIVDEIFEVLEEKIKS

SEQ ID NO: 65818 - protein, 556 aa, Streptococcus agalactiae 2603V/R
MKTDIEIAQSVALKPIAEIVEQVGIGFDDIELYGKYKAKLSFDKIEAVKSQKVGKLILVTAINPTPAGEGKSTMSIGLADALNKIGKKTMIALREPSLGPVMGIKGGAAGGGYAQVLPMEDINLHFTGDMHAITTANNALSALLDNHIHQGNELDIDQRRVIWKRVVDLNDRALRQVIVGLGSPVNGIPREDGFDITVASEIMAILCLATDLSDLKKRLSNIVVAYSRNRKPIYVKDLKIEGALTLILKDTIKPNLVQTIYGTPALVHGGPFANIAHGCNSVLATSTALRLADYVVTEAGFGADLGAEKFLDIKTPNLPTSPDAIVIVATLRALKMHGGVSKEDLSQENVEAVKRGFTNLERHVNNMRQYGVPVVVAINQFTADTESEIATLKTLCSNIDVAVELASVWEDGADGGLELAQTVANVIETQSSNYKRLYNDEDTIEEKIKKIVTKIYGGNKVHFGPKAQIQLKEFSDNGWDKMPICMAKTQYSFSDNPNLLGAPTDFDITVREFVPKTGAGFIVALTGDVLTMPGLPKKPAALNMDVLEDGTAIGLF

SEQ ID NO: 65819 - protein, 343 aa, Rhizobium leguminosarum bv. viciae 3841
MKAIVIHAAKDLRIEEREPEVAGAGQVEIAIEAGGICGSDLHYYNHGGFGTVRLREPMILGHEIAGTVKALGSGVADLAVGDRVAVSPSRPCNHCQYCLKGQQNHCLNMRFYGSAMPMPHIQGGFRQRLVAERWQCHKVTDGISIHEAAFAEPFAVTLHAANRAGSLLGKRVLVTGCGPIGMLAIVAARVLGAREIVATDVTDSVLAIARTSGADRTINVATHAADLAAYSADKGYFDVMFEASGNERAVRAGLETLKPRAILVQLGLGGDVSIPQNMIVAKEIEMRGTFRFHEEFALAVELINARRVDLKPLLTGVFGIEEAVAAFELAGDRSKSMKVQIAF

SEQ ID NO: 65820 - protein, 532 aa, Physcomitrella patens
MDRTLVLTCTTTCSHSAFRQSALPSNTSISVRLGTCSVRTQKRRTVVASLGNIETTSTSTVGQESNLPLREIPGSYGIPYLSQLLDRWTFFYREGEPQFWQSRMAKYGSTVIRSNMPPGWFWTDSRCIMLLDQKSYPTVFDYDKVDKYKAFAGTIMPSTEYNGGYEVCAYLDASDKKHEQLKGYCFELLKFSSSKWAREFHTAISETFNQWEGKLAQKTPALINPTLPESLFSFVINALTTARFDDSSIPDAEKPVCGDLQKWAGFQLMPVIRTGAPIYIEEMLHVAPIPASLTKGGYDKMVVFLQKYAAETLSIAEKFGLSQDEAVHNLIFFLILNAHGGFCRFLPVILREVAKNGQLQADLREEVRAAVKASGSDQVTMKAVMNDMPLVASTVFEALRFDPPVPFQYARAKKDFIIESHDARYQIKTGDFLGGVNYMVSRDPKVFTDRPNEFNARRFMGPEGDKLLAHLVWSNGRQTDETTVYTKQCAGKEIVPLTGRLLLAELFMRFDSFNIEGLEMEATFTSLTPRSD

SEQ ID NO: 65821 - protein, 296 aa, Kluyveromyces lactis NRRL Y-1140
MSSKHPCIKDGWFNEVSDKSFPGQAFSLKVNKILFHEKTQFQDILIFESSNYGNVLVLDGIIQVSEKDEFAYQELISHVPLYSHENPKKILVIGGGDGGVLREVVKHSCVEEATLVEIDAKVIELSKKYLPNMACSFKHPKVNVKLCDGFQFLRDVAESGTKYDVIITDSSDPEGPAEAFFQKEYFELLYKALTENGVVIAQASENVWLNLEYLKTLLNTSRSVFPVAEYCYTMLPTYTSGQLGLIACCKNPNTNLIDPCRAPTEDEQSQMRYYNNKMHSAAFVLPTWARKVLNPL

SEQ ID NO: 65822 - protein, 221 aa, Yersinia bercovieri
MNSHSTDKRKKITRIGIGGPVGSGKTAIIEVITPILIKRGVKPLIITNDIVTTEDAKQVKRTLKGILDEEKILGVETGACPHTAVREDPSMNIAAVEEMEERFPDSDLIMIESGGDNLTLTFSPALADFYIYVIDVAEGEKIPRKNGPGLVQADILVINKIDLAPYVGASLDVMESDTKVVRGERPYILTNCKTGQGIEELVDMIIRDFLFTHVQPEGANA

SEQ ID NO: 65823 - protein, 412 aa, Glycine max
MELFATTMVAMAAATASTQLIFSKPCSPSRLCPFQLCVFDTKQVLSSGRRRHVGGSGVRCMAVGEAATTGTKKRSGYELQTLTSWLLKQEQAGVIDAELTIVLSSISMACKQIASLVQRANISNLTGVQGAVNVQGEDQKKLDVVSNEVFSNCLRSSGRTGIIASEEEDVPVAVEESYSGNYIVVFDPLDGSSNIDAAASTGSNFWIYSPNDECLADIDDDPTLDTTEQRCIVNVCQPGSNLLAAGYCMYSSSIIFVLTLGNGVFVFTLDPMYGEFVLTQENLQIPRAGKIYAFNEGNYQLWDEKLKKYIDDLKDPGQSGKPYSARYIGSLVGDFHRTLLYGGIYGYPRDKKSKNGKLRLLYECAPINFIVEQAGGKGTDGLQVLRLQGTEIHQRVPLYIGEEVEKVEKYLA

SEQ ID NO: 65824 - protein, 320 aa, Bradyrhizobium sp. BTAi1
MPVQLDADAAAVYKAFQEAGRPAYETLTPQEARDYYLAARVVSNPEPPELADVKELSIPAPHGAIPARLYRPKTIRHNGGLAPALVFFHGGGWVIGNLDSHDVVCRALAHEGELIVVSIDYRLAPEHKFPAAVDDAVAATRWVADQAASLGIDDTRLSVGGDSAGGNLAAVVALSARDGQGPKLSGQVLIYPATDFSMNHPSHSEPETSVLLTHSVIRWFRDHYLNSAADIHDWRASPAKAETLAGLPPAYVLTAGADPLRDEGDDYARRLREAGVPVTHRTHPGQFHGFFTMGKLLDQANVAARDIGAWLKQLDRPSGI

SEQ ID NO: 65825 - protein, 438 aa, Bacillus licheniformis ATCC 14580
MKLTAGKTVSLSIQHVLAMYAGAVVVPLIVGGALGLTPAQLTYLVSADILMCGVATLLQVWKNRFFGIGLPVVLGCTFTAVSPMISIASTYGIPAIYGSIIAGGVIVVIISFFFGKLVKFFPPVVTGSVVTVIGITLIPVAMNNMAGGEGSSDFGELSNLALAFSVLLVIVLLYRFTSGFIKSISILIGLIAGTAGAALMGKVDFTEVANAGWVQMIHPFYFGAPVFEVTPILTMSLVLIVSLVESTGVYFALGDLTDRRLTEKDLGKGYRAEGIAVLLGGVFNAFPYTAYSQNVGLVQLTGVKKNSVIALAGAFLILLGLFPKAAALTTIIPKPVLGGAMVAMFGMVIAYGIKMLSRVDFGKQENLLIVACSIGIGLGVTVVPQMFQNLPDAVKLLTENGIVAGSFTAILLNAIFHIHPFSRHAEQPEAVSAEKSAV

SEQ ID NO: 65826 - protein, 296 aa, Oryza sativa (indica cultivar-group)
MPLPSPPPPPPLSPLLLLLLLLLRSPFLPAQLPLILHAHACGEAMASAKVSNLSHLSKLARRNDTASRVDEADKLRTVFLAMEDARAVLIKLADRLHNMRTLDSLPKVKQQCFAKETLEIFAPLANQLGILNWKEQLENLCFKYLYPELYEELSSNLLKFYNQDMIAAAIRRLEQALQVRGLCYHTISGRNKSMYSIYSKMARKKLDMDEIYDIHGMSVQEFPQNSTVLDLLKRTSSYDMQLRLRLNCHVVHNLNQELKMGDVVELIPSAQCNPGAGGYAREFHQMYDHRLTVSQS

SEQ ID NO: 65827 - protein, 449 aa, Bacillus anthracis str. A2012
MISIGGVIGAGLFVGSGAVVHSAGPGSIVSYALAGLLVVFVMRMLGEMAAINPTSGSFATYAREAIGPWAGYTIGWLYWFFWVIVIAIEATAGAGIIQYWIPEIPLWLLSLILTILLTLTNVFSVKSFGEFEYWFSFIKVISIVLFLCLGLAVILGFVPGTEAPGTSNLVGQGGFMPNGISSVLLGITVVIFSFMGSEIVAVAAGESAEPVKAVKTATNSVIWRILVFFIGSIAVVVTLLPWNSANILKSPFVAVLEHIGIPAAAQIMNFIVLTAVLSCLNSGLYTNSRMLFSMAERGDAPKAFLKLNSSGVPVRAVLFGTFFAYIGVVFSYISPDKVFLFLVNASGGIALLVYLVIAISHLKIRKKMGRVEQQNLKVKMWFFPYVTYVTIAAIIAVLIAMLAIESLRSQALLTMLVTVLIIISYFIFNRNKNSTVLNTKSKNEESVRF

SEQ ID NO: 65828 - protein, 521 aa, Arcanobacterium pyogenes
MSELRPVLVIDNGAQNAQLIARRVRDAGYYSELVPHSWSAQQVLDKQPRAIILSGGPSSVYAEGAPQLDPALLEAGVPVLGICYGFQQMTHALGGAVGRTDLKEYGTTPAQMVADGVVTGPAGRSATVWMSHGDSVTRAPEGFTVTATTPGAQVAAFENAERKLFGLQWHPEAKHCEHGQEQIEAFLRDGAGLEPNWDSSSVIEEQVRKIREQVGDKHAICGLSGGVDSSVAAALVHKAIGDQLTCVFVDHGLLRKGEAEQVVRDYAASLGIRVVAVDESERFLSALDGVTDPETKRKIIGREFIRSFEAAQRALVAEAGAAGKEIKFLVQGTLYPDVVESGGGDGTANIKSHHNVGGLPDDLDFELVEPLRDLFKDEVRAIGLELGLDEKLVWRQPFPGPGLGIRVVGAVNRERLDILREADAIAREELSAAGLDREIWQCPVVLLADVRSVGVQGDGRTYGHPIVLRPVSSEDAMSADWTRIPYDVLSKISSRITNEVDEINRVVLDVTSKPPGTIEWE

SEQ ID NO: 65829 - protein, 192 aa, Zea mays
THGPRPNGPDSVRRLRAGHPEARVAHEAGAKLVVDNTFTPVVVSPARLGADVVVHSVSKFISGGADIIAGAICGPASLVNAMMDLQEGALMLLGPTMNAKVAFELSERLPHLPLRMQEHSRRALAFAERMQGLGLRVLYPGLPGHPHHARLAAMGNPGYGCGGMLCLDMGTEERANRLMHHLQNTTQFGLMA

SEQ ID NO: 65830 - protein, 436 aa, Glycine max
MSPAAGVSVPLLGDSKGTPPPASVPGAVFNVATSIVGAGIMSIPAIMKVLGVVPAFAMILVVAVLAELSVDFLMRFTHSGETTTYAGVMREAFGSGGALAAQVCVIITNVGGLILYLIIIGDVLSGKQNGGEVHLGILQQWFGIHWWNSREFALLFTLVFVMLPLVLYKRVESLKYSSAVSTLLAVAFVGICCGLAITALVQGKTQTPRLFPRLDYQTSFFDLFTAVPVVVTAFTFHFNVHPIGFELAKASQMTTAVRLALLLCAVIYLAIGLFGYMLFGDSTQSDILINFDQNAGSAVGSLLNSLVRVSYALHIMLVFPLLNFSLRTNIDEVLFPKKPMLATDNKRFMILTLVLLVFSYLAAIAIPDIWYFFQFLGSSSAVCLAFIFPGSIVLRDVKGISTRRDKIIALIMIILAVVTSVLAISTNIYNAFSSKS

SEQ ID NO: 65831 - protein, 254 aa, Rhizobium leguminosarum bv. viciae 3841
MKNLFDLTGRRALITGSSQGIGYALAEGLAQHGAEVIINGRTPESVKRAVESLKDQGLSAHAAIFDVTSKDAAKEGIDAIETDIGPLDILINNAGMQFRTPLEDFPADKWELLLTTNISSVFYVGQAAAKPMIARGQGKIINIASVQSELARPGIAPYTATKGAVRNLTRGMCADWAKYGLQINAIAPGYFKTPLNQALVDNPEFSSWLEKRTPAGRWGNVEELVGAAVFLSGRGSSFINGHTLYVDGGITTSL

SEQ ID NO: 65832 - protein, 185 aa, Rhizobium leguminosarum bv. viciae 3841
MDFEKKAPPLAVVVMGVSGCGKSSVGEHLAARNGLPFLEGDQLHPAGNVEKMAKGIPLADDDRLPWLDRIGEEIRTAQEASQGLVISCSALKRSYRDRLRQAADGHLAFVFLEGSRDLLLSRMQARQGHFMPATLLDSQLQTLEPPTGEAGVVTVAIDNALDDIVALACKGLSGMAVKGGDYHAG

SEQ ID NO: 65833 - protein, 553 aa, Oryza sativa (japonica cultivar-group)
MAARRAASSLLSRGLIARPSAASSTGDSAILGAGSARGFLPGSLHRFSAAPAAAATAAATEEPIQPPVDVKYTKLLINGNFVDAASGKTFATVDPRTGDVIARVAEGDAEDVNRAVAAARRAFDEGPWPRMTAYERCRVLLRFADLIEQHADEIAALETWDGGKTLEQTTGTEVPMVARYMRYYGGWADKIHGLVVPADGPHHVQVLHEPIGVAGQIIPWNFPLLMFAWKVGPALACGNAVVLKTAEQTPLSALFVASLLHEAGLPDGVLNVVSGFGPTAGAALSSHMGVDKLAFTGSTGTGKIVLELAARSNLKPVTLELGGKSPFIVMDDADVDQAVELAHRALFFNQGQCCCAGSRTFVHERVYDEFVEKARARALQRVVGDPFRTGVEQGPQIDGEQFKKILQYVKSGVDSGATLVAGGDRAGSRGFYIQPTVFADVEDEMKIAQEEIFGPVQSILKFSTVEEVVRRANATPYGLAAGVFTQRLDAANTLARALRVGTVWVNTYDVFDAAVPFGGYKMSGVGREKGVYSLRNYLQTKAVVTPIKDAAWL

SEQ ID NO: 65834 - protein, 421 aa, Roseovarius nubinhibens ISM
MIIPFHVREMLRRIKARYDVDRTPQQMSPKGEGFLPLRPSRTADSKTVARFWEHLKPKASEADQAEIADPATVAASETYSANIENFIGTVKVPVGLVGPLRLNGMNANGDFYVPLATTEAALVASYARGAFAAGRAGGVSTAVLYEGVLRTPAFVFQSLLQAGQFVDWVVGNVEALQAVAEATTRHGKLVSLEPFIDTNIVFLICRYTTGDAAGQNMVTIATDALCRAIAKDCPVPIESWYIEGNFSGDKKASALAMVTGRGRKVSASITLPAGVVEKTLGTSVEAMLAYGRVANLGAHLSGQLGAQAHYANGLAAFYIATGQDAACVAESAVGVTRMEPRGEDLFCSVTLPNILVGSVGGGTGLPSQSAALNILGLKGAGHGTALAEVAAALCLCGEISIVAAIAAGHFTRAHESLARHR

SEQ ID NO: 65835 - protein, 475 aa, Bordetella parapertussis 12822
MSKQFDVVIIGAGPGGYIAAIRAAQLGMSVACIDAWQNGQGGPAPGGTCTNVGCIPSKALLQSSEHYEQANHHFAEHGIEVKGVSLKLDTLIGRKNTVVKQNNDGILYLFKKNKVTYFHGKGAFAGQVDGGWSIKVTGTTDADLVAKHVIVATGSSARELPGLPFDEKNILSNDGALNIGAVPKKLGVIGAGVIGLEMGSVWRRLGAEVTILEAMPEFLAAADQQVAKEALKSFAKQGLDIQTGVKIGEIKAAAKSITVPYVDAKGAEQKLVVDKLIVSIGRVPYTGGLNAEAVGLKLDERGFVAVDEDCKTNLPNVWAVGDVVRGPMLAHKAEEEGVAVAERIAGQHGHVNFATVPWVIYTSPEIAWVGKTEQQLKAEGREYKAGSFPFMANGRARALGDTTGFAKVIADAKTDEVLGVHIIGPMASELISEAVTIMEFRGAAEDIARICHAHPTLSEAVKEAALAVDKRTLNF

SEQ ID NO: 65836 - protein, 405 aa, Bordetella parapertussis 12822
MAITDVLVPQLSESVSEATLLTWKKQAGAAVEADEILIEIETDKVVLEVPAPSSGVLSEIVMGDGSTVTSGEVIARIDTAAKAAAAPAAAAEAPAAAAAAPAAAAPAAASSAASGVASPAAAKILAEKGVDAASVAGTGRDGRVTKGDALAAGNAPAAKAAAPVAPPTLSLDGRPEQRVPMSRLRARIAERLLQSQAENAILTTFNEVNMQAVMDLRARYKDKFEKEHGVKLGFMSFFVKAAVAALKKYPVLNASVDGKDIIYHGYFDIGIAVGTPRGLVVPILRNADQLTIAEIEKTIADFGKRAADGKLGIEEMTGGTFSISNGGVFGSMLSTPIINPPQAAILGIHATKERPVVENGQIVIRPINYLAMSYDHRIIDGREAVLGLVAMKEALEDPQRLLLDL

SEQ ID NO: 65837 - protein, 253 aa, marine gamma proteobacterium HTCC2207
MSRLLNKVAIITGAASNPGLGHATAMRFAQEGAKLVLTDIDMVGLAAAEKEMVALGAEVLTMEQNVVDEQRWQEVIDATVERFGGLDILVNNAGIAVMRPISEYSTADYDLQMDVNIRSVFLGCKKALPAMIASGGGSIVNMSSVAALRGIPGVSVYGIAKAGVQIFSKSIALEHAADGIRCNSLHPGLIDTNIQNDSRRDNPDEFEKLGDTVPFGRMGYPVEVANCVLFLASDESSYVTGAELVVDGGLISK

SEQ ID NO: 65838 - protein, 475 aa, Oryza sativa (japonica cultivar-group)
MFDASSMMNDLKRSPKNWMALISDWRDESFCLILEDLILSVLHGIKGTLGGGEGHRISLSTHPPRFTKPECTEPSRREISSYPSTTISSIRARVVAVAALDRLPIRAAAARGGAAAPAPENREPVWTVASAGASVDGINYEKVIKYSSPNSAGAECIDPDCSWVEQWVHRAGPRKEIYYEPEEVKAAIVTCGGLCPGLNDVIRQIVFTLETYGVKNIVGIPFGYRGFFEKGLKEMPLSRHLVENINLAGGSFLGVSRGGAKTSEIVDSIQARRIDMLFVLGGNGTHAGANAIHEECRKRKLKVSVVAVPKTIDNDILLMDKTFGFDTAVEEAQRAINSAYIEVPFTLDGEYGVLRHLEHLLKTKGFCVVCVAEAAGQIKMHFKDIGVPADVKYIDPTYMVRACRANASDAILCTVLGQNAVHGAFAGFSGITSCICNTHYVYLPITEVITVPKRVNPNSRMWHRCLTSTGQPDFH

SEQ ID NO: 65839 - protein, 925 aa, Bordetella parapertussis 12822
MNRHFGAFSMTHASTKALAWMQIGDNAMCNAQAGATPPRIPDPDPVETAEWREALDSLTQAGGPERAAYVLQQLLARATALGVRAPGITRTAYLNTIAADQDPPFPGNLSLEERIASINRWNALAMVVRANQAHGELGGHIASYASAADLFEVGFNHFFRAPAPGFGGDLVYMQPHSAPGIYARAYLEGFLSDVDLAHFRQEITAGAQGLRGLSSYPHPWLMPDFWQFPTGSMGIGPINAIYQARFMRYLEHRSLAMPSDRKVWGIFGDGEMDEPESIAALTLAARERLDNLVFVINCNLQRLDGPVRGNGRIIDELETLYAGAGWNVIKLVWGGDWDALLRRDPDGVLAGTFSHTVDGQFQTFAANDGAYNRQHFFGQDPRLSALVADWSDEAIDRLRRGGHDMVKIHAAYHRATHHRGQPTVILAQTKKGFGMGTAGQGKMTTHQQKKLDDEALLAFRDRFALPISDADCLALKFYKPAEDSAELRYLESRRAALGGYLPRRRTEAPRLAPPPVADWARFALQASGKEMSSTMAIVRMLTALLKDPQLGPRIVPIVADEARTFGMANLFRQVGIYSAQGQLYEPEDIGSVLAYREARDGQILEEGITEAGAISSWTAAGTSYSVNGLPMLPFYIYYSMFGFQRIGDLIWAAADQRTRGFLIGATSGRTTLGGEGLQHQDGYSHLAAAAVPNCRAYDPAYAYEVAVLVEHGMQRMLDEQCDEFYYLTVTNENLAQPDMPEGEETRTGILRGMHRVRAADGTPQVRLLGAGPMLDEAMRAAQLLRDEHGVDAEVWSVTSFSELARGGRGAERAQALGLPCPDGNWLAQCLGDQATPVVAVSDYVRAVPEQIRAWVPGPYRVLGTDDFGRSDTRARLRDFFEVGAPWIVLHALDLLAREDSAWQPALQARREQLQVATRNVPSWQS

SEQ ID NO: 65840 - protein, 768 aa, Bordetella parapertussis 12822
MRRKGCAPMDENLTKLALDYHAYPTPGKISVTPTKTLANQDDLSLAYSPGVAAACMAIFDQGNDAASKYTSRSNLVGVITNGTAVLGLGNIGPLAAKPVMEGKGCLFKKFAGIDVFDIELAENDPDKLVDIIAALEPTLGGVNLEDIKAPECFYIEKKLRERMNIPVFHDDQHGTAIISSAAILNGLKVVGKDIGQVKLACSGAGAAAIACLDLLVHLGIKREHIYVVDSRGVIWEGRDENMEPNKRRYAQKTEARTLADVVNGADVFLGCSTAGVLTPEMVKTMAAQPLILALANPEPEIRPELAKAARPDCIVATGRSDYPNQVNNVLCFPFIFRGALDAGATRITEEMKLACVKAIAELAQAEQNDEVARAYAGQELSFGPDYIIPKPFDPRLIVQIAPAVAQAAADSGVATRPIEDIEAYRQKLMGFVYHSGQLMRPLFQQAKQAPKRVVYADGEDERVLRAVQTVIDEKLAEPILVGRPSVIEMRIKKFGLRMVPGQNVEIVDPEDDSRFNDTWNGYYQLRGREGVTPAIAKAMIRKHNTLIGAMLLRRGDADALLCGVTSKYDNQLKYVEEVIGRKPGQTYGALNVLMLPNQTLFVTDTHVNENPSADEIANITIQAAEEMLRFGVMPKIALLSHSNFGSRPTDSSRKMAHARKLVAERAPHLEVDGEMHADAALSESIRLQAYPDSTLKGRANLLVMPNLDTGNITYNMLKMTGSNGIAMGPILLGSARPVHILTTSATVRRIVNMTALAVVDAQQEAAEG

SEQ ID NO: 65841 - protein, 338 aa, marine gamma proteobacterium HTCC2207
MTAPVINKKWTLKSRPETTVSAEHFNFENETIRDLVAGEFLVKNHYLSFEPAQRGWLNDVRSYVPPVAIGEVMRSMAVGEVIASNHSDYQIGDRVQGGFGWQEYAISDGTGLFPVSKIPEGMPIAYPLHIYGLTGLTAYFGLLDIGKPKAGDTVVISGAAGATGSTVGQIAKLMGCRVIGIAGGPAKCQWLIDELGYDAVIDYKSESVDARMKELCKNSINIYFDNVGGEILDSALVNLANHARVVLCGGISSGYQTKALPPGPKNYMQLVIRRSHMEGFIVLDHVERYPAAIEQLSQWVDEGKILVKEHILEGIEECPAGLAGLFAGHNFGKQLVKI

SEQ ID NO: 65842 - protein, 221 aa, Yersinia frederiksenii
MNSHSTDKRKKITRIGIGGPVGSGKTAIIEVITPILIKRGIKPLIITNDIVTTEDAKQVKRTLKGILDEEKILGVETGACPHTAVREDPSMNIAAVEEMEERFPESDLIMIESGGDNLTLTFSPALADFYIYVIDVAEGEKIPRKNGPGLVQADILVINKIDLAPYVGASLDVMESDTKVVRGERPYILTNCKTGQGIEELVDMIMRDFLFTHVQPQGEHA

SEQ ID NO: 65843 - protein, 197 aa, Lactobacillus plantarum WCFS1
MEVHNVELVMSAVAPSQYPTTGFPEIGLAGRSNVGKSSLINVLINRNSYARTSSQPGKTQTLNFYKVEDQLYFVDVPGYGYAKVSKKEREKWGQMIETYLTSRETLRGVVILVDARHAPTKDDVAMYEWMRYYEMPLLVVATKSDKIPRGKWNKQESLIKKTLNFQAEDDFIAFSAKTKEGKDAVWQWIEAHTVGGN

SEQ ID NO: 65844 - protein, 376 aa, Glycine max
  misc_feature (252)..(252): Xaa can be any naturally occurring amino acid
  misc_feature (334)..(334): Xaa can be any naturally occurring amino acid
MTTAEDRFVFLVEWYDAAASLVRTYNLTYYPKDKTIEMFDLKNKKLFLKRCEYPGVSLNDLYLGSIVTVYSRQLKIVDYADTFTRKNFETTRERTFGMIKPDCYQHIGKIIDIIEHSGFVIGNIKMARMTLNDAEEFYAEHKGKPFYPELTNFICSDFVVGMELVAEGAIAKWRKLIGPTNCQVARVEAPGSLRALFGTEGVRNACHGSDAPTSAQRELDFFFGDKCKLKPTAFLNNCTCCVIKPHIVSEAXCGKVIDHILSEGFEVSALQMFFIDKATSEEFLEIYKGVLPEFSGIANHLTTGPCIALEVRQENAVESFREICGPHDPEVARXLRKNSIRAIYGFDRIKNAVHCTDLSEDGPLEVEYFFTILNHK

SEQ ID NO: 65845 - protein, 358 aa, Desulfovibrio desulfuricans G20
MVDILNLTFEELETFLVEKLGEKKFRARQIWQWLWNKYVRDFDQMTNVSKQTRAQLKEHARIFWPEVVTTSKSQDGTTKFLLRLADGALVETVLIPGSQGRITQCLSCQVGCAMGCTFCATGTLGFERNMTMSEILGQVLVAREYLNDVAERPILRNLVFMGMGEPLLNLDEIMRSLHTLNSELGLQFSPRRITVSTCGVNPEGLRRLGESGLAYLAVSLHAPTQELRRTIMPKAARWELNDFIEALQSYPLKTRERITFEYLLLGGVNDSLEHAKQLVRLVSRTKAKLNLIVYNPSGDEADPYAAPTEERILAFEQYLWSKHVTAIIRKSKGADIKAACGQLKAAETGGTPCCAQND

SEQ ID NO: 65846 - protein, 359 aa, Synechococcus sp. RS9917
MRQHRVVLLPGDGIGPEITAVARMLLEAVAARHGFALQFDEQLIGGAAIDATGVPLPEASLEACRGADAVLLAAIGNPRFDALPREQRPESGLLALRSGLGLFANLRPVKIVPALSAASSLKAEVIEGVDLLVVRELTGGIYFGQPKGRVTADGEERGFNTMTYSASEVDRIARVAFELAKERRGQLCSVDKANVLDVSQLWRDRVEAMAATYPEVSVSHLYVDNAAMQLVRDPRQFDVLLTGNLFGDILSDEAAMLTGSIGMLPSASLGSAGPGLFEPVHGSAPDIAGQDKANPMAMVLSAAMMLRIGLKETEAADALEAAVNRVLAAGYRTGDLMAEGCTPLGCRAMGEQLLVHCNG

SEQ ID NO: 65847 - protein, 530 aa, Oryza sativa (indica cultivar-group)
MSVMPSIRRLLLAGAAVAVVVVSCAVVCAEASVHEYAGERFAGVGNGFVLHGGSEGVYASATAESFVRFEKVAFRRTPEAASVAEEDGNRTVTVAAVIFEAGDRDAVGAVSDVVGGERALCCTPGMARRGGCTEGAVVYRAPASSNATGRWPKVLAASFLPGSLVAAFPDETVAVARTGMYSLHFVHCDASLAAGQVVAAEGKTIWKNSRGYLPGRMAPLKPFYGAMSLAFAALAALWFARYARFWREVSPLQNFATAAIALGMVEVTTWYLDLAEFDASGVRPAGTTFWAATSGAVRAAACRVLALLVAMGYGVTRPALGCGNARVAALGAAFLAAAEVLDVGDNVGIVSDHSPARRLFFILPVAALNTVFIYWIFTSLSRTISKLKARRMTAKLEMYRKFANSLTIAVALSLGWITFEIHFKTTDEHNERWRVAWVIPAVWELISFFLLCTICILWTPSKNSMRFAYSREECEDDTEHDDVEDTRPLIRAGPLSYVDNWACYVTQDAKIILRTDSGVYAKAGEEYKRV

SEQ ID NO: 65848 - protein, 178 aa, Glycine max
  misc_feature (53)..(53): Xaa can be any naturally occurring amino acid
  misc_feature (101)..(101): Xaa can be any naturally occurring amino acid
  misc_feature (125)..(125): Xaa can be any naturally occurring amino acid
MASSTISSPTVTTVNRAGAGMDAPFTGLKAMAGFLTTKTNNDITSIASTGGRXHCMQVWPPPGNKNIETLSYLPHLDDAQLAKEGQHLLKKGWIPCLELQXEHSCRYREHNRSPRYYDGRYCTMXNLPMFGCTDAYHALNELRDADTAYPNGFIRIIRCNIVEQVQCINFIAYKPPDF

SEQ ID NO: 65849 - protein, 249 aa, Roseovarius nubinhibens ISM
MDKVTTKVDAAAEKRGWTRHIPLALIFGVAVLGAFTLRDYLSFDTLRDNREALLAFRDDHFLLLAGGFVALYIVIVAFSLPGAAVASVTGGFLFGLVLGTLFNVVAASIGACAIFWAARLGLGQALTAKMAASEGTVAKLRKGLEENEISVLFLLRLVPAVPFFVANLLPALVGVKFRNFALTTVLGIIPGALVFTWIGVGLGEVFDRGESPDLSLLWEPQILAPLLGLSALAALPIVIKALRGRKAGE

SEQ ID NO: 65850 - protein, 549 aa, Salmonella typhimurium LT2
MKNINPTQTSAWQALQKHYDEMKDVTIAELFANDSDRFAKFSATFDDLMLVDFSKNRITEETLAKLQDLAKETDLAGAIKSMFSGEKINRTEDRAVLHVALRNRSNTPIIVDGKDVMPEVNAVLEKMKTFSQAIISGQWKGYTGKAITDVVNIGIGGSDLGPFMVTEALRPYKNHLTMHFVSNVDGTHIAEVLKKVNPETTLFLVASKTFTTQETMTNAHSARDWFLKTAGDEKHVAKHFAALSTNAKAVGEFGIDTANMFEFWDWVGGRYSLWSAIGLSIILSVGFDNFVELLSGAHAMDKHFSTTPAEKNLPILLALIGIWYNNFFGAETEAILPYDQYMHRFAAYFQQGNMESNGKYVDRNGNAVDYQTGPIIWGEPGTNGQHAFYQLIHQGTKMVPCDFIAPAITHNPLSDHHQKLLSNFFAQTEALAFGKSREVVEQEYRDQGKDPAQLEHVVPFKVFEGNRPTNSILLREITPFSLGALIALYEHKIFTQGVILNIFTFDQWGVELGKQLANRILPELGDDKAISSHDSSTNGLINRYKAWRA

SEQ ID NO: 65851 - protein, 436 aa, Bordetella parapertussis 12822
MNLSDKKATLSFSDGSAPIEFPVYKGTVGPDVIDIRKLYGQTGMFTFDPGFMSTAACASGITYIDGDKGELLYRGYPIEQLAVNCDFLDICYLILNGELPNGGQKQDFDSQVTHHTMVNEQLHFFLRGFRRDAHPMAVLTGLVGALSAFYHDSTDITNPHHRHVSAIRLIAKMPTLVAMAYKYSQGQPFIYPQNDLSYTGNFLRMMFATPCEEYKVNDVVERALDRIFILHADHEQNASTSTVRLCGSSGTNPFAAIAAGVACLWGPAHGGANEACLQMLEELQANGGVAKVGEFMEKVKDKNSGVRLMGFGHRVYKNYDPRAKLMQETCKEVLVALGLENDPLFKLAMELERIALEDDYFVQRKLYPNVDFYSGIVQRAIGIPTSLFTAIFALARTVGWIAQWNEMLSDPDYKIGRPRQLFTGSVTRDVPGMDKR

SEQ ID NO: 65852 - protein, 150 aa, Aegilops umbellulata
MEFQGQHDNPANRVDEYGNPFPLAGGVGGAHAAPGTGGQFQAHRGEHKTGGILHRSGSSSSSSSSEDDGMGGRRKKGMKEKIKEKLPGGHKDNQQHTATGTGTGGAYGPGTGTGGAYGQQGHAGMAGAGTGTGEKKGIMDKIKEKLPGQH

SEQ ID NO: 65853 - protein, 78 aa, Aegilops umbellulata
DVYGNPVAGHGAGTGMGAHGGVGTGAAAGGHFQPTREEHKAGEILQRSGSSSSSSSEDDGMGGRRKKGIKEKIKEKLP

SEQ ID NO: 65854 - protein, 391 aa, Candida glabrata CBS 138
MFESGLRRWTVGLFLLGVVIVLWVLSSFLINYIFEDGTYRKPFFITYINTASFIFYLIPTFKNIVYNYKVTGKPYIHEELLIEEEANETVTNYTADNEQCRRANSIDEASNPLLEAQNIVRDAQLDRLSLPETIRLSAEFCVLWFAANFVTNASLGYTSVASQTILSSTSSFFTLFIGAAFRVETIDRVKVIGSLISFIGILLVTKSDVHIPQNTHMPHTHALDEKKRDKTFEIFFGNMLALSGALFYGLYSTLLKRKVKDESRINMKIFFGFVGLFTLILLWPTLLLLDKFNWETFVIPRDPLVITIILVNCLITFVSDFCWASAMLLTSPLTVTLGLSITIPLAMFGDFLFRHKTVPFLYFCGAILILGSFFVINKNSEKNERNEEAIA

SEQ ID NO: 65855 - protein, 139 aa, Aegilops umbellulata
MEYQGQQQHGQATNRVDEYGNPVAGQGVGTGAAAGGHFQPTMQEHKAGGILQRSGSSSSSSSSEDDGMGGRRKKGIKDKIKEKLPGSHGDQQQTAGTYGQQGHTGTAGTGGNYGQPGHTGMAGTDEKKGIMDKIKEKLP

SEQ ID NO: 65856 - protein, 400 aa, Bordetella parapertussis 12822
MSTSQKKPTVQQKKPAAQPAEKAAFKPKKSVALSGVVAGNTALCTVGRTGNDLHYRGYDILDFAGSAEFEEIAHLLVHGKLPNKAELKAYKEKLRALRGLPAQLQNVLECLPASSHPMDVMRTAVSVLGCVLPEKDDHNTPGARDIADRLMANLGSALLYWYHYSHNGRVIDVQTDDDSIGGHFLHLLHGAKPSDEWVRAMHTSLILYAEHEFNASTFTGRVIAGTGSDMYSSITGAIGALRGPKHGGANEVAFEVQKRYETPDEAEADTRQRVENKEVIIGFGHPVYTVSDPRNKVIKDVAKKLSRKAGSTKMFDIAERLETVMWDIKKMFPNLDWFSAVSYHMMGVPTAMFTPLFVIARTAGWSAHIIEQRIDNKIIRPTANYVGPEDQTYVPISKRA

SEQ ID NO: 65857 - protein, 290 aa, Lactobacillus plantarum WCFS1
MNFANVDLMTAMVTPFDDHQQLDEKRLASLIEHLLAHGTQGILVGGTTGEAPTLTEDEKLTLLKKAAEIVDGRVPIVAGTGSNSTAATIAFTKKVSQIKGIDAALVVVPYYNKPDQAGMIAHFTAVADQGGLPVIIYNIPGRVIVKMTVATILTLAQNPNIIGIKQCATMEEFGAIVENAPADFLVYTGEDSQSLAAKEIGGAGVISVASHIYGDEMTAMFSAIDQGEIATAAKYQRDLTPKMSALFSAPSPSPVKAALNHLGQPVGEPRLPILPLSTEQTAQLFKTLNI

SEQ ID NO: 65858 - protein, 261 aa, Triticum aestivum
HASGQDKTKWGTEIQGKGSLQPWSHAYTWEEDFAASDDDDDDVGEYQQIEERKPEKKKKEDKPKKIKEDDKKKKKPARTCVQIEEIPEDNTAGCDAIRKAFAMGNGKGKAKELSPQDAALLIQMNYRAHLAHRSQVLRCLRDLAVAKAKLKELRSLFYNLSYRRRLSHDHEERQRFSEKIIVLLLTVDALEGPDFMVRTAKKSMLEELESMLEIVDPQPPGKQRSFSRRKFDLPEGGATPNEKTAGVNNAVRVINTGKGKQ

SEQ ID NO: 65859 - protein, 605 aa, Ustilago maydis 521
MSTQESAAKRTKVDGQEHIITHSGTFHADEALAVNLLRKLPRFASARLTRTRDAATIESGSIVVDVGATYDAANHRYDHHQRGFEEVFDADHSTKLSSAGLVWKHFGQEIIATHLQLDAAAQKEVVDLLWLKLYDDFVEAIDGIDNGISQYPSDLKPKYKSRTDLSARVGYLNPSWNDKSDNAELDARFEKASAMAGNEFFERLDYTFNAWLPARQVVVDALNKRSHPQLLVFDQYASWKDHLFELEKNLNIAPTERPIYVVYPDESGKWRVQAVPVSAESFVSRKALPEPWRGIRDQQLSELTGIPGCIFVHQSGFIGGNATQEGALRMAKDALAHTGVAFIHSAPVGGETDGHSHSHSHNHDHGHTHDIMDHPGKFNDRELPNYENRNWDERAFTVGIGGPVGSGKTALLLSLCRKLRDRYNLAVVTNDIFTREDQEFLRKHSALSPESKIRAIETGGCPHAAIREDISANLEALEQLQAEFETQLLFVESGGDNLAAAYSVELADFHVYVIDVAGGDKVPRKGGPSITQSDVLVINKIDLAEQVGADLAVMKRDADRVRDGGPTAFTSVKLDQGVDAVVDLILSARRIAGADKAGKPVTAQQ

SEQ ID NO: 65860 - protein, 206 aa, Ureaplasma urealyticum serovar 2
MKRPLIIGVGGPVGAGKTMLIERLTRYLSTKGYSMAAITNDIYTKEDARILLNTSVLPADRIAGVETGGCPHTAIREDASMNFAAIDEMCDKHPDLQLLFLESGGDNLSATFSPDLVDFSIYIIDVAQGEKIPRKGGQGMIKSDLFIINKVDLAPYVGANVEVMKADTLKSRGNKDFFVTNLKTDEGLKSVADWVEKRLQLALLEE

SEQ ID NO: 65861 - protein, 142 aa, Xanthomonas campestris pv. vesicatoria str. 85-10
MQTVRQLLGTKQVEVFAVAADAAVIEAIRLMAEKAIGAVLVMEGTRLVGIVSERDYARKVVLRDRASSTTSVAEIMSAEVVTVSPSDTVERCMQLMTDGRFRHLPVVENGRVQGVISIGDLVKAVIEAQRQDIDQLQRYIAS

SEQ ID NO: 65862 - protein, 432 aa, Heliobacillus mobilis
MKFLIYRLVEGTVMKAGKPRIVVLGAGYAGILTTRRLQNLLSSDEAEIVLVNKHNYHYLTTWLHEVAAGTGDDDRITIQIKDVIDTDRVHLIKDTVLEVQKEEHRVILSHGEALIYDYLVVALGFEPATFGIPGIMKHALTIRSMNSARKIRHKIEALFADFADSNDEQEKLTFIVGGAGFTGIEFAAELAERIPVLCEQYAVDPRRVQVLNVEAAPGILAGFDPDLADYSKQSLERLGVEFRLSTRIKSVDPQGVTLLTEAGEERIESATVIWTGGVQGNSVVCGSAFEAQRGRIPAGEDLRIPGYDNVFVLGDCSAFLDKGTGRPYPPTAQLAILQSDVCAQNIVTLLRGGQELKTFVPFMKGAVASLGAHDAVGKVFGIKVRGTMAMIMKAIIDIRYMLMLGSPKLIFGKGKLSTYVMPTTYTQASGSK

SEQ ID NO: 65863 - protein, 456 aa, Coprinopsis cinerea okayama7#130
MVRFSLLPRFSLVLATASLVFARPIAFRPHDEDSTPQTELELLSEGNKAFRESVDPELLEKLAHEGQAPPFMFLGCSDSRVSEGTIFDAQPGTLFAHRNVANQFLSTDPNVESALAYATSALNVHHIIVMGHYGCGGVASAIMSRPKGPNIDAAQSAIHNWIEPLRELYASSDRPEIVDLRERLKNHTRIPEPPLHERMSYPPLPSFPAPTPLTLIFIVFFLPAGFRALVEENVKSTVRRIADSTIVRNHYARLNKSTSNSNLDSDLDVTSEKTGSPDTSNPYIHAIKPRPKPRPHVLFIHGWVYDIETGKIVDLDVSIGPPGKKIPRVPSLDSVLKSTSTSASSTTTTTTTTMTMTMISPEDDDEDEQVAANRDDAMIPESDRTATTHDDDEKNPHQRPLASPRQAIIPHRPPSISSVSRFLQQLPAIPSLSQSPLPALTQVLRLIQFDLKRLSM

SEQ ID NO: 65864 - protein, 135 aa, Triticum aestivum
MDVLSSAKRALPWGRTSAGGVIGGLRALLGTDGGGGRSLLPSRWKSSQPQLDPVDRSDEEGGGDIDWDNLGFGLTPTDYMYVMRCTQEEGGFSRGELARYGNIELSPSSGVLNYGQGLFEGLKAHRRADGPGYTL

SEQ ID NO: 65865 - protein, 149 aa, Triticum turgidum subsp. durum
MEFQGQHDNPANRVDEYGNPFPLGGVGGAHAAPGTGGQLQARRGEHKTGGILHRSGSSSSSSSSEDDGMGGRRKKGMKEKIKEKLPGGHKDNQQHMATGTGTGGAYGPGTGTGGAYGQQGHAGMAGAGTGTGEKKGIMDKIKEKLPGQH

SEQ ID NO: 65866 - protein, 424 aa, Streptococcus agalactiae 2603V/R
MKFNVQSNSQAALLGLQHLLAMYAGSILVPIMIASALGYNAKQLTYLIATDIFMCGIATLLQLRLSKHFGVGLPVVLGCAFQSVAPLSIIGAQQGSGYMFGALIASGIYVVLVAGIFSKVANFFPPIVTGSVITTIGLTLIPVAMGNMGDNAKEPSLQSLTLSLVTIGVVLLINIFAKGFLKSISILIGLISGTILAAFMGLVDASVVADAPLVHIPKPFYFGAPRFEFTSILMMCIIATVSMVESTGVYLALSDITNDKLDSKRLRNGYRSEGLAVLLGGLFNTFPYTGFSQNVGLVQISGIRTRKPIYFTALFLVILGLLPKFGAMAQMIPSPVLGGAMLVLFGMVALQGMKMLNQVDFEHNEHNFIIAAVSIAAGVGFNGTNLFISLPNTLQMFLTNGIVISTLTAVVLNIILNGLPKKLI

SEQ ID NO: 65867 - protein, 133 aa, Triticum turgidum subsp. durum
DVYGNPFLLAGGVGGAHAAPGTGGQFQAHRGEHKTGGILHRSGSSSSSSSSEDDGMGGRRKKGMKEKIKEKLPGGHKDNQQHMATGTGTGGAYGPGTGTGGAYGQQGHTGMAGAGTGTGEKKGIMDKIKEKLP

SEQ ID NO: 65868 - protein, 190 aa, Candida glabrata CBS 138
MSIESYAKDLKAALHQYPNFPSEGILFEDFLPIFREPQLFQKLVDAFKMHLEETFTEKKVDYIVGLESRGFLFGPSLALAMGIGFVPVRKAGKLPGECVKAVYEKEYGSDEFEMQKHAIPAGANVVIVDDIIATGGSAGAAEELIKKIGANVLEYDFVMELDFLKGRDKLNAPVFTLLSSQKEALQKPSA

SEQ ID NO: 65869 - protein, 149 aa, Triticum turgidum subsp. durum
MEYQGQQQHGQATNRVDEYGNPVAGHGVGTGAAAGGHFQPSREEHKAGGILQRSGSSSSSGSSEDDGMGGRRKKGIKDKIKEKLPGGHGDQQQTTDNAYGQQGHTAGMAGTGGTYGQPGHTGMAGTGTHGTDGTGEKKGIMDKIKEKLP

SEQ ID NO: 65870 - protein, 178 aa, Hordeum vulgare subsp. vulgare
MVGSSMQRGDPLVVGRVIGDVVDPFVRRVALRVGYASRDVANGCELRPSAIADQPRVEVGGPDMRTFYTLVMVDPDAPSPSDPSLREYLHWLVTDIPATTGVSFGTEVVCYEGPRPVLGIHRLVFLLFQQLGRQTVYAPGWRQNFSTRDFAELYNLGLPVAAVYFNCQRETGTGGRRM

SEQ ID NO: 65871 - protein, 334 aa, Staphylococcus aureus subsp. aureus MRSA252
MMQNKQILFNKIPEGMPQEDTFKIEDIDTPKLESDGVLVQTLYISVDPYMRGRMTKADSYVQPFEIGKPIVSHVVAKVIDSTLADYKKGDVVVGMLPWRIINHVQADQITKVPTTDVPLDLYLSVLGMPGQTAYHGLLDIGQPKDGDTVVVSAASGAVGSVVGQIAKIKGCRVVGIAGGDKKVNYLTETLGFDAGIDYKKEDFAESLAQAVPDGIDVYFENVGGTVGDEVFKHLNRFARVPVCGAISSYNHPEADIGPRIQGTLIKKQVMMRGFLVSEFANAFKEASEQLATWVQEGKIQSQVTIEDGFENAPRAFKNLFTGDNFGKQVIKVTE

SEQ ID NO: 65872 - protein, 376 aa, Triticum aestivum
MALRRLARRLAPVPFPPRLLPLPTPGHLRLFSIGEKEPPHFMAEYLVSTCGLSPAAAAKAAPRFAHLGSPERPDAVLAFLCSQGLGKAQVRAIVARKPALLLSDVDATLSPKFTAVRALGLRRADAARLFALFPAALTYGVRSNLLPRVLFWLDLLGSTTLLMKWLAKTWLLKYSVDLLLRNLAALRRLGIPDGRLTAAVRLRPTLIMQSPDKLRALVGRVEEACGGVPPSPGMYSWCLFALHNVGDRAFRAKKAAVTRALGCTDEEFAGMFRRAPCFVFAPEALLRRKVEFLQATVGCSAGCIVRNPLLLTLSLDERMAPRCRAIEALRSKGVDIGKTKMVSVVRLPEAIFVERYILKYKGDVPELLELYPQARV

SEQ ID NO: 65873 - protein, 495 aa, Rhodospirillum rubrum ATCC 11170
MPEGTTRIAALDIVREAGLLKDKAYIDGAWVGADDGGDFPVLDPATGREIGRVPNMGAAETRRAIDAAAAAWPAWRARTAKDRAAVLRRWYGLIMDNQEALAVLMTAEQGKPLGEARGEIAYGASFVEWFAEEGKRLYGEVVPAHGTDKRILTLREPIGVVAAITPWNFPSAMITRKVAPALAAGCPVVLKPAEDTPLSALALVELAERAGLPKGLINVVTTHEAKAVGGEMTANPIVRKLSFTGSTEVGKILMAQCAGTVKKVSLELGGNAPFIVFDDADLEAAVAGAIASKYRNAGQTCVCANRLYVQEGIYEAFTEKLKAKVEAMRVGPALEGDVQQGPLINKKGLDKVDGLVRDALDKGATAVLGGKVHALGGTFYEPTILTGVTAAMRMATEEIFGPVAPLYRFSTEAEAIALANATRFGLAAYFYTRDIGRVWRVAEGLEYGIVGINEGIISTESAPFGGVKESGIGREGSRHGIDDFVEIKYLCMGGI

SEQ ID NO: 65874 - protein, 98 aa, Halobacterium sp. NRC-1
MVGSVLEVFYDRGYIDGFEFVDNGKAGRFEVELKGAINECGPVNPRYSVGADGFEQWEKRYLPARDYGSLVVTTSHGIMSHYEAREAGIGGQVIAYVY

SEQ ID NO: 65875 - protein, 262 aa, Agrobacterium tumefaciens
MPPKRTLNRDSLSARHWPGDAQPPHSGRRNVGITVSVSAGIVGGLVNNRRVFPQIPADHLRQHPTILAKNSFVKGQPEHGAELADDLERLVALHGAETIAACIVEPVAGSTGVLVPPKGYLERLRAICDKHGILLIFDEVITGFGRMGSSFASNYFGVTPDIVTTAKGLTNGAIPMGASHSRKFHDALMHGPESQIELFHGYTYSGHPVPCAAGIATLDIYRDEGLFTRASELQDAWHDAIHSLKGSPNVIDIRNQSVSSPA

SEQ ID NO: 65876 - protein, 470 aa, Staphylococcus aureus subsp. aureus MRSA252
MTKTLPEDFIFGGATAAYQAEGATNTDGKGRVAWDTYLEENYWYTAEPASDFYNRYPVDLELSEKFGVNGIRISIAWSRIFPNGYGEVNPKGVEYYHKLFAECHKRHVEPFVTLHHFDTPEVLHKDGDFLNRKTIDYFVDYAEYCFKEFPEVKYWTTFNEIGPIGDGQYLVGKFPPGIKYDFEKVFQSHHNMMVAHARAVKLFKDGGYQGEIGVVHALPTKYPFDPSNPEDVRAAELEDIIHNKFILDATYLGEYSRETMEGVQHILSVNGGKLNITDEDYAILDAAKDLNDFLGINYYMSDWMRGYDGESEITHNATGDKGGSKYQLKGVGQREFDVDVPRTDWDWMIYPQGLYDQIMRVVKDYPNYHKIYITENGLGYKDEFIESEKTVHDDARIDYVRQHLNVIADAIKDGANVKGYFIWSLMDVFSWSNGYEKRYGLFYVDFETQERYPKKSAYWYKELAETKEIK

SEQ ID NO: 65877 - protein, 402 aa, Oryza sativa (indica cultivar-group)
MAAAVVARCGGAKKRKGEGLGEMHDDVLERVLARLPPASYFRLRGVCRRWSDAASSPTFLAACGRVPARDPWFLMLSEGEGQERRLPAVAFDAGEGEWARCGGAPGHVMPVVAASGGRVLYRAPDTGELTVANPLTGASRVLPAPPPGAALHAVAMYGSSPYRVVLITGDLPDLSMTVFDSSKNAWDDAVALSRKPDASSPERDAEGGVGGGGGETVYFLSKSGDVMATNMQRSASRQYSSAVTCGDGGEAVAYFLSNSGAVVACDLSRRAFAELPRILPVYFEYSIDVVACGGRAYVVVLSELLGTASLRLWEFAGGAWRQVAAMPPAMSHAFHGKKADVNCVGHGDRVMVCVSSGEANGCFMCDVPTNRWEELPPCAGAGGEPMDFVAAFSFEPRMEVTV

SEQ ID NO: 65878 - protein, 237 aa, Bacillus cereus ATCC 10987
MKKYALVTGGSGGIGSAISKQLIQDGYTVYVHYNNSEEKVNELQKEWDEVIPVQANLASTDGAEQLWKQIEHPLDVIVYAAGKSIFGLVTDVTNDELNDMVELQVKSIYKLLSMALPSMIQRRSGNIVLVSSIWGQIGASCEVLYSMVKGAQNSYVKALAKEVSLSGIRVNAVAPGAIETEMLNVFSEEDKNEIAEEIPLGRLGLPEEVAKTVSFLVSPGASYITGQIIGVNGGWHC

SEQ ID NO: 65879 - protein, 799 aa, Oryza sativa (japonica cultivar-group)
MMEADMENGRLYPERPRTFSTVRTKSSLPPIFRVLMRINPRAFIVLLLLVFSGVLYVGASTSPIVLFVFCICTLSLFFSLYLTKWVLAKDEGPPEMSEISDAIRDGAEGFFRTQYGTISKMACILALVILGIYLFRSTTPQQEASGVGRTTSAYITVASFLLGALCSGIAGFVGMWVSVRANVRVSSAARRSAREALQIAVRAGGFSAIVVVGMAVFGVAILYATFYVWLEVDSPGSMKVTDLPLLLVGYGFGASFVALFAQLGGGIYTKAADVGADLVGKVEQGIPEDDPRNPAVIADLVGDNVGDCAARGADLFESIAAEIISAMILGGTMAQRCKIEDPSGFILFPLVVHSFDLVISSVGILSIRGTRDSGLISPIEDPMAIMQKGYSITILLAVVTFGVSTRWLLYTEQAPSAWLNFALCGLVGIITAYAFVWISKYYTDYKHEPVRLLALSSSTGHGTNIIAGVSLGLESTALPVLVISVAIISAFWLGHTSGLVDESGNPTGGLFGTAVATMGMLSTAAYVLTMDMFGPIADNAGGIVEMSQQPESVREITDILDAVGNTTKATTKGFAIGSAALASFLLFSAYMDEVAAFAQLPFKEVDIAIPEVFVGGLLGSMLIFLFSAWACSAVGRTAQEVVNEVRRQFIERPGIMDYNEKPDYGRCVAIVASASLREMIRPGALAIISPMAVGIIFRMLGHATGRPLLGAKVVAAMLMFATVSGILMALFLNTAGGAWDNAKKYIETGALGGKGSESHKAAVTGDTVGDPFKDTAGPSIHVLIKMLATITLVMAPIFL

SEQ ID NO: 65880 - protein, 195 aa, Brassica napus
MKTIFDLPENLVEDEIFSRLQISSVRSTCRKWNTLCNRIFLGEEAAAKKQFLMMNSSRINLMNFDLSKDDGDPSIEQVSVLDQIQISKVFQCDGLLLCVLEDSSRPLLVWNPYLGQTRWIEPRSSSFHSSYRFSLGYDNNLNHKILRISNEIHPVTSEHVSGFELYDFSSGSWKVLDVTPHWEIWSHLRGVSLKG

SEQ ID NO: 65881 - protein, 317 aa, Yersinia pseudotuberculosis IP 32953
MTDKLTSLRQITTVVADTGDIAAMKLYQPQDATTNPSIILNAAQIPEYRKLIDEAIAWAREQSSDHAQQIIDATDKLAVNIGLEILKLIPGRISTEVDARLSYDTVASVTKAKRLIKLYNEAGISNDRILIKLASTWQGIRAAEQLEKEGINCNLTLLFSFAQARACAEAGVFLISPFVGRILDWYKANGDQKEFAPSEDPGVVSVTEIYQYYKKHGYKTVVMGASFRNLGEIIELAGCDRLTIAPSLLKELAESEGPVERKLAYTGEIQAKPAPLTEAEFYWQHNQDPMAVDKLADGIRKFAIDQGKLEKMISDLL

SEQ ID NO: 65882 - protein, 593 aa, Pseudomonas syringae pv. phaseolicola 1448A
MTADNALYIPPYKADDQDVVVELNTHFGAEAFTAQPTRTGMPVLWVERARLFEILTFLRNVPKPYSMLYDLHGVDERLRTNRRGLPGADFTVFYHLLSIERNSDVMIKVALSESDLSVPTITSIWPNANWYEREVWDMFGIDFPGHPHLSRIMMPPTWEGHPLRKDFPARATELDPYSLTLAKQQLEEEAARFRPEDWGMKRSGANEDYMFLNLGPNHPSAHGAFRIILQLDGEEIVDCVPDIGYHHRGAEKMAERQSWHSFIPYTDRIDYLGGVMNNLPYVLSVEKLAGIKVPEKVDVIRIMMAEFFRITSHLLFLGTYIQDVGAMTPVFFTFTDRQKAYTVIEAITGFRLHPAWYRIGGVAHDLPRGWEKLVKDFVDWLPKRLDEYTKAALQNSILKGRTVGVAAYNTKEALEWGVTGAGLRSTGCDFDLRKARPYSGYENFEFEVPLAANGDAYDRCMVRVEEMRQSIKIIDQCMRNMPEGPYKADHPLTTPPPKERTLQHIETLITHFLQVSWGPVMPANESFQMIEATKGINSYYLTSDGGTMSYRTRIRTPSYPHLQQIPSVIKGSMVADLIAYLGSIDFVMADVDR

SEQ ID NO: 65883 - protein, 472 aa, marine gamma proteobacterium HTCC2207
MKDLRNFYINGQWVQPLQTQDLAVENPATEESLAIISLGASGDVDLAVAAAKAAFPIYSQYSVEQRIALMEKLLDVYMARYDEMASAISMEMGAPISFATEAQAGCGHGHISAALEALKTFEFERQIGSTLVVKEPIGVCGFITPWNWPINQISCKVAPALATGCTMVLKPSEIAPLSGYLFTEMMDQAGFPAGVYNMVNGDGPGVGAVMASHPDVDMVSFTGSTRAGILVAKAAAETVKRVTQELGGKSPNIIFADADLESAVTGGVIGMMGNTGQSCNAPSRMLVEASVYDQAVEIARQVAAQIPVDQPAKQGEHIGPLSSRVQFDKVQGLITKGIEEGAELVAGGLGKPEGFETGYFVKPTVFAGVNNQMTIAREEIFGPVLTMIPFASEAEAIAIANDTPYGLAAYLSTGDDDRAKRVAGQLRAGMISLNSAQQDYTAPFGGYKQSGNGREWGEFGFDDFLEIKGISR

SEQ ID NO: 65884 - protein, 144 aa, Triticum aestivum
TSFKPTRLLLPSEPTQTQQPYAASSGNGGRHATMARSRARCNVCAAPITNVIREYNVRVDTTAGKALSIAKFNTGVPPFSKMKGAGNKWSLRKDGLTQGRQLTADMREKYYNRKPWILEDDTGEHQYQSQLEASQSATATYYLL

SEQ ID NO: 65885 - protein, 470 aa, Lactobacillus plantarum WCFS1
MVVGDFAEERDTMIIGAGPGGYVAAIRAAELGQKVTVVEKEYIGGVCLNVGCIPSKALISAGHRLQEAKDSKIFGIKNIQDPVLDFKVTQDWKDHQVVDRLTGGVEMLLKKHKVEVVRGEAYMHDNHTLRVMNGDHTGQTYKFKHLIIATGSRPVEIPGFKFSGRVVDSTGGLNLPEVPKELVVIGGGYIGSELAGAYANLGAHVTILEGTPQILPNFEKDMVKLVLNSFKKKGVDVITNAMAKNSEQDDSGVTVTYAVDGKETEIHADYVMVTVGRRPNTDDMGLEYTDVKLTKRGLIEVDEQGRTAAEDIFAIGDIVAGAALAHKAFAEAKVAAGAISGKKTANDYVSIPAVCFTDPELATVGMTKAEAEEAGLQVKTSKFPFAGNGRAISLNAMDGFFRLVSTKDEGTIVGAQIAGPGASDLISELSVAVNGGMNVEDLALTIHPHPTLGEVVQEAADEAMGYPTHI

SEQ ID NO: 65886 - protein, 359 aa, Sinorhizobium meliloti
MMGVRHATADAHAGGTVLESIGRTLTTATNGIKALADHLTSDQDFAGALVDAVELMGDGDGRVVVSGVGKSGHIGRKIAATLASTGTSAYFVHPTEASHGDLGMITAQDALVLLSWSGETAELANMLTYAKRFKVPIVSICSNRESTLARNSEIALVLPKVPEACPHGLAPTTSAMLQLAVGDALAIALLERRGFSAEDFKTFHPGGKLGAQLRLVQELAHGTGQMPLLSVGRPMSEAVIEMSAKGFGVVGITDESGKLIGVITDGDLRRHMAGDLLAQPVQEVMSRNPRVIKGDVLASAAMEFMQDHKVHRAVPRRRGRRPGRHPAHSRSAARRRRLIFAEFHRLLAGAAGRRRAPVH

SEQ ID NO: 65887 - protein, 431 aa, Lactobacillus plantarum WCFS1
MAYEFKLPELGEGLEEGEIASWLVKPGDEVKEDDSLVEIQNDKSVEELPSPVSGKVIDILVPEGETAKIGDVIVTIDDGSGDAAPAATKTEAPASEAAETPAATSAQPTGTPAAGNPNKRVLAMPSVRQYARDKDIDITLVTPTGAHGQITKQDIDNYTGAPAATGAKPAATPATTAPAASEAPAPTPVKPYVSDTPELETREKMTPIRKAISKAMVNSKHTAPHVTLFDEVEVSALMAHRKKYKQVALDRDIHLTFLPYFVKALVAVLQQFPELNASIDDANKEIVYKHYFNIGVATDTDRGLLVPNIKHAEGKGLFAIAKEITDNTQKAYDGKLKASEMSGGSITISNIGSIGGGWFTPVINQPEVAILGVGRIGKEPYVNDDGEIVVGKMQKLSLSFDHRLIDGATAQRAMNLLKQLLHDPELLLMEG

SEQ ID NO: 65888 - protein, 325 aa, Lactobacillus plantarum WCFS1
MSKKTYIQAITDALRLELGSDEKTLVFGEDVGKNGGVFRATDGLQAEFGEDRVFDTPLAESGIGGLSIGLALEGFRPIPEIQFLGFIFETLDSIAGQMSRERFRTGGTRHMPITIRSPYGGGTHTPEMHADSLEGYLAQIPGLRVVTPSNPYDAKGLLISSIRNNDPVFFLENLKLYRSMKADIPDEAYTVPLDKANVVREGTDISLIAYSAQVNQSLKVAEKLEKEGISVEVVDLRTLSPLDEETILKSVQKTGRAVAIQEAQRQAGIAANVASLIAEKGALYLSAPVGRVYAPDTVYPFGLAEDDWLPAEDEIEAKTREILNY

SEQ ID NO: 65889 - protein, 243 aa, Staphylococcus aureus subsp. aureus MRSA252
MKHDLETLKHIIDSSNRITFFTGAGVSVASGVPDFRSMGGLFDEISKDGLSPEYLLSRDYLEDDPEGFINFCHKRLLFVDTMPNIVHDWIAKLERNQQSLGVITQNIDGLHSDAGSQHVDELHGTLNRFYCNACHKSYMKSDVIDRTLKHCDNCGGAIRPDIVLYGEMLDQPTIIRALNKIEDADTLVVLGSSLVVQPAAGLISNFKGDNLIIINKDRTPYDNDATLVIHDDMVSVVKSLMTE

SEQ ID NO: 65890 - protein, 342 aa, Chlamydomonas incerta
AVSSKSGVRAKAARAVVDVRAEKKIRVAINGFGRIGRNFLRCWHGRQNTLLDVVAINDSGGVKQASHLLKYDSTLGTFAADVKIVDDSHISVDGKQIKIVSSRDPLQLPWKEMDIDLVIEGTGVFIDKVGAGKHIQAGAHKVLITAPAKDKDIPTFVVGVNDADYKHEYPIISNASCTTNCLAPFVKVLEQKFGIVKGTMTTTHSYTGDQRLLDASHRDLRRARAAALNIVPTTTGAAKAVALVLPSLKGKLNGIALRVPTPTVSVVDLVVQVEKKTFAEEVNAAFREAANGPMKGVLHVEDAPLVSIDFKCTDQSTSIDASLTMVMGDDMVKVVAWYDNEW

SEQ ID NO: 65891 - protein, 585 aa, Triticum aestivum
MCGILAVLGCADDTQGKRVRVLELSRRLKHRGPDWSGMHQVGDCYLSHQRLAIIDPASGDQPLYNEDKSIVVTVNGEIYNHEQLRAQLSSHTFRTGSDCEVIAHLYEEHGENFIDMLDGVFSFVLLDTRDNSFIAARDAIGVTPLYIGWGIDGSVWISSEVKGLNDDCEHFEIFPPGHLYSSKQGGFKRWYNPPWFSEVIPSVPYDPLALRKAFEKAVIKRLMTDVPFGVLLSGGLDSSLVAAVTVRHLAGTKAAKRWGTKLHSFCVGLEGSPDLKAAKEVANYLGTMHHEFTFTVQDGIDAIEDVIYHTETYDVTTIRASTPMFLMSRKIKSLGVKMVISGEGSDEIFGGYLYFHKAPNKEELHRETCQKIKALHQYDCLRANKATSAWGLEARVPFLDKEFINEAMSIDPEWKMIRPDLGRIEKWMLRKAFDDEEQPFLPKHILYRQKEQFSDGVGYSWIDGLKAHAESNVTDKMMSNAKFIYPHNTPTTKEAYCYRMIFERFFPQNSAILTVPGGPSVACSTAKAVEWDAQWSGNLDPSGRAALGVHLSAYEQEHLPATIMAGTSKKPRMIEVAAPGVAIES

SEQ ID NO: 65892 - protein, 613 aa, Rhodospirillum rubrum ATCC 11170
MTTLRNIAIIAHVDHGKTTLVDALLKQSGSFRENQKVDERALDSNDLERERGITILAKCTSVDWKGVRVNIVDTPGHADFGGEVERILSMVDGVVLLVDAAEGPLPQTKFVLGKALALGLRPIVVINKVDRPDARAHEVHDEVFDLFANLGASDKQLDFPCLFASGRNGWAVNTLEEIDGGTEGLTLEPLFKLVVDHVPAPERVLDAPFAMLATTLEYDPYLGRVLTGRILSGRAKINMPIKALARDGRILEQGRASKLLAFRGLNRVPVEEAEAGDIIAIAGIAKATVADTLCALELDQPIYAAPIDPPTLAMTFSVNDSPLAGLEGDKLTSRVIAARLAREAEGNVAIHIRETEDKDAFEVAGRGELQLGVLIETMRREGFELSISRPRVLYKTDEQGGNREEPIEEVVIDVDEEFSGTVVDKMSQRKAELQEMKPSGGGKLRLVFHAPSRGLIGYHGEFLTDTRGTGIMNRLFHGYAPFKGTIDGRREGVLISNGAGDAVAYAIFNLQDRGPMFIEPGVKVYEGMIVGEHNRGNDLEINVLKGKQLTNIRASGKDEAIRLTPPLRKSLEEALAYIQDDELVEVTPKTIRLRKRWLDSNERKKRSKKVSEA

SEQ ID NO: 65893 - protein, 472 aa, Xanthomonas campestris pv. vesicatoria str. 85-10
MHRHVHEPEILADPAAAQTAEHWRQRDLGVVWHPCTQMREHPHTLPLVPIARGEGAWLVGHDGRRYLDAVSSWWTNLFGHTEPRIGAAIARQAGELEQVMLAGFTHTPAVQLAEQLLAIAPRQAGRAPLSKVFYADNGSAGVEVALKMAFHYFHNRGDHRRTRFIALENGYHGETIGALSVGDIPLYRRVYAPLLLEAMFTPSPDAYLAEPGQSAEDYALQAADALQALFERSPGEICALILEPRVQCAGGMRMYHPAYLRRARELCDAHGAFLIADEIATGFGRTGTLFACEQAGVMPDLLCLSKGLTGGFLPLSAVLATQQLYDAFLDDSRERAFLHSHSYTGNPLACAAALATLKIFADDDVIARNQPIAARMRELAAQIGAHPAVADVRQAGMIVAFELTQGGDKRTPFASAARVGLKAYRAALEKGVVLRPLGDVLYWMPPYCVDEAQLALLADTTGHAITEAVACA

SEQ ID NO: 65894 - protein, 819 aa, Heliobacillus mobilis
MRVSLEWLGEYVNPGMEAADLGEKLTRSGIAVENILRRDARLDQVVVGHIDVIEKHPEADRLWVCSVNTGDRQYTVVTGAQNVRQGHKVPVALPGAKLPKGVEIGEAAFRGIKSSGMLCSAEELALEEKTISPEDREGILILDKDAQVGQPIAQALGLDVPILELELTPNRADCLAVINVAREVSAITGQPLQLPDVKVVEKGEGRTEEQVKVTIEDSDLCGRYAARLFTNLRPGPSPLWMQRRLQAAGMRPINNIVDITNYVMLEMNHPLHAFDYHTVKDGHIVVRRARTGEKLVTLDGQERELNSENLVIADPEKAIALAGVMGGLETEITEKTTTILLEAAHFYPASVRRTARQVGLRSEASQRFEKGVNINTVKLAMDRAAELVAQLGVADVVPGYVDNYLRPTEPVKVPFRASRINALLGTTIKPEQMEDIFQRLQFPVQWEAATEGEQRDAGIVVAPTYRPDIQGEHDLAEEVARLYGYDRIPTTLPQGKTTVGQRTWPQTVREKIIDALVGSGFREVVTFSFINPRHLDRLAIPAEDHLRQVIPVQNPLSEEQGILRPTIIPGLLELAARNASRRIPDLAIFELGGTFLPKALPLKELPDEAWKVSALVMGAAPVHWSGKPQPYDFYFLKGIVEKLLSALKIKGVTWSRETELSYLHPGRAARLQITQDGMVFDLGYMGEVHPDVREAYDLAARPVVMELDLSALTLLARAKGDYRPLHRFPSTDRDMAMVLPVAVPAGQVEAVIAEVGGNLLERWRLFDVYQGNQISAGFRSLAYTLRYQAPDRTLTDEEVNHAHESIKTALMERLGAQFR

SEQ ID NO: 65895 - protein, 675 aa, Arabidopsis thaliana
MSSCFKSSVSLFSVFLFMILKTVTSDPTYLYHICPNTTTYSRNSSYLTNLRTVLSSLSSPNAAYASLFDNAAAGEENDSNRVYGVFLCRGDVSAEICRDCVAFAANETLQRCPREKVAVIWYDECMVRYSNQSIVGQMRIRPGVFLTNKQNITENQVSRFNESLPALLIDVAVKAALSSRKFATEKANFTVFQTIYSLVQCTPDLTNQDCESCLRQVINYLPRCCDRSVGGRVIAPSCSFRYELYPFYNETIAAAPMAPPPSSTVTAPPLNIPSEKGKGKNLTVIVTAIAVPVSVCVLLLGAMCWLLARRRNNKLSAETEDLDEDGITSTETLQFQFSAIEAATNKFSESNKLGHGGFGEVYKGQLITGETVAIKRLSQGSTQGAEEFKNEVDVVAKLQHRNLAKLLGYCLDGEEKILVYEFVPNKSLDYFLFDNEKRRVLDWQRRYKIIEGIARGILYLHRDSRLTIIHRDLKASNILLDADMHPKISDFGMARIFGVDQTQANTKRIVGTYGYMSPEYAIHGKYSVKSDVYSFGVLVLELITGKKNSSFYEEDGLGDLVTYVWKLWVENSPLELVDEAMRGNFQTNEVIRCIHIALLCVQEDSSERPSMDDILVMMNSFTVTLPIPKRSGFLLRTMKDSRDPRSGGSASDHSATSKSLPLSVDDSSITIVYPR

SEQ ID NO: 65896 - protein, 1387 aa, Nocardia farcinica IFM 10152
MSDAPTSPAPGTARTACSYCGVGCGISVQTTVQGGDGVAGAGKRVLAKVGGDPRHPANAGRLCTKGATHLELMRAPGRMETAYRRPQRDQVPVPIPVDEAVHEVADRLRAILDEHGPDAIALYVSGQMSLEAQYLATKLAKGFLRTKHIEANSRLCMASAGTGYKQSLGADGPPGSYDDIDHADLFFVIGANMADCHPILFLRMADRLKAGAKLIVVDPRRTATADRADLFLQLRPGTDLALLNGLLHLLVADGAIDAEFIAEHTEGWAAMPEFLADYPPARVAAITGLAEDDLRTAARWIAEAGEWMSLWTMGLNQSTHGTWSTNALCNLHLATGAICRPGSGPFSLTGQPNAMGGREMGYMGPGLPGQRSLLSAADRAFVESAWGLAPGSLRAESGPGTIEMFRSMAAGEIKAAWIICTNPVASVANRKTVIAGLEAAELVITQDAYTDTATNAYADVLLPATLWAEADAVMVNSERNVTLMPRCVDPVGEARPDWLLIAQVATAMGFPGFEYGSSAEVFAEITGFANPATGYDLRGMSYPALAEGPMQWPCPDPARRRNPIRYRNDGVSQELFVDEHGHRPRLAFPTPSRRAVFWPRPHLDPAELPDDDYPFVLNTGRLQHQWHTMTKTGRIGKLTRLDGEPFVEVHPEDAERLGVRPGDQLEIASRRGRAVLPARISDRVRPGDCFAPFHWNDEQGEYLTINAVTNDAVDPDSWQPEFKQCAVALRRVAPVPRADEPCPEASAPQHPLAALLGLDAAATPTLSETERIYLGGYLAALQSIPVTGQPVLPDSAPIAGASRVWIDGLLAGMYSRAAVTADAPVPVAKPVTVLWASQTGNAEDLAAAVAQRLSGAGFAPRLLDMDSCALDALDGDVLIVTSTFGDGGPPDNGADFWDRLEGSATRFPGLRYAVFALGDSAYDDFCGHGRKIDRLLAERGARRMLERVDCEPDHAERAQRWLDEIVAVLGQGGGVPGGAASGTRWAGPPGADGVADGVAGGATATATAVLTKPARQAAPFTRNAPVAAPLIRNEVLSHPDSVKEVRRVGFDLRDLGVSYETGDSLGVWPSNCPDLVAEWLAATGLDGGRGIEIDGRELPLAEALRTHYDITRVSHDLLTFVAERNPSQQLAKLLRRDNRNELDGYLWDRQAVDVLRDFPVRADLIEWQGVLTKLQPRQYSISSSPLVDPHEVQLTVGVVRYGESGRRGGVCSTFLADRADTRVPIFLQRAPHFRPPLDPAAPMIMVGPGTGIAPFRGFLHERRALGATGRNWLFFGDQHAAQNFYYRAELEDMFRTGFLTRLDLAFSRDQRERIYVQHRMIEHGAELWAWLCEGAHLYVCGDAARMAKDVDETLLAIARIHGKLDEDGALAFRKQLVAEKRYVRDVY

SEQ ID NO: 65897 - protein, 500 aa, Arabidopsis thaliana
MATIWFLPLLFLSCLLLAALRLKKRRQHQRKPPSPPGFPIIGNLHQLGELPHQSLWSLSKKYGPVMLLKFGSIPTVVVSSSETAKQALKIHDLNCCSRPSLAGPRALSYNYLDIVFSPFNDYWKELRRMCVQELFSLKRVQSFQPIKEDEVKKLIDSVSESASQGTPVNLSEKFTSLTVRVTCKATFGVNFQGTVLNSDNFDKLIHDAFLFLGSFSASDYFPNGGWIIDWLTGLQGQRERSVRGLDAFYEQMFDLHKQGNKEGVEDFVDLLLKLEKEETVLGYGKLTRNHIKAILMNVLIGGIGTSAITMTWAMTELMRNPRVMKKVQSEIRNQIGKKSMITLDDIDQLHYLKMVINETWRLHPPSPFLIPREVMSEFEINGYTIPAKTRLYVNVWGIGRDPDTWKDPEEFLPERFVNSNIDAKGQNFELLPFGSGRRMCPAMYMGTTMVEFGLANLLYHFDWKLPEGMVVEDIDMEESPGLNASKKNELVLVPRKYLNL

SEQ ID NO: 65898 - protein, 76 aa, Brassica napus
RKSRSRTRSNWNWCGWRSVFHHYSINLAALSLIMLAEGMSKLEGIGSTERERLWPELVQSFKDIFQRLKKEKRKNT

SEQ ID NO: 65899 - protein, 206 aa, Bacillus cereus ATCC 10987
  misc_feature (192)..(192): Xaa can be any naturally occurring amino acid
MIDFGTIATAMVTPFDINGNIDFAKTTKLVNYLIDNGTTAIVVGGTTGESPTLTSEEKVALYRHVVSVVDKRVPVIAGTGSNNTHASIDLTKKATEVGVDAVMLVAPYYNKPSQEGMYQHFKAIAESTPLPVMLYNVPGRSIVQISVDTVVRLSEIENIVAIKDAGGDVLTMTEIIEKTADDFAVYSGDDGXTLPAMAVGAKGSFL

SEQ ID NO: 65900 - protein, 604 aa, Synechococcus elongatus PCC 6301
MTDVSVSKIRNFCIIAHIDHGKSTLADRLLQETGTVQAREMKEQFLDNMELERERGITIKLQAARMNYRAQDGEQYVLNLIDTPGHVDFSYEVSRSLQACEGALLVVDASQGVEAQTLANVYLALENDLEIIPVPNKIDLPGADPERVKREIEEVIGLDCSGAIEASAKSGIGIGEILESIVHLVPPPSDTTGEPLRALIFDSYYDPYRGVIVYFRVIDGTVRKGDRIRLMASGKEYEIDELGVLSPNQVQVEELHAGEVGYIAASIKAVADARVGDTITLARARATEPLPGYVEAKPMVFCGLFPTDSDRYPDLRDALEKLQLSDAALQYEPETSSAMGFGFRCGFLGLLHMEIVQERLEREYNLDLITTAPSVVYQVTTLDGEVLRLDNPSKLPPPQQREKIEEPYVKVEIITPENYVGALMDLCQTRRGIFIDMKYLTQERTTLIYEMPLAEVVTDFFDQMKSRTKGYASMEYSLIGYREGELVRMDILINSEPVDPLATIVHRDKAYYVGKALVEKLKELIPRHQFKIPLQAAIGSRVIASESIPALRKDVLAKCYGGDISRKKKLLQKQAKGKKRMKAIGTVDVPQEAFMAVLKLDREG

SEQ ID NO: 65901 - protein, 671 aa, Mycobacterium avium subsp. paratuberculosis K-10
MGLRDHHLSDHYLSDHREDIGLMRSRYAGEPFTTSTAEIAAALEDVSIPTLLLSLVHITGDPRFIRDFKQMGIFLNEVQGFMSEEDKARARAEALSVITDYRDRGCPEPEPLSPELIREMMDWAACEHVPDDYLPLICEELDLDGVDPRRPAALPAERAAGLPVLVVGCGESGILAGVRLKQANIPFTIVEKNAGPGGTWWENSYPGARVDVANHFYCYSFEPNNDWTHFFAEQYELQDYFTKVIDQHDLAGQVRWQSEVLAAEWDDGDGTWTVSLRSADGHTETMRARALITAVGQLNRPNIPAFDGAQTFRGPSFHSAAWDHSVELKGKRVALVGAGASGFQIAPAIAADVKRLTVFQRTAQWMFPNPMYHDEVGDGVRWAMRHLPFYGRWYRFLVLWPGSDKGLDAAEADPNYADQEHAVSDVNAAAHLMFSQWITSQVGEDSELLAKVMPDYPACGKRTLQDNGSWLRTLQRDNVELVRTPIDKITPHGIVTVDGAAYDADVIVYATGFRHTDVLWPLKVTGRNGVDLHQMWGSRPYAYLGITVPEFPNFFIIYGPGTHLAHGGSLIFQSELQMRYIDQCLARLCEPGVHSIEPKPDAAIDWHRRTPGPDQEDGVVAPGGQALLFQERRRRDSHGEPMASQRVLVRGARARLVAVHGADERCCATRK

SEQ ID NO: 65902 - protein, 488 aa, Bacillus anthracis str. Ames
MNSATNQTTSQTETTKGKGELRRGLKSKHLTMISLGGTIGTGLFLASGGVIHSAGPGGALIAYAAIGIMVYFLMTSLAELAAYMPVTGSFSTYATKFVDPSLGFALGWNYWYNWAITIAAELAAVTLIMKFWFPDTPSLIWSGLCLAIIFLLNYLSVKGFGESEYWFALIKVATIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLNDLPYRAKWFPFGPIFAFALCVIVILGQNYGAFMGESIDWNGVLVSYIGLPLFLVLWLGYKFTKKTKVIPLDKCELK

SEQ ID NO: 65903 - protein, 341 aa, Mycobacterium avium subsp. paratuberculosis K-10
MRTVVVDGPRSIRVDTRPDPVLPGPDGAIVEVSAAGICGSDLHFYEADFPMPDPIALGHEAIGTVVEAGPQVRNVKVGDQVMVSSVAGCGSCAGCATRDPVLCHSGFQIFGGGVLGGAQADLLAVPAADFQLLKIPEGISTEQALLLTDNLATGWAAAQRADIPFGGTVAVIGLGAVGLCALRSALFQGAATVFAVDQVDGRLARAARWGATPVKAPALEAILAATGGRGADAVIDAVATDASLTEALNAVRPGGTVSVVGVHDMNPFPLNALGCLIRSITLRMTTAPVQRTWPELIPLLQSGRLDVDGIFTTTMPLDEAAIGYATAGSRSGDDVKILLKP

SEQ ID NO: 65904 - protein, 314 aa, Glycine max
MSFYIGREASKLWKRICAETTTEVNLLAENWKYLLAGLVCQYIHGLAARGVHYLHRPGPTLQDVGFFLLPELGQDKAYISETLFAMIFISFVLWTFHPFILKNRKIYTVLIWCRVLAFLVASQALRIVTFYATQLPGPNYHCREGSKLATLPRPDSVFEVLLINFPRGVIYGCGDLIFSSHMIFTLVFVLTYQKYGTRRSIKQLGWLLAVVQSLLIVASRKHYTVDVVVAWYTVNLVVFFIDKKLPELPDRSIAAATLLPLSTKDKDNRTKEENHKLLNGNSGDPADWRQRTQVNGKIMEDGNTLHADSAMNGA

SEQ ID NO: 65905 - protein, 141 aa, marine gamma proteobacterium HTCC2207
MASERTLSIIKPDAVAKNVVGQILSRFETAGLQIIACKMQQLTQEQAEGFYAEHSERPFFKDLVAFMTSGPVSVQVLEGENAVMTNRDLMGATNPKEAEAGTIRADFAESIDANAVHGSDAAASAAREIAYFFADNELCSR

SEQ ID NO: 65906 - protein, 338 aa, Xanthomonas campestris pv. vesicatoria str. 85-10
MSASSPMEAVAFPRHETFVAADVGGTHVRLALVCESDDASKPVTVLDYRKYRCAEYPGLADIMTTFFAELGCAPVRRGVIASAGYALEDGSVITTNLPWVLAPEQIRRQLGMQALHLVNDFEAVAYAANYMIGNQVMQLSGPAQGAAGPALVLGPGTGLGAALWIPNGAHPVVLPTEAGHAALAPASDLEMALLQELRRTRTHVGTETLLSGPGLLNLYTVLAALRGDSVVHATPADITAAAMAGNDGLAHDALQAFCGFMGSVVGDLMLLYGVRSGVYLAGGFLPQIASFIAESDFVARLLDKGALRPALEQVPVSIVEHGQLGVIGAASWFLQHGR

SEQ ID NO: 65907 - protein, 284 aa, Solanum lycopersicum
MEGEVRRWWWWWTWRWLWWWERFWGRNARAGGGGAYAAGGHDGGYAGGGGSGSGAGGGHAGGGYAGGGGGGSGAGGAHAGGHDGGYASGGGEGGGAGGGHAGGGYAGGGGGGSGAGGAHAGGEHDGGYAAGGGEGGGSGYGGAGSADGGYAAGGGGGSGGGGGGAVAGGGAHGGGAYAGGSGGGTGGGYGAGGAPGGGYGGGGGHGGGGGSAYAGGEGGASGGGYGSGGGAGGGAGGAHGGAYGGGGGSGAGGGGAYAGGEHAGGYGGGAGGGEGGGHGGGYAP

SEQ ID NO: 65908 - protein, 253 aa, Desulfovibrio desulfuricans G20
MYKLVLVRHGQSTWNLENRFTGWTDVDLTPLGETEAREGARLIAAAGLTFDECHTSVLKRAIRTLNIIQEELDLLWLPVHRHWRLNERHYGALQGLNKKEMSEKYGEEQVFIWRRSFDTPPPALTADDPRHPAHDRRYASLTARQMPLCESLKDTVARVLPYWHETLAPAIQAGRRLLVAAHGNSLRALVMHLDGMSPDEVTGLNIPTGLPLVYELDSNLTPLRRAYLGDAEAAEAKARAVAEQAKAGTTERP

SEQ ID NO: 65909 - protein, 513 aa, Arabidopsis thaliana
MVEGKGFLVSSVTELHRKEKQKKKGKSGGFESLNLGPNVFNAIKKKGYKVPTPIQRKTMPLILSGVDVVAMARTGSGKTAAFLIPMLEKLKQHVPQGGVRALILSPTRDLAEQTLKFTKELGKFTDLRVSLLVGGDSMEDQFEELTKGPDVIIATPGRLMHLLSEVDDMTLRTVEYVVFDEADSLFGMGFAEQLHQILTQLSENRQTLLFSATLPSALAEFAKAGLREPQLVRLDVENKISPDLKLSFLTVRPEEKYSALLYLVREHISSDQQTLIFVSTKHHVEFVNSLFKLENIEPSVCYGDMDQDARKIHVSRFRARKTMLLIVTDIAARGIDIPLLDNVINWDFPPRPKIFVHRVGRAARAGRTGCAYSFVTPEDMPYMLDLHLFLSKPVRPAPTEDEVLKNMEEVMTKTSQAIDSGVTVYGRFPQKTIDLIFNRTREMIDSSAELDSLERTSTKAFRLYSKTKPSPSKESIRRAKDLPREGLHPIFRSIIETGELEAMSFFQKIKNFR

SEQ ID NO: 65910 - protein, 202 aa, Zea mays
MFSLFYGLWKYVFAKDEFRVLILGVDRAGKTTLLEKLKSIYLKGEGLPPDRVVPTVGLNIGRIEDAKAKLVFWDLGGQVSLRTIWEKYYEEAHAIMYVIDAATASSFEDSKSALEKVIRHEHLRGAPLLIVANKQDLPGAIDEEELAKFLHKELDERPYTFQAVSAYDGRGIKSGIDWLVEQMEKSKRTETLQARAGVAGQI

SEQ ID NO: 65911 - protein, 472 aa, Aspergillus oryzae
MPPVEPQQYDYIVLGGGSGGSGSGRRAAGWYGAKTLIVESGRSGGTCVNVGCVPKKMTWNFATVNETLHIAEHYGYTIPKDVKIDYGHFKELRDATVKRLNGAYERNWGREGIDLVHGRARFVEPKVIEVANNDGTKARYNAPHILIATGGRPKLPNIKGAEHGITSDGFFEIEELPPKIAVVGAGYIAVELAGVMGAVGVDTHMFIRGQTFLRKFDPMIQKTMTERYEAAGITVHKGHPGLKEVQLVRDGKGKDKLLKLISNDGSEMEVNEILWAIGRAPEVEDLHLDVPGVKLNDAGFVDVDEYQNSSVDGIYALGDVTGHAELTPVAIAAGRQLGNRLFGPPELKDSKLSYDNIPTVVFSHPEVGTVGLTEPEARERYGDDQIKVYYTKFTAMYYDVVPPEEKKKNPTEFKLICAGPEEKVVGLHILGLGVGEMLQGFGVAVKMGATKRDFDSCVAIHPTSAEELVTLR

SEQ ID NO: 65912 - protein, 420 aa, Zea mays
  misc_feature (219)..(219): Xaa can be any naturally occurring amino acid
EALLRLTALHCTCCLLPSSVGPGPWPCPRRAPSSAAVGYHVAGGPSYMRGAVFWEPGRPLTLEEFHMPRPKAGELLIKTKACGVCHSDLHVLKGELPFSSPCVVGHEITGEVVDHGTHTPAEIISRFPVGSHVVGAFIMPCGNCFYCVKGQEDLCESFFAYNRAKGTLYDGETRLFLRGNGKPVYMYSMGGLAEYCVVPANALAVLPASLPYTESAILXGCAVFTAYGALRHAAEMRPGDSVAVIGVGGVGSSCLQIAKAFGASQVIAVDVLDEKLQNATTLGATHTVNAAKDDAVERIKEITDGRGVDVAIEALGKALTFSQCAKSVRDGGKAVMIGLAATNVMGEVDITRLVRRQVKIIGSYGARARQDLPQIVKLAESGAFNLQNTISRKCKFEEANGAYEDLNQGKIVGRAVVEIM

SEQ ID NO: 65913 - protein, 558 aa, Roseovarius nubinhibens ISM
MGYKTDIEIAREANKKPIQEIGDKLGIPSEHLLPYGHDKAKVSQDFINSVQDRKNGKLILVTAINPTPAGEGKTTTTVGLGDGLNHIGKKAMICIREASLGPNFGMKGGAAGGGYAQVVPMEEMNLHFTGDFHAITSAHSLLSAMIDNHIYWGNELEIDVRRVQWRRVVDMNDRALRQINVSLGGVANGFPREGGFDITVASEVMAILCLANDLKDLERRLGDMIVAYRRDRTPVFARDIKAEGAMTVLLKDAMQPNLVQTLENNPAFVHGGPFANIAHGCNSVIATTTALKLADYVVTEAGFGADLGAEKFMNIKCRKAGIAPSAVVLVATVRAMKMNGGVAKADLGAENVEAVKKGCPNLGRHIENVKSFGVPVVVAINHFVTDTDAEIQAVKDFVKAHGAEAVLSRHWELGSEGSADLARKVVEVADAGNANFSPIYDDDMPLFEKIETIAKRIYRADEVLADKKIRDQLKLWEEQGYGKLPICMAKTQYSFSTDPNLRGAPTGHSVPVREVRLSAGAGFVVVVCGEIMTMPGLPRVPSAEAIRLNDAGQIEGLF

SEQ ID NO: 65914 - protein, 632 aa, Aspergillus oryzae
MLLGSRPARAGSLKDIDHVVIFMQENRSWNNYFGTMAGVRGFNDPNVQVNDDGLSVWHQKVDPSMSENATTLLPWYLGYKGGDWNDAIQCMVAGSNGYEDNQASLNHDLNNNWARNNTPWSWGYLKRNDIPVQFAIAEGWTAGDMYQESQITSTNPNRVTLVSGSVNIPGSPQASDQGGPYIDNNETPGCDTDNINCYPLKWKTIFEIYEEAGVSWQVYQEKNNFDDNPLAWFQQYQNASASSPLAKKGLSYLGLDAFYKAAANGSLPEVSFIVGPAELSEHPPYMPKDGAWLQKKVVDAVTKSPKYSSTLLIISYDETGGFGDHVVPFHSPEDTPGDWMTDPYGKFGKIYVGPGLRVPFYMISPWTRGSRVFTEHADHNSQILFIEQWLKARGYENVETPEMVQWRREHMSDLVSALDLDHPDTNLPTLPDAEEPATLLGNYVGSSNCQASHPTQRPPVPYGQQSNVSDALWFEEGYKEVVGYLTEGRYLVFEKSGYALTNAGNATRISSSRTGSGYGDKKQRWVIHYSGGQQSGVFHISSALDGKWLGPKGTLLSSNRGSQAADVKITFVGNGQGYTLQYADSTPIEIDSKGALTLQRREASEEGYKVWSYLAYVCNRRKLHTYRSSARV

SEQ ID NO: 65915 - protein, 1077 aa, Yersinia pseudotuberculosis IP 32953
MPKRTDIKSILILGAGPIVIGQACEFDYSGAQACKALREEGYRVILVNSNPATIMTDPEMADATYIEPIHWEVVRKIIEKERPDAVLPTMGGQTALNCALELERQGVLAEFGVTMIGATADAIDKAEDRRRFDIAMKKIGLDTARSGIAHNMEEALAVAADVGFPCIIRPSFTMGGTGGGIAYNREEFEEICERGLDLSPTKELLIDESLIGWKEYEMEVVRDKNDNCIIVCSIENFDAMGIHTGDSITVAPAQTLTDKEYQIMRNASMAVLREIGVETGGSNVQFSVNPKNGRLIVIEMNPRVSRSSALASKATGFPIAKIAAKLAVGYTLDELMNDITGGRTPASFEPSIDYVVTKIPRFNFEKFAGANDRLTTQMKSVGEVMAIGRTQQESLQKALRGLEVGATGFDPKVSLDDPEALTKIRRELKEAGAERIWYIADAFRAGMSVDGVFNLTNVDRWFLVQIEELVRLEESVAELGINGLTAEFMRHLKRKGFADARLAKLVGAAESEVRKLRYKYGLHPVYKRVDTCAAEFSTDTAYMYSTYEEECESNPTSDRPKVMVLGGGPNRIGQGIEFDYCCVHASLALREDGYETIMVNCNPETVSTDYDTSDRLYFESVTLEDVLEIVRIEKPQGVIVQYGGQTPLKLARELEAAGVPIIGTSPDAIDRAEDRERFQQAVNRLGLKQPANATVATIEQAVEKATGLGYPLVVRPSYVLGGRAMEIVYDEIDLRRYFQNAVSVSNDAPVLLDRFLDDAVEVDVDAICDGERVLIGGIMEHIEQAGVHSGDSACSLPAYTLSKEIQDVMRQQVEKLAFELCVRGLMNVQFAVKNNEVYLIEVNPRAARTVPFVSKATGMPLAKIAARVMVGQSLAEQGMLEEIIPPYYSVKEVVLPFNKFPGVDPILGPEMRSTGEVMGVGRTFAEAFSKAMLGSQSGMKKSGRALLSVREGDKHRVVDLAAKLLKQGFELDATHGTAVVLGEAGINPRLVNKVHEGRPHIQDRIKNGEYTYIVNTTAGRQAIEDSKLIRRSALQYKVHYDTTLNGGFATAMALNADPTDQVISVQEMHAKIKNMKA

SEQ ID NO: 65916 - protein, 328 aa, Arabidopsis thaliana
MEEEVLSRVPVKSLGKLRLTCKKWNTITKSESFLKKKQRNGIEVVMMMDYRVSLMSVDLLSPSIDPIGNLNADGIKISKIFHCQGDKDSSRVVVWNPYLGQTRYIELPRNSIYHKCVKYALGYEKKNHKILRFVNEYLETSRDRIRELQIYSLYSNSWEVIDDFTPDWYILYKHSGVSLKGNTYWYALEEIPFHAVFGDTVTLASVREEQLAVLFHRASVVEIWITNKIEPNAVSWSNLLFAVDMKPVAGFWFPNVGRSFFVDEEKKVAVVLDKEIIDKCHLPARNIAYIIGNNGILSKVDLGESRDKFCYPLVCSYVPSSVQIPNTP

SEQ ID NO: 65917 - protein, 242 aa, Bacillus anthracis str. Ames
MQQFEEVRTILEKAKKITVLTGAGASTESGIPDFRSANGLYADANVEMYLSRGYYNRSPKEFWKHYKEIFQINTFHQYKPNRGHRFLAELEEQGKDITILTQNIDGLHQVGGSKHVIDLHGTLQTAHCPKCKMGYDLQYMIDHEVPRCEKCNFILNPDVVLYGDTLPQYQNAIKRLYETDVLIVMGTSLKVQPVASFPQIAKREVGATTILVNEELTGQEYNFDYVFQNKIGEFVEGLSSIK

SEQ ID NO: 65918 - protein, 457 aa, Arabidopsis thaliana
MASLGQITLPRAPSSEIGLLRRRFERPIIRTRIGFNGRIASVLTNAGDQAVSVKASVSQKVIEEEAKVIVGTYARAPVVLSSGKGCKLFDPEGKEYLDCASGIAVNALGHGDPDWLRAVTEQAGVLAHVSNVYYTIPQIELAKRLVASSFADRVFFCNSGTEANEAAIKFSRKFQRFTHPEDKEVATGFIAFTNSFHGRTLGALALTSKEQYRTPFEPIMPGVTFLEYGNIQAATDLIRSGKIAAVFVEPIQGEGGIYSATKEFLQSLRSACDAAGSLLVFDEVQCGLGRTGLMWAYEAFGVTPDIMTVAKPLAGGLPIGAVLVTEKVAETINYGDHGSTFAGSPLVCSAAIAVMDKVSKPSFLSSVSNKGRYFRDLLVKKLGGNSYVKEVRGEGLIIGVELDVPASSLVDACRDSGLLILTAGKGNVVRIVPPLVISEEEIERAVEIMAQNLTALD

SEQ ID NO: 65919 - protein, 294 aa, Zea mays
MAMYSQSVRAPPPPPCRFVPRPCYVMARPLLVFMPNGALLKAAVRDVWASNFDEELSNLSAVLPRYPCVCVDTEFPGAVHDSDMPRYMRGPRESYELVKRNVDDLKLLQVGIALSGPTGRFPVAWQFNIRGFDPALHPHAPASIAMLREQGMDFAMLNEFGIDPKDFAPGFRRSGLACGRLTRTAFSGSYDFAYLAKALTGGQPLPDTLDGFLALVRRLFGHSVFDVKHLARCCAMRGGLEQVATALGVKRAVGRAHCAGSDSLLTTDVLLLMLHRFFRNVDVLAHAGTIVDLT

SEQ ID NO: 65920 - protein, 1178 aa, Oryza sativa
MAGKKRKSASSDKQQKQQWLPLGADADAAKRRRSGAAKILREALTQQQEESLADKRPATSATAAPSPSFSFPVPNKDGEEEEDDDVDEFDGLDAQSKYDGGVPEIDEENEKALAAFMSKDTSSKRTLGDIILKKIRQKDAEISTDALSVHVGLLSLHVRRLILLMSSPFCASVQLPLALMDRQWMYADRRSKEFIDGVHYFLRVAEANRQRGFICCPCNKCKNQKEYSASRTIHFHLFESGFMPSYNCWTSHGEQGVEMEEDEVEDDNIPDFAQYVGFEGNQTGEEEIAADGNDVADDLGQMLQDAREDCESEKEAHKLDKMLEDHRTSLYPGCEQGHKKLDTTLELLQWKAKNGVSDKAFGDLLKLVKNILPGGNKLPETTYEAKKIVCPLGLEVHKIHACPNDCILYRGEEYENLEACPVCKALRYKIRRDDPGEVDGQLTKKRIPAKRKYIMMPIIIQGPKQPGNDIDVYLRPLVEDLKQLWKKEGVPVWDEDKQEEFNLRALLFVTINDWPALSNLSGQSNKGYKACTHCMDETESTYLKHCRNVVYMGHRRFLAANHPVRKKGKHFEHKADHRTKPKHRSGKTVFAMVKNLKVVFGKGPGSQHIESEDGHAAMWKKNSIFWELPYWEFLDVRHAIDVMHLTKNLCVNLLGFLGVYGKSKDTLEARNDLKHMEQRGDLHPEPKEKGSHYLSPASYTLSKAEKESMFECLESIKVPSGYSTNIKRIISTKEKKFTNLKSHDCHVLMTQLLPVVIRGILPDNVRATITKLCAFMNAISQKVIDPDRLEALQNEVVQCLVSFELIFPPSFFNIMTHLLCHLVKEIRILGPMYLHNMFPFERYMGVLKKYVRNRARPEASIAKGYGTEEVIEFCVEFIEDLRPIGVPESRHEGRLRGKGTLGRKAIMTVDNNLFRKAHFAVLQHSSLVAPYIEEHLALVRARNIGKSDAWITRHHIDTFPAWLRQHLMGNESINQQLAFLARGPSGSITTFQGYEINGYTFYTRAQDMKSTNQNSAVRVDAMGHDGTTATYYGAIEDIWELDYGPLKVPLFRCQWVRLTGGGVMIDDSGMTTVDLNKVGYSDKPFVLANDVIKGKKGRGPDEPKRQVVLPGKRKIVGVEDKTDEDYDQLDGQPPFTVTIDPSILLSNEDTPYSRSDHKEGTIVRRKYVRSTVTADVMP

SEQ ID NO: 65921 - protein, 244 aa, Brassica napus
MPKTRRMSDLPQELVGEKILTKVPITSVKEVRSTCKKWEAITKSWVVLGKAAAAAAAAGPHEFLGFMTMNAKVYSLRFHLREEEEEDLVVDVSAKQVDLLNQLEISKVYHCDGLVLCVATDHSKLVVWNPYLCQTRLIGPRENFNIRDNYAIGYSSSSSERDHKILRFVDDYSAPGPTRVFRCEIYGIGSDSWRVLKPKPEWKIQINEHHRGVSVKGNTYFFAHERFVVIDDFGGRDCEVEDSY

SEQ ID NO: 65922 - protein, 386 aa, Xanthomonas campestris pv. vesicatoria str. 85-10
MHPPRLLSRLVASLAASLGVVAAQAQSPASPPSPIVLSEFIADRAPTPQAHASTLLETRDGRLLAAWFGGEHEGAADVGIWLAQRGPQQWQTPRRIADGAHAGVDGVAVPAWNPVLFQSTTGPVQLYYKLGPNPRQWWGLRLLSTDDGAHWSPPQRLPDGILGPIKNKPVQLPNGRILAPSSSEDRGWRAHLEWSDDDGAHWQRGMPLNDAKAIGAIQPSLLLYPDGRLQALGRSQQNKLFSTFSLDGGLHWQPMHLLDVENPNSGTDAVMLRDGRALLVYNPAIAGKDWWDGRGTLAVAVSNDGVHWQRVLTLEDSAHDEFSYPAVIQTRDGLVHVSYTWKRRRIKHVVLDPTRFGACSTCQAPAPATLSERCTTACGHAADPSS

SEQ ID NO: 65923 - protein, 121 aa, Brassica napus
  misc_feature (59)..(59): Xaa can be any naturally occurring amino acid
  misc_feature (86)..(86): Xaa can be any naturally occurring amino acid
PTSVVNFRFPAVDFFGGLKFNFFSAEFFSRQTRTGPVPVVFSDQQRRGSLGPSKVFGVXSNTGWGMGGKETGKNPSWIWAPGMGDXIDKRGTETGKVQEWGADWGEIRLDGLKDFNPLGDL

SEQ ID NO: 65924 - protein, 343 aa, Aspergillus oryzae
MDVILDVLDTLVFDRLYAAVLPRHSATKIAHYFPSNGTELATLNESVNRYFALSPSKWATQSILPRDHLLRQSLSLFLITWLFGIILYFLSATLSFHFIYDKRAMKHPKFLRNQISMEIAQAVNAMPVMAALTVPFFLAEVRGYTKLYDFSSQAPFPLYTYLQYPIFIAFTDFGIYWIHRGEHHPKVYKHLHKPHHKWIISTPFASYAFHPVDGWAQSLSYHVFPILFPLQKVAYLGLFVFVTIWTVMIHDGEYALDSPVVNGSACHTIHHYYFNYNYGQFLTIWDRIGGSYRKPNRELFDREVRMTQNEIKKQVEEMEKLVKEVEGVDDRCYETQTEMKKTL

SEQ ID NO: 65925 - protein, 409 aa, Corynebacterium efficiens
MVECVKGRPNVLAIVLAGGEGKRLFPLTEDRAKPAVPFGGTYRLIDFVLSNLVNAGYLKIAVLTQYKSHSLDRHISVSWNVSGPTGQYIASVPAQQRLGKRWFTGSADAILQSLNLISDEKPDYVIVFGADHVYRMDPSQMVDEHIKSGKSVSVAGIRVPRHEATAFGCIQSDDEGNITEFLEKPADPPGTPDDPDVTFASMGNYVFTTEALVRALKDDSENEDSEHDMGGDIIPYFVDRGDAHVYDFSRNIVPGATERDKGYWRDVGTIDAFYECHMDLISVHPIFNLYNKEWPIHTTVEGNLPPAKFVQGGIAQSSMVAPGSIISAGTVRNSVLSTDVIVEEGATVEGAVLMPGVRIGKGAVVRHAILDKNVVVRDGELIGVDHDRDSQRFKVSAGGVVTVGKNQVV

SEQ ID NO: 65926 - protein, 678 aa, Rhizobium leguminosarum bv. viciae 3841
MPDTSQAPKTFPAPKDQRLRDLADCIRFLSMDAVQQAKSGHPGMPMGMADIAAVLFSEFLKFDAADPYWFDRDRFVISNGHGSMLLYSLLYLTGYKDMTIEEIKRFRQIDSRTAGHPEYRHATGIETTTGPLGQGIANSVGLALGERIMNASFGDNLVNHHTYVFLGDGCLMEGISHEAISLAGHLKLGKLIAFWDDNSISIDGATSLAESDDHPARFRAANWHVQQIDGHDTDAIRAAIIEAQKVTDRPSMIACKTIIGFGFPTRAGTQKAHSDAPGEDEIAGARKILGWASPPFEIPEALLNDWRKIGAKGGPARMAWAVRVQTASPDKRDDFERRMNGELPSGWRAAIAAAKQELSGSEKDLATRQASGIVLNHLFDAIPELLGGSADLTPSNNTKAKNQVEIKPGEYGGSYLHYGVREHGMAAAMNGLALHGGLIPYGGTFLTFSDYCRPAIRLAAIMEVRSIFVMTHDSIGLGEDGPTHQPIEHLSALRAIPRLAVYRPGDPIETAECWEAIMDAPRQAALIALSRQPMPLLRRGPSDENRSARGAYVLQEAEGGERQLTILASGSELNLAVEARSVLQDEGIRTAVVSMPCRLLFEKQDAAYKKSVLGGSRARVAVEAAVRDSWDRYLGLDGVFVGMHEFGASGKIDDVYTKFDITTDAVIRAGREVAGKQA

SEQ ID NO: 65927 - protein, 432 aa, Bacillus cereus ATCC 14579
MNFTKSEALHKEALEHIVGGVNSPSRSFKAVGGGAPVAMERGKGAYFWDVDGNKYIDYLAAYGPIITGHAHPHITKAITTAAENGVLYGTPTALEVKFAKMLKEAMPALDKVRFVNSGTEAVMTTIRVARAYTGRTKIMKFAGCYHGHSDLVLVAAGSGPSTLGTPDSAGVPQSIAQEVITVPFNNVETLKEALDKWGHEVAAILVEPIVGNFGIVEPKPGFLEKVNELVHEAGALVIYDEVITAFRFMYGGAQDLLGVTPDLTALGKVIGGGLPIGAYGGKKEIMEQVAPLGPAYQAGTMAGNPASMASGIACLEVLQQEGLYEKLDELGAMLEKGILEQAAKHNIDITLNRLKGALTVYFTTNTIEDYDAAQDTDGEMFGKFFKLMLQEGVNLAPSKYEAWFLTTEHTKEDIEYTIEAVGRAFAALADNK

SEQ ID NO: 65928 - protein, 524 aa, Zea mays
MDVALSTIVFVIAIFIPALLTLVQRSRSRHAGHNQPPPPEPRAIPLVGHLHQLLRKKPLHRTLAHLAERHGDVLGLRFGSSRVAVVSSASVAQQCLVALDTSFGNRPRLPSARILSYEWSTMGHSNCGPYWRQARRTTSTEFSSVERVQHFADVHEQAARAMARSLCRLALASGRGRALVDVKPRLFEMLMNGLLDMLFKGTASRSGSSDEKDEAVEVSEEARCFMAMAEETMELTLTVWDFLPPLARWLDVDAVGRRLQRLQANRTEFLQRLIEEHKEMEKGGQVTRRTLVGVMLELQDKDPEAYTDQLIRSMCVSALEAGTLSTGYTIEWVMSLLLNNPHIMKKARDEIDACVGEPKRLLDATDLPKLPYLRCIILETLRLYPVVPLLVPRESSTNCTVNGFNIAKGTMLLVNTFAIHRDPRTWDDPETFLPERFEDGSNQAGKTTMDLSFGMGRRRCPAENLGMQLAGIALGTMIQCFNWERVGTELVDMAEGSGLTMAKKVPLEAFCQPRASMVDLLANI

SEQ ID NO: 65929 - protein, 254 aa, Rhizobium leguminosarum bv. viciae 3841
MIFDRFRLNGQVALVTGGTRGIGLAIAEALGEAGAKVIITGRTRNAAAEDRLSRAGVDCDFVAADLMKESAADELVTETLSRAGRLDILVNNAGIAIHGDSGEFSDAIWREIMTVNVDTVFRACRAALAPMRRQGGGAILNIGSISGIVSNIPQNQVAYNTSKAAVHMMTKSLASEVAAENIRVNAIAPGYIETDLSRGGIDNPDWFPTWRSMTPMGRVGQPEEVASAALFLCSAAASYVTGEVLVIDGGYTTR

SEQ ID NO: 65930 - protein, 156 aa, Synechococcus sp. CC9311
MVLQQTVKEVMSSPVLTVTPETALKDAVSLLSDHHISGLPVVDKSGLLIGELTEQDLMVRESGVDAGPYVMLLDSVIYLKNPLNWDKQVHQVLGTTVGDLMGRDLHSCLESLPLPKAASLLHERSTQRLIVVDDDKHPVGVLTRGDIVRALASEQP

SEQ ID NO: 65931 - protein, 406 aa, Triticum aestivum
  misc_feature (148)..(148): Xaa can be any naturally occurring amino acid
MDWAAVAYTAAALLCAAAATVITLGHIYRHLLHYAEPIFQRFIVRIIFMVPVYAVMSFISLILPDNAIYFTSIREIYDAWVIYNFFSLCLAWVGGPGAVVVSLNGRTLKPSWFLMTCCFPAIPLDGRFIRRCKQGCLQFVILKPILVXVITFILYAKGKYEDGNFSVNQSYLYITIIYTISYSMALYALALFYAACRDLLRPYNPVPKFIIIKSVVFLTYWQGVLVFLAAKSRFIKNAEKAADLQNYVLCVEMLIAAIGHLFAFPYKEYAGANARPSGGFRESLLHALKFNDFYHDTVHQFAPTYNEYVLYNHNEGESAPTKFPSGSAVPSVRDVELAGITVMPPSNSPVTSSVSSNHVDQDESMTTPIRNKVDPPGGMYDLTDLLDVDLSSYPAKVPAISDVRKQ

SEQ ID NO: 65932 - protein, 308 aa, Zea mays
MAPSRPLMRGIRPPRVFPTRGGRASPYAVALTALLLVSAALLALIAFGVFSLPVSAPNAAATTTAGGETESADTRPARPRARRDLGEGLGERGAQWTEVISWEPRAFVYHNFLSKEECEYLIGLAKPHMVKSTVVDSTTGKSKDSRVRTSSGMFLQRGRDKVIRVIEKRIADYTFIPVDHGEGLQVLHYEVGQKYEPHFDYFLDEFNTKNGGQRMATLLMYLSDVEEGGETIFPDANVNVSSLPWYNELSECAKRGLSVKPKMGDALLFWSMKPDATLDPLSLHGGCPVIRGNKWSSTKWMHIHEYKA

SEQ ID NO: 65933 - protein, 148 aa, Bacillus licheniformis ATCC 14580
MEKTFVMVKPDGVQRQLIGEILLRFERKGLQLIGAKLMKVSEETAGEHYKEHNGKPFFGELVDFITSGPVFAMVWEGEDAIAVARQLIGKTNPKEALPGTIRGDFGMFVGKNIIHGSDSPESAAREINLFFKEDELVEDEKLMNQWIY

SEQ ID NO: 65934 - protein, 320 aa, Bacillus licheniformis ATCC 14580
MKLTTFYSFLNDDIELIEKELEKTVHSDYPLLSEASLHLLQAGGKRIRPVFVLLSGMFGEYDISKIKNVAVSLELIHMASLVHDDVIDDAELRRGQPTIKAKWDNRIAMYTGDYLFARSLEAMTKINEPKAHEILSKAIVEVCLGEIEQIKDKYNMEQNLRTYLRRIRRKTALLIASSCQLGAIAAGAGENIHKTLYWFGYYVGMSYQIIDDILDFTSSEKELGKPVGSDLLQGNVTLPVLYARKSPELKARLMLVNSETTPEQIKPVIEELKKTDAIEQSFRVSEMYLNKAFELLETLPKNRARTALGQIAKYIGKRKF

SEQ ID NO: 65935 - protein, 365 aa, Robiginitalea biformata HTCC2501
MNDLICIFASLPRGNRRHAGISEAPGSEIKPIWMKKVTKEVYLKWYEDMLFWRKFEDKLAAVYIQQKVRGFLHLYNGQEAVLAGSLHAMDLEKDRMITAYRNHVQPIGLGVDPKRVMAELYGKVTGTSKGMGGSMHIFSKEHRFYGGHGIVGGQIPLGAGLAFADKYFERDAVTLCYMGDGAVRQGSLHETFNLAMLWQLPVVFICENNGYAMGTSVARTAHSTEIWKLGLGYEMPCGPVDGMDPVTVAEEVYKAVDRARTGGGPTFLEMKTYRYRGHSMSDAQHYRTKEEVEEYKKIDPITQVLDVIKDKRYATDEEISEIDKRVKQRVKECEKFAEESDFPPVEQLYDTVYEQEDYPFLAHKL

SEQ ID NO: 65936 - protein, 572 aa, Robiginitalea biformata HTCC2501
MAEIIKMPRLSDTMEEGTVAKWLKQVGDKIEEGDILAEIETDKATMEFESFYEGTLLHIGIEEGDGAPVDALLAIVGEEGEDISGLIDGAGSGDAGAGEDTKETVAEEAATGDGSEDAETASGDDAGGQAEVPEGVEIIRMPRLSDTMEEGTVASWIKKKGDAVEEGDILAEIETDKATMEFESFYSGTLLHIGIEEGESAPVDAVLAVIGPEGTDVEAVLSAGSGSGKPAATEEKGAEAKKESSEEKAASTDGAAAGREEARSGGSSSGDGRIFISPLARKMAEEKGIDLSDVEGTGDNGRIVKRDIENYTPSAKPAASVGEGAAKAPAEQAVPASAASMAPAGEESVEEVKNSQMRKVIAKRLSESKFTAPHYYLTIEVDMSQAMASRARINELPDTKVSFNDMVVKACAMALRKHPQVNTTWNGDTTKYNGHVHIGVAVAVEEGLVVPVLKFTDQMSLTAIGASVKDLAGRARNKKLTPAEMEGSTFTVSNLGMFGIREFTSIINQPNSAILSVGAIVEKPVVRDGQIVVGHTMTITLACDHRTVDGATGAQFLQTLRAYLEHPVTMLA

SEQ ID NO: 65937 - protein, 525 aa, Hordeum vulgare subsp. vulgare
  misc_feature (297)..(297): Xaa can be any naturally occurring amino acid
  misc_feature (331)..(331): Xaa can be any naturally occurring amino acid
MDMDQLCLMAVATILLTLILRQVLGGKGTGAKLPPGPWNLPVIGSLHHLVATKPPPHRALLSLSRRYGPVMLLRLGEVPNVIVSTPEAAVLVLKTNDLTFATRTSGPTLDVVGSASEGIIFAPYGEHWRQMRKVCVVELLSAMQVRRIQSIMQAEIAHLLESVAAASSASPFRSAVVDVGKGLARLTNNVIARAVFGGKSRQQEAYLRELGVMAILGGGFSLVDLFPSSRLVRWLSSSGRAMRRLHSRMQRILGDIIQDRKETRAPNGASDAATARDNEDLLDVLLRLGKQDALSFXLTSEIISAVIFDIFSAATDTTAATLEWAMAELVXNPQAMARAKLEVRQMLRHRRSSTITSADLAGLHYLRMVIKETLRLHPSAPLIHRASQENCRVMGYDIPKGTAVMINAFAVGRDPAHWGADAAEFRPERFQGTSVEYSSQGPHMEFVPFGAGRRQCPGALFATTMLELVLANLLYHFDWAIPGGESPEAMDMGEVFGIIVHTRSSLHLQASEACHLQDQTTGVVS

SEQ ID NO: 65938 - protein, 226 aa, Triticum aestivum
MDTIAAWPQFDGQEYRTVWPEEQEYRTVWSEPPKRRAGRNKLQETRHPVYRGVRRRGREGQWVCELRVPAGSRSYSTIWLGTFASAQMAARAHDSAALALSGRDACLNFADSAWRMMPVHAAGSFKLAAAQEIKDAVAVALKEFQEQQRPADESTAPSSTAEESALSIIPSDLSGLDNEHWIGGMEAGSYYASLAQGMLMEPPADGASWREDREHDDGFDTSLWSY

SEQ ID NO: 65939 - protein, 360 aa, Arabidopsis thaliana
MRTISDLPVALVEEILSRVPLTSLSAVRSTCKTWNALSKTQIFGKTRQQFLGFMMIDFGLYSIKFDLQGLNYESDFVEPSIKRVSILDQLDIFKVFHCEGLLLCVFRGNRWPVVWNPYLGGTGWIQPISDFHKYQVSDKFAFGYENKNHFFGFYDIYDLNSSAWKVLDVNPDCDIKCGVSLKGKTYFFAKEIAKAPNVKDFLVCFDFTAERFGPRLPLPFHSCGLFSEHVTLSCVRDEHLAVLYRRYNGVMEIYITTKIEPNEVFWSNFLKVDLTTFPDRFYGSRSHYFFIDEEKKVAVVFKNEPEWTMDCSYQTAYIIGKGGYLKSVKFGETPNDRKHNNAWNINSFMLSSYVPSLVQL

SEQ ID NO: 65940 - protein, 113 aa, Oryza sativa (japonica cultivar-group)
MGCAGSTPKTDDNSKKLKKPKPWKHNQAITTTQLKQMRDEFWDTAPHYGGQKEIWDALRAAAEAELSLAQTIVDSAGIIVSNSDMTICYDERGAKYELPKYVLSEPTNLIREG

SEQ ID NO: 65941 - protein, 578 aa, Hordeum vulgare subsp. vulgare
MGGGNGIVDGFRRLFHRRTPSGSVLGSSNQSSAGEDSSELEAVEDLDLVGLRPIRVPKRKMPLPVESHKKNIMEKEFFTEYGEASQYQIQEVVGKGSYGVVAAAIDTRTGERVAIKKINDVFEHVSDATRILREVKLLRLLRHPDVVEIKHIMLPPSRREFQDIYVVFELMESDLHQVIRANDDLTAEHYQFFLYQLLRALKYIHGANVFHRDLKPKNILANADCKLKICDFGLARVSFNDAPSAIFWTDYVATRWYRAPELCGSFFSKYTPAIEIWSIGCIFAELLTGRPLFPGKNVVHQLDIITDLLGTPSSETLSRIRNEKARRYLRYMRKKHPVPLTQKFPNADPLAVRLLGRLLAFDPKDRPSAEEALADPYFASLANVEREPSRHPISKLEFEFERRKVTKDDVRELIYREILEYRPQMLEEYMKGGDQISFLYPSGVDRFKRQFAHLEEHYSKGERGSPLQRKHASLPRQRVGASNDSNNEQHISDQEMSAEPDAHGAVSPQKPQDAPGVGQNGLSPTSLSSRTYLKSASISASKCVVVNPNKQPEYDDAISEETEGAVDGLSEKVSKMHA

SEQ ID NO: 65942 - protein, 290 aa, Helicobacter pylori J99
MDYKRFKGKHANIVIEIISLLEKGVKKAQEILEKPDAGSYTQLENSSGDTPIKADLALDKFLEETFLSLENVKSVFSEEKETPVTKENGSYLIAYDPLDGSSVMEANFLVGTIIGVYEKDYKAQNLVASLYVVFGHKIELVVALEEVYRYAFYQNKFHFIETIVLENKGKIIASGGNQKDFSLGLKKALEGFFAENYRLRYSGSMVADVHHVLVKKGGMFSYPQKKLRKLFEVFPLALMVEKAKGEAFYFDKGVKKRLLDQSVESYHEKSECYLASPHEAQILEKHLKGE

SEQ ID NO: 65943 - protein, 356 aa, Gaeumannomyces graminis
MSRAANPPSNSGSRKISFNVSEQYDIQDVVGEGAYGVVCSAIHKPSGQKVAIKKITPFDHSMFCLRTLREMKLLRYFNHENIISILDIQKPRSYETFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPQDVGSRLDLLEKLLAFNPVKRITVEEALKHPYLEPYHDPDDEPTAPPIPEEFFDFDKHKDNLSKEQLKQFIYQEIMR

SEQ ID NO: 65944 - protein, 445 aa, Nocardia farcinica IFM 10152
MSASPRATHASAAASARLFDRAAQVIPGGVNSPVRAFRSVGGTPRFIASADGYTLTDADGNEYVDLVCSWGPMILGHAHPAVVDAVRRAATGGLSFGAPTEAEVELAEHIVARVAPVDRVRLVNSGTEATMSAVRLARGFTGRTKIIKFAGCYHGHVDALLADAGSGVATLGLPTSPGVTGAQAADTIVLPYNDLDAVAAAFEANPGEIACVITEAAAGNMGAVAPLPGFNAGLRELTENHGALLIMDEVMTGFRVSRSGWYGREGVAGDLYTFGKVMSGGLPAAAFGGRAEVMNQLAPLGPVYQAGTLSGNPVAVAAGLATLRAADDAVYAALDRNAERLGGLLTEALTAAGVEHQVQFAGNMVSVFFSDRPVTDYATAKASQTWRFPAFFHALLDGGVYAPPSAFEAWFVSAALDEDAFARIAAALPAAARAAAAATPEGSRA

SEQ ID NO: 65945 - protein, 717 aa, Pseudomonas putida GB-1
MSPRTPKKTRSVAPSRIREGMPFPLGATWDGLGVNFALFSANATKVELCLFDSTGEQEIERIELPEYTDEIYHGYLPDAHPGLVYGYRVYGPYEPENGHRFNPNKLLIDPYAKQLVGSLKWSEALFGYTIGHPDGDLSFDERDSAPFVPKCKVIDPAFTWGRDQRVLIPWERTIIYEAHTRGISMRHPAVPEALRGTFAGLANDELLKHIKDLGVSSIELLPIHAFVNDQHLLDKGLNNYWGYNSIAFFAPHPRYLASGKIAEFKEMVAHLHDAGLEVILDVVYNHTAEGNERGPTLSMRGIDNASYYRLMPDDKRYYINDSGTGNTLDLSHPCVLQLVTDSLRYWAGEMHVDGFRFDLATILGRYHDGYSERHGFLVACRQDPMLSQVKLIAEPWDCGPGGYQVGNFAPGWAEWNDRFRDTARAFWKGDEGQLADFAARLTASGDMFNNRGRRPYSSVNFITAHDGFTLRDLVSYNHKHNEDNDENNQDGTDNNLSWNCGVEGPTDDPGINALRMRQMRNYFATLLLAQGTPMIVAGDEFSRTQHGNNNAYCQDSEIGWVNWDLDQQGEELLAFVKRLTRLRLAYPVLRRSRFLVGDYNEAIGVKDVTWLAPDGSEMTVEQWEDPHGRCLGMLIDGRAQVSGIARPGAEATVLLIVNAHHDIVPFKLPSVPEGEYWSCLVDTDRPELRKGQHLQFDSTFEVKGRSMLLMVLQRDEE

SEQ ID NO: 65946 - protein, 583 aa, Medicago truncatula
MDARRRLKSLPPRSPAGGENLKTQKLKSLPTTTTGENLNSQTVFLCVTNAVFFGVFFSVAYFLLHRWREKIRTETPLHVVTVSETAAIVSLIASAVYLLGFFGIGSRTSFPDDLSDEEILAKEDSRKPGPCPAALVDTDVKPPPATLTPIVAPVKIYEVVAPVNLTPEDEEIAKSVVTGSIPSYSLESRLADCRKAAAIRRSAVQTITGKSLEGLPLEGFDYDSILGQCCEMPIGFVQIPVGVAGPLLLDGVEYTVPMATTEGCLVASTNRGCKAIHVSGGASSVLLRDGMTRAPVVRFSSAKRAAELKFFLEDPLNFDTLAVTFNKSSRFARLQSLQPTIAGKNLYIRFRCSTGDAMGMNMVSKGVQNVLDFLQSDFPDMDVIGISGNFCSDKKAAAVNWIEGRGKSVVCEAVIKEEVVKKVLKTSVEALVELNMLKNLTGSALAGALGGFNAHASNIVSAVYIATGQDPAQNVESSHCITMMEAVNDGKDLHISVTMPSIEVGTVGGGTQLASQSACLNLLGVKGANTESPGANARLLATIVAGSVLAGELSLMSAIAAGQLVKSHMKYNRSSRDMSKIVS

SEQ ID NO: 65947 - protein, 364 aa, Aspergillus oryzae
MSSYNIVVFGGDHCGPEVTAEAIKVLRAVEKNCDVTFNLQDHLLGGASIDATGSPLTDEALNAAKNADAVLLGAIGGPKWGTGAVRPEQGILKLRKEMGTFGNLRPCNFAAPSLVESSPLRADVCRGVNFNIIRELTGGIYFGERKEDDGSGYAMDTEPYSRAEIERIIRLAAHLALQHDPPLPVWSLDKANVLATSRLWRKVVTEVMAKEFPQLKIEHQLIDSAAMIMVKNPRQLNGIVVTSNLFGDIISDEASVIPGSLGLLPSASLSGIPDGNSKVNGIYEPIHGSAPDIAGKGIVNPVAAILSVAMMMQYSFGLFAEARAIEQAVSNVIESGVRTGDIGGKATTAEVGDAVAAELEKLLK

SEQ ID NO: 65948 - protein, 232 aa, Triticum aestivum
  misc_feature (136)..(137): Xaa can be any naturally occurring amino acid
  misc_feature (190)..(190): Xaa can be any naturally occurring amino acid
  misc_feature (203)..(203): Xaa can be any naturally occurring amino acid
AYLGDFQQFVQKSRLVPVRNSRDIVDPRVRSSSNQAMSLAPSIPSIKVKVGRIAPPPPYRACRSFAVIRSSKAEGPRRPAAPPLSPPPPMPPKTPALSTPPSLSQPPTPVKPAQPSPPPPETKPAVATAAATPPVXXVVTFEYQRKVAKELQEYFKKKKLEETNQGPFFGWLAKNEIANGRWAMFGFAVXDANRVRNRLGFRXANEDPSLQFWDCGFGIEGLIVWSLVLNKA

SEQ ID NO: 65949 - protein, 170 aa, Geobacillus kaustophilus HTA426
MDLKQYITIVPDFPKPGIMFKDITTLMDNGPAYKYATDQIVQYAREKQIEIVVGPEARGFIIGCPVAYALGVGFAPVRKEGKLPREVVRVEYGLEYGTDVLTMHKDAIKPGQRVLITDDLLATGGTMRATIDLVEQLGGVVAGLAFLIELTELGGRKKLEGYDILTLMQF

SEQ ID NO: 65950 - protein, 530 aa, Ostreococcus tauri
MTTLELGTPVTMTVPRGADVRMNFTLRDDGADVVFELERVANYPMVYVERGSGEEEWYRRQVGAYRVPDGEGRYGDVPTRGSAGENIAYGMFGLAGNYRSMKFIGMRAGWYDVRVKAELVAGAYGDAEFKLTARSGAQTSGGPLCPYDCSNNGECVNSGSASGDDTKCACSSTPFAGVAGSLAPFGNACRDMYRHYGTATSATPVISLEPGKFWYGSYDLSGIYRYSGDGVEISFNWRGVGGDPLLLIKVQSEPTLVDYDYYYQRFLSNGVTTLSLKNVMSDVRYYFAIYNRDLPSGANVDFTIQVTRASWYSQREPPNLMSMAFVLFICVSFCMVVMTIRRFFQRRQLRRFREQRMTQLAFQDGTRGQQTGTPEEVVQALPIVKFDPVLKEVIESEGHDPTCTICLDDYTNGEELRRLPSCKHLFHKECADLWLRGSCTCPICRTSVIGESTSQDSAPAPGMTPQTPERSIELTSLGGEYATYVPQSQLPQMTVVVVPSRALDDLAVEARRREDGNARGWHHRDTSSIV

SEQ ID NO: 65951 - protein, 234 aa, Triticum aestivum
GLVASNIVFCLGVVLQTIATDIPLFVAGRFFAGYGVGMISATIPLYQSETAPKWIRGTIVGCYQLAITIGLLLAAIVDNATKDRDDTGSYRIPIAVQFAWAIVLFVGCIWLPETPRWFIKKGRPENAAKSLSTLRRLNVDDPALVEELAEITANHEYELSLGKATYADCFRGNLGKRLATGCLLQSLQQLTGVNFIFYYGTSFFQNSGIRNPFVVTMITSCVNVASTFPGLYLV

SEQ ID NO: 65952 - protein, 327 aa, Brassica napus
MEEIVVESLLRGNREAQIEAAIELSNLSRKQRQKVAEKDIISPLLSMLQSQDSLTTEVSLSALLSLAFGSERNKVRIVKAGAVQMLLEILQSETKMVIVELAMAFLLILSSCNRNKIKIASTKLIQLLVGLIGLDQLTVQAKLDGIATLHNLSTLQQIVPLVVSSGAPYALLQMINSCDKSSELAEKASSLLENIVHHSPESISGIGGAIEVLVEAIEEGSGQCKEHAVGILLGVCSFDRETNREMILREGVMPGLLQVSVDGTRRGKEMARELLLLLRDCSGYVIKDKQSKIEIVEQIMREIDQEGERIPGTMLKLVEEMISKLST

SEQ ID NO: 65953 - protein, 537 aa, Halobacterium sp. NRC-1
MRRERARILLDALLTLGPTFIKLGQLLSTRPDVLPTEYIEELAELQDRVPPADWAEAQRVIEDELGPVDDVFDAFNRESISGASLGQVYTADVDDQQVAVKVRRPGIESLVEADLRAIRWSIPIVVRFVGQGQAFSLENLADEFAKTIREEMDYSREGRMLTEIRANFADEPDIVIPTVYEEYSSDRVLTMQYIEGTKISDVDTLERRGVDRSQVSETLERAYLQMIIEDGVFHADPHPGNLAVQDDGSIVFYDFGMSGRVDSFIQDKIVEFYVGVANQDIDAILDALIDMGTLSPEADRAVMADVMELAIQDARGENIETYRVQQIVGKVEDTIYEFPLRLPPNLALVLRVATVVEGVCVTLDPEFDFITVATDYLAEQGYREESIRQFAAGTAEEFQAAATSVLRVPPKLERALDKVEREDLYVRADLEDSNRVIDALARRVVLGLVLATSVPTTAFLYVTADVTAAAISGAFTAAVGAALYKTFRRRNGLQASPQFTRQNLRERDGDGDDGGTALARSGSQIEADDAGTATNGD

SEQ ID NO: 65954 - protein, 280 aa, Fagus sylvatica
DACENWGFFELVNHGLPHELLDTVERLTKEHYKKCMEQRFKELVTAKGLEGVQTEVNDLDWESTFHVRHLPQSNISEIPDLEDEFRKVMKEFALKLEKLAEELLDLLCENLGLEKGYLKKAFHGSKGPNFSTKVSNYLPCPKPDLNKGLRAHTDAGGIILLFQDDKVSGLQLLKDGQWIDVPPMRHSIVINLGDQLEVITNGKYKSVLHRVIAQTNGNRMSIASFYNPGGDAVIYPATALVEKEAEEKNNVYPKFVFEDYMKLYAGLKFQAKEPRFEAMK

SEQ ID NO: 65955 - protein, 319 aa, Fagus sylvatica
MENFPVINLEKLNGEERGTTMEKIKDACENWGFFELVNHGLPHELLDTVERLAKEHYKKCMEQRFKELVTAQGLEGVQTEVNDLDWESTFHVRHLPQSNISEIPDLEDEYRKVMKEFALKLEKLAEELLDLLCENLGLEKGYLKKAFHGSKGPNFGTKVSNYPPCPKPDLIKGLRAHTDAGGIILLFQDDKVSGLQLLKDGQWIDVPPMRHSIVINLGDQLEVITNGKYKSVLHRVIAQTNGNRMSIASFYNPGGDAVIYPATALVEKEAEEKNNVYPKFVFEDYMKLYAGLKFQAKEPRFEAMKAVESNVTVGPIATA

SEQ ID NO: 65956 - protein, 226 aa, Hordeum vulgare subsp. vulgare
SLQAFIVHHPNGVAFYGVVLDGPGGSVATVTEYMANGSLRQALQRHEKIFDRRRRLLIVMDVAFGMEYLHGKNIVHFDLKSNNLLVNLRDPQRPICKVGDLGLSKVKCQTLISGGVRGTLPLMAPELLNGSSNLVSEKVDVFSFGIVMWELLTGEEPYADLHYGAIIGGIVNNTLRPLVPESCDPQWRSLMEQCWSAEPTERPSFTEVVKRLRAMATSPTKPLLQK

SEQ ID NO: 65957 - protein, 601 aa, Streptomyces avermitilis MA-4680
MTNKDARTPASSQTGEALASPQGDQEAGKSIGWHKAYVAGSRPDLRVPVRQVHLTNGESVTLYDTSGPYTDPSVDTDVRRGLAPLRENWIIARGDTEEYAGRPVRPEDDGIKHTSPRGGLRNLDAVFPGRPRQPRRGRDGQAVTQLAYARRGEITPEMEFVAVRENVSAEVVREEIAAGRAVMPVNVNHPEIEPMIIGKRFLVKVNANIGNSAVTSSIEEEVEKMTWATRWGADTVMDLSTGRNIHTTREWVLRNSPVPIGTVPLYQALEKVDGRAEELTWEIYKDTVIEQAEQGVDYMTVHAGVRLPYVPLTANRKTGIVSRGGSIMAAWCLAHHKESFLYENFEELCEILAAYDVTYSLGDGLRPGSIADANDEAQFAELRTLGELNRIAKRFNVQTMIEGPGHVPMHKIKENIDLQQEICDEAPFYTLGPLTTDVAPAYDHITSGIGAAMIAWWGTAMLCYVTPKEHLGLPNRDDVKTGVITYKIAAHAADLAKGHPGAQEWDDALSDARFEFRWEDQFNLALDPDTAREFHDETLPAEPAKTAHFCSMCGPKFCSMKISQDIRREHGGTRTEVEEGMAQKSKEFAAAGNRVYLPLAD

SEQ ID NO: 65958 - protein, 423 aa, Medicago truncatula
MASAMVEDANFEDDQLANMSTDDIVRASRLLDNEIRILKEESQRTNLELESYKEKIKENQEKIKLNKQLPYLVGNIVEILEMNPEDEAEEDGANIDLDSQRKGKCVVLKTSTRQTIFLPVVGLVDPDKLKPGDLVGVNKDSYLILDTLPSEYDSRVKAMEVDEKPTEDYNDIGGLEKQIQELVEAIVLPMTHKERFQKLGIRPPKGVLLYGPPGTGKTLMARACAAQTNATFLKLAGPQLVQMFIGDGAKLVRDAFQLAKEKSPCIIFIDEIDAIGTKRFDSEVSGDREVQRTMLELLNQLDGFSSDDRIKVIAATNRADILDPALMRSGRLDRKIEFPHPTEEARARILQIHSRKMNVHPDVNFEELARSTDDFNGAQLKAVCVEAGMLALRRDATEVNHEDFNEGIIQVQAKKKASLNYYA

SEQ ID NO: 65959 - protein, 458 aa, Helianthus annuus
MVSPSIEVLNSIADGKKYITSKELKKHNNPNDLWISILGKVYNVTEWAKEHPGGDAPLINLAGQDVTDAFIAFHPGTAWKHLDKLFTGYHLKDYQVSDISRDYRKLASEFAKAGMFEKKGHGVIYSLCFVSLLLSACVYGVLYSGSFWIHMLSGAILGLAWMQIAYLGHDAGHYQMMATRGWNKFAGIFIGNCITGISIAWWKWTHNAHHIACNSLDYDPDLQHLPMLAVSSKLFNSITSVFYGRQLTFDPLARFFVSYQHYLYYPIMCVARVNLYLQTILLLISKRKIPDRGLNILGTLIFWTWFPLLVSRLPNWPERVAFVLVSFCVTGIQHIQFTLNHFSGDVYVGPPKGDNWFEKQTRGTIDIACSSWMDWFFGGLQFQLEHHLFPRLPRCHLRSISPICRELCKKYNLPYVSLSFYDANVTTLKTLRTAALQARDLTNPAPQNLAWEAFNTHG

SEQ ID NO: 65960 - protein, 404 aa, Oenococcus oeni PSU-1
MTKLTVKDLDLKGKKVLMRVDFNVPIKDGVIGNDNRVVAALPTIKYVLEQGGKAILFSHLGRIKKAEDKPGLSLAPVAKHLSDLLNQEVVFPGKTEGKELEDAIDKLKDGQVLMVENTRYEDVDANGEYVKRESGNDPELGKYWADLGDDLFVNDAFGTAHRSHASNVGIASNVSKTAAGFLMEKEIKYLDEAVNNPKRPFVAVLGGAKVSDKIEVIKNLLSKADKVIVGGGMSYTFSNAKGVKIGNSLFEADKVSLAKEIMKEAGDKLVLPEDSVAAESFANDVPTKVFENGIPDGWMGLDIGPKTIEKFKNTLKGAKTVVWNGPMGVFEMSNFANGTLELGKFIGSLTSEGAATIVGGGDSTAAVSQLGIADQFTHISTGGGASLEYLEGKTLPGIAAISDK

SEQ ID NO: 65961 - protein, 277 aa, Magnaporthe grisea 70-15
MAHSHSHDGSAPHSHSHDGSTFNAQEHGHSHEILTGPGSYLGREMPIVEGRDFSERAFTIGIGGPVGSGKTALMLALCLALRDTHSLAAVTNDIFTREDAEFLTRNKALPPSRIRAIETGGCPHAAVREDISANLACLEDLHRTFNGVDLLLIESGGDNLAANYSRELADFIIYVIDVSGGDKIPRKGGPGITQSDLLVVNKTDLAEIVGADLGVMERDARKMREGGPTVFAQVKKSVGVEHIVNLILSAWKASGAEEIAKANGGPRPTEGLEELNA

SEQ ID NO: 65962 - protein, 633 aa, Mycobacterium sp. MCS
MDLPNDFRNVAIVAHVDHGKTTLVDAMLRQSGALSHRGDDAVERLMDSGDLEKEKGITILAKNTAVHRHHPDGTMTVINVIDTPGHADFGGEVERGLSMVDGVLLLVDASEGPLPQTRFVLRKALAAHLPVILVVNKTDRPDARIAEVVSESHDLLLDVASDLDDEAQKAAEEALGLPVLYASGRAGIASTTEPANGENPDGENLDPLFDVLLEHIPPPQGDPEAPLQALVTNLDASAFLGRLALIRIYKGRIRKGQQVAWMREVDGHPVVTNAKITELLVTVGVERTATDEAVAGDIVAVAGIPEIMIGDTLADPDHAHALPRITVDEPAISVTIGTNTSPLAGKVSGHKLTARMVKSRLDSELVGNVSLKVVDIGRPDAWEVQGRGELALAVLVEQMRREGFELTVGKPQVVTRTIDGKLHEPFEALTIDCPEEFVGAITQLMAARKGRMEEMTNHAAGWVRMDFIVPSRGLIGFRTDFLTLTRGTGIANAVFDGYRPWAGEIRARHTGSLVSDRSGSVTPFAMIQLSDRGQFFVEPGDDTYEGQVVGINPRAEDLDVNVTREKKLTNMRSSTADVMETLARPLELGLEQAMEFCAEDECVEVTPEVVRVRKVELDATLRARARSRAKARN

SEQ ID NO: 65963 - protein, 336 aa, Magnaporthe grisea 70-15
MVKCGINGFGRIGRIVFRNAIEHPDCEIVAVNDPFIEPKYAKYMLEYDSTHGRFKGTVEVSGSDLVVNGKKVKFYTERDPANIPWSETGAEYVVESTGVFTTTDKASAHLKGGAKKVIISAPSADAPMYVMGVNEKSYDGSASVISNASCTTNCLAPLAKVINDKFGIVEGLMTTVHSYTATQKTVDGPSAKDWRGGRGAAQNIIPSSTGAAKAVGKVIPALNGKLTGMSMRVPTANVSVVDLTCRLEKGASYEEIKAAIKEAADGPLKGILEYTEDDVVSSDMIGNNASSIFDAQAGIALNDKFVKLVSWYDNEWGYSRRVIDLVTYISKVDGGK

SEQ ID NO: 65964 - protein, 520 aa, Zea mays
MERFYYVAVATFVLVFLLHHLLTRKKQQRLPPGPRFAYPILGHLPLLKKPLQTSFADLVSRHGPIIHLRLGRRHAVVVGSAAVAKECFSGELDVAIANRPHFPSAREVTFDYSVLTAVNYGALWRTMRRVSTVHLLSAHRVNVMSDTVIARELRVMVRRLARASASAPGDAARVELKRRLFDLSHSVLMEIMAQTRNTYSDDPEEDMSREARDMKDIIEEIIPLVGAANLWNYVPLLRWLDLYGAKRKLADVVNRRDLIFDNMIGAERQKLRQLERKKGEAHASESDKMGMIGVMLSLQKTEPDVYTDTFINALVSNLLAAGTETTSTTLEWAMSLLLNHPDVLKRAQEEIESNVGRDRLLDKNDLPRLPYLHCIISETLRLYPPTPMLLPHEASTDCKIHGYDVPAGSMVLVNAYAIHRDPAMWEDPEEFRPERFELGRAEGKFMMPFGMGRRRCPGENLAMRTMGLVLGALLQCFDWTRVGDREVDMATATGTIMSKAVPLEAQCKPRANMSAVLQKI

SEQ ID NO: 65965 - protein, 130 aa, Aspergillus oryzae
MVKTSVLNDTLNAINNAEKAGKRQVLVRPSSKVIVKFLSVMQKHGYIGEFEEVDDHRSGKIVIQLNGRLNKCGVINPRYPVQLRDLEKWTTQLLPSRQFGFVVLTTSAGIMDHEEARRKHVAGKLLGFFY

SEQ ID NO: 65966 - protein, 402 aa, Ehrlichia ruminantium
VELDDQKITLPILYDTEGNEVLDITSLYKNTGVLTYDPGFMSTAACESKITFINGNKGILRYRGYDIADLVYNNKSFIEVVYLLFYGVFPNAEQLQEFMLHISQEYVLPQMVRNVIMSFPQNSHPMAILIASFSSLAAYYCDQKTDGELECKLAVAKVASIVALIYRHITNQDFIQADVGLSYSKNFIHMMFDISSYKFTEIVDKALDVIFVLHADHEQNASTATVRMAGSSGPNLFACLAAGAATLWGPAHGGANEAVINMLMNIGKPENVKQFIQKVKDSNKGTKLMGFGHRVYKNYDPRARIMCTICKEILKDFGLNDPLLEVAVELENIALQDDYFIARNLYPNVDFYSGIVLKTIGIPVKMFTTLFALARTSGWSAQWYEMVSSKNYKISRPRQLYT

SEQ ID NO: 65967 - protein, 512 aa, Mycobacterium avium subsp. paratuberculosis K-10
MLSKCSALSAVGAGHDGSPEDSPEERDQMTVQAVLDDIRKRPGTGDVIAVIDPATEEKITEFTDCGAEAVDEAAARAKASFESGVWSQLPGRERAKILWRIGDLIDEHAEEFAQLDSLNTGMPLLQAQLQMSTCSEFFRYYAGWCSKINGTAYDVKTDGIATDTFVNMHAYTLKEPYSVVGLIFPWNGPIFNANAKLAPALAAGCSLLVKPAEETPLSALLLDRLVHEAGVPEGVVNLLTGYGHTAGAAITAHPDVEKVAFTGSTEVGKEIVRASAGNLKKVTLELGGKSPVLIFDDADLDKAILMASLGIFVHSGQGCVCGSRIFVQRGVYDRVVEGIAMMANTFKLGAPSEEGCVSGPLISQKQLNRVMGFIDEGKNDGVEVVTGGYRLDRKGYFVHPTVLTNVDPGMRLYQQEIFGPVVAILPFDDEDEAVAMANDTTYGLAATAWTENLGRAHRIVKRLQAGSVQVNCQLVFDHDVPFGGYKQSGWGHEFGKEGLEIYLKTKSVWAQL

SEQ ID NO: 65968 - protein, 492 aa, Ostreococcus tauri
  misc_feature (1)..(2): Xaa can be any naturally occurring amino acid
XXLDLGAAVNKNVQRCKFKKPTPVQKYAIPSALQGRDLMACAQTGSGKTAAFCFPIIAGILKKGLQGGHMNRKTYPLALVLSPTRELASQIHEESRKFAYQTGVASCVIYGGAPAVEQFRAMERGCDLLIATPGRLIDLIDRAKISLSRCVYLALDEADRMLDMGFEPQIRQIVEQRDMPPCGERQTMLFSATFPREIQRMAADFLDDYIFLTVGRVGSSHALITQSVERVNSYHEKSEMLLDLVEAVPGLTLVFVETKRGADQLEDFLFTNGKPATSIHGDRTQQEREAALKSFRSGKTPILVATDVAARGLDIPHVTHVINFDLPSDIDDYTHRIGRTGRAGKKGRATALFLESKDGQIARSLVDLMSEANQEVPTWLTQVSGNSFGGGGRRRGGGGGNRFGGRDYRSGGGGGGGGGGGWGREVLRIFSGRSSRHPHNRARRVMKFGQLFAASTASTAPSVREQVRARVGRRHGVATTIAATMTRGEFSG

SEQ ID NO: 65969 - protein, 368 aa, Triticum aestivum
MMNPKSRVQEWEAEHIDLIPGMPDDIAVDCLARVPHGSYRSMRRVCRGWRSAAAAPDFALARAEAGANEDLVFLMQFGNPVAGDGGAPENTPAYGVAVYNVTTGEWHRESSAPPVPMFAQCAAVGTRVAVMGGWDPNTFEPVADVNVLDATTGVWRRGAPMRSARSFFACAEAGGKIYVAGGHDKLKNALKTAEAYDAEADGWDPLPDMSEERDECDGMATVAGDRFLAVSGYRTGRQGGFERDAEWFDPATREWRRLERVRAPPSAAHVVVRGRVWCIEGTAVMEWRGERRGWLEVGPYPPGLKAGTARAVAVGGGERVVVTGAIESEGGGGGHALWVFDVKSKNWTVVRPPPQFAGFVFSLASVRV

SEQ ID NO: 65970 - protein, 385 aa, Oryza sativa
MGGDLYALDFDGVLCDSCGESSLSAVKVTPRASSSFRPVSWMGPSVRALMMAALVRQAAKVRWPWVFEQVDAAMEEWIVEQMYTLRPVVETGYENLLLVRLLIEIRIPSARRSSLYQMFMPRLYCKVADGLSIQEILENWLKLKPTIMSEWNEDRDSLVDLFGSIRDDWIENDLSGWIGANRFYPGTADALKFSSSEVYIVTTKQGRFAEALLKELAGIEFPSERIYGLGTGELCGGNGDAKAGELHDLDALMQWSCFANRHLFFLDRAPSNFLPLGLSSTLVSQVGSSQAHGSQRSTVPAQWLWVSQQEEVQCWRKEKSKLDILLGFVEDRLATLKNVIKEPALDQWNLYLVNWGYNTPKEREDAEGISRIQVIDLPGFSQKLK

SEQ ID NO: 65971 - protein, 453 aa, Atriplex hortensis
MSSYDPENAATNGVPPVKNDNSNHQQQHQQTVVVPETAHQISTDSWLQVGFVLTTGINSAYVLGYSGAIMVPLGWIPAVLGLIAATLISLYANSLVAKLHEYGGKRHIRYRDLAGFIYGPKAYSLTWALQYINLFMINTGFIILAGSSIKAAYHLFTDDPALKLPYCIIISGFVCALFAIGIPHLSALRIWLGVSTFFGLIYIIIAIALSLKDGINSPPRDYSVPTERGKVFTTIGAAANLVFAFNTGMLPEIQATVRKPVVGNMMKGLYFQFTAGVVPMYAIVFIGYWAYGNKTDSYLLNNVHGPVWLKALANISTFLQTVIALHIFASPMYEYLDTRFGITGSALNPKNLGSRVLIRGGYLAVNTFVAALLPFLGDFMSLTGAISTFPLTFILANHMYFKAKRNKLSMAMKIWLWINIVFFSCMAVASFIAALRLIATDSKQYHVFADLEG

SEQ ID NO: 65972 - protein, 352 aa, Oryza sativa
  misc_feature (114)..(114): Xaa can be any naturally occurring amino acid
  misc_feature (142)..(142): Xaa can be any naturally occurring amino acid
MVHPAQGQMVQDLAAGGELGAPPSRYVLREKDRPVAAAGAVQAAQRELAAIPTIDVSRLAAESGDDVVDDGGEAAKLRSALQSWGLFAVTGHGMPEPFLDEILAATREFFHLPXEEKERYSNVVAAADADGVGAGGERFQPXGYGIDRVDTDEQILDWCDRLYLQVQPEEERRLEFWPEHPAALRGLLEEYTRRSEQVFRRVLAATARSLGFGEEFFGDKVGEKVTTYARFTYYPPCPRPELVYGLKPHTDNSVLTVLLLDKHVGGLQLLKDGRWLDIPVLTNELLVVAGDEIELFALLGVADHEQVFMAPVHRVVTSERERMSVVMFYQPEPHKELAPSEELVGEERPAMY

SEQ ID NO: 65973 - protein, 240 aa, Atriplex hortensis
MSYSYPPPLPSNTLNNFLSPKPVTMKTTGGPPKPTKLYRGVRQRHWGKWVAEIRLPKNRTRLWLGTFDTAEEAALAYDKAAYKLRGDFARLNFPNLRHEGSHIGGEFGEYKPLHSSVNAKLEAICESLAKQGNEKQGKSGKSKKKDVANNNNNTSSSSSSSCCTTATAAADAPQQQQRMPENGGDVKTESTSDSEVGSGGSSPLSDLTFGDNEEMGSENFLLESCPSHEIDWDAILSSES

SEQ ID NO: 65974 - protein, 424 aa, Marinobacter sp. ELB17
MTDRKATLTVGNKSLELPVYSGTVGPDVIDVRSLVQQGVFTYDPGFVSTAACESAITFIDGDKGVLLHRGYPIEQLAEHSDYLELCWLLLHGELPTAEENKAFHETIKNHTMLHDQMRNFFNGFRRDAHPMAIMCGVVGALSAFYHDQMDVTDEHQREITGHRLIAKMPTIAAWCYKYSMGQPFIYPRNDLSYAENFLQMMFATPCEEYKPNPVLANAMDKIFILHADHEQNASTSTVRLAGSTGANPYACMASGIAALWGPAHGGANEAVLAMLAEIGDEANIETFIDKAKDKDDPFRLMGFGHRVYKNFDPRAKVMAETAHEVLTELGLENDPLLRIAKRLEKIALEDEYFVERKLYPNVDFYSGLILKAIGIPTSMFTVVFAMARTIGWFSHWNEMVSGEYRIGRPRQLYTGSPKRDYPKD

SEQ ID NO: 65975 - protein, 224 aa, Brassica napus
MESLGLRAVGSHCSLSEMDDLDLNRALDRPRLKIERKRSFDERSMSELSRHDSPRGRSVLDTPLSSARNSFEPHPMMAEAWEALRRSMVFFRGLPVGTLAAVDNTTDEVLNYDQVFVRDFVPSALAFLMNGESDIVKHFLPKTLQLQDSEKRVDRFKLGKGVMPASFKVSHDPIRETDHLVADFGETAIGRVDPVDSGFWWIILLRAYTKSTGEFESLGRTPEV

SEQ ID NO: 65976 - protein, 277 aa, Staphylococcus epidermidis ATCC 12228
MGGYIVMKTLDSVNIPIRKDETHKGDYGKILLIGGSANMGGAIMLAARACVYSGSGLITVATHPNNHAALHSRCPEAMVIDINDTKMLTKMIEATDSILIGPGLGVDFKGNNAITFLLQNIQPHQNLIVDGDAITIFSKLKPQIPTCRVIFTPHQKEWERLSGIPIEEQTYERNLEAVERIGATVVLKQHGTEIYFCNDDVYKLPIGTPAMATGGMGDTLAGMITSFVGQFDNFKEAVTSATYMHSFIGEKLSDTMYVVPPSRLISEIPYVMKQLEG

SEQ ID NO: 65977 - protein, 304 aa, Shewanella sp. MR-4
MPEQALLEEVVDKVRPLLGQGKVANYIPALANVDAGKLGIAVTTIDGETIGAGDYLEPFSIQSISKVFSLTLALTLYEETEIWSRVGKEPSGHSFNSLVQVELERGKPRNPFINAGALVIADLLQSRLGAPKHRMLELVRALSQNDKVCFDKQVADSEYQHSARNAAIAYLMKSFGNFQGDVDTVLRTYFHYCALKMNCADLSRAMLYLANRGKTLDGTELISQVQTRQLNALLATSGLYDGAGEFAYRVGMPGKSGVGGGIIAVIPGELSVCVWSPELDNQGNSLAGTAMLEHLSQRLGRSIF

SEQ ID NO: 65978 - protein, 286 aa, Oenococcus oeni PSU-1
MNKKIIEKEILSKVIKKRKEGSNKTNYGRILLICGSQSFGGAAIMASKAVVYSGAGLVTLASDMINRAPFLSSVSEAMFLDYTRTDKLINSIAKSDVILIGSGLEDSDFSFSLLKLVFQNAKTNQLLVLDGTALSMIGKRNLNIPKKPTIIMTPHQGEWQRVSGLSISEQVPVQNYKKMVDLNIDFLVLKSSATEIYALQNPREYKELNIGGPFQAIGGMGDTLAGLIAGFLGQFKNDQISVIQAATYLHSYIARNLSQKQYVTLPTRISEQIPTEMKKIIQTSKY

SEQ ID NO: 65979 - protein, 211 aa, Magnaporthe grisea 70-15
MADLGGFLPNAVVLIGDSGVGKSNLLSRFTRNEFNLDSKSTIGVEFATRSIQVDSKTIKAQIWDTAGQERYRAITSAYYRGAVGALLVYDISKHQTYENVTRWLKELRDHADANIVIMLVGNKSDLRHLRAVPTEEAKAFASENHLSFIETSAFDASNVELAFQNILTEIYRIVSSKALDSGDTPSMPQTGTNIALSNPTEDSAAKNGKCC

SEQ ID NO: 65980 - protein, 632 aa, Burkholderia vietnamiensis G4
MRKVQCCTARSQRAGAEFIIADRGHKRIAAVCRGFSCTEEVRVSFTLHGIPVSRGIAIGRAYLIAPAALDVAHYLIDTSQIDAEVERFRAAREGVHRELEALRADLTDDTPTEVGAFIDVHAMILSDAMLVQETIDLVRTRRYNVEWALTEQLELLTRHFDDIEDEYLRERKADIEQVVERVLKALAGAPSASQALDRAAAQGQNEMIVVAHDIAPADMMQFKSQSFQAFVTDLGGRTSHTAIVARSLGIPAAVGVQHASALIRQDDLIIVDGDQGIVIVDPAPIVLEEYSYRQSEKLLEQRKLQRLKFSPTQTLCGTKIDLYANIELPDDAKAAVEAGAVGVGLFRSEFLFMHQKQMPEEEEQFAAYKRAVEWMKGMPVTIRTIDVGADKPLEALDEGYETAPNPALGLRAIRWSLSEPQMFLTQLRAILRASAFGQVKILIPMLAHAQEIDQTLDLIREAKRQLDDAGLAYDPNVRVGAMIEIPAAAIALPLFLKRFDFLSIGTNDLIQYTLAIDRADNAVAHLYDPLHPAVLHLIAYTLREAKRAGVAVSVCGEMAGDPALTRLLLGMGLTEFSMHPSQLLVVKQEILRAHLKALEKPTADVLAAFEPEEVQAALQRLAVAEPRADAAA

SEQ ID NO: 65981 - protein, 344 aa, Aspergillus oryzae
MSQNKALVFKKIPQGYPVPGQDIVVEPVSVDPNSPAPANGVVLQSLYTSLDPYMRGRMRPAEVKSYSPAFAMDKPIDSSSIAKVLRSNNSKYKEGDLVIGFVPIQEYIVLDEQSIVRIRPLENPLGIEDIRVFLGALGMPGLTAYSSLYEIGKPKKGETIFVSAASGAVGQLVGQLAKHEGLKVIGSVGSDDKLEYITKELNFDGGFNYKNEKPADALARLAPEGIDIYYENVGGEHLEAALDAMNNFGRVVVCGMISQYNSAPYPIKNIQYVLTKRLTMRGFIVGDAGMGDKYTKEHQENVQKWIKDGSFKALTHETVGIDNSADALLGIFHGKNKGKAVLKF

SEQ ID NO: 65982 - protein, 403 aa, Vibrio cholerae O1 biovar eltor str. N16961
MTVEMSVDRSSFDEVMVPCYNPMEFIPVKGFGSRIWDQQGHEYIDFAGGIAVSCLGHCHPVMVQALTTQANKLWHLSNVMTNEPALRLAKKLTQVSFAEKVFFANSGAEANEAALKLARRYAADVYGPEKSEIIAFNQGFHGRTFFTVSVGGQATYSDGFGPKPGDIVHLPYNDLAALQAQISDRTCAVMMEPLQGEGGIVSPSAEFVQAVRELCDKHNALLIFDEVQTGNGRTGDFYAYQGIGVTPDILATAKSLGGGFPIGAMLTTAKIAEHMKVGVHGSTYGGNPLACAVAEAVVDFVAQPEILAGVKQREQWMRAELEKINQKYQLFKEIRGKGLLLGAALNDEWQGRARDILVAAGKQGLMVLVAGASVVRFTPSLIISQQEIEEGMARLDKAIATLM

SEQ ID NO: 65983 - protein, 377 aa, Bacillus anthracis str. Ames
MKAVTYQGPNQVQVKQVDDAKLEKKDDIIVKITSTAICGSDLHLYQGNMPLPQGYIIGHEPMGIVEEVGPDVTKVKKGDRVVIPFNVACGHCFYCQHEMESQCDNSNPHYDSGGYFGYTEKFGNHPGGQVEYLKVPFGNFTPFVIPESCELEDESLLFLSDVLPTAYWSVINAGVKPGDTVIVLGCGPVGLMTQKFAWMHGAKRVIAVDYLDYRINYAKKINNVEVFEFTKFPDMGEHLKEITHGGADVVIDCVGMDGKKSPLEFLEQKLKLQGGTLGPIQIATKAVRKYGTVQMTGVYGGNYNAFPLGAFWVRNINLKMGQAPVIHFMPELFEKITNKEFDPKEIITHKIPLEEASYGYQIFNNREDDCIKVILKP

SEQ ID NO: 65984 - protein, 1113 aa, Ostreococcus tauri
MQTLSSELKKFNVFFMNREEEIVMKEGHMQQVFEQNEERIASAINAGAYTNECLLSDTQLCQKFANFHGELVLLEHWTNLNYAALVKILKKHDKRSNLSLRSPILGNVLQQPFYNVEVLTAMIGRAEERFRTIEQRIRGFVGEHAAPSALEGMPPVNLRISSDGSEISDDEEDMYSIEHTKAALNCWQGLEKSECMKNPLVFIGFITTLGTIFDAISLLTSRVLSRRGEPDARRRATDRTPSRASSGFARTRPTARERSRPCRAARGSRHRAPRLGTGRAPVSSRHVSRRFEDESNDAADAIARETSASAPSASADEAMKRELDKNGSSSPRCADWTPRRVATQFLNAKLSVPRESFEEFMAFIVAESTISLTRAWLERIEARSASKVGSSTPRVVLSAYMIVHHSDVVMGGSSPEEVSLLTSSRELVQALEAVAAALAGSTASPRDVDSLVARFGRSWNAFYCDWTVWKTKDAQSLENELVRIGVAMEASMFNVCGPNALDESVCLGEERNAIREAQKRDRALLREKISRLSGDDAAQRFDAMICCVREDALRQSESKSGDESSSDAQGNLEQRREAREAMNKRMADAIANDKARSVQYDEETMDSVESQKDRILHELMINPEFKLSLAEHEAGSLRTAVEEAMTQAFWDVAYESLIGNSVSIVRERIIEWKDCAIDEALSSEDMSTQRLKDLKDQLVLIDVDDLERCILHMETHPLDACAALRKALDYGYTALKILCDDDETNARLEIEHETLIHKLQTTTEDKKSISRSIVDALAFLFSFREKIHTTKYLNAANLVIDDLRSGIAASSKEGFEYARERFLRRHGVCTGETDVEIYKLKFPRTLGWLEAVADDLVRLDAQENMMTLRRNSDATWRGIKLQSGLIGCAKERPQLAYIVAADLHSTAIMTIEGACRVALARLISNRNAIEQEFYPETLEFDLERLDRMWAEFQQLRVLAACSALCRQINVRADIVLERVSLLLNDPHEVSSVDKIAELIRDACEHKRDEATTIANMLRKLTGEEALAVRIVDILRSALAVRLLYGFQDDTKAYRAVESTFAAFGPVAARLLRERVDDIARQAAVVVNLQSHVCIDVLNALAGELLSKVDPDEI

SEQ ID NO: 65985 - protein, 684 aa, Geobacter metallireducens GS-15
MEQYAVYFALACAVAAVAYGLVSAQWILGLPQGNDRMRQIAAAIQEGAGAYMKRQYTIIAVVGVIMFIALFATLGMKTAIGFAIGALFSGLTGFIGMFVSVRANIRTTEAAKSGIHKALNVAFKGGAITGMLVVGLGLLGVAGYYFILQQVMPGAPVKEVVSQLVGLGFGGSLISIFARLGGGIFTKGADVGADLVGKVEAGIPEDDPRNPAVIADNVGDNVGDCAGMAADLFETYAVTLIAAMLLGAIAFTGNVAAVNYPLILGGISIVASIIGTFFVKLGGNQKIMPALYKGLIASGVLACIAFYVVTAQMFPQGLTTAAGVTYSATNLFISAIVGLVVTGAIFWITEYYTATEYGPVKHIAQASTTGHATNIIAGLGVSMKSTAMPVIVIAAGIIVAFQCAGVYGIAIAAVSMLSLTGIVVAMDAYGPITDNAGGIAEMAELDDSVRAVTDPLDAVGNTTKAVTKGYAIGSAGLAAVILFTSYVDELKLAGKIIDFNLADPYIIVGLFLGGMLPYYFAALCMEAVGKAGGSVVEEVRRQFREIKGIMEGTGKPDYASCVDIVTRTALKEMVIPGIIPIAAPIIIGFTLGPKALGGVIVGTIVTGIFVAISMTTGGGAWDNAKKYIEDGYHGGKGGDAHKAAVTGDTVGDPYKDTAGPAVNPMIKIINIVSLLIVPLLAKLG

SEQ ID NO: 65986 - protein, 410 aa, Marinobacter sp. ELB17
MSTEIKAPVFPESVAEGTVATWHKQPGEACARDELIVDIETDKVVLEIVAPADGVIEEILKNDGDTVESGEVIGRFKAGAASESKDSGSKDAVESKDQGADAASSSDAILSPAARKLADENNVEPSALKGTGKDGRISKEDVQSHIDNAKASIESPAAKAAAEPAHAAAPVAEISAGERIEKRVPMTRLRASIAKRLVNAQQSAAMLTTFNEVNMGPIMELRKQYKESFEKRHGIKLGFMSFFTKAATEALKRFPAVNASIDGNDMVYHGYQDIGVAVSTERGLVVPVLRDVDALSLADIEKKIVEYGTKAKTGKLGIDEMTGGTFTITNGGTFGSLLSTPILNPPQTAILGMHKIQPRPMAVNGQVVIQPMMYLALSYDHRMIDGKEAVQFLVAIKEMLEDPARILLDV

SEQ ID NO: 65987 - protein, 191 aa, Oryza sativa (japonica cultivar-group)
MLPRSQSIFHLGEEGGVVHCHRGGNHLVAASMGMGGAGGHYGSGTRGGGRRARERERLVVGLQIIVHSQHHHGRHAHAHAASVVLKQMVRPRAAAAAAAGRHGAVSCSFLKACSLCRRELSPTKDVYMYRGDQGFCSEECRWQQIAVDEAREREAVAAAGRPERRGLARHHSPHRAAAPVRGRPRKTLAVA

SEQ ID NO: 65988 - protein, 479 aa, Marinobacter sp. ELB17
MADKFDVIVIGAGPGGYVAAIKAAQLGLNVACVESWSSDEGKQVLGGTCLNVGCIPSKALLEISHKYEEAQHGFAEQGIIANDISIDIAKMMERKTGIVKQLTGGIAGLFKSNGVTSIYGHGKLLANRQVEVTDNDGKTKTYEADNVILATGSRPIEIPPAPKTEGYITDSEGALEFTEVPKRLGVIGAGIIGLELGSVWARLGSEVTLLEAQDTFLPGVDQQIAKATLKEFQKQGLNIVMGGRVTGAEVKRKLVYVSYEDSKGKQELMVDKLIVAVGRRPFTDNLLAADSGVNMDERGFVFVDDHCKTDAPGVWAVGDVVRGQMLAHKASEEGVMVAERIAGHKPQVNYDCIPNVIYTSPEVAWVGKNEEQLKADGAAYKVGTFPFAANGRAMAANSAVGMVKIIADEKTDRILGFHVLGPAASEIVAQGVIAMEFGSSAEDLALTCFAHPTLSESVHEAALAVNGGAIHMANRRKKK

SEQ ID NO: 65989 - protein, 1006 aa, Desulfovibrio vulgaris subsp. vulgaris str. Hildenborough
MDQQHLDGKVVERGKEFFRSISGEAPSIFNKGWWTGKVMDWAMQNEDFKVQLFRFVDVLPYLNTSESLLRHIREYFATEDADIPPVLKWGAGKAGIGGALTAKLMGMTIRSNIEGMARQFIIGDNSKEAVKGLAKLRKDGFTFTVDLLGEATVSEEESEAYAQGYHEVVDAIAREQEKWKALPGNGPVEGFDWGATPKVNVSIKPSALYSQAKPVDVEGSVRGILSRLVPIYRKVVAMGGFLCIDMEQLKYKEMTLELFKRLRSDPEFRHYPHLSIVLQAYLRDTEKDLDDLLHWARSEKLPIGIRLVKGAYWDYETVIAKQNGWEIPVWTDKPESDIAYEKLAHRILENSDIVYFACASHNVRTIAAVMETALALNVPEHRYEFQVLYGMAEPVRKGLKNVAGRVRLYCPYGELIPGMAYLVRRLLENTANESFLRQSFAEGAALERLLENPQKTLHRLLAARPEPRAVEPGPGGLPPFTNDAMIDFTVPDNRKAFVEALADVRSRFGQTVPLYIGGRDVTTADLIPTTNPAKPAEVVASICQAGRPEIDDAIAAAKKAALTWRDTSPADRAAYLRRAADICRKRIWELSAWQVVEVGKQWDQAYHDVTEGIDFLEYYAREMLRLGAPRRMGRAPGEHNHLFYQPKGIAAVIAPWNFPFAIAIGMASAAIVTGNPVIFKPSSISSRIGYNLAEVFREAGLPEGVFNYCPGRSSIMGDYLVEHPDISLICFTGSMEVGLRIQEKAAKVQPGQRQCKRVIAEMGGKNATIIDDDADLDEAVLQVLYSAFGFQGQKCSACSRVIVLDAIYDRFIERLVKAASSIHIGPSEDPSNYMGPVADATLQKNVSDYIRIAEEEGRVLLKRTDLPAEGCYVPLTIVGDIRPEHRIAQEEIFGPVLAVMRAATFDEALSIANGTRFALTGAVFSRSPEHLDKARREFRVGNLYLNKGSTGALVERQPFGGFAMSGVGSKTGGPDYLLQFMDPRVVTENTMRRGFTPIDEDDDWIV

SEQ ID NO: 65990 - protein, 313 aa, Magnaporthe grisea 70-15
MAAVFKALSKGAGGDKSSEAASAPRKNKQRVLILSSRGVTFRHRHLLNDLAAMLPHGKKDVKFDSKSKLYQLNELAELYNCNNVLFFEARKGQDLYVWASKVPNGPTVKFHLQNLHTMDELNFTGNCLKGSRPVLSFDSAFDKDPHYRVIKELFLHIFGVPEGARKSKPFVDHVMGFSIADGKIWVRNYQINEVEKTKGEDGEDGEAKKEKKSSRKPDAKDTDINLVEIGPRFVLTPVVIQEGAFGGPIIYENKQFVSPNQVRADLRRKKAGRHQMRSGQQADLMAKKDGLGLRTEGSKKQREDELDTRKIFA

SEQ ID NO: 65991 - protein, 544 aa, Oryza sativa (japonica cultivar-group)
MVAGGGNGGAAVLVGITVLLFVVVVVVVVLVRWWSGGEGGAAPSPPALPVLGHLHLLKKPLHRSLAAVAAGVGAPVVSLRLGARRALVVSTHAAAEECFTACDAALAGRPRTLAGEILGYDHTIVLWTPHGDHWRALRRFLAVELLSAPRLAALAADRHAEAASLVDAILRDAAGGAKVTLRPRLFELVLNVMLRAATTRRRHASVDARKLQEIIEETFSVNGTPSVGDFFPALRWVDRLRGKVGSLKKLQARRDAMVTGLIDDHRQWRSGSAGDGDQDKEKKGVIDALLALQETDPDHYTDNVVKGIILFSITVPLLHFYSIVINMYNGFDHGVQSLLFAGTDTSALTIEWAMAQLVTHPETMKKARAEIDANVGTARLVEEADMANLPYIQCVIKETLRLRTAGPVIPAHEAMEDTTVGGFRVARGTKVLVNAWAIHRDGDVWDAPEEFRPERFVDSDAGGAVTAPMMPFGLGRRRCPGEGLAVRVVGVSVAALVQCFDWEVGDDDVVDMTEGGGLTMPMATPLAAVCRPREFVKTILSTSM

SEQ ID NO: 65992 - protein, 573 aa, Geobacillus kaustophilus HTA426
MAKVELKAPDGPPSDVERIKQESRYLRGTLAETMEDPLSAGIPDDDNRLMKFHGSYLQDDRDVRTERQKQKLEPTYQFMIRVRTPGGVATPEQWLVMDELARKYANGTLKLTTRQAFQLHGVLKWNVKKTMQAINGALMTTLAACGDVNRNVMCNPNPYQSEVHAEVYEWAKLISDHLLPRTRAYYEIWLDDEKVAGTPPVDGEEEPIYGPTYLPRKFKIGIAVPPSNDVDVFSQDIGFIAIVEDGKLAGFNVAIGGGMGMTHGDKTTYPQLAKVIGFCKPDQVVEVAEKIMTVQRDYGNRSSRKHARFKYTIDRLGLEAVKEEIERRLGWRLGEARPYHFEHSGDRYGWVEGVNGTWHFTLFVEGGRVKDYDDYKLMTGLREIAKVHTGDFRLTPNQNLIIANVTSEKKPEIEALIAKYGLTDGRRYTALRRNALACVALPTCGLAMAEAERYLPKLLDKIEEIIDENGLRDEEITIRMTGCPNGCARHVLAEIAFVGKAVGKYNMYLGAAFNGTRLGKLYRENIGEEEILRELRMLLSRYAKERLDGEHFGDFVIRAGIVKEVTDGTNFHD

SEQ ID NO: 65993 - protein, 245 aa, Nocardia farcinica IFM 10152
MTYTLVLLRHGESEWNALNLFTGWVDVHLTDKGVAEGKRAGELLAEHGILPDIVYTSLLRRAISTANIALDAADRHWIPVVRDWRLNERHYGELQGKNKAQIRDKYGEEQFMLWRRSYDTPPPPIEAGNEYSQEGDARYAGIDIPKTECLLDVVNRMVPYWESTISKDLLAGKTVLIAAHGNSLRALVKHLDQISDEEIAGLNIPTGIPLRYELDENLRPVRPREYLDPEAAAAGAAAVASQGGK

SEQ ID NO: 65994 - protein, 488 aa, Geobacillus kaustophilus HTA426
MKMGTEKQTYLNYINGEWIHSSTGKIEASLNPANIDDIVGYVQESGVEDVNVAVEAARRAQAAWRKLSGPKRGEYLFRAADVLEKRLDEIAETMTREMGKTLPEAKGEVQRGVNILRYYAGEGMRSIGEVIPSMDSEALMFTTRVPLGVVGVITPWNFPVAIPIWKIAPAIVYGNTVVFKPAQETAVTAAKIVECFDQAGLPAGVVNLVTGKGSVIGNAIAEHPHIHGITFTGSNEVGKTIAQKAVARGAKYQLEMGGKNPVIVLEDADLDRAVEATISGGLRSTGQKCTATSRVFVQSSIYESFKEQLLAKIKQLKIGDGLKEGVWMGPCASRKQLETILSYIEKGIEEGATLLCGGRRLVDGELGNGFYIEPTVFENVSPNMTIAREEIFGPVLSLIKVDTFEEALALANDTPFGLSASIFTQNIGKMLAFIQDIEAGLVRINEESAGVELQAPFGGMKQSSSHSREQGRAAIEFFTAIKTVFVKG

SEQ ID NO: 65995 - protein, 471 aa, Bacillus anthracis str. Ames
MSKLLKKKSVTQLLEHNQSKALTKTLGAFDLIMLGVGSIIGTGVLVLTGLVAARDAGPAVIFSFVLAAIICGFIALCYAEIASTLPASGSVYTYSYATIGEFVAHLVGWSLLLIYIVATAAVAAGWTGYFHNLIKGFGLEIPKALVTIPSHGGIVNLPAVIITLILAWMLSRGTRESKRINNIMVLIKIGMILLFITVGIFYVKPMNWIPIAPYGLSGVFTGGAAILFAFTGFDILATSAEEVKDPKRNLPIGIIASLIICTIIYVMVCLVMTGMVSYKELNVPEAMAYVMEVVGQGKVAGAIAVGAVIGLMAVIFSNMYAATRVFFAMSRDGLLPKSFAKVNKKTGAPTFITGLAGIGSSIIAGFIDLKELVNLVNIGSLVTFALVCLSVIILRKSHPNLKRGFMVPFVPVLPCVAIVCCVFLMLNLPLRTWVYFSIWITIGVVIYFLYSIKHSNLNEETISKLHDKIAR

SEQ ID NO: 65996 - protein, 414 aa, Bacillus anthracis str. Ames
MSLLRDEALKMHKEKQGKIGVYSKVKVQNSTDLSLAYSPGVAEPCLEIYKDESKVYDYTMKGNLVGVISDGTAVLGLGNIGPKAAMPVMEGKALLFKSFAEIDAFPICLNTNNPDKIVEVVKLLEPNFGGINLEDIAAPQCFEIEERLRKSCDIPVFHDDQHGTAIVTIAGLINALKLTNKKIEDVQIVVNGAGAAGIAIVKLLLHMHVKNVILCDTKGIIYEQRPIGMNALKEEIARITNIEQKRGTLAEALIDADVFIGVSAADVVDEDMIRSMNHNPIIFALANPTPEIMPNKAKIAGALVVGTGRSDFPNQVNNVLAFPGVFRGALDVQAKEINEEMKLAAVYAIAELISEEELHVNYVIPNPFDPRVVPHVAYAVARAAVETGVSRKNISMSEIKNNLFRLTKEVNILK

SEQ ID NO: 65997 - protein, 522 aa, Xylella fastidiosa Dixon
MTPNIHHDKILILDFGAQYTQLIARRIREIGVYCEVWPWDHSPEEILSFGAKGIILSGGPESTTSPGAPAAPQHVFDSDLPIFGICYGMQTMAVHLGGATEAADKREFGHASVQVIYPDTLFSGLSDHPSEFRLDVWMSHGDHVSRVPPGFTITAATDRIPIAAMSREDKRWYGVQFHPEVTHTLQGQALLRRFVVDICGCQTLWTAANIIEDQIARVRERVGRDEVILGLSGGVDSSVVAALLHKAIGSQLTCVFVDTGLLRWGEGDQVMAMFEEHMGVNVVRINAASRYFDALQGVYDPEAKRKIIGNLFIQIFEEEASKRKQAKWLAQGTIYPDVIESAGSKTGKAHVIKSHHNVGGLPEQMTLGMVEPLRELFKDEVRRLGVALGLPHAMVYRHPFPGPGLGVRILGEVKPEYAELLAKADSIFIDELHQADLYDKVSQAFAVFLPVKSVGVVGDARAYEWVIALRAVETVDFMTAHWAPLPYDFLSTVSNRIINELRGVSRVVYDISGKPPATIEWE

SEQ ID NO: 65998 - protein, 195 aa, Oryza sativa (japonica cultivar-group)
MASVIVAAACIFLSCSASVAHGRRFVRSSSYDKPCKEMRLYLHDILYDYSNSTSNSTSAAATKPTALATAVPSTGGTFFGQVVVFNDPMTEGRALPPSLEETAVRAQGVYLYNSKEAFNAWFAFSIVFNSTGRRGTLNLMGADIIAEKTRDISVVGGTGDFFMSRGVATLRTDAFEGFTYFRLQMDIKLYECYVV

SEQ ID NO: 65999 - protein, 143 aa, Glycine max
MPWARLSGSPRLDVAIDMGNPFLNLTVDGFLKIGAVAATRSAAEDTYHIIQKGNISSHDFEKTLKKMCKEGVYWGTIAGVYVGMEYGVERIRGTRDWKNAMIGGAVTGALVSAASNNKKDKIAIDAITGAAIATAAEFINYLT

SEQ ID NO: 66000 - protein, 183 aa, Oryza sativa (japonica cultivar-group)
MATWSKPSLIAAVIFLLVSLLSSASVANGGRSGGRRLVRSYDEPCKEMRLYLHDILYDYSNSTSNSTSAAATKPTALSAAVSNPGFFFGRMVVFNDPGLYLYDGKVVFDAWFAFTVVFNSTAHHGTLNLMGADPNTEMRDISVVGGTGDFFMSRGVATLRTDAFEGFTYFRLQMDIKLYECYV

SEQ ID NO: 66001 - protein, 208 aa, Helicobacter pylori J99
MIVIKDAHFLTSSNNLSQCPASLTSEMVILGRSNVGKSTFINTLLGKNLAKSSATPGKTRLANFFSTTWEDKENALTTTFNVIDLPGFGYAKVSKSLKKEWEGFLWELLSVRVSIKLFIHLIDARHLDLEIDKNAKENIQALLRPDQAYLSLFTKFDKLNKNEQHRLFLNAPKPFLINTIHFNALSSKYPTLEIVRQTLLKYLLTNPL

SEQ ID NO: 66002 - protein, 161 aa, Arabidopsis thaliana
MDIPKQYLSLFILIIFITTKLSQADHKNDIPVPNDPSSTNSVFPTSKRTVEINNDLGNQLTLLYHCKSKDDDLGNRTLQPGESWSFSFGRQFFGRTLYFCSFSWPNESHSFDIYKDHRDSGGDNKCESDRCVWKIRRNGPCRFNDETKQFDLCYPWNKSLY

SEQ ID NO: 66003 - protein, 363 aa, Magnaporthe grisea 70-15
MAANFWESTQRRNWLFTKEELAARRQQLENEDPSLVTMYPLPEWRHLYNYFNYQMLRLAKNLSIRQQAIATAQVYMKRFYTRVEIRSTNPTLVLVTAVYLACKMEEMPLHIRNVSLEAKKVWPMETPSLEIAKIGECEFWLISEMSAQLIVHQPYRTLTALQQDFQLANDDHVLAVSFLNDHFMTDLPLLYAPHTIALAAIMLALVLRLSKASSSNNAAAGQQGGAQAGPLGITLASGLSMFQQAVAAKAMTPGGSGSPAMSSPIQQNPPNQAYQLTPQQQEMFRQQQMQQQNRQPETQAKDSPQKEKSKLQRFAAWLSESGVDIEAMIDCTQELIAFYECQESYNEQITRDQINRFVKARGL

SEQ ID NO: 66004 - protein, 431 aa, Medicago truncatula
MKSFKDLGLPESLVEACEKVGWKTPLEIQIEAIPPALEGKDLIGLAKTGSGKTGAFALPILHALLEAPRPNHFFACVMSPTRELAIQISEQFEALGSEIGVKCAVLVGGIDMVQQSVKIAKLPHIIVGTPGRVLDHLKNTKGFSLARLKYLVLDEADRLLNEDFEESLNEILGMIPRERRTFLFSATMTNKVEKLQRVCLRNPVKIETSSKYSTVDTLKQQYRFLPAKHKDCYLVYILSEMAGSTSMVFTRTCDSTRLLALILRNLGLKAIPINGHMSQPKRLGALNKFKSGDCNILLCTDVASRGLDIPAVDMVINYDIPTNSKDYIHRVGRTARAGRSGVAISLVNQYELEWYVQIEKLIGKKLPEYPANEEEVLLLEERVGEAKRLAATKMKESGGKKRRGEGDIGEEDDVDKYFGLKDRKSSKKFRR

SEQ ID NO: 66005 - protein, 399 aa, Bacillus cereus ATCC 14579
MLANQINERSLLLHKELVGKIEITSKVEVNSADDLSLTYTPGVAESCKAIAADEETVYDYTARGNMVAVVSDGTAVLGLGNIGPKAAMPVMEGKSILFKKFANVDAFPLCLGTTDVDEIVTLVKNLEPTFAGINLEDIAAPRCFEIEKRLKEETNIPVFHDDQHGTAIVVLAAVINALKVVSKQMDNVKIVINGAGSAGIAIGKLLLKAGAKHITLVSLEGIVCEGETWMNEAQIEVSKKTNREHVRGTLKEAIHQADIFIGVSAPNVLTKELVQTMNEKAIVFAMANPIPEIFPEDALEAGAAVVGTGRSDYANQVNNVLAFPGIFRGALDVRATDITEEMKLAAAYGIANIITDEERNANYVIPNPLDKRVVPSVAEAVAKAAIDSGVAQITKIPRY

SEQ ID NO: 66006 - protein, 331 aa, Clostridium difficile 630
MYKVTLIPGDGIGPEVAKAMKKVVEATGVEIEWEEVNAGEAVIEEYGTPLPEYIIDSIKKNKIAIKGPITTPVGKGFRSVNVTLRQALDLYVNLRPIKSFKGIKSRYEDVDLVVVRENTEDLYAGIEHKIGDYAAESIKIITRSASERIVDFACNYVKDNKRKKVTAIHKANIMKMSDGLFLDVFREVASKHGVEYDDLIVDAAAMNLVLNPENYDVMVMPNLYGDILSDLGAGLVGGLGIIPSANIGKDCAIFEAVHGSAPQIAGQNKANPTALIQSSVMMLRYLGEYENAQKIETALEKVFLEGSKLTVDLGGSASTTEFADEVCKYIV

SEQ ID NO: 66007 - protein, 254 aa, Chlamydophila abortus S26/3
MERKRYIFGNWKMHKTAKEAKDYLSVFCPLLEEVAPVSCVGITPAFTALHACCESIKFFHSPLWLGAQNVHQDTSGAFTGEISLPMLKEFDVNFVLLGHSECRHIFHEEDTTIALKVGAAAREGIIPVLCIGETLEVREKGATEAMLSNQLMLGLAQLPETASVIIAYEPVWAIGTGKVASAVDVQEAHAFCREVLANIFSKEKAEEISILYGGSVKADNAEGFARCPDVDGLLVGGASLDPKVFADVVANFHR

SEQ ID NO: 66008 - protein, 326 aa, Bacillus anthracis str. Ames
MIKDSSVQVEGQEKVCLDQWVAHYRTYAAKGRSASYIPALGEINVSQLGICIVKPDGTMIKSGDWEIPFTLQSISKVIGFIAACLSRGISYVLERVDVEPTGDAFNSIIRLEIHKPGKPFNPMINAGAITIASLLPGTSVQEKLESIYVLIEKMIEKRPAINEIVFQSEWETAHRNRALAYYLKENGFLESDVEETLEVYLKQCSIEINTEDIALIGLILAHDGYHPIRKEQVLPKEVARLTKALMLTCGMYNASGKFAAFIGLPAKSGVSGGIMTLVPSKSRKDLSFQDGCGIGIYGPAIDEYGNSLPGIMLLEHIAKEWDLSIF

SEQ ID NO: 66009 - protein, 473 aa, Saccharomyces cerevisiae
MRSYMQILQKFAKFIGPGILVSVAYMDPGNYATSVSGGAQYKYTLLFSIFISNIFAVLLQCLCVKLGTITGYDLAENCRHNLPKKLNYTLYLFAEVAIIATDLAEVVGTAIALQILFKIPLTWGVLLTVLDVLVILMFYTPNGQSLKKVRVFEFGVGILVIGTCICFVLELFKVSIPDKAELFKGFLPSNIIFKEQQALYISLGILGATVMPHSLYLGSSIVKPRLHDYDLKKYGKVNARPSLSAIKYTLNYAYAELIISLFLIATFVNSAILIVAGATLSGQPEAEDADLLSIYKLLVHYISPAAGLIFALAMLCSGQSAGIICTLAGQIVSEGFLQWSLPPWATRLCTRLIAIVPCLFVTLTMGEKGISDILNFSQVVLSLILPIVSAPLIYFTANRKLMVVHDENGVVRAPADVNAIADETTPLNSKHSKIVDFTNSRLLTYTSVFVWALIGSLNCYLVISYLLGADIHF

SEQ ID NO: 66010 - protein, 659 aa, Neisseria meningitidis FAM18
MSQLANAIRFLSADAVQKANSGHPGAPMGMAEMAETLWTKFLNHNPANPKFYNRDRFVLSNGHASMLLYSLLHLTGYNLSIEDLKNFRQLHSKTPGHPEYGYTDGVETTTGPLGQGIANAVGMALAEKILAAEFNKDGLNIVDHYTYVFMGDGCLMEGVSHEACSLAGTLGLGKLIVLYDDNNISIDGKVDGWFTENIPQRFESYGWHVVPNVNGHDTAAIQAAIEAARAETGKPSIICCKTLIGKGSANKEGSHKTHGAPLGADEIEATRKHLGWTYPAFEIPQEIYDAWNAKEKGAKLEAEWDKLFAQYQAKYPAEAAEFVRRMDKKLPENFDGYVQTALKEVCAKAETVATRKASQNSIEILAKELPELVGGSADLTPSNLTDWSNSVSVTRDKGGNYIHYGVREFGMGAIINGLVLHGGVKPFGATFLMFSEYERNALRMAALMKINPVFVFTHDSIGLGEDGPTHQPIEQTATLRLIPNMDVWRPCDTAESLVAWAEAVKAADHPSCLIFSRQNLKFQARSEQQLNDIKRGGYVISEAQGNAQAVIIATGSEVELALEAQKALAAQNIAVRVVSMPSTNVFDRQDTAYQAAVLPEGLPRIAVEAGHADGWYKYVGLNGAVVGINRFGESAPADLLFKEFGFTVDNVVDTVKSVL

SEQ ID NO: 66011 - protein, 172 aa, Oryza sativa (japonica cultivar-group)
MAAWSMASLMIVAAIFLLSLTSASVVHGRSSRRRFVRSYDEPCMEMRLYLHDILYDYSNSTTNSTSAAATKPTALSTAVSSPGYFFGRVVVFNDPMTEGRALPPSLEETAVRAQGLYLLDKKDDFSAWFAFSIVFNSTARRGTLNLMGADPNAARGHLRTQISIELATSITG

SEQ ID NO: 66012 - protein, 497 aa, Oryza sativa (japonica cultivar-group)
MNLIKHAAFAASFQGETDCTSHASARKFSTSGSSPLLDSTEGNGFKGHSMLAPFTAGWHSTDLEPLIIERSEGSYVYDSKGNKYLDTLAGLWCTALGGSEPRLVKAATDQLNKLPFYHSFWNSTAKPPLDLAEELISMFTAKEMGKVFFTNSGSEANDSQVKLVWYYNNALGRPNKKKIIAQSQAYHGSTLISASLSGLPAMHLKFDLPAPFVLHTDCPHYWRFGLPGEAEEEFATRLADNLENLILKEGPETVAAFIAEPVIGAGGVIPPPKTYFEKIQAVLQKYDVLFIADEVITGFGRLGTMFGSDLYNIKPDLVSLAKALSSAYVPIGATLVSPEISDVVHSQSNKIGFFAHGFTYSGHPVSCAVALEALKIYRERNIPAHVKQISPRFQEGIKAFAGSSIIGETRGVGLLLATEFANNKSPNDPFPVEWGVAQIFGAECKKRGMLVKVVGDEIAMSPPLIMSQREVDGLVSIYGEALKATEERVAELRSKKK

SEQ ID NO: 66013 - protein, 497 aa, Aspergillus nidulans FGSC A4
MSDLFTTIETPVIKYEQPLGLFINNEFVKGVEGKTFQVINPSNEKVITSVHEATEKDVDVAVAAARAAFEGPWRQVTPSERGILINKLADLMERDIDTLAAIESLDNGKAFTMAKVDLANSIGCLRYYAGWADKIHGQTIDTNPETLTYTRHEPVGVCGQIIPWNFPLLMWSWKIGPAVAAGNTVVLKTAEQTPLSALYAAKLIKEAGFPAGVINVISGFGRTAGAAISSHMDIDKVAFTGSTLVGRTILQAAAKSNLKKVTLELGGKSPNIVFDDADIDNAISWANFGIFFNHGQCCCAGSRILVQEGIYDKFVARFKERAQKNKVGNPFEQDTFQGPQVSQLQFDRIMEYINHGKKAGATVATGGDRHGNEGYFIQPTVFTDVTSDMKIAQEEIFGPVVTIQKFKDEAEAIKIGNSTDYGLAAAVHTKNVNTAIRVSNALKAGTVWINNYNMISYQAPFGGFKQSGLGRELGSYALENYTQIKTVHYRLGDALFA

SEQ ID NO: 66014 - protein, 340 aa, Helicobacter pylori J99
MILSIESSCDDSSLALTRIEDAKLIAHFKISQEKHHSSYGGVVPEIASRLHAENLPLLLERVKISLNKDFSKIKAIAITNQPGLSVTLIEGLMMAKALSLSLNLPLILEDHLRGHVYSLFINEKQTRMPLSVLLVSGGHSLILEARDYEDIKIVATSLDDSFGESFDKVSKMLDLGYPGGPIVEKLALDYAHPNEPLMFPIPLKNSPNLAFSFSGLKNAVRLEVEKNAHNLNDEVKQKIGYHFQSAAIEHLIQQTKRYFKIKRPKIFGIVGGASQNLALRKAFEDLCAEFDCELVLAPLEFCSDNAAMIGRSSLEAYQKKRFIPLEKADISPRTLLKNFE

SEQ ID NO: 66015 - protein, 620 aa, Coccidioides immitis RS
MADSHGFGGAGRGPTFPRQPEELHIPSANSSLPSNGPRPAQHQFPAPPEYAANHPPTTVGIQASASQPQPQSHPQYSASTGQTNPGNVLPGALQPGNASRSGPISSNTAPTLPTISQQPPASSPSRPALATQPHSYSASSPAAFDQQKYKPFGGSSDGSKYISPTLATYSQGNQYSPLGLADIRSRMDHGMMEDMSGAGQPNNADPPISTNCNYMAPWSVYALDWCKWSVPPGTPTAGKVAIGSYLEDNHNYIQILGAQYTPPDRDYPEPDGLPGLEFVKIAEATHSYPVTRILWEPPSSQKQSTDLLATSGDHLRLWSLPSESSQFRHHGSSSINRSTNARPPVQKLSPLALLSNSKSPEHTAPITSLDWNAVSPSLIITSSIDTTCTIWDIPTLTAKTQLIAHDREVYDVRFCANSVDVFVSCGADGSVRMFDLRSLEHSTIIYEPSEKNDKLANPGNLSPSSYPSVWPPPLLRIAASPHDAHLLATFSQDSSVIRILDVRQPGQALLELKGHSAPINCVEWCPARRGTLASGADDSLVLIWDLINQNNAAAISSQTPVGQPHHNSSSGASTMERGPAAAWQCDYEVSNVSWAPHAPSGNVSGWLGVSGGKGLWGVSI

SEQ ID NO: 66016 - protein, 450 aa, Geobacillus kaustophilus HTA426
MQTEQTHQLWLDKDDRYIWHSMKPYNPQATLIAAEAKGCWVTDAAGHQYLDAMAGLWCVNVGYGREELAEAAYEQLKTLAYFPLTQSHLSAIQLGEKLNELLGDEYVIFFSNSGSEANETAFKIARQYHQQRGEHHRYKIISRYRAYHGNSMGALSATGQAQRKYKYEPLAPGFIHVPPPDVYRDPDAADDPRRLRAVKAIDDVMTWELSETIAAVIMEPIITGGGVLIPPDGYMKAVKEVCEKHGALLIVDEVICGFGRTGKAFGFQHYGVKPDIITMAKGITSAYLPLAATAVRKEIYEAFKGTGEYDYFRHVNTFGGHPAACAVALKNIEIMEEERLFDRSREAGEWLLSALKTKLADHPYVGDVRGKGLLVGIELVADRATKEPLDVSLVNQVIHRCKENGLIIGKNGTTVAGYNNVLTLSPPLCITDDELSFVVRVLTGALAAIQ

SEQ ID NO: 66017 - protein, 584 aa, Arabidopsis thaliana
  misc_feature (169)..(169): Xaa can be any naturally occurring amino acid
  misc_feature (543)..(543): Xaa can be any naturally occurring amino acid
MDRILKAARTSGSLNLSNRSLKDVPTEVYQCLETAGEGENWWEAVDLQKLILAHNDIEVLREDLKNLACLVVLNVSHNKLSQLPAAIGELTAMKSLDVSFNSISELPEQIGSAISLVKLDCSSNRLKELPDSIGRCLDLSDLKATNNQISSLPEDMVNCSKLSKLDVEXNKLTALSENHIASWTMLAELNACKNMLGVLPQNIGSLSRLIRLDLHQNKISSVPPSIGGCSSLVEFYLGINSLSTLPAEIGDLSRLGTLDLRSNQLKEYPVGACKLKLSYLDLSNNSLTGLHPELGNMTTLRKLVLVGNPLRTLRSSLVNGPTAALLKYLRSRLSNSEETSASTPTKENVIASAARMSISSKELSLEGLNLSDVPSEVWESGEITKVNLSKNSIEELPAQLSTSVSLQTLILSRNKIKDWPGAILKSLPNPMCLKLDNNPLNQIPLDGFQVISGLQILDLSVNAVSFREHPKFCHLPQLRELYLSRIQLSEVPEDILNLSNLIILDLNQNSLQSIPKGIKNMTSLKHLDISNNNISSLPPELGXLEPTLEVLRLDGNPLRSIRRPILERGTKAVLNYLKDRLPDQ

SEQ ID NO: 66018 - protein, 584 aa, Arabidopsis thaliana
MDRILKAARTSGSLNLSNRSLKDVPTEVYQCLETTGEGENWWEAVDLQKLILAHNDIEVLREDLKNLACLVVLNVSHNKLSQLPAAIGELTAMKSLDVSFNSISELPEQIGSAISLVKLDCSSNRLKELPDSIGRCLDLSDLKATNNQISSLPEDMVNCSKLSKLDVEGNKLTALSENHIASWTMLAEPNACKDMLGVLPQNIGSLSRLIRPDPHQNKISSVPPSIGGCSSLVEFYLGINSLSTLPAEIGDLSRLGTLDLRSNQLKEYPVGACKLKLSYLDLSNNSLTGLHPELGNMTTLRKLVLVGNPLRTLRSSLVNGPTAALLKYLRSRLSNSEETSASTPTKENVIASAARMSISSKELSLEGLNLSDVPSEVWESGEITKVNLSKNSIEELPAQLSTSVSLQTLILSRNKIKDWPGAILKSLPNLMCLKLDNNPLNQIPLDGFQVVSGLQILDLSVNAVSFREHPKFCHLPQLRELYLSRIQLSEVPEDILNLSNLIILDLNQNSLQSIPKGIKNMTSLKHLDISNNNISSLPPELGLLEPTLEVLRLDGNPLRSIRRPILERGTKAVLNYLKDRLPDQ

SEQ ID NO: 66019 - protein, 687 aa, Cryptococcus neoformans var. neoformans JEC21
MANFSSNDITAVNTIRTLAADVVAKANSGHPGAPMGMAPAAHVLFTRFMRFNSKNPKWINRDRFVLSNGHACALQYILLHLAGYEVSMEDLKQFRQIDSITPGHPEVGVTPGIEVTTGPLGQGIANAVGLAISQAHMGAVFNKENFSLIDNYTYCFLGDGCLQEGVASEACSLAGHLKLGNLVAIYDDNKITIDGDTAVSFTEDVEMRFKSYGWNVLHVEKGDDDLAAIEKAITEAKKSKDAPTIINLKTTIGFGSLHAGGHDVHGSPLKKDDIVQLKKKFGFNPEETFVVPKETSDLYHKVAESGAKAEAEWQALFKSYSEKYPKEAAELQRRVEGRLPDGWEKALPTYTTSDAAVGSRKLSETTITKLVEVLPELVGGSADLTGSNLTRWKGAEDFQHPSTGLGSYAGRYFRFGVREHGMTAVCNGIAAYGGIIPFTATFLNFVSYAAGAVRLSALSHLRVLNVATHDSIGLGEDGPTHQPVETAAWLRAIPNLAFWRPADGNETSAAYLVAILSQHTPSVFAFSRQNLPQLANSSIEKATKGGYVVEEVENADVTLVSTGSEVILCLQALEQLKSKGIKARLVSLPCFEVFNNQPKDYKLSVLPSGAPILSVEAYSTFGWGTYSHDHFGLKAWGASGPYNKVYEKFDITPEGIARRAEKVVDFYKKRGQPVFSPLISALDDISE

SEQ ID NO: 66020 - protein, 472 aa, Nocardia farcinica IFM 10152
MAKQVPTSRLARGTKLGAVAAGSVLRTQRTRLSMRGRSEAVRAKMAEESMIRTTEQVVAVLGTMKGVAMKLGQMMSVLDLDLVPEAHRERFQQRLAVLRNAAPTVPFEGMRRVVEEDFGAPLDTVFAEFEPEPIAAASIGQVYRARLHDGRVVAVKVQYPGIDAAVRADLKNLTMFRKVLQSAMPWVTPAVLDELRLNIESELDYRAEAQTQAELAELYADHPFIVVPGTLLELSTTRVLVSEYLPGRGFDEIRGLPDADRNRIGEIIYRFYVGSLFEFAEFCGDPHPGNVLLLDDGRVGFLDFGLFNRMDPAHVRFEITCLRAAAEERAEDLRQLMIQRGVIDSPEEIGAEECLEYVLAASEWCLVDEELTITPELASGAFLLAVDPRASEFAGMKQQNLPPEHLFSRRADFLTFGMLGQLHTTANWHRIAREWLYDEDPVTELGRAHRQWLAQRTPPKPARARKKTATRR

SEQ ID NO: 66021 - protein, 418 aa, Nocardia farcinica IFM 10152
MTDHMTDTRDFDLTVFGATGFVGKLTAEYLLDAAPEGARIALAGRSADKLAKVREELGPRAANWELVVADSTDQAALDALAARTTAVITTVGPYLRYGMPLVRACAEAGTHYADLTGEPLFIREAIDAHHDRAVETGAKIVNSCGYDSVPSDLSVYQLYRSSVADNTGELTDVTLVASLKGGVSGGTIDSGRAMMEAVAADSSKAAVLAHPYSLSPDKSMDPDVGRQSDQALERASNIDPSLDGWVGTFVMAAHNTKIVRRTNGLLGWVYGKNFRYREVMSAGSSRLSPVIATVMSGGIVAGLAAGAVLSRARAGRKLLDTVLPKPGTGPSEESRRSGWFTMKTFARTTSGAKYVATFAGKGDPGYQATAVMLGQSGLCLAFDELPELAGILTPAAAMGDALTERLRAAGMTIEVARA

SEQ ID NO: 66022 - protein, 978 aa, Bacillus cereus ATCC 14579
MAEQTVRVTVDGKEFSASGEKTILQLFNESNLEHPQICHVPEVDPIQTCDTCIVEVNGKLLRACSTKLENGMHIERQSQRAKEAQTEAMDRILENHLLYCTVCDNNNGNCKVHNTVHMMGIEEQKYPYEPKVSACEVDMSHPFYRYDPNQCIACGQCVEVCQNLQVNETISIDWSLDRPRVIWDNGVSINESSCVSCGQCVTVCPCNALMEKSMLGEAGFMTGLKPDVLDPMIDFVKDVEPGYSSILAVSEVEAAMRKTKVNKTKTVCTFCGVGCSFEVWTKDRHILKVQPVSDAPVNGISTCVKGKFGWDFVNSEDRITKPLIRQGDMFVEASWEEALEVVASNMQHIKSEYGSDAFGFISSSKVTNEENYLMQKLARQIYGTNNVDNCSRYCQSPATDGLFKTVGMGGDAGTVKDIAEAGLVIIVGANPTEGHPVLATRVKRAHKLHDQKLIVADLRKHEMAERADLFIHPRQGTDYVWLAGITKYIIDQDWHDKKFIAENVKNFDEYSKMVEKYTLDYTEEITGISKENLKEMARMVYEADGTCVLWGMGVTQNTGGSTTSAAISNLLLVTGNYRRPGAGAYPLRGHNNVQGACDMATLPNWLPGYQAVSDDALRAKFEKAYGTTIPKAPGLNNIAMLLAADEGKLRGMYVMGEEMALVDSNANHVQHILANLDFLVVQDMFLSKTARFADVILPAAPSLEKEGTFTNTERRIQRLYEVLKPLGDSKPDWWILQKVARALGGDWNYENPSEIMDEIASLAPLYSQATYDRLEGWNSLCWGSHDGSDTPLLYVDGFNFPDKLARLSLDEWVPPVVAPDEYDLLLNNGRMLEHFHEGNMTNKSAGILSKVSEVFVEISPELALERNVKDGGLVELASPFGKIKVQALVTDRVMGKELYLPMHATVNEEAINILTGTATDLYTCTPAYKQTMVKMRVLREKGNRPLPSSNPRDKKRNPQNGVEIQQKWQRKQYVSLVD

SEQ ID NO: 66023 - protein, 162 aa, Yarrowia lipolytica CLIB122
MVTLVSSDGVSFNVDQKVASRSALIKNMMEDIGEDAGEIPVPNVSSNVLKKVIEYCTYHKDDPLPQSGEDEGTSAADKKKSTVIDDWDYNFLQVDQEMLFEIILTANYLDIKPLLDVGCKTVANMIKGKTPEEIRRTFNIANDFTPEEEAQIRRENEWAEDR

SEQ ID NO: 66024 - protein, 471 aa, Bacillus cereus ATCC 14579
MANLFKKKSVTQLLGESKSKTLTKTLGAFDLTMLGIGAIIGTGVLVLTGLVAARDAGPAVIFSFMIAAIVCGFAALCYAEVASTLPVSGSVYTYSYATIGEFVAHLMGWTLLSVYVVTTAAVAGGWTGYFHNLVSGLGLEIPKALLTIPSQGGMVNLPAVIVTLIITWLLSRGTKESKRVNNIMVLIKIGIVVLFIAVGVFYVKPENWIPFAPYGLSGVFAGGAAVFFAFLGFDALATSAEEVKNPQRDLPIGIIASLVICTIIYVVVCLVMTGMVSYKELDVPEAMAYVLEVVGQDKVAGVIAIGAVIGIMAVIFAYIYATTRVFFAMSRDGLLPESFAKINKKTEAPTFTVWLTGIGSALIAGFIDLKELSNLANIGALLTFAMVGVSVIILRKTHPKLQRGFMVPLVPILPIISIACCLFLMVNLPLKTWMYFGAWLAIGVVVYFVYSKKHSHLKDDGSSQDNLEQAN

SEQ ID NO: 66025 - protein, 204 aa, Oryza sativa (japonica cultivar-group)
MATWSNASSLIVAAVILLGLSSASVAHGRRGRRSFVSSYDEPCMEMRLYLHDIIYDYSNSTSNSTSAAATKPTPLSTAVSNPGYFFGEMVVFNDPMTEGRALPPSPAMEEETAVRAQGVYLYDKKEAPNAWFAFSVVFNSTGRRGTLNLMGADLMSEKTRDLSVVGGTGDFFMSRGVATLRTDAVEGLVYFRLQMDIKLYECYV

SEQ ID NO: 66026 - protein, 187 aa, Glycine max
  misc_feature (105)..(105): Xaa can be any naturally occurring amino acid
  misc_feature (119)..(119): Xaa can be any naturally occurring amino acid
  misc_feature (121)..(121): Xaa can be any naturally occurring amino acid
  misc_feature (154)..(154): Xaa can be any naturally occurring amino acid
TLKSYYHFLLLSCGITDTLIGVSAAITGTAAECAIDKAEKWGWQSAGDLAIHVILSTLGAQDTARVARVSKRFCSSASHDTLWIPHCFHALALTQALDHLGKPSXSSEECYQAWPRSFXMXPRSLVNPAKRRRPTITPWLTNNFPQAQATLCPXATATRLSPTRGKYSKPEIGPFPSTSFFSFFQFG

SEQ ID NO: 66027 - protein, 103 aa, Saccharomyces cerevisiae
MVTQFKTASEFDSAIAQDKLVVVDFYATWCGPCKMIAPMIEKFSEQYPQADFYKLDVDELGDVAQKNEVSAMPTLLLFKNGKEVAKVVGANPAAIKQAIAANA

SEQ ID NO: 66028 - protein, 571 aa, Marinobacter sp. ELB17
MTKELSRNERIKEASEYLRGTLAEGLREEITGAIIEDDAQLVKFHGMYLQDDRDLRAERGRKKMEKAFSFMIRVRVPGGVCTPGQWLTMDHIARTYGNGTMRLTTRQTFQLHGIIKSNLKATMREMDEVLLTTMAACGDVNRNVMCNPNPYQSHAHAASLVLARALSDHLLPRTTAYREIWLDGERIAGGEDENEIVEPIYGKTYLPRKFKIVIAVPPSNDVDIYAHDLGFIAILDSKHEIDGYNVTVGGGMAMTHGEPQTYPRTADVMGYCRADQVIAVAEAVVTVQRDWGDRVNRKHARLKYTIEDRGLDAFRAEVEQRSGVKLDAAKPFTFTSTGDRYGWTESDNGCAHLTLFIENGRVKDVPGGPQWLTGLRRIAEVHDGDFRLTANQNLIIANVPKEKRQAIEALVAEYGPTTGASALRRNAMACVALPTCGLAVAESERYLPDLITALEERLAAHGLAEAEIVIRMTGCPNGCSRPYIAEIGLVGKGPGRYNLYLGAAFDGSRLSKLYAENLDHGAIIENLDPIFAAYKSERQNAEHFGDYTIRAGFIAATVNGTDFHEDTGARR

SEQ ID NO: 66029 - protein, 516 aa, Candidatus Kuenenia stuttgartiensis
MLENNIEKVLILDFGSQYAQLIARRVRENHVYSEIVSHLITAEQIKKIKPKGIILSGGPASVYSKNAPGCDEEIMKLGVPVLGICYGMQLGCMMLGSKVSPSAAREYGRTLCAISGENRFLKTLPQEITVWMSHGDIVTELPAEFESLAHTKNCPYTAVKHKNRDFYGVQFHPEVTHTPNGSQIIRNFLYEICHCSGNWKMDSFIEKSVNDINRQVGNGRVVCGLSGGVDSAVTAALIHKAIGNRLSCIFVDNGLLRNFEAEEVVKTFKENFSADLHVVRAQDRFLGKLKGVSDPEKKRKIIGHEFIKVFKNEAQKISDVQFLAQGTLYPDVIESIPAHGGPTVTIKSHHNVGGLPEELGFELVEPLRFLFKDEVRKIGEELGLPKELVGRHPFPGPGLAIRIIGEISGQRLEVLRKADKIVIEEICKAGLYNKIAQCFAVLLPLSTVGVMGDERSYENVIAVRAVETTDFMTADWYRIPNETLGSISHRIINEVKGVNRVVYDISTKPPSTIEWE

SEQ ID NO: 66030 - protein, 590 aa, Bacillus subtilis subsp. subtilis str. 168
MQNNSVQQANISIMSSFSGSKKVYVEGSSSDIQVPMREIALSPTTGSFGEEENAPVRVYDTSGPYTDPEVTINIQEGLKPLRQIWITERGDVEEYEGRAIKPEDNGYKKAKPNVSYPGLKRKPLRAKAGQNVTQMHYAKKGIITPEMEFIAIREHVSPEFVRDEVASGRAIIPSNINHPESEPMIIGRNFHVKINANIGNSAVTSSIEEEVEKMTWAIRWGADTMMDLSTGKDIHTTREWIIRNCPVPVGTVPIYQALEKVNGVAEDLTWEIYRDTLIEQAEQGVDYFTIHAGVLLRYVPLTAKRTTGIVSRGGAIMAQWCLAHHQESFLYTHFEEICEIMKMYDIAFSLGDGLRPGSIADANDEAQFAELETLGELTQIAWKHDVQVMIEGPGHVPMHKIKENVDKQMDICKEAPFYTLGPLTTDIAPGYDHITSAIGAAMIGWYGTAMLCYVTPKEHLGLPNRDDVREGVITYKIAAHAADLAKGHPGAQIRDDALSKARFEFRWRDQFNLSLDPERALEYHDETLPAEGAKTAHFCSMCGPKFCSMRISQDIRDYAKKNDLSEAEAINKGLKEKAKEFVDTGSNLYQ

SEQ ID NO: 66031 - protein, 410 aa, Xylella fastidiosa Dixon
MLRSMGRYSDAHSVDFAFFYVLTRDKSFMQVTSKLPQVGSTIFSVMSQLADVYGAVNLGQGFPDFPVPLRLQEALAGAVREGHNQYPPMIGVAGLRQGIAAKVLRCYGAQVDVDVEITVTSGATEAIFNAIHAVVGAGDEVIVLDPAYDCYEPGIVLAGARAVHVPLDAVSFTVDWERVGAAITSRTRLLIVNSPHNPSGALFSADDMRALAALLDGTDILLISDEVYEHIVFDGCGHESVLRWPQLRARAFVISSFGKTYHCTGWKIGYAIAPPALSAEFRKVHQYNTFTSFGPAQYAFAAMLREEPEYVEQVGLFYQARRDCFREQLLTTKLVPLPVSGGYFQLVDYGAVSDLSDVEFSRWLAVEKGVVSIPLSPFYETAPAGQRLVRLCFAKNDMTLGAAIERLQRL

SEQ ID NO: 66032 - protein, 421 aa, Neisseria meningitidis FAM18
MSEALAKETLNPFEIARKQVKTACDRLKTDPAVYEILKSPTRVLEVNFPVKLDDGTVKTFTGYRSQHNNAVGPYKGGVRFHPGVNLDEVKALSIWMTIKCCVAGIPYGGGKGGVTLNPRDYSEAELERIARAYSEAISPLIGEKIDIPAPDVNTNGKIMSWMVDAYENVVKHSAPGVFTGKPVEFGGSLARTEATGYGVNLAAVQALEKLGKDVKGATYAIQGFGNVGYHTGYYAHQSGAKVVAVSTVDVAIYNENGLDMEAIIKEFQTKGFITNEAGYGKEITNAELLALEVDVLAPCALENQLTSENAGKVRATIVVEGANGPTTPEADVILRQNGVLVVPDILANCGGVVVSYFEWVQNLQGYYWEFDEVQEKETVVLRRAFRDIWNLAQEYDVDLRTASYMMSIRRVEKAMKLRGWY

SEQ ID NO: 66033 - protein, 242 aa, Geobacillus kaustophilus HTA426
MTITSWLAASRHTVVLTGAGMSTESGLPDFRSPRTGLWARFNPSELATIDALYHRRESFVEFYQYRIRTLQQCQPHDGHRLLADWERRGIVQTIVTQNVDGFHQEAGSRRVIELHGSLRTVHCQRCGESKPSFVYLHGVLTCECGGVLRPSVVLFGEPLPEKAITEAWEAAQQADLFLVLGSSLQVSPANQLPLVAKRNGAKLVIINWEPTELDDLADAVIHQRKIGEVLNELNEQLAEVDP

SEQ ID NO: 66034 - protein, 33 aa, Brassica rapa subsp. rapa
QAGGQTCAGNICCSQYGYCGTTADYCSPDNNCQ

SEQ ID NO: 66035 - protein, 34 aa, Brassica rapa subsp. rapa
ATYHYYNPAQNNWDLRAVSAYCSTWDADKPYSWR

SEQ ID NO: 66036 - protein, 391 aa, Chlamydophila abortus S26/3
MDYYDVLGVSKTASPEEIKKSYRKLAVKYHPDKNPGDAEAEKRFKEVSEAYEVLSDPQKRESYDRYGKDGPFAGAGGFGGAGMSNMEDALRTFMGAFGGELGGSGSFFEGLFGGLGEAFGMRGDPAGARQGASKKVHITLTFEEAARGVKKELLVSGYKTCETCSGSGASSKQGIKCCDRCKGSGQVVQSRGFFSMASTCPECGGEGRMITDPCSSCRGQGRIKDKRSVHVQIPAGVDSGMRLKMEGYGDAGQNGAPAGDLYVFIDVEAHPVFERRGDDLILELPIGFVDAALGMKKEVPTLLKEGACRLTVPEGIQSGTILKIKNQGFPNVHGRGRGDLLVRVSVETPQNLSEEQKELLRKFAATEKAENFPKKRSFLDKIKGFFSDLTV

SEQ ID NO: 66037 - protein, 478 aa, Geobacillus kaustophilus HTA426
MALPGGAAMNITIRLQFEKDIVSFSDIAAAIGKAGGDIVGIDVISSSKVHTVRDITVSALDTKQCDLIIEALKKIQGVKIINVSDRTFLMHIGGKIETNSKIPVKTRDDLSRVYTPGVARVCTAIAEDPRKAYSLTIKRNTVAVVSDGTAVLGLGDIGPYAAMPVMEGKAMLFKEFAGVDAFPICLNTKDTEEIIQIVKAIAPAFGGINLEDISAPRCFEIEKRLKEELDIPVFHDDQHGTAVVLLAGLLNALKIVDKKLEDIKVVLTGIGAAGIACTKILLAAGVRNIIGVDRHGAIHRDETYENPYWQEYAQITNPDNLKGSLSDVIAGADVFIGVSAPGILKVEDVKKMARDPIVFAMANPIPEIDPELAEPYVRVMATGRSDYPNQINNVLCFPGIFRGALDCRAREINEEMKLAAAKAIASVVTEDELNETYIIPSVFNSKVVERVRQAVIEAAYRTGVARKDNIPVGGYTGQ

SEQ ID NO: 66038 - protein, 678 aa, Chlamydophila abortus S26/3
MVAIQHELGSSIKEVLKLVWSLRFAENKMLLLSRQSDSGGTFQLSCAGHELVGVVAGKSLLRGKDWSFPYYRDQGFPVGLGCDLSEIFASFLGRLAPNHSSGRMMPYHYSHKKLRICCQSSVVGSQFLQAAGRAWAVKHTKSNEVVYVSGGDGSTSQGEFHEMLNYVALHKLPLVTVVQNNAWAISVPFKDQCSTDLVRLGESYQGLSVYEVDGGDYFKLVDTFSKAVDQARHTSVPALILVDVMRLEPHSNSDNHEKYRSREDLDHCKSHDPLIRLERLMIDECGISPAEILDIKAEAEAEVTRACEIAEGMPFPSKGSTSHDVFSPHTTSLIDYENSLEAQRLRDTQPKVMRDAITEALIEEMSRDSGVVVFGEDVAGDKGGVFGVTRNLTDRFGSERCFNTPLAEATIIGTAIGMAMDGIHKPVAEIQFADYIWPGINQLFSEASSIYYRSAGEWEVPLVIRAPCGGYIQGGPYHSQSIEAFLAHCPGIKVAYPSNAADAKALLKAAIRDPNPVVFLEHKALYQRRIFSACPVFSSDYVLPFGKAAITQVGSDLTIVSWGMSLVMSMEVAKELAALDISAEVIDLRTIVPCDFSTVIESVKKTSKLLIAHEASEFCGFGAELAATVAEQAYAYLDAPIRRVAGLHAPVPYSKILENEVLPQKEKIFQAAKSLAEF

SEQ ID NO: 66039 - protein, 130 aa, Glycine max
  misc_feature (27)..(27): Xaa can be any naturally occurring amino acid
  misc_feature (40)..(40): Xaa can be any naturally occurring amino acid
  misc_feature (89)..(89): Xaa can be any naturally occurring amino acid
  misc_feature (101)..(101): Xaa can be any naturally occurring amino acid
SLFLSNLKLVHYMKIPPLFMYSSHLIXTLLSYILNLSLSXFIFYIINYICIDHKLHHYTPFTYPNYILTFYASFIFPLILPNNLFLPHXLYINLLFLFLIXTFLPLPILFFIKIFPYNKFIPLINIPFIT

SEQ ID NO: 66040 - protein, 562 aa, Shewanella oneidensis MR-1
MDDNKRPLYLPFAGPAILEAPLINKGSAFSEEERIFFNLEGLVPYAIETIEEQASRAYDQFRSFNNDLDKHIYLRNIQDTNETLFYRLVQNHISEMMPIIYTPTVGLACERFSKNYRRNRGLFISYPNKDRIDDILNNSTRQKVKIIVVTDGERILGLGDQGIGGMGIPIGKLSLYTSCGGISPAYTLPITLDVGTDNPQLLEDPMYMGWRHPRIGGEEYAEFIEAFMQAVHVRWPDTLIQFEDFAQKNAMPILERYKERYCCFNDDIQGTAAVTVGSLLAACKAAGTELNKQRVAFLGAGSAGCGIAEAIVAQMVSEGISDEQARSQVCMVDRWGLLLDNMPNLLPFQQKLAQKCADISHWNNFSDNISLLDVVNNAKPTVLIGVSGAPGLFTEEIVRAMHSHCPRPIIFPLSNPTSRVEATPKDILHWTSGQALVATGSPFEPVVVDGETYEIAQCNNSFIFPGIGLGVLASGARHVSDAMLMASSRALAECSPLAINGSGPLLPKLEDIHSVSKHIAFAVGKVAIEQGLSLPASDELLMQSIEDNFWKPEYRRYKRTSF

SEQ ID NO: 66041 - protein, 192 aa, Arabidopsis thaliana
MKGRISKIGSYAISSSIRDQHQQPCISCTTFNILAPIYKRLSHKDQSLRESDNRAYWLGRNHRIIDWLLYERSSIICLQEFWVGNEELVNLYEKRLGDAGYLSYKLGRTNNRGDGLLTAVHKDYFRVVNSRDLLFNDCGDRVAQLLHVELVPPYSQYDAHQEVLIVNTHLLFPHDSTLSIVRLQQVEFCFKS

SEQ ID NO: 66042 - protein, 429 aa, Geobacillus kaustophilus HTA426
MRSYERSKTAYEEAVKLMPGGVNSPVRAFKSVGMTPIFMARGQGAKIYDIDGNEYIDYVLSWGPLILGHANPQVVEALKRVAEQGTSFGAPTLLENELAKLVIERVPSVEIVRMVNSGTEATMSALRLARGYTKRNKIMKFEGSYHGHGDSLLIKAGSGVATLGLPDSPGVPESVAQHTITVPYNDLDSVRYAFERFGEDIAAVIVEPVAGNMGVVPPVPGFLEGLREVTKQYGALLIFDEVMTGFRVDYHCAQGYYGIEPDLTCLGKVIGGGLPVGAYGGKAEIMELVAPSGPVYQAGTLSGNPLAMTAGYETLRQLTPETYEELGRKAARLADGLHQAAEKYDIPHTINRAGSMIGFFFTNEPVVNYETAKTSDLELFAAYYREMANEGIFLPPSQFEGLFLSTAHSDDDIEYTIAAAERVFARLRG

SEQ ID NO: 66043 - protein, 473 aa, Burkholderia mallei ATCC 23344
MAYRNDSLLTSAQQDTRHLLHPWADLSALGRETPTVIVEAQGTRVTDAEGRTYLDAIGGMWCVTLGYGRREIADAIRDQALRMPFYTPFGAMTNEPAAALGARLAELAPGDLKRVHLTTCGSTAVESALRFAHYYFGATGRPRKRHIVTRGDAYHGSTYLAASISGKAWDRTCFHYDSTIVHHLSSPNPYRRPAGMSVDAFCASLVDEFDALIAKLGAEQIACFIAEPILASGGVIVPPPGYLAAMRERCRRHDILYISDEVVTGFGRVGHFFASHAHFGIEPDMIVVAKGLTSGYQPLGAVLISERLVDAVSGEHAYGNGVFTNGFTYSGHPVACAAALANIELMERERICEHVRDVGPYFIRRLDALRRLPIVGDVRGDHLMACIECTSGAGATGALPTPADIAIAQRVDRHCEEMGLLVRPYESMCILSPPLTVTRADIDEICAILAAALERTQRELAQHAPVREENETC

SEQ ID NO: 66044 - protein, 470 aa, Burkholderia mallei ATCC 23344
MLINGLCIEGGGEPLSIVDPATGEPLAAPAAASAADLERAVAAAEAAFPAWRATTPATRASLLLALADEIDRQAGALARIESRNTGKPLHLVVQDELLAVADCFRFYAGAARTASGPSAGEYVEGHTSMVRRDPIGVVAQIAPWNYPLMMAAWKLAPALAAGNTIVFKPSEWTPLSIVALEAALARIFPTGVVNIVLGDGASVGRALATHPRVRMISLTGSVEAGKSVLAAAAGNLKRTHLELGGKAPVLVFDDADLDAAVAGIRYAGFYNAGQDCTAATRIYVQRGIYDTLAQRLADAASTLRVGPPDRADAEMGPLVSAAHRARVERFVREAAALRHARVLTGGAPLPGPGCYYAPTVIAGVRHDDAPMRREAFGPVVTLTPFDTESQALRWANDSEYGLASSVWTRDAARGMRLAACIDAGVTWVNAHFTYTADMPHGGTKQSGYGSDLSTLGLADYTQPRHVMWRH

SEQ ID NO: 66045 - protein, 236 aa, Neisseria meningitidis FAM18
MNAAIEHVQAVAFDLDGTLCDSVPDLAAAAEAMLEQLGMKPLPAKVVESYVGDGIGKLVHRVLTNDRDREADSELWEKGFVSYMKYYRDHLSVFTRPYPKTEAGLALLKSLGIPLAVVTNKNEILAVELLKQLGLADYFSLILGGDSLPEKKPSPLPLRHAAEVLGIDVANMVMVGDSRNDIIAAKAAGCLSVGVTFGYGDMTLLSQDDATRPDWIIGSLPEIYENLQPQKNKDEE

SEQ ID NO: 66046 - protein, 283 aa, Zea mays
  misc_feature (42)..(42): Xaa can be any naturally occurring amino acid
MAGSDEVNRNECKGAVPIHTWVLISNFKLAYNMLRRADGTFXPFPVILFFHGGSFAHSSSGTAIYDNLCRRLVRLSKGVVVSVNYRRAPEHRYPCAYDDGWAALKWATSQPSLGSGSSGGARVFLSGDSSGGNIAHHVAVRAAVAGIRVRGNVLLNAMFGGAERTESERRLDGKYFVTLQDRDWYWKAYLPEDADRDHPACNPFGPNGRRLAGLPFPRSLIIVSGLDLTCDRQLAYADGLREDGHHVKLVYREKATVGFYLLPNTNHYHEVMEEIADFLRANL

SEQ ID NO: 66047 - protein, 365 aa, Saccharomyces cerevisiae
MDLVLEVADHYVLDDLYAKVLPASLAANIPVKWQKLLGLNSGFSNSTILQETLNSKNAVKECRRFYGQVPFLFDMSTTSFASLLPRSSILREFLSLWVIVTIFGLLLYLFTASLSYVFVFDKSIFNHPRYLKNQMAMEIKLAVSAIPWMSMLTVPWFVMELNGHSKLYMKIDYENHGVRKLIIEYFTFIFFTDCGVYLAHRWLHWPRVYRALHKPHHKWLVCTPFASHSFHPVDGFLQSISYHIYPLILPLHKVSYLILFTFVNFWTVMIHDGQYLSNNPAVNGTACHTVHHLYFNYNYGQFTTLWDRLGGSYRRPDDSLFDPKLRDAKETWDAQVKEVEHFIKEVEGDDNDRIYENDPNTKKNN

SEQ ID NO: 66048 - protein, 477 aa, Neisseria meningitidis FAM18
MNEYSQLIKHPDISLSPISDSIGIGNPATGEILAYVRNTGSDKLKNLIQKAAAAQKLWAAKTALERADILWRWYFLVKENKEALARLMTMEQGKSLTEARGEIDYAASFVRWFAEEARRIDGDVLTSVKASQKLVVLKQPVGVTAAITPWNFPSAMIARKAAPALAVGCAMIVKPASLTPLSAYALASLAYEAGIPQDLLPVVSGSASEIGHEFATNPIIRKISFTGSTEVGAKIFADSAADIKKLSLELGGNAPFIVFDDADLDKAVEGALASKFRNSGQTCVCTNRVYAQSAIYDEFCRKLSEKAAALKLGNGLEDGVNQGPLIEEKAVEKVEQHIADALAKGASCLTGGKRSALGGTFFEPTVLSGVTAQMAVAREETFGPLCPVFRFETEAEVIEAANNTEYGLAAYLFTADTARQWRVGEALEYGMVGINTGLISNEAAPFGGVKRSGLGREGSKYGADEYLELKYLCMDVG

SEQ ID NO: 66049 - protein, 595 aa, Saccharomyces cerevisiae
MPTVSVNKQQLFDLLGKNYTSQEFDELCFEFGMEMDEDTTEEALKTGEEPELKLDISANRYDLLCIEGISQSLNEYLERKERPDYKLSKPTTKLIIDKSTEQIRPFATAAVLRNIKLNEKSYASFIALQDKLHANLCRNRSLVAMGTHDLDSIEGPFHYRALPPKDIKFVPLNQTQEFTGDKLIEFYKSPEQKNNIGRYVHIIEDSPVFPVIMDSKDRVCSLPPLINSEHSKISVNTRNILIDITATDKTKAEIVLNILTTMFSRYCDEPFTVEPVEIVSEHNGQSRLAPNFNDRIMDVSIKYINSCLGLDQSADEIAHCLKKMSLHAVQSKEDKDILHVDIPVTRPDILHACDIMEDAAVGYGFNNLPKGEKLSNANFIAKPLPINKVSDIFRVASSQATWVEVLPLTLCSHDENFKFLRQSDNGDLAVKLANPKTLEYQVVRTTLLPGILKTVKENRKHSLPIKVFETGDVVFKDDKLERKAYNERHWAAIYVGKNSGFEIIQGLLGKIMQTFRTEWIADYGAAASGRGYWIEEDDSVKTYFPGRGAKVMFRSKEGAEPKQIGHLGVLHPEVMMNFDVPFAASFVEVNAEVFL

SEQ ID NO: 66050 - protein, 2275 aa, Aspergillus nidulans FGSC A4
MPETVGHEEPALPSSPQAGGAVAYNAISKELQPLPPTETANGGIIPPASSRIEGSTGRLCALELEDGTVYQGYNFGAEKSVAGELVFQTGMVGYPESITDPSYRGQILVITFPLVGNYGVPSRETMDELLKTLPKHFESTEIHIAALVVATYAGENYSHFLAESSLGQWLKEQGVPAIHGVDTRALTKRIRQKGSMLGRLLLHKADVAETDAALAQDTWKSSFEQIDWVDPNTKNLVSEVSIREPKLFSPPENVALKHPSSRPIRVLCLDVGLKFNQLRCLVARGVEVLVVPWDYDFPTLAGKDYDGLFVSNGPGDPATMTTTVNNLAKTMQEARTPIFGICLGHQLIARSVGAQTLKMKFGNRGHNIPCTSLVTGKCHITSQNHGYAVDSSTLPSDWQELFVNANDGSNEGIRHVSRPYFSVQFHPESTPGPRDTEYLFDVFINAIKDTIASPEALQKPVNFPGGAVAENIKASPRVSVKKVLILGSGGLSIGQAGEFDYSGSQAIKALKEEGIYTILINPNIATIQTSKGLADKVYFLPVNADFVRKVIKHERPDAIYVTFGGQTALQVGIQLKDEFESLGVKVLGTPIDTIITTEDRELFARSMDSIGEKCAKSASASSLEEALQVVESIGFPVIVRAAYALGGLGSGFADNLDELKDLCAKAFAASPQVLIERSMKGWKEIEYEVVRDARDNCITVCNMENFDPLGIHTGDSIVVAPSQTLSDEDYNMLRTTAVNVIRHLGVVGECNIQYALNPYSKEYCIIEVNARLSRSSALASKATGYPLAFIAAKLGLNIPLNEIKNSVTKVTCACFEPSLDYCVVKIPRWDLKKFTRVSTQLGSSMKSVGEVMAIGRTFEEAIQKAIRSVDFHNLGFNETNALMSIKTELQTPSDQRLFAIANAMAAGYSVDDIWKLTNIDKWFLTRLKGLSDFGKLMTNYNASTVTAPLLRQAKQLGFSDRQLAKFLSSNELAIRRLRVEAGIIPIVKQIDTVAAEFPSVTNYLYLTYNASEHDVRFDDNGIMVLGSGVYRIGSSVEFDWCSVRTIRTLREQGHKTVMVNYNPETVSTDYDEADRLYFENINLETVLDIYQLESSSGVIMSMGGQTPNNIALPLHRLNVRILGTSPEMIDGAENRYKFSRMLDRIGVDQPAWKELTSIEEAREFCDKVGYPVLVRPSYVLSGAAMNTVYSEHDLASYLNQAADVSREHPVVITKYIENAKEIEMDAVARNGVMVGHFISEHVENAGVHSGDATLILPPQDLDPETVRRIEEATRKIGNALNVTGPFNIQFIAKDNDIKVIECNVRASRSFPFVSKVMGVDLIEMATKAMIGAPFAEYPPVTIPKDYVGVKVPQFSFSRLAGADPVLGVEMASTGEVASFGRDKYEAYLKALLSTGFKLPKRNILLSIGSYKEKMEMLPSIIKLRDVGFELFATSGTADFLKENGVPVKYLEILPGEDEDIKSEYSLTQHLANNLIDLYINLPSSNRFRRPANYMSKGYRTRRMAVDYQTPLVTNVKNAKILIEAIARHYALNVQTIDYQTSHRSIILPGLINVGAFVPGLGSADSKDFEAVTKASIAAGFSMIRVMPVGVDSSITDARTLKLVQQNAGKASFCDYNFSVVATSSNSAEVGQLTGEVGSLFIPFNHLSGNISKVAAVTSHFGAWPSSKPIITDAKSTDLASVLLLASLHSRNIHVMSVTSKEDIGLIALSKEKGLKVTCDVSIYCLFLSRDDYPEAAFLPTAEDQKALWEHLSTIDIFSIGSIPYQLAGEKGSPAAGIAEALPLLFTAVSEGRLTVEDIIARLYENPKKIFELHDQSDSSVEVEIDRPYLFQSAQAWSPFSGKSVKGLVQRVIFQGKTSCLDSEITPDAPKGSDMSGHRIVPASPSLKAMSPRVDGALDRRQSISIAGTPARLGRKPVDHFPAATGAELGPPLYTPVPRASSPLLQMLSRSPFKQKHVLSVNQFNRADLHLLFTVAQEMRLGVQREGVLDILKGRLLCTLFYEPSTRTSASFDAAMQRLGGRTIAISTEHSSTKKGETLQDTLRTLGCYGDAVVLRHPEPSSTEVAAKFSPVPVINGGNGSVEHPTQAFLDLFTIREELGTVGGLTITFTGDLKYGRPVHSLIKLLQFYDVRVQLVAPKDLSLPADIRQQLLATGQLLTESEELTPEIVARSDVLYSTRVQKERFADLEQYERLKNSFIIDNALLKHAKSHMVVMHPLPRNAEVSEEVDFDQRAAYFRQVSLQSRGPSSEFDMLMWMQMRYGLYCRMALLALIMAP

SEQ ID NO: 66051 - protein, 105 aa, Marinobacter sp. ELB17
MNVQEKILSQVTADTIVLYMKGKPQSPLCGFSATTVQVLNACGVQDFAAVDVLADPEIRDGIKVYSNWPTIPQLYIKGEFVGGADIVREMYEQGELQKLLQSALA

SEQ ID NO: 66052 - protein, 525 aa, Shewanella sp. MR-4
MSDIHEHKILILDFGSQYTQLIARRIREIGVYCELWAWDVTEAQIREFAPNGIILAGGPESVTADNSPRAPEYVFNAGVPVLGICYGMQTMSEQLGGKVIQGVGEGEFGYAQIEMLAQSALFKDIEDAVSADGKSLLDVWMSHGDKVSAIPEGFVAVAKTDTCPFAAMSCEEKRFYGVQFHPEVTHTRQGMRMLSHFALDICGCAANWKPSSIIEDAIERLKKQVGDDEVILGLSGGVDSSVVAMLLHRAIGKKLTCVFVDNGLLRLNEAKQVMEMFGDHFGLNIVHVDAENRFLDALKGEADPEAKRKIIGRVFVEIFDEEAKKCVNAKWLAQGTIYPDVIESAGSATGKAHVIKSHHNVGGLPDDMELGLVEPLRELFKDEVRKIGLELGLPYNMLYRHPFPGPGLGVRVLGEVKKEYCDLLRRADAIFIEELHKADLYNKVSQAFTVFLPVRSVGVMGDGRKYDWVVSLRAVETIDFMTAHWAHLPYDFLGRVSNRIINEIDGISRVVYDISGKPPATIEWE

SEQ ID NO: 66053 - protein, 232 aa, Arabidopsis thaliana; identical to SEQ ID NO: 1355

SEQ ID NO: 66054 - protein, 192 aa, Alkalilimnicola ehrlichei MLHE-1
MSSVLVPLATGCEELEAVTVIDLLRRAGIDVVTASLDGEPVRASRGVTLVADTHLDEALRRDFDMVVLPGGAEGARRLGEDDRVTELLRKLADSERFTAAICAGPKVLAGAGLLEGRQATAFPGALDDVPGVELRGGEPVVVDASVVTSRGPGTAMDFALRLIELLAGEAQAAEVEQQLQRPSGHRQYNGEA

SEQ ID NO: 66055 - protein, 461 aa, Ostreococcus tauri
MTTARTRGDEGATRATRFGSSDAAARKATTVKMARRFASRVRARASVRTPGAVANPLATPTYDDVPEGRERDAKEPIRLKIGDEWYDARGWAKAHPGGERWIHFFDGRDATDIFYALHSYGPNGSDLALRRLSKLPRCDPPKDMSRMPSKESYAVISSFGELRDKLAEDGFFKRNPVKEAWALFQVVALYVSGTAVAYSHPFIATILLSLGMQQAGWLGHDYVHGRGPWCDLMRYMPTLLNGHSVEWWMQKHSMHHTFTNEEHLDNDIMMEPFFYLREPSASGRPDHPMRKYQHIYGYPLLSIMFWLWRFHSITTAWGRKDVKELAMIGVNYLFLATMMPWQVAVGSIFFSGFLVGALVSATHQSEEIMDFGEGAEYVEGQFRSTRDAECVFGGLETWLWGGMDTQLEHHLFPTMPRYHYHKLRPLLKSWAKANGIEYRSSPSTTIISDNFKTLFRVAKAA

SEQ ID NO: 66056 - protein, 251 aa, Buchnera aphidicola str. Bp (Baizongia pistaciae)
MILLKIIHIIFVMIFLSIFFPKSLYASTSLIRKDHIIQKNLENFDDQSAYALGVSLGNYINHSFREQKRLGVILDKNSLLSGIRDSLSGKTILSDQEISMELIKLEKKLKYFEDIVLKKEAHNNKIQGDLYIKKMLKKKDARHTSSGLVFFIKKKGSGKFLHDSDVITVHYKGSLINGNEFDNSYKRGQPLSFSLDSVIPGWIEGLKYIKKGGLIKLVIPPKLAYGETGVPGIPGNSTLIFEIELIDIQSK

SEQ ID NO: 66057 - protein, 380 aa, Zea mays
MATAGKVIKCRAAVAWEAGKPLSIEEVEVAPPQAMEVRIKILYTALCHTDVYFWEAKGQTPVFPRILGHEAGGIVESVGEGGVTELAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQAKKFGCTEFVNPKDHDKPVQEVLIELTNGGVDRSVECTGNINAMISAFECVHDGWGVAVLVGVPHKDDQFKTHPMNFLSEKTLKGTFFGNYKPRTDLPNVVEMYMKKELELEKFITHSVPFSEINTAFDLMLKGESLRCIMRMED

SEQ ID NO: 66058 - protein, 265 aa, Vibrio cholerae O1 biovar eltor str. N16961
MIRYGDIPMRRPVVMGNWKLNGSKAMVTDLLNGLNAELEGVEGVDVVVAPPAMYLDLAERLIKEGGNKLILGAQNTDTHNSGAYTGDMSPAMLKDFGASHIIIGHSERRDYHKESDEFVAKKFAFLKENGLTPVFCIGETEAQNEAGETEAVCARQINAVIDAYGVEALNGAIIAYEPIWAIGTGKAATADDAQRIHASIRALIAAKDAAVAEQVIIQYGGSVKPENAASYFAQPDIDGALVGGASLDAKGFAAIAKAAAEAKKA

SEQ ID NO: 66059 - protein, 385 aa, Arabidopsis thaliana
MTMRSLPFSSSSYSLASTSLSNRLETIFKKASELCTLCDIEACVIYYGPDGELKTWPKEKEKVRDIALRYSQLNEALRSKKSVNLHGFLNKKKKKKKKGLKNPNNKRKTCLKKNVNVLKYPLADHYPPDQVSQLTQSLKLHVSKFQERLRFLESQKQTKPDHQSLTPSSLNHQTQSLNPRQFSLFMYNHGDNTLSQISVSASNFNQNYFSALLEQSELKNQLMKQDGYDQNQNMRMGDITNNNFQLPYFSKKEAVQESVNYFGMNQLMLKELYGCDQNMCMGNINSNSFQHPCVSKAQHYSAVEGSVNNQRQSELMQQELCGYEQNMCFTNNNFQVSNKEAVQESVTNFGLMQHELYGCDQNMSMGNIINNSFQQRLKHRTRICE

SEQ ID NO: 66060 - protein, 195 aa, Geobacillus kaustophilus HTA426
MNVKKAELVTSAVKPEQYPDGGRPEVALAGRSNVGKSSFINKMINRKNLARTSSKPGKTQTLNFYLINDSFYFVDVPGYGFARVSKQERQKWGNMMETYFTTREALKAAVLLVDLRHPPTKDDVMMYEFLKHYEIPVIVIATKADKVPRGKHQKHAKIARETLRMADGDPLILFSAETGQGKDEAWAALLPFVAS

SEQ ID NO: 66061 - protein, 430 aa, Robiginitalea biformata HTCC2501
MSIIIDVHARQILDSRGNPTVEVDVVTENGVLGRAAVPSGASTGEHEAVELRDGGKTYMGKGVSQAVKNVNTEIAEKVRGMLVYEQNKIDQAMIELDGTPNKGRLGANAILGVSLAVAKAAANEMGQSLYRYVGGVSANTLPVPMMNIINGGSHSDAPIAFQEFMVMPVKAKNFTHAMQMGTEIFHNLKKVLHDRNLSTAVGDEGGFAPTLDGTEDALDTIAKAVEQAGYKMGDEVMIALDCAAAEFFVDGKYDYTKFEGDSGAVRNSAEQAQYLADLCAKYPIISIEDGMDENDWEGWKMLTDKVGDTVQLVGDDLFVTNVERLSRGIDEGIANSILIKVNQIGTLSETIDAVNMAKNAGYTSVMSHRSGETEDNTIADLAVALNTGQIKTGSASRSDRMAKYNQLLRIEEELGSVAYYPGSDAFKVRS

SEQ ID NO: 66062 - protein, 343 aa, Arabidopsis thaliana
  misc_feature (84)..(84): Xaa can be any naturally occurring amino acid
MAKSFEKPKFSLRLLIDEEKNRVILAEAGKDFVDVLCSLLTLPMGTIVRLLEKHQNPQSSVVGCLHNLYKSVADMDVDNFESQXCKHFLLHPRSAKGSHGRDLKLNIDDTEATKFFVCPNFVSTEACRKLFSNVSTMKCRCGSSMHREIPVEEQQADGVFPSCRTSFVITDDLKVALNSMGLVLNVLNDFGYSGFDKLQEMLIDVGFEEILTLLGCLFTSEAPLTDTFLRKHCMSRKRKMLTPLVQESSVAGAADNLLTLKVYVRKTDRAVLYAECREEFVDFLFTFLAIPIEFAWELSIDIGNMGCVGNLCRSVKDLSFEKQKAATVSQCMLPYFYWKGTTS

SEQ ID NO: 66063 - protein, 419 aa, Burkholderia mallei ATCC 23344
MNANLHAFTAADTAPSTEYWWARERLHYRGNALHFCGRDVAELAAAFAEPVFLYDPQRALDNVARLQRALGDLQRGDFRLHYAMKANRFRPLLSELRRSPLFGIDACSPEELREALACGFAPERISYTAHGMMPDEAALLAALPGVHVNCDTLSAIALLGSRSPGREIGIRVNPGVGIGYGDSERLSYAGAAVTKFGIYAEQFGAALELAARHGLAVTWLHCHAGCGYLDAQLESFERVLDALDAFAARVPGLRGINLGGGLGLPHRATDRPLDLERWRAAVHARFGGRPLAIAIEPGDFIAKDAGMLVLRVAYVELKRNRRFVGLNGGFNLAIEPAFYDLPCEPVPCVRRPGPAQSVCVAGNINEALDVWGNDVSLPPVEPGDFIALLNAGGYASSMSSNHCLRGQFRELALFDAAPH

SEQ ID NO: 66064 - protein, 104 aa, Glycine max
MSGRGKGGKGLGKGGAKRHRKVLRDNIQGITKPAIRRLARRGDVKRISGLIYEETRGVLNIFLENVIRDAVTYTEHARRKTVTAMDVGLCAHEAGKRPSYGFGG

SEQ ID NO: 66065 - protein, 182 aa, Candidatus Kuenenia stuttgartiensis
MNSKEAHAMQSIKGKKVVIIIAKNNFRDEELLEPKAILEKNGAAVTIASSSLKESKGMLGAKVSPDILFTDIAVGDYDAVIFVGGTGSSEYWDNPTAHTIAKEANKVNKIVGAICIAPVTLAKAGLLKGKKATTYSSTVNDIKSEGANYTGEGVERDGNIITADGPASAKKFGEAIVKALQK

SEQ ID NO: 66066 - protein, 502 aa, Coccidioides immitis RS
MSDLFTELTAPNGRKYTQPLGLFINNEFVAAKSGQKITSINPTNEAEIASVHAAGAEDVDIAVKAAKKALKDPSWKELPPTDRGKLMVKLAELVEQHIETLATIEAWDNGKPYSVAVSEDCVEVAETLRFYGGFADKVYGSTISTSPAKFAYTLRQPIGVVGQIIPWNYPLAMAAWKLGPALACGNTVVLKPAEQTPLSILYFANLIKEAGFPPGVVNILNGFGKDAGAAIASHLDIDKIAFTGSTATGRQIMKMAAVNMKNITLETGGKSPLLVFGDADLEQAAKWAHIGIMSNMGQICTATSRILVQDTVYDKFVAQFKEVVASTSKVGDPFADDTFQGPQVTKAQYDRVLSYIESGKSEGAKLESGGVPHKNVGDGKGFFIEPTIFTNVNDNMKIYREEVFGPFVVIAKFSTEEEALSKANDTTYGLGAAVFTRDIERAHRVAAEIEAGMVWINSSNDSDFRVPFGGVKQSGIGRELGEAGLEAYSQTKAVHVNMGTKL

SEQ ID NO: 66067 - protein, 544 aa, Methanosarcina barkeri str. Fusaro
MPVITLQYDDLEKLTGTDKETIIKRAPMIGADIERVEEESIDIEFFPDRPDLYSVEGAARAMRGFLDLETGLSKYEIKPPKVSISVSEKILRIRPFLGCAVVRGIKFTSSSIKSLMDLQEDLHWGLGRNRKKVSIGVHDLSNVKPPFRYMAVDPGFKFVPLDYTEKMSMTEILEKHPKGTRFAHLVRGFKKYPIILDSDDNVLSFPPIINGTLTSVTESTTDLFIDVTGLGEAVYTALNIVVTALAERGGQIEFVKVVRPDSGELILPDLEPKTRFLTKTEVRDLLGMELSIEEIVKQLERMRFGAKALDEETIEVKVPAYRADILHNYDLVEDIAKGYGYENIKVKIPETYTPGKSHPISLLRAPVNEIMVGLGYYEVMPFTLTSEKINFENMRRQKTDDVTYVLHPISEDQTMIRTTLLPNLLEILALNQHRELPQKIFEFGEVVNNEITGQHVAAVSIHPQANFTEIYEVVDALMREMMLPYEVKESEDPAFLEGRRADVYVNGKKLGVFGEFHPEVINNFALGYAVVGFELDLNDLIGQS

SEQ ID NO: 66068 - protein, 388 aa, Coccidioides immitis RS
MGHGRFNEVKVHTRIAEMSGPLFPPFHRRKMVVIRRRAPYTQAVVELNLSLAKDPLTRPVLFEQLRYALISVGFLYISNHGVPEKVINDLVNVLPELFDLPESAKEEIALRNSPHFLGYSSVGSETTGGKADKREQAEFATELLAVESKDAPLYERLRGPNQLPPLRPAVTSYIQELTALGERFLRLVAEALSLPQETFFHFLSDQHRLKLVHYPGASNSPSSGTITQGVGPHKDSSGWWTFLLQASPPEIKGLQALNKNGDWIDVPVIPGTFVVNIGQAFEVVTNGVCKATTHRVLMSGYKDRYSVPFFQGVRRNLTKTEAVETLKEHFSRFAAGGESVEAKDIDSTFLRGKYDTWGESQLRTKIRSHRDVGKKFYGDVFDKYVNDD

SEQ ID NO: 66069 - protein, 356 aa, Saccharomyces cerevisiae
MTDLTTQEAIVLERPGKITLTNVSIPKISDPNEVIIQIKATGICGSDIHYYTHGRIANYVVESPMVLGHESSGIVALIGENVKTLKVGDRVALEPGIPDRFSPEMKEGRYNLDPNLKFAATPPFDGTLTKYYKTMKDFVYKLPDDVSFEEGALIEPLSVAIHANKLAKIKFGARCVVFGAGPIGLLAGKVASVFGAADVVFVDLLENKLETARQFGATHIVNSGDLPHGVTVDSVIKKAIGKKGADVVFECSGAEPCVRAGIEVCKAGGTIVQVGMGQEEIQFPISIIPTKELTFQGCFRYCQGDYSDSIELVSSRKLSLKPFITHRYSFKDAVEAFEETSHHPLNNIKTIIEGPE

SEQ ID NO: 66070 - protein, 298 aa, Bacillus halodurans C-125
MVDTGTDRVKRGMAEMQKGGVIMDVVNAEQAKIAEEAGAVAVMALERVPADIRAAGGVARMADPTIVEEVMNAVSIPVMAKCRIGHIVEARVLEALGVDYIDESEVLTPADEVYHLNKRDFTVPFVCGARDLGEAARRIGEGASMIRTKGEPGTGNIVEAVRHMRMMQAQIRKVSNMSTDELMTEAKNIGAPYELLLSIKETGELPVVNFAAGGVATPADAALMMQLGADGVFVGSGIFKSETPEKFARAIVEATTHYEDYDLIAKLSKGLGTAMKGIEISTLDASERMQERGWEKGS

SEQ ID NO: 66071 - protein, 526 aa, Clostridium difficile 630
MLIGTSKLSRNVDTACVEEVGIPMIVLMENAVISAMKNMDIDMYNSYTVVCGVGNNGGDGLGIARHLNTYGKEVNVFLVGNLEKLSECSKINYNVLLNMGINIININKNDLSEKNYGDENEVDKIIKVEKQNIIKNKNLTIFKDRVSKSDVVVDAIFGTGLKRDITGIFKEVIDIVNDNSKNTYSIDIPSGIDSDNGNVLGTCIRANKTISFEFYKRGFLNYDTSTLIGDVVVEKIGVPDFITRKYHDEEFITDKTFVKNNIRRRDKHGFKSDFGKVSIVAGSKGFYGASFIATESAVKSGSGLVTLISSEDVQEKVSIRLTEAMTLNFEEERLNKLLNSSDAIGFGPGMGDNSQTFDKLLKIVENSNCPIVLDADGLNVMKDRCYKFLEWKNRFVITPHLGEMARLTGDSIGYIREHRVDVAKEFAQKYNLVVLLKGYQTVITDGKKTYINPTGNSCMATGGMGDCLLGMITSFIGQGMDILEATVSGAYIHGYIGDKLSKAMYTVNATDLISNISLTMKELLDI

SEQ ID NO: 66072 - protein, 371 aa, Geobacillus kaustophilus HTA426
MGNYRIAVLPGDGIGKEVTSGAVEVLKAVGIRFGHEFTFEYGLIGGAAIDEAGTPLPEETLRLCRESDAVLLGAVGGPKWDDNPPHLRPEKGLLAIRKQLDLYANLRPVVCYDSLVSASPLKPDLVQGVDFVIVRELTGGIYFGQPSGRVVENGEEKAVDTLLYKKEEIERIVRMAFILARGRKKKVTSVDKANVLSSSRLWREVAEEVAKQFPDVTLEHMLVDNAAMQLIRAPKQFDVIVTENMFGDILSDEASMLSGSLGMLPSASLSASGPSLYEPVHGSAPDIAGMNKANPIAAILSAAMMLRLSFGLTAEAEAVEHAVRQALDQGLRTADLAPSGGRIVSTNEMVEEIKTAVLDYTAIAQIMTVYA

SEQ ID NO: 66073 - protein, 425 aa, Vibrio cholerae O1 biovar eltor str. N16961
MSDDNRLNPTPEEQFRQRALDYHAYPTAGKIGIALTKPADSAADLALAYSPGVAEPVREIAQNVDNVYKYTAKGNTVAVISNGTAILGLGNLGPMASKPVMEGKALLFKRFAGLDSIDIEVKHRTIDEFIDTVANIADTFGGINLEDIKAPDCFEIERRLIERCDVPVFHDDQHGTAIVTAAGMLNALELQGKQLKDCIIVCLGAGAAAVACMELLIKCGAMREKIYMLDRKGVIHTRRDDLNEYKALFANNTDKRTLEDVIAGADLFLGVSGPNLLPADALKLMADKPVVFACSNPDPEIKPEIAHQVRNDMIMGTGRSDYPNQVNNVLCFPFIFRGALDVRASEINDQMKLAAVEAIRQLAKEPVPAEVLAAAGVDKLSFGIDYIIPKPMDPRLLPRVARAVAEAAVESGVARIPMPENYMQA

SEQ ID NO: 66074 - protein, 386 aa, Clostridium difficile 630
MKKEMLAMILAGGQGSRLGVFTKRIAKPAVSFGGKYRIIDFVLSNCSNSGIDTVGVLTQYRPLILNSHIGMGSHWDLDRINGGVYVLQPFMNEKEGNWYNGTAHAIYQNMDFVDTYNPEYVLILSGDHIYKMDYSKMLKFHKEKGSKATIAVIEVPWDEASRFGIMNTNEDSSIYEFEEKPSEPKSNLASMGVYIFDWKMLRNYFKEAEKNPEINYDDFGKNLIPKMLEDNVGMYAYPFKGYWRDVGTIQSLWDANMDIIKSPETLDLADPKWKIYTNTMAMPPQYIGKNANVHRSMIADGCRILGEVGNSVLSHGVVVGKGSKVIDSVIMPNVVIGENVTIEKAMIGECATINDNVQIKNVNNEINVVSEYENIEPRCVLIEGGL

SEQ ID NO: 66075 - protein, 234 aa, Bacteroides thetaiotaomicron VPI-5482
MKNLVVLTGAGMSAESGISTFRDAGGLWDKYPVEQVATPEGYQRDPALVINFYNARRKQLLEVKPNRGHELLAELEKNFNVTVITQNVDNLHERAGSSHIVHLHGELTKVCSSRDPYNPHYIKELKPEEYEVKMGDKAGDGTQLRPFIVWFGEAVPEIETAVRYVEKADIFVIIGTSLNVYPAAGLLHYVPRGAEVYLIDPKPVDTHTSRSIHVLRKGASEGVEELKQLLIPAP

SEQ ID NO: 66076 - protein, 292 aa, Arabidopsis thaliana
MSGGLDMSLDDIIKSNRKPTGSRGRGGIGGGNNTGGRGGSGSNSGPSRRFANRVGARTAPYSRPIQQQQAHDAMWQNDVFATDASVAAAFGHHQTAVVGGGSSIETGTKLYISNLDYGVSNEDIKELFSEVGDLKRYGIHYDRSGRSKGTAEVVFSRRGDALAAVKRYNNVQLDGKLMKIEIVGTNLSAPALPILATAQIPFPTNGILGNFNENFNGNFNGNFNGNFRGRGRGGFMGRPRGGGFGGGNFRGGRGARGRGGRGSGGRGRDENVSAEDLDAELDKYHKEAMETS

SEQ ID NO: 66077 - protein, 199 aa, Oryza sativa (japonica cultivar-group)
MASLTIVVATIFLLSLTSASVAVHGRSSRRRFVRSYDEPCMEMRLYLHDILYDYSNSTSNSTAAAATKPTALANAVPSTGGTFFGEVVVFNDPVTEGRALPPSLEETAVRAQGLYLYNSKEAFNAWLAFSIVFNSTGRRGTLNLMGADIIAEKTRDISVVGGTGDFFMSRGVATLRTDAFEGFTYFRLQMDIKLYECYV

SEQ ID NO: 66078 - protein, 223 aa, Neisseria meningitidis FAM18
MTTQDELKRIAAEKAVEFVPENEYIGIGTGSTINFFIEALGKSGKKIKGAVSTSKKSSELLAQYDIPVVSLNEVSGLAVYIDGADEVNHALQMIKGGGGAHLNEKIVASASEKFVCIADESKYVSRLGKFPLPVEVVESARSLVSRKLLAMGGQPELRIGYTTFYGNQIVDVHGLNIDKPLMMEDEINKITGVLENGIFARDAADVLILGTEEGAKVIYPCQG

SEQ ID NO: 66079 - protein, 441 aa, Oryza sativa (japonica cultivar-group)
MATITIVRITIGEEKKTCRLLEVKAAHVKAKERNDGGSWRKSSDGVGHHDCSPGLSDNSMSKEDAMSTGDSTESLDIDCLDDGDSEVVSSLQHLADDKLHISDNRDVAGVASKWTKHGCNSVEIDYIVDIDNNHEDPQLCATLAFDIYKHLRVAEQTKKRPSTDFVETIQKNIDTSMRAVLIDWLVEVTEEYRLVPETLYLTVNYIDRKYEEICPPQVEELCYISDNTYTKDEVLKMEASVLKYLKFEMTAPTTKCFLRRFLRAAQVCHEAPVLHLEFLANYIAELSLLEYSLICYVPSLIAASSIFLAKFILKPTENPWNSTLSFYTQYKPSDLCNCAKGLHRLFLVGPGGNLRAVREKYSQHKAQLPRANLMAKAHGSSSTFQFEKWRLRNLSLRKMENERRCARFCHQDGTRQLTPWDVLKAHDNEKLRASRKIVKIE

SEQ ID NO: 66080 - protein, 355 aa, Anabaena variabilis ATCC 29413
MSATPVTQLTPSSQPQQPCLPLLGASVTELTSWVQQQGQPAYRGKQLHDWIYHKGVRSLTDISVFSKQWRAAVADVPIGRSTIHHRSVASDGTVKYLLQLSDGEIVETVGIPTDKRLTVCVSTQVGCPMACDFCATGKGGYKRNLERHEIVDQVLTVQEDFQQRVSHVVFMGMGEPLLNTENVLAALRSLNQDVGIGQRSLTLSTVGIRDRISQLAEHHLQVTLAVSLHAPNQALREQLIPSARSYHIEDLLAECREYVAITGRRISFEYILLAGVNDLPEHALELSKHLRGFQNHVNLIPYNPISEVDYKRPSGDRIQAFLTVLQQQHIAVSVRYSRGLEADAACGQLRTKTSR

SEQ ID NO: 66081 - protein, 325 aa, Agrobacterium tumefaciens
IAGWKAINESDMVLMPDPATAHIDPFFAQSTLVVLCDILDPVSGEAYNRDPRGTAKKAEAYLKASGIGDTVFVGPEPEFFVFDDVKYKADPYNTGFKLDSSELPSNDDTDYETGNLGHRPRVKGGYFPVPPIDSLQDMRSEMLTVLAEMGVVVEKHHHEVAAAQHELGVKFDTLVSSADKMQIYKYVVHQVANAYGKTATFMPKPIFGDNGSGMHVHQSIWKGGKPTFAGDEYAGLSENCLYYIGGIIKHAKAINAFTNPTTNSYKRLVPGYEAPVLLAYSARNRSASCRIPFGSNPKAKRVEVRFPDPTQNPYLGFAAMLMAGL

SEQ ID NO: 66082 - protein, 504 aa, Staphylococcus epidermidis ATCC 12228
MKIRKRLDTYYTTIFLSTNSNYSYLSKEESRMTGEVKKYVDLLVIGAGSGGYVAAIRAAQLGKKVVLVDKAELGGVCLNRGCIPSKALISASERVKHIKHANTMGLKVSGEVQVDMPEVVKWKDGIVNKLTDGIRTLLKGNGVEVISGEAYLTEAHIAKIKIEDEEQIFSYKDLILAIGSLPVELKSMPFDQKRIISSTEALQLQEVPNHLVVVGGGYIGLELGTAYAKFGAKVTILEGSDTILSGTDPILTKTVKRHLKEIGITVITDALVQGGENTGDEVNVHVQVDGKEEIIQCDYCLVSIGRKPNTGKIGLENIGVVLDDQGFIKINNKCQTNIEHVYAIGDCAGGDLLAHKASYEAKIAAEVISGQNSVIDFQAMPFVIFSDPEVAYTGLTEKEAKEKGYETVSSRFPFQANARALSVSDADGFVQVVAEKNTKRVLGVQMVGPEVSSLIAEAVFAIEAGANAEDLSLTIHAHPTLPEPLMEAAEGVMGHATHMLNKKQ

SEQ ID NO: 66083 - protein, 325 aa, Agrobacterium rubi
IAGWKAINESDMVLMPDTGTVHMDPFFAQSTMVIICDILDPISGESYNRDPRGTAKKAEAYLKASGIGDTVFVGPEPEFFVFDDVKYKADPYNTGFKLDSSELPSNDDTDYETGNLGHRPRVKGGYFPVPPVDSLQDMRSEMLTVLGEMGVVVEKHHHEVASAQHELGVKFDTMVSSADKMQIYKYVVHQVANAYGKTATFMPKPIFGDNGSGMHVHQSIWKGGKPTFAGDEYAGLSETCLYYIGGIIKHAKAINAFTNPTTNSYKRLVPGYEAPVLLAYSARNRSASCRIPFGSNPKAKRVEVRFPDPAQNPYLGFAAMLMAGL

SEQ ID NO: 66084 - protein, 325 aa, Rhizobium giardinii
IGGWKAINESDMVLMPDPATVHMDPFFAQSTMVIVCDILDPVSGEAYNRDPRGIAKKAEAYLKASGIGDTVFVGPEPEFFVFDDVKYKADPYNTGFKLDSSELPSNDDTDYETGNLGHRPRVKGGYFPVPPVDSCQDMRSEMLTVLTEMGVTVEKQHHEVAAAQHELGVKFDTLVRNADKIQIYKYVVHQVANAYGKTATFMPKPIFGDNGSGMHVHQSIWKDGKPTFAGDEYAGLSETCLFYIGGIIKHAKAINAFTNPTTNSYKRLVPGYEAPVLLAYSARNRSASCRIPFGTGPKSKRVEVRFPDPLANPYLGFAAMLMAGL

SEQ ID NO: 66085 - protein, 512 aa, Streptococcus pyogenes M49 591
MKAVEANEPGKLILVTAINPTPAGEGKSTMSIGLADALNQMGKKTMLALREPSLGPVMGIKGGAAGGGYAQVLPMEDINLHFTGDMHAITTANNALSALIDNHLQQGNDLGIDPRRIIWKRVLDLNDRALRQVIVGLGSPVNGVPREDGFDITVASEIMAILCLATDLKDLKKRLADIVVAYTYDRKPVYVRDLKVEGALTLILKDAIKPNLVQTIYGTPALIHGGPFANIAHGCNSVLATSTALRLADYTVTEAGFGADLGAEKFLNIKVPNLPKAPDAIVIVATLRALKMHGGVAKSDLAAENCEAVRLGFANLKRHVENMRQFKVPVVVAINEFVADTEAEIATLKALCEEIKVPVELASVWANGAEGGLALAKTVVRVIDQEAADYKRLYSDEDTLEEKVINIVTQIYGGKAVQFGPKAKTQLKQFAEFGWDKLPVCMAKTQYSFSDNPSLLGAPTDFDITIREFVPKTGAGFIVGLTGDVMTMPGLPKVPAAMAMDVAENGTALGLF

SEQ ID NO: 66086 - protein, 248 aa, Candida albicans
MARQFFVGGNFKANGTKQQITSIIDNLNKADLPKDVEVVICPPALYLGLAVEQNKQPTVAIGAQNVFDKSCGAFTGETCASQILDVGASWTLTGHSERRTIIKESDEFIAEKTKFALDTGVKVILCIGETLEERKGGVTLDVCARQLDAVSKIVSDWSNIVVAYEPVWAIGTGLAATPEDAEETHKGIRAHLAKTIGAEQAEKTRILYGGSVNGKNAKDFKDKANVDGFLVGGASLKPEFVDIIKSRL

SEQ ID NO: 66087 - protein, 325 aa, Rhizobium gallicum
IGGWKAINESDMVLMPDTETVHMDPFFAQSTMVIVCDILDPVSGEAYNRDPRGTAKKAEAYLKASGIGDTIFVGPEAEFFVFDDVKYKADPYNTGFKLDSSELPSNDDTDYETGNLGHRPRVKGGYFPVPPVDSAQDMRSEMLTVLAEMGVVVEKHHHEVAAAQHELGIKFDTLVRNADKMQIYKYVVHQVANAYGKTATFMPKPIFGDNGSGMHVHQSIWKGGKPTFAGDEYAGLSETCLYYIGGIIKHAKAINAFTNPSTNSYKRLVPGYEAPVLLAYSARNRSASCRIPFGSNPKAKRVEVRFPDPTANPYLAFAAMLMAGL

SEQ ID NO: 66088 - protein, 325 aa, Rhizobium leguminosarum
IGGWKAINESDMVLMPDTETVHMDPFFAQSTMVIVCDILDPVSGEAYNRDPRGTAKKAEAYLKASGIGDTVFVGPEAEFFVFDDVKYKADPYNTGFKLDSTELPSNDDTDYETGNLGHRPRVKGGYFPVPPVDSAQDMRSEMLTVLSEMGVVVEKHHHEVAAAQHELGIKFDTLVRNADKMQIYKYVVHQVANAYGKTATFMPKPIFGDNGSGMHVHQSIWKGGKPTFAGDEYAGLSESCLFYIGGIIKHAKAINAFTNPSTNSYKRLVPGYEAPVLLAYSARNRSASCRIPFGSNPKAKRVEVRFPDPTANPYLAFAAMLMAGL

SEQ ID NO: 66089 - protein, 404 aa, Coccidioides immitis RS
MFSRLVRARSSAQLGRFPSSVARRSVTTNAASAHADNVPAEDDKPFTIKLSDESFETYELDPPPYTLEVTKKELKQMYRDMVAIRRMEMASDRLYKEKKIRGFCHLSTGQEAVAVGIEHALDREDKLITAYRCHGFAYMRGGTIKSIVGELLGRREGIAYGKGGSMHMFAPGFYGGNGIVGAQVPVGAGLAFAQKYEGKQNTTICLYGDGASNQGQVFEAFNMAKLWNLPVIFGCENNKYGMGTAANRAAAMTDYYKRGQYIPGLKINGMDVLAIKAAVKYGREYTLAGHGPLVFEYVTYRYGGHSMSDPGTTYRTREEIQRMRSTNDPIAGLKHKLLDWNVTTEEELKTIDKETRSFVDSEVAEAEKMPVPDANSRILFEDIYVRGSEPLWMRGRTVEETFYY

SEQ ID NO: 66090 - protein, 130 aa, Brassica napus
  misc_feature (123)..(123): Xaa can be any naturally occurring amino acid
IYHDLNAYRILFDDEGDPRLSTFGLMKNSSNGKSYSTNLAYTPPEFLRTGRVIPESVVYSYGTILIDLLSGKHIPPNHALDMIRGRNALLLMDSSLEGQFDNEDATKLVDLASKCLQNEAKDXPDTKFLQ

SEQ ID NO: 66091 - protein, 376 aa, Clostridium difficile 630
MRNECLGIINLNKKGDPAINKLNYGRPIASTPIAGRYRIIDFALSNMINSGITKVGIFAKEKYRSLTDHIGSGKDWDLSRKKGGLSIFSPENTKYRNTYSHREGDIYTILANLDYIEKSEEEYILIAPSYMLCNLNYSQALEYHKKSHNDITIIYKNVNNANKDFAGNLTLNLDSNNRVINVGNNLGKFPRANICMETYIMKREDFVECIYNIVNKGNYCYLEEFIIEEAENMKIGAYEYTGYLKCVNSVESYFEMSKDLLNLEVADELLYSERKIFTKEKNESPTIYTDSAKVENSFIASGCLIEGTVKDSIIFRKVNVEKGTVIENSIVMQNCVIKSNAKLYNAILDKNTSVSNGKELRGDEKYPLVVEKNTNI

SEQ ID NO: 66092 - protein, 330 aa, Legionella pneumophila str. Lens
MTIRVAINGYGRIGRCILRSIFEYNRQNEFEVVAINDLSGIDVTAHLTRYDSTHGPFRSDVSIEGNMLIVDGHGIQVIAERDPAKLPWKQLDIDIVFECTGFFTSRDAAMGHINAGAKKVLISAPAKGVDTTVVYGVNHSVIKASDVIVSNASCTTNCLAPVVKVLHDAIGIESGLVNTVHAYTKDQMLLDGSHKDLRRARSATQSIIPTKTGAAAAVGLVLPELAGKLDGFAMRVPVLNVSVVDLTFQAKRATSVEEVNDILRKAKSRILQINEDPLVSCDFNHNPASAIFDTTETKVIGNLVKVVAWYDNEWGFSNRMIDTAHQMMNC

SEQ ID NO: 66093 - protein, 668 aa, Legionella pneumophila str. Lens
MNSFTELANAVRMLSIDAVNQAQSGHPGMPLGMADIATVLWKKFLKFNPQNPHWFNRDRFVLSNGHGSMLLYSLLHLTGYNLDIGELKNFRQLHSKTPGHPEHGHTPGVETTTGPLGQGLANSVGMALAERVLASTFNHDHFNLVDHYTYTFAGDGCLMEGISHEACSLAGTLGLGKLIVFYDDNGISIDGKVESWFTDDTTSRFKAYNWQVIGPIDGHDANQIEHAISEARENTTQPSLIICKTVIGLGSSVAGSEKAHGSPLSAQDISNVREFFNWKHASFEIPDSIYKQWNHKEQGEKEEQLWLQLLHEYQQQYPSEHDDFLRRANGDLPDDWQEISAGFLKQCLNNEKAIATRKASQQCIEFFAPILPEMFGGSADLTGSNNTDWSGSKAITAHNFSGNYLYYGVREFAMAAIMNGLAVHGGFIPYGGTFLVFADYARNAIRLSALMKQRVIYVLTHDSIGLGEDGPTHQPVEHIAMLRMTPGMTVWRPADLMETAVAWQQSLEHHNGPSALLLSRQNLPALAHGTDAADLIKKGGYIIADCEGKPDAILIATGSEVQLAITAAEKAKARGLQVRVVSMPCAEQFLAQSDDYKNQILPGQVRTRIAIEAASSAYWHQFVGFDGAVIGLDCFGVSAPATDAFNYLGITVEKIINTLDTLTKQTMV

SEQ ID NO: 66094 - protein, 366 aa, Buchnera aphidicola str. Bp (Baizongia pistaciae)
MKRNYKIAVLPGDGIGPEIMREGYKILRILKSKLSLNIMTQEFDVGGVAIDKYGVALPKKTLQGCRDSHAILFGSIGGPKWEDLPSHLQPERGALLPLRKYFNLFSNLRLARIYSGLEKLSPLKSRISNLGCDILCVRELTGGIYFGDPKGSKVSKSLNCAFDTEVYYQFEIERIAHMAFDLALTRRCKVTSIDKANVLESSMFWRKIVNRISTQYSQVKLSHLYVDNAAMQIIKNPSQFDVLLCSNLFGDILSDECAAITGSIGLLPSASLNDKNFGLYEPAGGSAPDIKGKNIANPIALILSIGMMMRYSFKLYDVADLIDWAVNKTLKLGYRTQDISENNKFINTSSMGDIIAEILANRIHKI

SEQ ID NO: 66095 - protein, 331 aa, Vibrio cholerae O1 biovar eltor str. N16961
MIFDSQSSRVSMIKKIGVLTSGGDAPGMNAAIRGVVRTALGAGLEVFGIYDGYQGLYEDRIKQLDRSSVSDVINRGGTFLGSARFPQFREVEVREKAIENLKKHGIEALVVIGGDGSYMGAKKLTEMGFPCIGLPGTIDNDIAGTDYTIGYLTALNTVIEAIDRLRDTSSSHQRISIVEIMGRHCGDLTLTSAIAGGCEYIITPETGLNMEQLISNIKDGIAKGKKHAIIALTELMMDANKLAKEIESATGRETRATVLGHIQRGGKPTAFDRVLASRMGNYAVHLLMEGHGGRCVGIQKEQLVHHDIIDAIENMKRPVRTDLYKVAEELF

SEQ ID NO: 66096 - protein, 481 aa, Salmonella enterica subsp. enterica serovar Typhi str. CT18
MTIWENAMQYQLLINGVLVDGEGERQSVYNPATGEVILEIAEASPVQVDAAVLAADSAFAEWGQTTPKARAECLLKLADSIEQNALEFARLESQNCGKPLHCVINDEIPAIVDVFRFFAGAARCLSGLAAGEYLEGHTSMIRRDPIGVVASIAPWNYPLMMAAWKLAPALAAGNCVVIKPSEITPLTALKLAALAKDIFPPGVLNVLFGRGQTVGDVLTGHEKVRMVSLTGSIATGEHILRHTAPAIKRTHMELGGKAPVIVFDDADLDAVAQGVRTFGFYNAGQDCTAACRIYAQRGIYDALVEKLGNAVSSLKMGAPEDKSTELGPLSSLAHLKRVTAAVEEAKALSHIRVITGGSQTEGKGYYFAPTLLADAKQEDAIVQREVFGPVVSITVFDDEDQVLRWANDSRYGLASSVWTQDVGRAHRLSARLQYGCTWINTHFMLVSEMPHGGQKQSGYGKDMSLYGLEDYTLVRHIMVKH

SEQ ID NO: 66097 - protein, 119 aa, Triticum aestivum
MSAMETDAPDAAPPPAADAAASSSSSRKPGKRFEIKKWNAVALWAWDIVVDNCAICRNHIMDLCIECQANQASATSEECTVAWGVCNHAFHFHCISRWLKTRQVCPLDNSEWEFQKYGH

SEQ ID NO: 66098 - protein, 304 aa, Halobacterium salinarum
MPTHAPAPGSGDPLGLHGVVPPVVTAFDADESLDADTTADHARMVVDAGVHGVFPLGTNGEFPLLTPSERDRVVTAVVDEVGGEVPVIAGVGAPSTRQTVAHAEHAASVGADGVVVVTPFYYPLDGTAAVEHYRRVAAAVDCPVYVYHIPSKTGNELSLETLAALAEIDTLAGVKDSSKDVPWLGQAVDAHPELTFLAGSDSLLAPGLDVGCAGLVSAVANVAPELVVGLYEAYDEGDRERARARQSTVYEVRAALKRGPYMAGVKAALGLRGFDAGPLRSPLRGLDDDDRAALEADLADLGLL

SEQ ID NO: 66099 - protein, 123 aa, Zea mays
MDTIGPHVLIVDDTFVDRLVASRVLKTCNIQVTMVEGPKQALDFLDVENDVNLILTDYCMPGMTGYDLLMEVKESPKLKHIPVVVMSSDHIPQRMQKCMDAGAKEYIIKPIKAIDVPRILSYI

SEQ ID NO: 66100 - protein, 305 aa, Streptomyces coelicolor
MTTDDDSAPFGRSLCAMVTPFTGSGALDLDGAQRLADRLVARGCDGLVLSGTTGESPTTTDAEKAALVTAVREAVGDRAALVAGVGTADTRHTVELALAAEKAGADGLLVVAPYYSRPPQDALEAHFREVADASGLPVMLYDIPGRTGTRIEPDTVVRLAAHPRIVAVKDCAYDLLGTQKVLSRTGLAYYAGCDEQILPLYAIGAAGYVSTVANVVPELFRAVLDAFDAGDTGRAALLQRRAVPLVESMMAAGLPGTVTAKALLGALGLPAGPVRAPLRSADRETTAGLLAAYGELAADAGQSQA

SEQ ID NO: 66101 - protein, 510 aa, Sulfitobacter sp. EE-36
MRGPHNIWRLIRTGATLERTGAMNVVLDAFDATPALRFVAKALGKPFKFLGYAGDPSMPPATRALTALGPAYIKFGQVLSTRPDVVGDELAVQLRVLQDKLPPFSIEQAKAEVEKELGLPVDAIFSDFSAPVAAASIAQVHRATIAETQEDVAVKVLRPGIEKAFRKDVDAFYLAARMVELFSPGSRRLRPMEVIEHFDGVVRGELDLRLESSAASEFAANTKGDAGFQLPAIKWEYSARRVMTLGWADGVPMGDNAAIDAAGHDRVALGDRVLQLFLNHALRDGYFHADMHQGNLKVAPNGDIIAYDFGIMGHIDEYTRRVYAEILFGFIRKDYKRVAEVHFEAGYVPADKDVDEFARALRAVGEPIFGMDATRISMARLLTYLFEVTERFGMETRTELILLQRTMVVVEGVARSLNPHINIWEVSNPIVTDYISKSIGPRAVIKDLSKTAMVLARFGPRLPALVENALIRQQDETPPQRPAFRRWIILSAIVGAGTATGIIAILQALS

SEQ ID NO: 66102 - protein, 662 aa, Lactococcus lactis subsp. lactis Il1403
MTENKTFYITTPIYYPSGKLHLGSSYTTIACDVLARYKRLMGFDTFYLTGLDEHGMKIQRKAEELGMTPKEYLDPMAADVQELWKKLDISYDKFIRTTDTYHEEAVAKAFEQLLEQDDIYLGKYAGWYSVSDEEFFTETQLEEIFRDESGNITGGIAPSGHEVEWVEEETYFFRMGKYADWLLQYYDEHPDFIQPEVRKNEMVNNFIKPGLEDLALTRTSFTWGIPVPSNPKHVVYVWFDALLNYITALGYNSDNDSNFKKYWPGINMVGKEIVRFHTIYWPIMLHALGLPAPKKIFAHGWLLMKDGKMSKSKGNVVYPEMLIERYGLDAVRYYLMRAISFGQDGIFTPEDFVGRINFDLANDLGNLLNRTVSMINKYNDGKIEATGVSTEFDASLEEVVEETISHFHKAMDKFEFNVALADVWTLISRTNKYIDETAPWVLAKSEDDKAKLNNVLYHLAENLRIAGALLQPFMRATSGKIFEQLGMDERSFSLENLSFGYSFTHPVVAKGQPIFPRLDVEEEVAYIKLQMAGGVLPEKEWVPEEVELNLTLPQIKFDDFEKIELKVAEVLEVEPVEGSDKLLRFKLDAGDSEPRQILSGIAQFYPNEQELVGKKLQIVANLKPRKMMKKYVSQGMILSAEFDGKLSVLTVDDDVPAGSLIG

SEQ ID NO: 66103 - protein, 1196 aa, Anabaena variabilis ATCC 29413
MKQQKARRNRGVTLTLQGWDKLQAAKAKAEWEKNGGDSFSLEELSDRTRLALHTISRILARLEPVDKSSLQLAFAAFNLELSPSDYTRPTSTVEELETRQGNPQYDWAEAPDVSVFFGRSEELLQLRQWVLEERCRLVGLLGIGGIGKTTLAVKLGLQIQAEFEVVVWRSLQNAPPVDEQVTNILQSLLSALQKEMVIPESFDGKLVKLMECLHSNRCLLILDNFETILSGGQAGQCRPGYEGYGQLLKRIGEVPHISCLLFTSREKPREIVPLEGERTGAKSLPLKGLNTTEGQELFQQKGQFTGTEQEWQLLIEHYGGNPLALKMVAAGTQELFDGRIAPVLEYVEHGILIFEDIGDLLERQFYHLSPVETEVMYWLAINREPVSLAELVADIVTSSSQRLVPSAINSLLQRSLIERSGKYFFLQPVVMEYTTQRLVQQIRQQLLGEKSARLGLFQTHALIKATSKDFIRETQRQLIVQPLLEQLLLEMGSQEQLIILLQNILEQQRHQTAILTGYAGGNILNFLAHLQVNLREYDFSNLCMRQADLQRINLAGVNFQNTAFDQSAFATSLKNIFSLALSPDRKLLATGDQDGQIHLWQMANRKNLLTFKGHECVVWTVAFSPDGQTLASGGHDGLIKLWDVQTGNCLKTLAQHEGIVWSVRFSPDGQTLVSGSLDASIRLWDIRRGECLKILHGHTSGVCSVRFNPDGSILASGSQDCDIRLWDLNTDKCIKVLQGHAGNVRAVCFSPDGKTLASSSSDHSVRLWNVSKGTCIKTFHGHKNEVWSVCFSSDGQTIATGSYDSSVRLWDVQQGTCVKIFHGHTSDVFSVIFSSDRHIVSAAQDFSVRIWNISKGVCVRTLQGHSCGAFSVSFNSVCPTGVDCMLATGSMDGLVRLWDVASGYCTKILQGHTNWVWSVSFSPDGSILASGSHDKSIKLWDVISGHCITTLYGHNGGVTSVSFSPDGQTLASASRDKSVKLWDIHERKCVKTLEGHTGDIWSVSFSPDGNTLATASADYLVKLWDVDEGKCITTLPGHTDGVWSLSFSPDGKILATGSVDHSIRLWDTSNFTCLKVLQGHTSTIWSVSFSPNGSTLASASSDQTIRLWDMNNFTCVRVLDSHTSGGCAVSFNSVGNILVNTSQDEVIKLWDVETFERIKTLKVDRLYEGMNIRGVTGLTAAQRSALLALGAVEGVG

SEQ ID NO: 66104 - protein, 325 aa, Agrobacterium rhizogenes
IAGWKAINESDMVLMPDTETVHMDPFFAQSTMVILCDILDPVSGEAYNRDPRGTAKKAEAYLKASGIGDTAFFGPEAEFFVFDDVKYKADPYNTGFKLDSSELPSNDDTDYETGNLGHRPRVKGGYFPVPPVDSAQDMRSEMLTVLGEMGVTVEKHHHEVAAAQHELGIKFDTLVRNADKMQIYKYVVHQVANAYGKTATFMPKPIFGDNGSGMHVHQSIWKAGKPTFAGDEYAGLSESCLYYIGGIIKHAKALNAFTNPSTNSYKRLVPGYEAPVLLAYSARNRSASCRIPFGTNPKAKRVEVRFPDPTANPYLGFAAMLMAGL

SEQ ID NO: 66105 - protein, 325 aa, Rhizobium galegae
IGGWKAINESDMVLMPDPATVHMDPFFAQSTMVIFCDILDPISGEAYNRDPRGTAKKAEAYLKASGIGDTVFVGPEPEFFVFDDVKYKADPYNTGFKLDSSELPSNDDTDYETGNLGHRPRVKGGYFPVPPVDSLQDMRSEMLTVLAEMGVVVEKHHHEVASAQHELGVKFDTLVRNADKIQIYKYVVHQVANAYGKTATFMPKPIFGDNGSGMHVHQSIWKDGKPTFAGDEYAGLSESCLFYIGGIIKHAKAINAFTNPTTNSYKRLVPGYEAPVLLAYSARNRSASCRIPFGTGPKSKRVEVRFPDPLANPYLAFAAMLMAGL

SEQ ID NO: 66106 - protein, 325 aa, Rhizobium huautlense
IGGWKAINESDMVLMPDPATVHMDPFFAQSTMVIFCDILDPISGEAYNRDPRGTAKKAEAYLKASGIGDTIFVGPEPEFFVFDDVKYKADPYNTGFKLDSSELPSNDDTDYETGNLGHRPRVKGGYFPVPPVDSLQDMRSEMLTVLAEMGVVVEKHHHEVASAQHELGVKFDTLVRNADKIQIYKYVVHQVANAYGKTATFMPKPVFGDNGSGMHVHQSIWKDGKPTFAGDEYAGLSESCLYYIGGIIKHAKAINAFTNPTTNSYKRLVPGYEAPVLLAYSARNRSASCRIPFGTGPKSKRVEVRFPDPLANPYLGFAAMLMAGL

SEQ ID NO: 66107 - protein, 563 aa, Triticum aestivum
  misc_feature (371)..(371): Xaa can be any naturally occurring amino acid
MPMAKTVVFTSVKKWDGDSNRYIASGEYIQMSGRAGRRGMDARGICVFMRPSRPMEMSVIKDMVLGKPAPLISTFRLSYYTILNLLSRAEGQFTAEHVIRNSFHQFQYEKALPEVVQKITRLENEASLLGSSGENDLAEYHKLGLDISELEKKIMSEMIRPERALLYLVPGRLVKVRDGSTDWGWGVVVNVVKKPPASSSLPPALSASRNNNYIVDTLLHCSSSLSESGLRSKPCPPRPGEKGEMHVVPVPLPLVCGLSSIRISIPSDLRPPEARQNILFAVQELGKRYPQGLPKLHPITDMGIEEPELVDLVHKLEDLEQKLCSHPLHKSDQSEQQLSWYQRKAELNHEIQQLKSKMRDSQLQKFRDELXKNRSRVLKMLGHIDTDGVLQLKGRAACLIDTGDELLITELMFNGTFNELDHHQVASVVSCFVPCEKSSEQIRLRNELSKPMMQLSEAARKIAEVQRECKLDVNVEEYVESTCKPYLMDVIYCWSKGATFGEVIEMTDIFEGSIIRLVRRLDEFLNQLKAAAEAVGEVNLEKKFGLASESLRRGIMFANSLYL

SEQ ID NO: 66108 - protein, 325 aa, Sinorhizobium arboris
IAGWKAINESDMVLMPDPETAHMDPFFAQSTMVIFCDILDPVSGEAYNRDPRGTAKKAEAYLKASGIGDTVFVGPEAEFFVFDDVKYKADPYNTGFKLDCSELPSNDDTDYETGNLGHRPRVKGGYFPVPPVDSSQDMRSEMLTVLSEMGVTVEKHHHEVAAAQHELGVKFDALVRNADKMQIYKYVVHQVANAYGKTATFMPKPVFGDNGSGMHVHLSIWKDGKPTFAGDEYAGLSETCLYFIGGIIKHAKALNAFTNPSTNSYKRLVPGYEAPVLLAYSARNRSASCRIPFGTNPKAKRVEVRFPDPTANPYLAFAAMLMAGL

SEQ ID NO: 66109 - protein, 669 aa, Alkalilimnicola ehrlichei MLHE-1
MTTDSEGKPRLSRTHLLALLRQMLRMRRFEERCVELYTQEKIRGFLHVYIGEEAVGAGAMFGLDPNDGVVATYREHGHALLNRIAMNPVMAEMYGKAAGCSLGRGGSMHLFDAEHRFYGGNAIVGGGLPLAVGLALADKLAGRQRVTACFFGDGAVAEGVFHESLNLAALWQLPVFFVCENNQYAMGTALHLAHAQTELYRKAEALGVPAERVDGMDVVAVEAASGRALASVRAGEGPRFLECETYRFRAHSMFDPQLYRDKAEVEAWQARDPIRRLSDWMSRSGALHEGELEAMDGEIGEEIDAAVAFAEQAEWESPDTLLDHVCAPVSEAPPPPPDVATEPERLSFREAFRRGLIEALTHEPRSFMMGEDIGHYGGCYAVSRGLLEQFGPERMRDTPLSENGFTGAGVGAALGGARPIVEIMTVNFSLLALDQIVNNAATLLHMSGGQFPVPLVIRMATGAGRQVAAQHSHSLENWYAHVPGLKVLAPGTLEDARHMLWAALHDPNPVVIFEHVLLYNQEGELTPCPQGVDIRQAAIRRPGQHLTLITYGGSLGKTLEAAEALAEEGIEAEVLDLRVLRPLDTEALVASVTRTQRAVIVDEGWKTGSLAAEISAILAEQALWYLDAPIARVCSAEIPIPYARHLETAALPQVEDIVGAARQVMEGAE

SEQ ID NO: 66110 - protein, 360 aa, Oenococcus oeni PSU-1
MTMVKAAVIYGPKDIRFEKRNIPDPAPDEVQIEVAFNGICGSDIHEYLEGMDLATMPHPLTHMQAPLIPGHEFSGTISKIGKQVSKLRIGDKVAVEPMIACGKCPECLSGHYNWCEHAIGSDQSAGFLGFSANGGLAEKCNVKSTFAHLLPTDFPLDLGALVEPVSVAAQAVMASRVSPGDDVLIQGAGPIGLFTALIAQISGAHHVIINDMSEERLDLANELGVQYPIRADSQKSLAHAISTITENQGVDVAFDCAGVQPTLTGAIQALKNGGKVTVIALFQHPPVVDVRALLKKGGSLLTSYGYANIFDRVIKIIDTYRSLFKRVITKKIELNELVSEGIESLEKDKKQAKILVRLHS

SEQ ID NO: 66111 - protein, 486 aa, Bacillus subtilis
AEIRKLKNYINGEWVESKTDQYEDVVNPATKEVLCQVPISTKEDIDYAAQTAAEAFKTWSKVAVPRRARILFNFQQLLSQHKEELAHLITIENGKNTKEALGEVGRGIENVEFAAGAPSLMMGDSLASIATDVEAANYRYPIGVVGGIAPFNFPMMVPCWMFPMAIALGNTFILKPSERTPLLTEKLVELFEKAGLPKGVFNVVYGAHDVVNGILEHPEIKAISFVGSKPVGEYVYKKGSENLKRVQSLTGAKNHTIVLNDANLEDTVTNIVGAAFGSAGERCMACAVVTVEEGIADEFMAKLQEKVADIKIGNGLDDGVFLGPVIREDNKKRTLSYIEKGLEEGARLVCDGRENVSDDGYFVGPTIFDNVTTEMTIWKDEIFAPVLSVIRVKNLKEAIEIANKSEFANGACLFTSNSNAIRYFRENIDAGMLGINLGVPAPMAFFPFSGWKSSFFGTLHANGKDSVDFYTRKKVVTARYPAPDFN

SEQ ID NO: 66112 - protein, 332 aa, Zea mays
MAAPAPSGAASAAASPSPLMQLPSPFAELVKGPSGLEKVVLRGARNCCAEIYLYGGQVTSWKNDNGEDLLFLSSKAIFKPPKAIRGGIPICFPQFGSHGNLEQHGFARNRFWTIDNNPPPLPLNPAIKAFVDLILKPSEEDLKIWPHSFEFRLRVALGPSGDLSLTSRIRNNNPDGRPFSYTFAYHTYFSVSDISEVRVEGLETMDYLDNLKAKERFTEQGDAIVFESEVDKVYLAAPSKIAIIDHEKKRTFVVTKEGLPDAVVWNPWDKKAKAMQDFGDAEYKSMLCVEPASVERPITLKPGEEWKGRLVLSAVPSSYCSGQLDPLKVLQG

SEQ ID NO: 66113 - protein, 525 aa, Glycine max
MDSSSSSPNNNNHHKLGFQPARSRSRLAMASPANTSEPKIVTGTAGYILEDVPHFTDYIPNLPTYPNPLQDNPAYSVVKQYFVHVDDSVPQKVVVHKDGARGVHFRRAGPRQKVYFEADEVQAAIVTCGGLCPGLNTVIRELVCGLHHMYGVKKVLGINGGYRGFYARNTITLTPKSVNDIHKRGGTVLGTSRGGHDTKKIVDSIQDRGINQVYIIGGDGTQKGASAIFEEVRKRGLKVSVVGIPKTIDNDIPVIDKSFGFDTAVEEAQRAINAAHVEAESVENGIGVVKLMGRNSGFIAMYATLASRDVDCCLIPESPFYLEGPGGLYEYIEKRLKENGHMVIVIAEGAGQELVSESVQSMSKQDASGNKLFQDVGLWISQKIRDHFAAQKTLPITLKYIDPTYMIRAIPSNASDNVYCTLLAQSAVHGAMAGYTGYTSGLVNGRQTYIPFYRITERQNHVVITDRMWARLLSSTNQPSFLDAKGDNEEKEEEEALNQLPDGHCAKDTSLASKEINSSIYPTAC

SEQ ID NO: 66114 - protein, 345 aa, Salmonella enterica subsp. enterica serovar Typhi str. CT18
MKQQTNRNRRWVLASRPHGAPQMDNFRLEEDDVATPGEGQVLLRTVFLSLDPYMRGRMSDEPSYAPPVEPGCVMVGGTVSRVVASNHPDYRPDEWVLSYNGWQDYDISDGEGLVKLGDNPQHPSWSLGVLGMPGFTAYMGLLDIGQPKEGETLVVAAATGPVGATVGQIGKLKGCRVVGIAGGAEKCRHATDVLGFDLCLDHHADNFPQQLAQACPQGIDIYYENVGGKVFDAVLPLLNTSARIPLCGLVSGYNATTLPDGPDRLPLLMATLLKKRIRLQGFIINQDYGHRIHEFQQEMGRWIKEGKIHYREQITDGLENAPEAFIGLLAGKNFGKVVIRLADDA

SEQ ID NO: 66115 - protein, 275 aa, Zea mays
  misc_feature (42)..(42): Xaa can be any naturally occurring amino acid
MGSSSQHDSISASGSSERADGSRSSISMWTKITSTDSWRWCXLGLIYIVAVASIWIAASYIVQSVVDAGVSPFLITYICNSLFVVYIPIVEAARYFEDSIGDLWTKLKFKDAESLQQASDMESVNLLQSGGHEINVASDQPQARLSGDTSVPDTSFPAQAELTVVDCSKGLDAKGRWTRARVAQVSMLISPFWFLAQLTFNLSLRYTTVTSNTILSSTSSLFTFLVALVFLGETFTWLKLISVLLCMGGTIIVSLADSSSSSNAIATNPPLGDFL

SEQ ID NO: 66116 - protein, 522 aa, Arabidopsis thaliana
MAAETASGSNRSISNSPLIENSDSNQILVPEKKSWKNFFSYLGPGFLVSIAYIDPGNFETDLQSGAQYKYELLWIILVASCAALVIQSLAANLGVVTGKHLAEHCRAEYSKVPNFMLWVVAEIAVVALIGTAFALNMLFNIPVWIGVLLTGLSTLILLALQQYGIRKLEFLIAFLVFTIALCFFVELHYSKPDPKEVLYGLFVPQLKGNGATGLAISLLGAMVMPHNLFLHSALVLSRKIPRSVTGIKEACRYYLIESGLALMVAFLINVSVISVSGAVCNASDLSPEDRASCQDLDLNKASFLLRNVVGKWSSKLFAIALLASGQSSTITGTYAGQYVMQGFLDLRLEPWLRNFLTRCLAIIPSLIVALIGGSAGAGKLIIIASMILSFELPFALVPLLKFTSSKTKMGSHANSLVISSVTWIIGGLIMGINIYYLVSSFIKLLLHSHMNLVAIVFLGVLGFSGIATYLAAISYLVLRKNRESSSTHFLDFSNSQTEETLPREDIANMQLPNRVAVIGDLN

SEQ ID NO: 66117 - protein, 601 aa, Ustilago maydis 521
MTRSNTDGSMTPSKQEGNLVSATHPPLAKRRFGSTSLTEDLQRHWRVYLLGICASFGGLLFGWDTGLIGGVLNMAAFQNDFGLKNNPSKLAALKGNIVSVLQAGCFFGAASSFYLPHRFGRRNAMLISAAVFLVGSIIQTTCRLHGQSATSALNQLYVGRVIGGFGVGLASSVVPTYLSECAPRSIRGRLAGMYQLLIVTGICIAYFVNYGMVQNYPDQHSSAMWQVPFALQCLPGFLFVVTLFFQPESPRWLVEQGRSEEAHRALARINRTPIDDPSVVAILQEIQNDLQGKQGLSIRQQVRMAFAERVTTYRVFTGALLMFFQQFTGTNSINYYSPQIFASLGVTGQSSGLLATGVYGVVKIVTTGLFMVVAIEQLGRKWCLITGGIVQVFCLFWIAIYQAVRPSGTPVDGVGYLTIAMIYLFVVGYGLGWSSVTWAVSAEIAPNQLRALAMSAATMSQWFFNFVIALITPRALEHIKFGTFILFAVVTSVAVLWAAFFLPETSGVSLELMHRVFQGNIITRSIQDLSPKKRKAFRDRLMAEADGTIDQGTNPGVNQEQTASADVATLDRVPSKLPKGGEDGILNTSDAVSSDNDHGKR

SEQ ID NO: 66118 - protein, 439 aa, Fusobacterium nucleatum subsp. nucleatum ATCC 25586
MIIFCLLIFKEEFRMSKETLNPLESGQKQVKKACDALGLDPAVYELLKEPQRIIEITIPVKMDDGSIKTFKGYRAAHNDAVGPFKGGIRFHQNVNSDEVKALSLWMSIKCQVTGIPYGGGKGGITVDPSELSQRELEQLSRGWVRGMWKYLGEKVDVPAPDVNTNGQIMAWMQDEYNKLSGEQTIGVFTGKPLSYGGSQGRNEATGFGVAVTMREAFKALGKNLKGATVAVQGFGNVGKFTVKNIMKLGGKVVAVAEFEKGKGAYAIYKDSGFTFEELEAAKAAGSLTKVAGAKELSMDEFWALNVEAIAPCALENAITNHEAELIKAGIVCEGANGPITPEADEVLYKKGIVVTPDVLTNAGGVTVSYFEWVQNIYGYYWTEKEVEEKEERAMVDAFTPIWALKKEFDGKGQPISFRQATYMKSIKRIAEAMKIRGWY

SEQ ID NO: 66119 - protein, 447 aa, Desulfovibrio vulgaris subsp. vulgaris str. Hildenborough
MDIPVFNCKNGDDVIRAVKEYNVSFVQFWFVDILGNLKSFQVTPSELEAAFEEGMGFDGSSILGFTRIEESDMVAFPDATTFQICSWRPLERPVARMFCDIRTPDGTPYEGDPRYILRKLIDKAAQKGYTFYVGPELEFFFFSSPQCPTPIDAGGYFDAPPLDLGNDVRRDIIFALQRMGIPVEYSHHEVAPSQHEIDLRYNEAMKMADVVMTYKVVVKEMARKHGIYATFMPKPIFGENGSGMHVHQSLFRNGKNAFFDPNDQHNLSHECRSYIAGLLKHAREFCCVTNQWINSYKRLVPGYEAPVYIAWAQRNRSALIRVPMYKPGKEAATRIELRSPDPACNPYLAFAVMLGAGLEGIENNYELPKAVEANIFHMGEEDLGKHGIGSLPGSLYEAAMELRNSNLMKEILGEHTHANIVGNKLIEWDDYRTHISEFELKRYLPIL

SEQ ID NO: 66120 - protein, 450 aa, Bacillus subtilis subsp. subtilis str. 168
MEMMGMENIQQNQGLKQKDEQFVWHAMKGAHQADSLIAQKAEGAWVTDTDGRRYLDAMSGLWCVNIGYGRKELAEAAYEQLKELPYYPLTQSHAPAIQLAEKLNEWLGGDYVIFFSNSGSEANETAFKIARQYHLQNGDHSRYKFISRYRAYHGNTLGALSATGQAQRKYKYEPLSQGFLHAAPPDIYRNPDDADTLESANEIDRIMTWELSETIAGVIMEPIITGGGILMPPDGYMKKVEDICRRHGALLICDEVICGFGRTGEPFGFMHYGVKPDIITMAKGITSAYLPLSATAVKRDIFEAYQGEAPYDRFRHVNTFGGSPAACALALKNLQIMEDEQLIQRSRDLGAKLLGELQALREHPAVGDVRGKGLLIGIELVKDKLTKEPADAAKVNQVVAACKEKGLIIGKNGDTVAGYNNVIHVAPPFCLTEEDLSFIVKTVKESFQTI

SEQ ID NO: 66121 - protein, 377 aa, Arabidopsis thaliana
MAEADDIQPIVCDNGTGMVKAGFAGDDAPRAVFPSVVGRPRHHGVMVGMNQKDAYVGDEAQSKRGILTLKYPIEHGVVSNWDDMEKIWHHTFYNELRIAPEEHPVLLTEAPLNPKANREKMTQIMFETFNSPAMYVAIQAVLSLYASGRTTGIVLDSGDGVSHTVPIYEGFSLPHAILRLDLAGRDLTDYLMKILTERGYMFTTTAEREIVRDIKEKLSFVAVDYEQEMETSKTSSSIEKNYELPDGQVITIGAERFRCPEVLFQPSFVGMEAAGIHETTYNSIMKCDVDIRKDLYGNIVLSGGTTMFSGIADRMSKEITALAPSSMKIKVVAPPERKYSVWIGGSILASLSTFQQMWISKAEYDEAGPGIVHRKCF

SEQ ID NO: 66122 - protein, 377 aa, Lactococcus lactis subsp. lactis Il1403
MTNLFENYGRLPFSLIKGEDQYLFDDRGNKYLDFTSGIGVMNLGYSFEKGKVAVKAQLDSLSHLSNLYQNPLQEDVAEKLSQNHSYKAFFCNSGTEANEAALKLTHLIKKDQKILAFTDGFHGRTFGAMSATMQEKIQAGFSPLLPNFVASPFNDVVALEQILEKEKIGAIIFEIIQGEGGVLPISPDFVEALKSCQQKGILLIIDEIQTGIGRTGKLFAFEHFDFEPDIFTLAKALANGIPTGAMLAKNKYASYFSAGKHGSTFGGNPLAMASANEVLKEIDSDFLEKVTDKGIFFLKLLTEKLSVKATVKSIRGLGLMIGIQLTDEKKVPEVLALLRENGLLALSAGHDVIRLLPPLVMTKVELQKGAELLEKIL

SEQ ID NO: 66123 - protein, 536 aa, Arabidopsis thaliana
MTTISDLPEDVVEEILPRVPLTSLSAVRSICKTWNTLSKNRVLCKAAVKKQFLGFIMMDYRVCSMKFHLRNDEGGDLVDDLSIKQVGILDQIEISEVLHCDGLLLFVTKDNSSLVVWNPYLGQTRLIQPSNNFHCSDRYAIGYDNNRNLKILRNFSDYGSSGSNKRGVSFKGNTYILAQGKIRVDSRWKIEAILLSFDFTTERFGPRLQLPFGFYYPQDLFSLSCVREEQLVVLHQSWMVSGELEIWITNKIDPGVVSWTKFLRSISCCRISIQAGSFFINEENQVAVVFDLDEYKGSETCRNQTAYIIGQDEYFKSVNIGEAPNLGRPEKYAPHIYCRPLGNTYILAQGKIRVDSRWKIEAILLSFDFTTERFGPRLQLPFGFYYPQDLFSLSCVREEQLVVLHQSWMVSGELEIWITNKIDPGVVSWTKFLRSISCCRISIQAGSFFINEENQVAVVFDLDEYKGSETCRNQTAYIIGQDEYFKSVNIGEAPNLGRPEKYAPHIYCRPLVCSSYVPSLVPLQINQPDTRKESDD

SEQ ID NO: 66124 - protein, 325 aa, Sinorhizobium meliloti
IGGWKAINESDMVLMPDPETAHMDPFFAQSTMVIFCDILDPVSGEAYNRDPRGTAKKAEAYLKASGIGDTVFVGPEAEFFVFDDVKYKADPYNTGFKLDSSELPSNDDTDYETGNLGHRPRVKGGYFPVPPVDSSQDMRSEMLTVLSEMGVTVEKHHHEVAAAQHELGVKFDALVRNADKMQIYKYVVHQVANAYGKTATFMPKPIFGDNGSGMHVHLSIWKDGKPTFAGDEYAGLSESCLYFIGGIIKHAKALNAFTNPSTNSYKRLVPGYEAPVLLAYSARNRSASCRIPFGTNPKAKRVEVRFPDPTANPYLAFAAMLMAGL

SEQ ID NO: 66125 - protein, 374 aa, Alkalilimnicola ehrlichei MLHE-1
MSDKKLGGAGLRGQSAGQTALCTVGKGSGLTYRGYDVRELAEGATFEEVAYLLLKGDLPTKAELAAYTEKLKGMRDLPDALKAVLEQIPADAHPMDVMRTGASMLGNLETEQSFDEQQEATDRLLAVLPGIITYWYRYSHDGVRIDTATDDDSIGAHFLHLLRDEKPNSLHEKVMHASLILYAEHEFNASTFTARVCASTLSDIHSCVTGAIGSLRGPLHGGANEAAMAMIEQWNSPDEAERELKGMLERKEKVMGFGHAIYRVSDPRNEIIKAWSKKLADEVGDTVLYPVSERVEQVMWDEKKLFPNADFYHASAYHFMGIPTKLFTPIFVMSRVTGWCAHVFEQRANNRIIRPSADYTGPEERPFTPIDQRG

SEQ ID NO: 66126 - protein, 523 aa, Arabidopsis thaliana
MGNCCSHGRDSDDNKEEPRPENGGGGVGAAEASVRASKHPPASPPPATKQGPIGPVLGRPMEDVKSSYTLGKELGRGQFGVTHLCTQKATGLQFACKTIAKRKLVNKEDIEDVRREVQIMHHLTGQPNIVELKGAYEDKHSVHLVMELCAGGELFDRIIAKGHYSERAAASLLRTIVQIIHTCHSMGVIHRDLKPENFLLLSKDENSPLKATDFGLSVFYKPGEVFKDIVGSAYYIAPEVLRRKYGPEADIWSIGVMLYILLCGVPPFWAESENGIFNAILSGQVDFSSDPWPVISPQAKDLVRKMLNSDPKQRLTAAQVLNHPWIKEDGEAPDVPLDNAVMSRLKQFKAMNNFKKVALRVIAGCLSEEEIMGLKEMFKGMDTDNSGTITLEELRQGLAKQGTRLSEYEVQQLMEAADADGNGTIDYGEFIAATMHINRLDREEHLYSAFQHFDKDNSGYITTEELEQALREFGMNDGRDIKEIISEVDGDNDGRINYEEFVAMMRKGNPDPNPKKRRELSFK

SEQ ID NO: 66127 - protein, 325 aa, Sinorhizobium medicae
IGGWKAINESDMVLMPDPETAHMDPFFAQSTMVIFCDILDPVSGEAYNRDPRGTAKKAEAYLKASGIGDTVFVGPEAEFFVFDDVKYKADPYNTGFKLDSSELPSNDDTDYETGNLGHRPRVKGGYFPVPPVDSSQDMRSEMLTVLTEMGVTVEKHHHEVAAAQHELGIKFDALVRNADKMQIYKYVVHQVANAYGKTATFMPKPIFGDNGSGMHVHLSIWKDGKPTFAGDEYAGLSETCLYFIGGIIKHAKALNAFTNPSTNSYKRLVPGYEAPVLLAYSARNRSASCRIPFGSNPKSKRVEVRFPDPTANPYLAFAAMLMAGL

SEQ ID NO: 66128 - protein, 474 aa, Alkalilimnicola ehrlichei MLHE-1
MANSYDVIVIGAGPAGYVAAIRCAQLGMTTAVIDEFRYKDGKPQPGGTCLNVGCIPSKALLDSSEHYHKAKDGGLSVHGITAKDVSIDVKKMIARKDKVVKDLTGGIHQLLKANKIDFKTGHGKLISNSTVEFTPHEGKAEELKGEYIILATGSKPIDIGAAPADEKDILTSNGALDMEAVPKRLGVIGAGVIGLEMGSVWNRLGSKVVLLEAQDEFLAPVDRQVARMAHKAFTDQGLDIRLGCRVTDTKVGKQVSVHYEDKDGKHTLQVDKLIVSVGRRPNTDGLAADDVDLLLDERGFVHVDDECRTNLPNVYAVGDVVRGPMLAHKGSEEGVMVAELIAGHPGHLNYDTIPWVIYTHPEIAWVGKTEAQLKSEGVPYKSGTFNFAANGRARAMEESTGMVKIISHAETDRILGVHMVGAATSELIAEAVVAMEFAGSAEDLARICHAHPTLSESVHEAALAVSKQAIHKAN

SEQ ID NO: 66129 - protein, 422 aa, Alkalilimnicola ehrlichei MLHE-1
MSIEVKVPPLPESVSEATVVAWHKQPGDAVSRDENLVDLETDKVVLEVPAPADGVMGERFKNEGDTVTADEVLGKLEEGAAPAKAESKPAEAAPAPKQEAASAPAPKPAEAPAAASAPAEDLADLPPAARRLVEENNLDPKQIPGTGRAGRITKEDVVRFMKGETQPVQQPAAGQPAAAAAPQVSADAADRPEKRVPMTRLRQRIAERLVEAQQTAAMLTTFNEVNMQPVMNTRGQYKDKFEKTHGIKLGFMSFFVKAAVEALQRFPAVNASIDGKDIMYHGYYDVGIAVSSPRGLVVPVLRDADQMSFAEIEAKIAEFGQKAREGKLSMEELTGGTFTITNGGIFGSLLSTPILNPPQSGILGMHKIQERPMAENGQVVIRPMMYLAHSYDHRIIDGREAVQFLVTIKECLEDPTRLLLEV

SEQ ID NO: 66130 - protein, 596 aa, Burkholderia vietnamiensis G4
MYRYNEFDKAFVANRAAQFRDQIERWQSGKLSDAEFLPLRLQNGWYVQRHAPMLRVAVPYGELSSAQIRVLARIAREYDEPDTEVYRRALDAQRKLGTERLPTHQAHFTTRTNVQYNWIPLSKAADVMDLLATVNMHGIQTSGNCIRNISCDERAGVAPDEIADPRPFAELMRQWTTLHPEFAFLPRKFKIAISGSTEDRAATGWHDVGLRLVQDEDGELGFRVLVGGGMGRTPVIGIVLREFLPWRHIMNYIEAVVRVYNQFGRRDNKYKARIKILAKAEGQRFIDEVEEEFRQIVDFDGGPHTIPQAELARMRSYFAVPPEVAASRPADPEADVVRTATARQSPQFARWLERNVASHRDPSLRIVTLSFKRPLQSPGDASAEQLERIAELADRFSAGEARVTHSQNIVLPWVHVDDLLPLWHAAVAVQLASANVHLLTDMISCPGGDFCALANARSLPVAQSIMERFQDLDELNDIGEIDLHISGCINSCGHHHSGHIGILGVDKDGAEWYQITLGGADGSARSGVARPGKVIGPSFAAHEVTDAVEAVLDCYLALRARSGERCETFIETLRRVGLEPFKSAADAARTTAETLA

SEQ ID NO: 66131 - protein, 511 aa, Frankia sp. CcI3
MLVPFGARDFLDRAVTVYGRRVGVVDEPDQPAQPWPDLTYARLGETARAQAAGLDALGVGHGERVAIVSHNSARLLASFFGVSGYGRVLVPVNFRLSPEEVSYIVEHSGSEVLLIDPELEEKLSGVTAKQKFVLGAESDAELYRFDAEPTPWEPDENATATVNYTSGTTARPKGVQITHRNIWVNAVTFALHAGVTDRDVYLHTLPMFHANGWGMPFGMTGLGVQQVVLRKIDGPEILRRVEQHGVTVMCAAPAVVNAVLDAVRDWDGEVPGRDRVRVICAGAPPPTKTIQRVEEELGWEFIQIYGLTETSPLLTINRSRVEWDDLPPEDRAGKLVRAGAPALGVTLKLSDSGEVLARSNVILAGYWERPQESAGALAGGWFHTGDGGVIDDEGYLTISDRKKDVIITGGENVSSIQVEDCLFGHPAVAEVAVIGVPDEKWGEAIKALVVLAEGRTATEAELIKHCKERLASYKAPTSVEFRDQLARTATGKLQKFKLRAPYWEGHERQVD

SEQ ID NO: 66132 - protein, 552 aa, Buchnera aphidicola str. Bp (Baizongia pistaciae)
MKKINPNNTESWKMLQNHFYEIKSFHIKELFKKDKNRFKKFSLKFDNRILVDYSKNRITSFTIKLLLKLANEMDLNNSIKSMFSGKIINETENRAVLHTALRNRSNSSIIHNGCNIMFDINKVLEKMKHFSNLVINRKWLGYTGKYITDIVNIGIGGSDLGPKMVIKALNSYRNHLNIHFVSNVDGANIFNVLKKLNPESTLFIIVSKTFTTQETIVNANTAKKWMLNAVNKNEFLDQHFIAVTTNAQEAMNFGIRYKNIFLFWDWVGGRFSLWSSVGLSIVLAVGFKNFEQLLDGAYMMDQHYLHTKFDNNIPVLLALIGVWYNNFFKSETEAIFFYDWNMNYFSSFLQQMNMESNGKNICRSGEFVNWQTGPIIWGEPGTNGQHAFYQLLHQGTKLIPSDFIISIIPKHPFKDHHKYLLSHFFAQTQALAFGKFNQKCNVHINDKKTFDERLSSISFHKVCKGNQPSNSIVLDQLNPYNLGILIALYEHKVFTQGVIFNIFSFDQWGVELGKLLAKEIFLNMNTTGSKNYEYDSSTNGLINFYKIHSNNT

SEQ ID NO: 66133 - protein, 433 aa, Burkholderia vietnamiensis G4
MSSEPVFSSSLPDIDAHLGVAVIGGGQAGLSISYYLKQAGIDHLVFEKETVTHTWRKQRWDAFCLVTPNWQCALPGYPYRGADPHGFMTKDEIVEYLDGFIRSVDAPVLEHTAVEHVTRDADGRYRIATSRGTYMADRVVVASGGYHRPIVPRMAERLPASIVQLQSSEYRNPAALPDGPVLVVGSGQSGAQIAEDLHLAGRKVLLAVGDAPRCARFYRGRDVVDWLADMQYYDMPVDAHPLREGVRDNTNHYVTGRDGGRDIDLRRFAAEGMELYGRLEDFSGGQLRFSADLSAQLDSADDTYNRINAGIDAHIEKNGIAAPPATRYEPVWRPDHERTTLDLAASGIASVIWCIGFTPDFNWLDAPVFNGRGYPAHRRGVTPVPGLYFVGLPWLYTWGSGRFSGVARDAAHIVDRIQAEMTAARRSAESEVA

SEQ ID NO: 66134 - protein, 102 aa, Burkholderia mallei ATCC 23344
MDTQQRIKQIVDENPVVLFMKGTAQFPMCGFSGRAVQVLKACGVDQFKTVNVLEDEEIRQGIKEFSNWPTIPQLYVKGEFVGGSDIMMEMYQSGELQQLFTA

SEQ ID NO: 66135 - protein, 395 aa, Legionella pneumophila str. Lens
MIFGILNLTFWGYVLATFVLTQITIASVTLYLHRYQTHRALTMHPIVSHFFRFWIWLTTGMVTRVWVAIHRKHHAMTDVEGDPHSPQIFSLKKVFWQVPELYREAAKDKDMIEKYSHGTPNDWIERNLYSRYSSKGILLMFLIDLLLFGFPGITIWAIQMIWIPLSAGVVNGVGHYWGYRNFECFDRSTNVFPLGFLIGGEELHNNHHTYASSAKFSVKWWEFDLGWFYIRCLSFLRLAKVKKLPPKLIRDNSKQYVDLNTIKAITSNRFQVMSDYYKRVTIPILKNEKQNYNYIKNKKEWYLFKGAKRLLRQETKKANYHLLALLNRFEQLQLVYNYRQSLQQIWLKKVSSQNELIESLNQWCKKAEESGLDVLRQFSLRIKSYVLIGTDSSSV

SEQ ID NO: 66136 - protein, 241 aa, Ustilago maydis 521
MASRDHFANRQVACKLERETYSDMARPSRRPAVTQVDADDAADKSQDKRAELSAQIQDGDKRAHLLNRAVRATRVPVCALHVQRALSLTPRVLPCAVAPRLLSSSASKAAMSTAYKVIHTTEAPGAVAPYSQAVVHNGVAYVSGCIPFTPQMKLVEGGIEEQTEQALNNLFAVVKAAGSEPSHILKCTIFMKDMNNFEKINAIYEKRFAPYKPARSAVEVARLPKDVGVEIECIAAVKSNL

SEQ ID NO: 66137 - protein, 247 aa, Candidatus Kuenenia stuttgartiensis
MDSFKKYIAEFLGTFTLVFIAAGAICTDYYLRKAGGDGIGVLGISIAYGLAIVSITYALSYISGAHINPAVTIACWITRRMNPNLAIKYIAAQIAGAALAGFVLKILFPEAIYTVHLGASMLGDGISVMQGLVMEFIVSFLLVLTVFGTAIDKRSFGSFSGLTIGLVVLFGVLIGSPISSGAMNPARAFGPAIASWQFANHYVWWVGPVLGGVAAAFFYDAVFAEKEKKMKAAKKTTIPAFRRKRRR

SEQ ID NO: 66138 - protein, 398 aa, Oryza sativa (japonica cultivar-group)
MAAGEDAAAAWCDRMRGSLDSLGRPKRLFILVNPFGGKKCGKKIYEAEIKPLFEAAGVNVTMQETRYQGHARQVASSLDLARYDGIVCVSGDGVLVEVVNGILQRMDWEEAMKIPIGVVPAGTGNGMAKSLLHSASKTYSVPNAVFAIIRGYSQSLDVCTIVQGRKKFFSVLNMTWGLVADIDIESEKYRWMGSARFDFYALVRIMNLRKYYGSIQYVPAPGYEAYGDVVKQVENCTVECQEQIGKSLCSYQGPSVEFQGSEWRSLDGPFVSIWINNVQWAAESIMAAPGAKFSDGYMDAVIVRDCPKADLLALLMKMGDGSHVKSPYVTYLKVRCLRLSPGQLVENPKRGGIIDVDGEAIARGEGTYGKNQKQDVMGYGPSIQMTVHRALATMYCPK

SEQ ID NO: 66139 - protein, 361 aa, Bacillus clausii KSM-K16
MEALNLYGAGDIRFEQSPKPTIMNDNEVIVRVETAGICGSDLSRYKKLGPYISGTTFGHECSGTIEEVGSNVSHLKEGMRVAVCPALPCGDCTQCRQGAFSRCPSLTVIGAVQPGAFAEYVKLPAENVLPLPNEIDADTAAFIEPAAVVAHGFYKTAIEPGADVAIIGCGSIGLLAIQWAKLFGARYVYAIDIDEQKLKVAKELGADQRVNPLDGPVHEQIHDLTAGEGVDVAIEAAGTPITSAQALALPKKGGEVVFLGIPYGDVTIERFYFEKIVRNELRVHGSWNGLSAPFPGKEWKTAIHSLQTGALQVNPLITHRLPLSDGPFVFKEMASGSPGYIKTLLYPGKTGQKERAINHLK

SEQ ID NO: 66140 - protein, 334 aa, Anabaena variabilis ATCC 29413
MQVKEPKTTIHPEILELVKTIKKRMDELGHPPISELKPEASRFFYQEAIKLYHLTNEEGVTIEDRWIKRLEDISIPIRVYTPRDEVDNINSIQEKSTLYPILVYFQGGGWIFGNLDSADAPCSFLCKHINCIVVSVQYRQAPEYKCPIPVIDALEAIKWVHKNSQSLGGDAQKIAVGGESAGANLAAVAAIKLRDEGNISLEAQLLITPVTQYGFNTQSYQAGYTKGLSLETMKWFWNHYLENDLQGEEYYASPLKVQDARNLPPCLIVTAEHDPLRDDGLLYAQYLQSFQVKVKILHYESFIHSFIRMIRVIEDTRQALYEIAINFREMLYFY

SEQ ID NO: 66141 - protein, 361 aa, Oryza sativa (japonica cultivar-group)
MRRCRGVACVVIILSTAFTLIVFIAPITTFLVRLVSVHYSRKATSVLFGMWLSLWPFLFEKINKTNVVFSGESVLPKKRVLLFANHRTEVDWMYLWDLALRKGYLGYIKYILKSSLMKLPVFSWAFHIFEFIPVERKWEIDEAIIQNKLSAFKDPRDPLWLAVFPEGTDYTEKKCIKSQEYASEHGLPILKNVLLPKTKGFLCCLQELKSSLDAVYDVTIAYKHRLPDFLDIIYGTDPSEVHIHIRTVKLCDIPTSEDEVTDWMIERFRQKDQLLSDFFMQGHFPDEGTEGDVSTPECLANFIAIVSSTGFFLYLSLFSSVWFKVYVLLSCAYLTFVTYFSIQPPQLICSSEGGTHAKKVL

SEQ ID NO: 66142 - protein, 457 aa, Saccharomyces cerevisiae
MGLIVSIFNIGCAIGGIVLSKVGDIYGRRIGLITVTAIYVVGILIQITSINKWYQYFIGRIISGIGVGGIAVLSPMLISEVAPKHIRGTLVQLYQLMGTMGIFLGYCTNYGTKNYHNATQWRVGLGLCFAWATFMVSGMMFVPESPRYLIEVGKDEEAKHSLSKSNKVSVDDPALLAEYDTIKAGIEIEKLAGNASWSELLSTKTKVFQRVLMGVIIQSLQQLTGDNYFFYYGTTIFKSVGLKDSFQTSIIIGVVNFFSSFIAVYTIERFGRRTCLLWGAASMLCCFAVFASVGVTKLWPQGSSHQDITSQGAGNCMIVFTMFFIFSFATTWAGGCFVIVSETFPLRAKSRGMAIATAANWMWGFLISFFTPFITGAINFYYGYVFLGCLVFAYFYVFFFVPETKGLTLEEVNTMWLEGVPAWKSASWVPPERRTADYDADAIDHDNRPIYKRFFSS

SEQ ID NO: 66143 - protein, 342 aa, Bacillus clausii KSM-K16
MKALVKTAPGFGHVELQNKPEPAPGEKQVKIKVKYAGICGSDIHTYEGHYKVAFPVTLGHEFAGEIVEVGPGVQSFKVGDRVTSETTFSICGQCPYCQTKDYNLCSERKGLGTQQDGGFAEYVLAREESLHLLPDNVDFRSAAMTEPLACTHHALAKTTINAGDLCVVIGPGPIGLLAAQAAKSKGAKVMITGLNHDKVRLEKARALGIDYVVNGEETDVGEVVNELTNGYGADVVLECSGAVKAANQGLKLLRKKGQYSQVGIFAASEIPFDLETIIQKEIHVIGSRSQKPADWEPSLMLLKTGNVNARALVTHEYELHQWEEAYQAIKSGEAIKVLLKPE

SEQ ID NO: 66144 - protein, 109 aa, Saccharomyces cerevisiae
MSGVNNTSANDLSTTESNSNSAVGAPSVKTEHGDSKDSLNLDATEAPIDLPQKPLSAYTTVAILCLMIAFGGFIFGWDTGTISGFVNLSDFIRRFGQKKTTRGLTTYRK

SEQ ID NO: 66145 - protein, 325 aa, Sinorhizobium saheli
IAGWKAINESDMVLMPDPETAHMDPFFAQSTMVIFCDILDPVSGEAYNRDPRGTAKKAEAYLKASGIGDAVFVGPEAEFFVFDDVKYKADPYNTGFKLDCSELPSNDDTDYETGNLGHRPRIKGGYFPVPPVDSSQDMRSEMLTVLAEMGVTVEKHHHEVAAAQHELGVKFDALVRNADKMQIYKYVVHQVANAYGKTATFMPKPIFGDNGSGMHVHLSIWKDGRPTFAGDEYAGLSENCLFFIGGIIKHAKALNAFTNPSTNSYKRLVPGYEAPVLLAYSARNRSASCRIPFGSNPKAKRVEVRFPDPSANPYLAFAAMLMAGL

SEQ ID NO: 66146 - protein, 357 aa, Zea mays
MSSDGRLRRALAAFGGDVWDLVDAALAAAARDSPGDLRARRDGIVQRLYAGAARCRNCDADATPAPAQPRKANDAVAAAAAASPAAAAASAFPASPEQEVDADGLDDVDDAADAGMESKILAIRDFLEDPDQSEDDIVSLLQNLADMDITYKALQDTDIGRHVNGLRKHPSSEVRQLVKLLVRKWKEIVDDWVRLHNSGGDGSGSIISDGDSPDKVQSKYHQNTHASDFKYPPSPQRHNVFSSERSSNHNLVESTTEKRRSSPAPAYNNTKQNNSNNYSSISSSAPARAIREQKNTLLDSEKLDSARKRLQENYQEAQNAKKQRTIQVMDIHDIPKPKNRNTFVRKSGGGGFPAKHR

SEQ ID NO: 66147 - protein, 197 aa, Alkalilimnicola ehrlichei MLHE-1
MMNRSAEVQRDTLETRVKVRLDLDGTGESRIRIGVPFMEHMLDQVARHGLIDLDIEADGDTHIDDHHTVEDVGITLGQALAQALGDKKGIRRYGHAYVPLDEALSRVVVDFSGRPGLQFHVDFVRARIGQFDVDLFQEFFQGLVNHAALTLHVDNLRGINAHHQAETVFKALGRALRMAAEADPRQADRIPSTKGAL

SEQ ID NO: 66148 - protein, 470 aa, Triticum aestivum
  misc_feature (31)..(31): Xaa can be any naturally occurring amino acid
  misc_feature (371)..(371): Xaa can be any naturally occurring amino acid
FGTRAPCVSSNASQFLYLALASAYISDLPWXCVAISKGIPIPFSYDKHGPNSDPSSEIAKAVDNFGATTFTWHLSNITDVCQQCEHQGRYCGFSSQRRQAFCQHHGTHVIPIAASSVAAFVVLSLIVATVIYLSLKSRYNEEINMNVEMFLKAYGTSKPTRYTFPNVKKIARRFKDKLGQGGFGSVYKGELPNGVPVAVKMLESSTGEGEEFINEVATIGLIHHANIVRLLGFCSEGMRRALIYEFMPNESLEKYIFTHVSNISRKLLAPNKMLDIALGIARGMEYLHQGCNQRILHFDIKPHNILLDYNFNPKISDFGLAKLCARDPSIVTLTAARGTMGYIAPELYSRNFGGVSYKSDVYSFGILVLEXMVSGGRNSDPGVENQDEVYLPEWIYEKVFSRHEWELTPEMTAEDKEKMRQLTIVGLWCIQWNPKNRPSMTKVVNMLTGRLQNLQVPPKPFVSYENQPRT

SEQ ID NO: 66149 - protein, 158 aa, Zea mays
MAMGLINANPIIHEKKERRARQAPETTDENAAEPIDQLEIFDHIRDIKDPEHPYSLEQLNVVTEDSIELNDESNYVRVTFTPTVEHCSMATIIGLCIRVKLVRSLPPRYKVDIRVAPGSHATEAAVNKQLNDKERVAAALENPNLLDMVEECLSPTFD

SEQ ID NO: 66150 - protein, 376 aa, Glycine max
MPNTSQVISCKAAICWGAGKPVTVEEIQVDPPKATEVRVKMLCASLCHTDISSIQGFPYINFPLALGHEGVGVVESVGDQVRNLKEGDVVIPTYIGECQECENCVSGKTNLCLTYPIRLTGLLPDNTSRMSIRGQRLHHVLSCATWSEYMVSDANYTLKVDPTIDPAHASFISCGFSTGYGAAWKEAKVESGSSVAVFGLGAVGLEAISGAKMLGATKIIGIDKNEMKREKGEAFGMTDFIKAGDSAKSVSELVKEMSGGMGVDYSFECSGVAPLLTESVEATKVGTGKTIAIGTGTEPIIPFGLTSIMYGRTLKGSVFGGLKAISDLSIVANKCQKEEFPLQELFTHEVPLTDINKAFELLKKPNCVKVVIKMSH

SEQ ID NO: 66151 - protein, 239 aa, Zea mays
MDSDLWISRLTAAKRQFALQRAQRQHAAPASHHDRFGYDDIEPEDDVRSDFPCPYCYEDHDVTSLCAHLEDEHPFESKIVSCPVCLARISKNLLDHITLQHGYLFKLQRHHRVRRVTGNGNHNLSYAGRDLQLQETYLKVLLGNSSRSSSTNASSTVTDSLLSSLVLNLSSLEVEDTSKSSAPSVVENNWFKRSLPSKTWKLSAVDSSLSHEERERRRRRAVVRSAFVQHLLVTTLFED

SEQ ID NO: 66152 - protein, 149 aa, Cocos nucifera
RTLRELKLLRHMDHENVVAIRDIIPPPVREIFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDVWSVGCIF

SEQ ID NO: 66153 - protein, 487 aa, Sinorhizobium meliloti
MRAQPKASHFIDGEYVEDAAGTVIESIYPATGEIIARLHAATPGIVEKAIAAAKRAQPEWAAMSPTARGRILKRAAELMRQLNRELSELETLDTGKPIQETIVADPTSGADSFEFFGGVAPAALNGDYIPLGGDFAYTKRVPLGVCVGIGAWNYPQQIACWKGAPALVAGNAMVFKPSENTPLGALKIAEILIEAGLPKGLFNVIQGDRATGPLLVNHPDVAKVSLTGSVPTGKKVAGAAAAELKHVTMELGGKSPLIVFDDADLESAIGGAMLGNFYSTGQVCSNGTRVFVQRKIKEPFLARLKERTEAIVIGDPLDEATQLGPMVSAAQRDKVFSYIGKGKAEGARLVTGGGIPNNVSGEGTYIQPTVFADDTDGMTIAREEIFGPVMCVLDFDDEVEVIARANATEFGLSAGVFTADLTRAHRVADRLEAGTLWINTYNLCPVEIPFGGSKQSGFGRENSVAALNHYTELKTVYVGMGPVEAPY

SEQ ID NO: 66154 - protein, 316 aa, Bacillus clausii KSM-K16
MFDVITLGDAMISFSPNATGPLKFVHSFERRVGGAELNVAIGCSRLGLKTGWITRLGKDEFGQHIQTFARGEGVDVSETKLVDGYATSLNFKEIMANGAGRTLYYRNPSPTETLKPEDLNPSYFQQAKILHLTGIYPAVATGNMAVTKQAIKLAKENGVKVAFDPNIRLRLWSKEEARLALYPLLQEVDILLTGDEEMEIILGTSDPAEIIAETTKLGIDLVAIKRGENGSVGSYQGKVVEAAPVQAAKVVDTVGAGDGFDAGLLYGYLQGWPLERMLAFANTIGSMVVSIVGDNEGLPYLEEVQAQLGELERIER

SEQ ID NO: 66155 - protein, 372 aa, Candida albicans SC5314
MSAPKVATQVFLKTCPSGFIHTKVNEDDSTFEVKEVPVPELKEGQVLAKVLYLSNDPTQRTWLRKAGDNSPSYMPPVHEGTPMASLGLAEIIESKSEKYQKGDIASGRIYWADYAVVPDVVFFNKIDKSLGLPLEFFLSILGMTTLTAFFGLTEVGKLKKYLDGPKEGEKGPVVCVSAASGATGSSVVQIAKHLLGASKVIGISGSDEKCKWVESLGADLCVNYKNSEWKQQVSDYLAKDNEGIDVYFDCVGGEILSFILTKMNKFGHVAACGAISGYNDNKAFAVTSWPFIITNSLNVQGFIVGNFAAQFPEAIKILGAAVKEGKIKAQGAYHVEKLSGDEPSKRLADIPRIWNMLFEDNKPNGKLLIKVD

SEQ ID NO: 66156 - protein, 228 aa, Bacillus clausii KSM-K16
MDQLKRMAAEAAAEYVKDGMKIGLGSGSTVFEFVRVLGEKAKEGLNIQAVAASRKTEALAKACGIHIIDFPTMEKLEVAFDGADEIAPGLMLLKGGGGSLLREKLVAAAAKRLVVLADESKLVEELGAFKLPVEIIPFGWETTAMRIEALGGVASLRQTGKSPFVSDNHNWILDCDFGNIRDPYSLHEKVKKLVGVVETGLFLDMACEAIVASKNGIHHITKGDEFNV

SEQ ID NO: 66157 - protein, 326 aa, Gluconobacter oxydans 621H
MSAPQHDLLCIGNAIVDVLAPVGQDLIDGLGAAAGSMTLIDAPTAHAIESRVDIENVTGGGSGANTAVVAARMGAKVAYLGKVTADEAGDHFTRDIREQGITFPSEPLPAADGTPTARCIVLVTPEGQRTMFTYLGACTEFTPQDVHESVVADAAITYLEGYLYDKPQAQEAFEHAARLARKANRQVALTLSDTFCVERHRAAFHELVAGHVDILFANEAELLALYEVTDFEEAVTQVSAETKLAVITRGEKGAVVIGDGERHDVPTTEVKVVDTTGAGDAFAAGFLAGLSKKHDLVTCAKLGNQAAGEIITRYGARPTEAFTLTA

SEQ ID NO: 66158 - protein, 386 aa, Triticum aestivum
  misc_feature (23)..(23): Xaa can be any naturally occurring amino acid
  misc_feature (154)..(154): Xaa can be any naturally occurring amino acid
  misc_feature (334)..(334): Xaa can be any naturally occurring amino acid
MGRTVKKAGKSKSKKGKGAKKAXASSSAAAAVASGPAKVWQPGVDALEEGEELQFDPEAYNYLRGFSIGWPCLSFDVVQDQLGLVRSEFPHTLYGVAGTQAEKAPWNYIGVFKLSNINGKKREPIPSSKAGAGSDMDSDSSSDEEEEEETNEDXSPILHLKKVAHAGGVNRIRSMTQQPHICATWGDTGHVQVWDFKSFLNSVADSGPVAHKEDDIIHSHVPLKIFNGHKDEGYAIDWSPLVTGRLVSGDCNSCIHLWEPSSSTWDVDTKPFVGHSASVEDLQWSPTEGDVFASCSVDGKICIWDVRTEKKPCMSIKAHNADVNVISWNRYIYXVFLFMSTTISSVYRCIYVVTSIIRLASCMIASGCDDGSFSIRDLRFIKVLSS

SEQ ID NO: 66159 - protein, 325 aa, Sinorhizobium kostiense
IAGWKAINESDMVLMPDPETAHMDPFFAQSTMVIICDILDPVSGEAYNRDPRGTAKKAEAYLKASGVGDTIFVGPEAEFFVFDDVKYKADPYNTGFKLDSSELPSNDDTDYETGNLGHRPRIKGGYFPVPPVDSVQDMRSEMLTVLTEMGVTVEKHHHEVAAAQHELGVKFDTLVRNADKMQIYKYVVHQVANAYGKTATFMPKPVFGDNGSGMHVHMSIWKDGRPTFAGDEYAGLSETCLYFIGGIIKHAKAINAFTNPSTNSYKRLVPGYEAPVLLAYSARNRSASCRIPFGSNPKAKRVEIRFPDPSANAYLAFAAMLMAGL

SEQ ID NO: 66160 - protein, 514 aa, Oryza sativa (japonica cultivar-group)
MGRSKREVAPPPQALPASFPSGMWLATPPMQASFAPGGWQGTAAAPGGWQGMAPPQPPQAPLFAYGANTSAPHLAQMKQGSDRSSMDDSLSDLQESGMDSRPPGGFLSYFQDPSSLQNHQPSIPLNYYATQQAAPWAPSPAEYRSPVTKSGPGEQHPINIDSGGEETPTVRTEKRLTWTHEEDIRLVSAWLNNLNDSINGNFKKNDCYWGDVTTAYNSTTPRNRMRQEKQIKDRFHKIKKNVGRFCCAYKEVKSIYVSGQNELQLMEKVHATYEADYKEGQFTFLHCWKALRDQPKWHAYLEELEKPNKTKSDNEVEVRELTSTPNSPEDIIRPEGTKAAKARRNGKDKRKRKAKVYLSDMDDEIDKPKEVQNMADKGRDELLETQRRVSSENLESKRLAHLAAMEHKEAVMLETYRALMLQDTKDMPDDVRFEHVMALKSMREKLFPKTKVSKMLILAACFGSASAREATYYIIFSNPPILSKQNLCSNYLLSMSLYGSLLWPMNDVWIIVID

SEQ ID NO: 66161 - protein, 430 aa, Gluconobacter oxydans 621H
MLTPILVICLLIFLNAVFAMGEMALISAKRPRLDVLAKQGVWGATTAIRLAEDPHSFLPTVQVGMTLVSILEGTFGGSQMESTVTAWIANIPSLRPIASEVSIVLVVAMITFTMLVFGELIPKQIALQQPEAIASRLAWLLVGVARIAQPIVWLLSGTSSLVLRLLRVGPLTRAAVTEEELKAVLAEGARAGVLETDEQAMIERLLRLADRPVRAIMTPRNELFWIDRHADQETLVRKLRQSSYARIVVCEGDVDHPVGVILAKDIMDRLLLKLPVSVDAVLREPPVIPDSLSAQDMIERMRGVNLGITFVLDEYGSFEGIVTPSDVFEAIVGEEKTESSSSELQAAEGEDEYIFDGFMPADELRSRLDLPELPGAGGYHTLGGVMLALLRRVPARGDKVAFGGWLFEVLEMDRRRVGRVKVSHQVLAED

SEQ ID NO: 66162 - protein, 412 aa, Salmonella enterica subsp. enterica serovar Paratyphi A str.
MADSRPERRFTRIDRLPPYVFNITAELKMAARRRGEDIIDFSMGNPDGATPPHIVEKLCTVAQRPDTHGYSTSRGIPRLRRAISHWYQERYDVDIDPETEAIVTIGSKEGLAHLMLATLDHGDTVLVPNPSYPIHIYGAVIAGAQVRSVPLVEGVDFFNELERAIRESYPKPKMMILGFPSNPTAQCVELEFFEKVVALAKRYDVLVVHDLAYADIVYDGWKAPSIMQVPGARDVAVEFFTLSKSYNMAGWRIGFMVGNKTLVSALARIKSYHDYGTFTPLQVAAIAALEGDQQCVRDIAEQYKRRRDVLVKGLHEAGWMVEMPKASMYVWAKIPEQYAAMGSLEFAKKLLNEAKVCVSPGIGFGDYGDTHVRFALIENRDRIRQAVRGIKAMFRADGVLPSHPKPVEASTE

SEQ ID NO: 66163 - protein, 406 aa, Brassica napus
MAAALQTNIRPVKFPATLRALTKQSSPAPFRVRCAAASPGKKRYNITLLPGDGIGPEVISIAKNVLQQAGSLEGLEFSFQEMPVGGAALDLVGVPLPEETVSAAKESDAVLLGAIGGYKWDKNEKHLKPETGLLQLRAGLKVFANLRPATVLPQLVDASTLKREVAEGVDLMVVRELTGGIYFGVPRGIKTNENGEEVGYNTEVYAAHEIDRIARVAFETARKRRGKLCSVDKANVLDASILWRRRVTALAAEYPDVELSHMYVDNAAMQLVRDPKQFDTIVTNNIFGDILSDEASMITGSIGMLPSASLSDSGPGLFEPIHGSAPDIAGQDKANPLATILSAAMLLKYGLGEEKAAKRIEDAVLGALNKGFRTGDIYSAGTKLVGCKEMGEEVLKSVDSHVQASV

SEQ ID NO: 66164 - protein, 325 aa, Sinorhizobium fredii
IAGWKAINESDMVLMPDPETAHMDPFFAQSTMVIVCDILDPVSGEAYNRDPRGTAKKAEAYLKASGIGDTVFVGPEAEFFVFDDVKYKADPYNTGFKLDSSELPSNDDTDYETGNLGHRPRIKGGYFPVPPVDSCQDMRSEMLTVLAEMGVTVEKHHHEVAAAQHELGVKFDALVRNADKMQIYKYVVHQVANAYGKTATFMPKPVFGDNGSGMHVHLSIWKDGKPTFAGDEYAGLSETCLYFIGGIIKHAKALNAFTNPSTNSYKRLVPGYEAPVLLAYSARNRSASCRIPFGSNPKAKRVEVRFPDPTANPYLAFAAMLMAGL

SEQ ID NO: 66165 - protein, 463 aa, Salmonella enterica subsp. enterica serovar Paratyphi A str.
MLTILKTGQSAHKVPPEKVQATYGRYRIQALLSVFLGYLAYYIVRNNFTLSTPYLKEQLDLSATQIGLLSSCMLIAYGISKGVMSSLADKASPKVFMACGLVLCAIVNVGLGFSSAFWIFAALVVFNGLFQGMGVGPSFITIANWFPRRERGRVGAFWNISHNVGGGIVAPIVGAAFAILGNEHWQSASYIVPACVAVIFALIVLVLGKGSPREEGLPSLEQMMPEEKVVLKTKNTAKAPENMSAWQIFCTYVLRNKNAWYISLVDVFVYMVRFGMISWLPIYLLTVKHFSKEQMSVAFLFFEWAAIPSTLLAGWLSDKLFKGRRMPLAMICMALIFVCLIGYWKSESLLMVTIFAAIVGCLIYVPQFLASVQTMEIVPSFAVGSAVGSRGFMSYIFGASLGTSLFGVMVDKLGWYGGFYLLMGGIVCCILFCYLSHRGALELERQRQNALHNQDSLQLADAQ

SEQ ID NO: 66166 - protein, 922 aa, Sulfitobacter sp. EE-36
MADKVKFTLDGEEVEADTGLTIWEIANGRGLKIPHLCFTPEPGYRPDGNCRACMVEIEGERVLAASCLREPSDGMVVTTNNARAENARKMVMELLVTDQPAPEVAHDKSSHLWDMAAMEGISESRFPKLEEGRIPLLDDSHVAMRVNLDACIQCNLCVRACREVQVNDVIGMAGRGHDSYPVFDMADPMGASSCVACGECVQACPTGALMPATVVDDAQVGDSADFDSEVDSICPFCGVGCQVSLKVKDGKIKYVEGINGPANEGRLCVKGRFGFDYIHHPHRLTKPLIRRKDAPPKGLNVDPGNWQTHFREATWDEALDFAAGGMKKIGGAGVAGFGSAKCTNEEAYLFQKIIRQGFGHNNVDHCTRLCHASSVAALMENVGSGAVTATFNQIENADVAIVIGANPTENHPVAATFFKQFAKRGGKLIVMDPRGQALKRHASHMLQFRPGTDVSMLNAIMHVIVEEKLYDQQYIEAYTENWEIEKAHLKTFTPEKMSKICGIDAEVLRDVARTFAGANAAMIFWGMGISQHIHGTDNSRCLISLALMTGQIGRPGAGLHPLRGQNNVQGASDAGLIPMFLPDYQPVSDDGVRSAFTDVWQSSDFSDKKGLTVTEIMDAVHDGDIRSLYVLGENPAMSDPDVEHARDALAKLDHLVVQDIFLTETANFADVILPASAFAEKSGTVTNTNRQVQMGRPAVPPPGDAKEDWWIEVELAKRLGLGWTYTDPSEVFAEMKLNMSSLNNITWDRLESEGAVTYPSTSPTDPGQAIVFADGFPRQDGRARFTPASIIAPDDAPDEDYPMILTTGRQLEHWHTGSMTRRSYVLDGLEPEANCSLHPSTLRKLGVEPGAYIRLTTKRGSIELMAREDRAVSPDMVFLPFAYVEAAANILTNPAVDPYGKIPEFKFSAVKVEAATGPQPAE

SEQ ID NO: 66167 - protein, 149 aa, Cocos nucifera
RTLRELKLLRHMDHENVIAIRDIIPPPVREIFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDGGLVGCIF

SEQ ID NO: 66168 - protein, 479 aa, Escherichia coli B
MSVPVQHPMYIDGQFVTWRGDAWIDVVNPATEAVISRIPDGQAEDARKAIDAAEHAQPEWEALPAIERASWLRKISAGIRERASEISALIVEEGGKIQQLAEVEVAFTADYIDYMAEWARRYEGEIIQSDRPGENILLFKRALGVTTGILPWNFPFFLIARKMAPALLTGNTIVIKPSEFTPNNAIAFAKIVDEIGLPRGVFNLVLGRGETVGQELAGNPKVAMVSMTGSVSAGEKIMATAAKNITKVCLELGGKAPAIVMDDADLELAVKAIVDSRVINSGQVCNCAERVYVQKGIYDQFVNRLGEAMQAVQFGNPAERNDIAMGPLINAAALERVEQKVARAVEEGARVALGGKAVDGKGYYYPPTLLLDVRQEMSIMHEETFGPVLPVVAFDTLEDAISMANDSDYGLTSSIYTQNLNVAMKAIKGLKFGETYINRENFEAMQGFHAGWRKSGIGGADGKHGLHEYLQTQVVYLQS

SEQ ID NO: 66169 - protein, 225 aa, Oryza sativa
  misc_feature (6)..(6): Xaa can be any naturally occurring amino acid
  misc_feature (20)..(20): Xaa can be any naturally occurring amino acid
PPPPPXPPASRRSPPLRRGXPPPAPATPPSPPPPPPPYIHIETNDFLHRRHKRQKEEDIAVCECQYNLLDPDSACGDRCLNVLTSTECTPGYCLCGVYCKNQRFQKSQYAATRLVKTEGRGWGLLADENIMAGQFVMEYCGEVISWKEAKRRSPAYENQGLTDAYIIYLNADESIDATKKGSLARFINHSCQPNCETRKWNVLGEVRVGIFAKTDIPIGTELSYD

SEQ ID NO: 66170 - protein, 100 aa, Triticum aestivum
  misc_feature (22)..(22): Xaa can be any naturally occurring amino acid
  misc_feature (47)..(47): Xaa can be any naturally occurring amino acid
  misc_feature (75)..(75): Xaa can be any naturally occurring amino acid
  misc_feature (79)..(79): Xaa can be any naturally occurring amino acid
MPMPQWQICTVHHKSSGYPDGXPTEKHQATLLEFGKTENGRPTTAMXLTVGVPAAIGALLLLQNKVQRKGVIRPXEPEXYIPALEILEASGIKLIERVET

SEQ ID NO: 66171 - protein, 216 aa, Triticum aestivum
  misc_feature (113)..(113): Xaa can be any naturally occurring amino acid
  misc_feature (170)..(170): Xaa can be any naturally occurring amino acid
MGSLPVLSPAECAPPPTEGTRATVAASDLAALFDAQRRHLDHFFDRLDMPQAAAFAQALLDAPGAVFFTGVGKSGIVARKLAQTLASLGFARAGFLSPVDALHGDIGSVFPGXDVLVLLSKSGASDELLALAPCARAKGAKLISLTSAASGADCPLAAACDLNVHLPLQXKVCPFGLGPVTSTALQNGLRRTPSVAALHGRRAPLPRGNQYAVKTT

SEQ ID NO: 66172 - protein, 148 aa, Cocos nucifera
TLRELKLLRHMDHENVVAIRDIIPPPVREIFNDVYIAYELMDTDLHQIIRSNQALSEEHCQYFLYQILRGLKYIHPANVLHRDLKPSNLLLNANCDLKICDFGLARTTSETDFMTEYVVTRWYRAPELLLNSSEYTAAIDVWSVGCNV

SEQ ID NO: 66173 - protein, 143 aa, Triticum aestivum
SLIAASARHYLLQPIIADHTTLESLDLTDADGQGVLTMDKWQLQELRVKPVSASGGSHRTLMPALSMRLWYAPHIELPGGLVLNGATLVAIKPTEEATRDTVGTGIAGSAGGCWVSDAFEEPYRTAVGMLLKRRTYSLEMNSF

SEQ ID NO: 66174 - protein, 157 aa, Brassica napus
MAEQQMKPVASLLLLLNFCMYAIVLGIGAWSMNKAISHGFPIGADFSLPAHFSPIYFPMGNAATGFFVMFALIAGVAGAASVISGVSHLQSWTTASFPAAVSAAMIAWSLTVLAMGFGCKEIELGMRNARLRTMEAFLIILSATQLLYIAAIHGVRN

SEQ ID NO: 66175 - protein, 180 aa, Oceanobacter sp. RED65
MSAYENEIKQAVRTIENWPDEGVMFRDIMPLLQDAHIFRKLIDSFVHRYQKETVDAVAAIDARGFILGAPLAYELGVPLVPVRKKGKLPYETVSQSYKLEYGEAEIELHTDALKAGDNVVVMDDLIATGGTMLAACELIKKLDANVLEVAAIIDLPDLKGSERLRDAGFNIYSICQFDGL

SEQ ID NO: 66176 - protein, 1535 aa, Gibberella zeae PH-1
MDAATQHQVKTPEEAVARIAYLSSDVIVSVQPAIGTDSEFSSHLNRYAGRKDSSLVAQSADTVPEIIPVRHNTDPLLSVYTPTRAGKLVSVTTTSTILLPSVSHLYKLANYPVVLHVSLQPRTFPDYSVITAIRNSGFTFVQSETLQEAQDLALTAHALAIRTGKGVIHFFAPSTSANDKPIGVEDASVVRDVLDIESVRRYQAGSAPSSQTGIYADDGHIAVSSDHDAPATTGAASGNLTVPPSANASKAPSAGTSVKSSQDSESSTPVAPSSVATTVESAPPQVTSEDIYKSAGRIWAHLKTAVGREYSAFEYSGPPNAENCLFIFGSDAGAFAQAIDEANTQEIFANTAILTPRLYRPWLGSRLVEAIPRSVKRIAVLEQIHRKTTKWGPLLIDVLTSVKSGPGGVEAIVGHQLGYIAPEVVVQALRGVLQNLTAEKPIQNLEVGKKEAWKEPTGYDLKAPQLETAYTKILDQLFGQRAYVANAIKSSTTGISPTVSASPEFGFGSLLARKQRRGQFVSQVKDAATNGSFTTEAPKSWLARWAMNADDASKSTEIADDVIARLETDGSPLAAQLLTAKGLFRKESLWLTGSDAWSYDLGNSGVHHVLASGENVNMLIIDSTPYSERAAADANRRKKDIGLYAMNFGNVYVASTAVYSSYTQVLQALLEADKFEGPSVVLAYLPYFGETDSPLTVLQETKKAVDTGYWPLYRWNPENEKKGEPNFSLDSELIKQELKTFLARDNQLTQLASKEPKFAAALVKDFGSEVRAQQKRKAKDAYNQLLEGLLGAPLTVLYASDNGNSTTLAKRLASRGRARGLKTTVLAMEDYPLEDLPTEENIVFITSTAGQGEFPQNGLPFWDAIKDNTDLDLAAVNYSIFGLGDSHYWPRKEDKIYYNKPAKDLDRVLTNLGGKHLIDIGLGDDQDPDSFQTGYKEWEPKLWAALGVDKVDGLPDEPPPITNEDIKVASNYLRGTIVEGLNDTSTLAISAADQQLTKFHGTYMQDDRDIRDERKAQGLEPAYSFMIRCRLPGGISTPQQWVQMDDIANELGNETMKLTTRQTFQFHGVVKSKLKPAMQAINRALMTTIAACGDVNRNVMCSSLPTQSKYHREVFACSQLISDHLLPSTSAYHEIWLTDDDNKKTQVAGDAVQDFEPLYGPTYLPRKFKITIAIPPHNDTDVYAHDIGLIAIKGEDGKLAGFNVLAGGGMGATHNNKKTYPQTGRMFGFCKTEDVHIVCEKIMLVQRDNGDRKNRKHARLKYTIDDMTVPVFRSKVEELWGKKFENERPFEFKSNVDTFGWQKDEHGLNHFTFFIENGRIEDTPEFQMKTGLREIAKSLKGESEFRLTGNQHLILSNVADEHLDDVKELMKKYKLDNVQFSALRLSSSACVAFPTCGLAMAESERYLPVLISKLEGCLEENGLRQDSIVMRMTGCPNGCARPWLAEVAFVGKAYGAYNMYLGGGYHGQRLNKLYRQSIKEDEILDIMKPLLKRYALERNEGERFGDFCVRSGVIVATTDGQNFHDNVADEEEDDE

SEQ ID NO: 66177 - protein, 608 aa, Magnetospirillum magnetotacticum MS-1
MCGICGYVGAERPGLIQAMIAEIRHRGPDGEGCDSALGIHLGHARLAILDPSHGAQPLTGADGRYTVSYNGEIYNYPDLRRELEALGHRFETTCDTELLPLGFAAWGEGLFARLDGMFAFALRDNADGRLWLVRDQLGIKPLYYSLAGGELAFASSARALTRHPQVSRRLRPDAIQEFLQFRWVRSGRHLFSDVEILPPGGVLRWTEGEARLDRFWTPARRGPARNALPRDWAAEVELVLEDSVRRQLRADVALGIFLSGGVDSAMIGHYAARNAANRLTAFTFSTGDRVDETAQAAAMARDFGFDHRVVSLTASDFADFPQAVACLDNPVGDAVVLPTWKLCREAAREVKVVLTGEGADEMFAGYAHLPILRKLDQLGSVAGVLRLLAPLIRLMPVGLLNHLFDYQASLGRLGRDAAAELLAVAGDSGKMLARASAIMGDAEMAQATTLGPPPPRPKADLSLGGLLLDLTRGWLPEEILHKMDQLSMAHGLEARVPYVTTALYDLLLRCPDQMAMGKTLLRHVASQSGLAAARRRKVAFHLPVETLWRPQLEEMCREYLSPAMIRRHAILNEAFVGRSLSLLKAGEFLASKRLVAMVSLHAWLDAHT

SEQ ID NO: 66178 - protein, 482 aa, Mycobacterium avium 104
MMIDGKLVDGQAGTFTNINPATEEPLGEVADASKEDMHRAIDAARRAFDETDWSTNRELRKRCLLQLHEAIESEKEELREELILEVGSPRAITFGPQLDAPLEDGLKYPARLIDEYAWETDLGDKVISLTGTLTTRKVWREPVGVVGAIVPWNFPFEVTLNKLGQALGTGNTVVLKPAPNTPFNATRLGRLIAEKTDIPAGVVNVVTASDHFVGEELTLSPKVDLISFTGSTVVGQRIMEKGAATMKRLFLELGGKSATIVLEDADFGMACAIGIAPCMHAGQGCANPTRMLLPRSRYDEGVAILKGIYENVTCGDPQDPGTLCGPVISQVQRDRVMGYIRKGVEEGATALVGGPDAPTGFDKGYYVRPTLFTDVDNSMTIAQEEIFGPVLCVIPFDDEEDAIRIANDSRYGLAGNVMSGSLERSLSVARRIRAGFMGVNGGAPYGADTPFGGYKYSGVGRQNGVAGFDQYTEIKSVAYPAG

SEQ ID NO: 66179 - protein, 437 aa, Xanthomonas oryzae pv. oryzae KACC10331
MIGGGIFVITGQAAADHAGPAIMLSFVLAAVCCAFCAMAYAEFAAMVPVSGSAYTYTYATFGELAAWFIGWMLVLEYGVSASAVAVSWTGYFLSLLDHFGIHLPAAFVSAPLDGKLQPTGAIANLPAAGIVLLLTWLCYVGIRKSSAMNMAMVILKTGLILLVIAVGWKYVDTANWHPFIPANEGPGKYGMEGVLRGAAMVFFAYIGFEAVSVAAQESHRPQRDLPIGMILSLVICTVLYISMAAVMTGLLPYTLLGTDEPVVTAIAAHPQLAWLRVIVEVGALIGLSSVVLVMIIGQPRIFMIIARDGLLPSIFTRIHPKYRTPHINTVITGVGIALLAAVFPLDVLGELTSMGTLIAFAAVCAGVLILRRTHPELPRPFRMPAAWLICTAGMLSCLALLSAMTLHNWMLMGLWTLVGLVIYSGYGYRHSRLRDGR

SEQ ID NO: 66180 - protein, 512 aa, Xanthomonas oryzae pv. oryzae KACC10331
MRRTTFVRASARLCFATYGMYRMLKSVLRVKPIEPAGLVDAGEPVEGSPQGEATLQRTLSAKHLIMLGIGAVIGAGIFVMTGQAAANHAGPAVMLSFVFAGIACTFAGLCYAEFAAMMPVSGSAYSYSYATLGEGIAWFIGWCLVLEYLFAGSSVAVAWSAYLISFITGTLGLPFPTELTNAPLAWINGEFVASGSILNLPAVMIVTAVSGLCYVGITQSAFINAIVVAIKIAVICLFVGFGAAYVDPANWHPFIPENTAPGVYGWSGVFRAASIVFFAYIGFDAVSTSAGETKDPQRNMPIGILGSLAVCTIIYIIICAVLTGLMPYTQLGTAKPVATALEAHPQLTWLKTAVEIGAIAGLSSVVLVMLMAQPRIFYTMAKDGLMPKLFGKVHPRFHTPYVGTVIVGVIAASLAGLIPLSVLGELVSMGTLLAFATVCAGVMVLRFTKPALERPFRVPLAMIICPLGTLACLALFFQAFQEHWKVFVGWTVIGLLIYFGYGIHHSYLAKRA

SEQ ID NO: 66181 - protein, 376 aa, Candidatus Pelagibacter ubique HTCC1002
MAKRDFYDVLGVSKSASPEELKSAYRKLAVKYHPDKNPGDKASEDKFKEAGEAYGILSDKEKKQNYDNFGHAAFEGGGGRQGGGFGGGFGGADFSDIFEDFFGDFGGGQSRGRRKTNNRGSDLRYDLSITLEEAYEGKKQDIKFSTTEKCNTCSGNGSKPGHSPDRCTVCGGNGKVRSNQGFFTVQQTCPQCAGSGEEITNPCTDCNGQGNKQASKKISVTIPKGVDDGTRIRLAGKGEAGSKGGANGDLYLFVNVHSHDLFKRSDENLFFEFPISIADAALGTTIEIPTIDGGKAKIKIPDGTQNGKQFRLKGKGMPYMRGSGNGDLYVQVNTEVPISLNKEQKALLEKFREIENEKSNPSIKQFFQKAKSFWKN

SEQ ID NO: 66182 - protein, 552 aa, Methanosarcina barkeri str. Fusaro
MHLIEESLGNYFEKQVAVDPDHEFIIYPDRNLRFTYGQFNERVNNLAKGLLAIGITKGDHVGIWAKNVPDWLTFMFATAKIGAVLVTVNTAYKSHEVEYVLKQSDMKALAMIDSYRDVDYLEIINELVPELKTSERGRLKSKNFPYLKSIIYVGQEKHRGMYNTNELMLLGSHYPDDKLREIMTSVDCDDVVNMQYTSGTTGFPKGVMLTHKNILNNGLSIGDRQRFTYVDKLCFPVPLFHCFGIVLGVMAVLTHRATLVMLEVFDPLLVLAAVHKEKCTALYGVPTMFIAEYTHPMFDMFDLSSLRTGIMAGSTCPVEAMKKVVNDMHCYQITSVYGLTEASPGMTQTAVDDPLELRVETVGKHFPSVEVRVVDPDTNEPVPLNTVGEICCRGYNVMKGYYKMPEETKKVIDEDGWLHSGDLGTCDENGYYRITGRIKDMIIRGGENIYPREIEELLLTMPEITDVQVVGIPDKKYGEIVGAFVILKKGADFTEVDIRDYALSKVARYKVPKHIFIVDEFPLTASGKIQKYRLRELAVELLNEQGEKIAIE

SEQ ID NO: 66183 - protein, 333 aa, Alkalilimnicola ehrlichei MLHE-1
MDQSRMTLGRFLAQQCPQDEKGKALALLLRQVGDSCRRIADAVAGGALREMTGAADNVNVQGEEQKKLDVFANDVLIEGCNWGGTVAGMASEEEDDIYTLPEGEPRGPWLLLFDPLDGSSNIDVNVSVGTIFSVLPAPDTGRDPVNEDLLQPGHRQVAAGYAVYGPSTVLVLTLGDGVYAFTLDRGQGEWFLTSSKMKVPEQTAEFAINCSYQRIWPAPIKRYIEECLDGEEGPRGKRFNMRWIASMVADLHRIFTRGGVFLYPADEKRPNGRLRVLYEINPMSMLMEQAGGEAFTGKERALDLQPEALHQRSGLMLGSREEVEVLRRYYAEQ

SEQ ID NO: 66184 - protein, 325 aa, Ensifer adhaerens
IGGWKAINESDMVLMPDPETAHMDPFFAQSTMVIICDILDPVSGESYNRDPRGTAKKAEAYLKASGIGDTVFVGPEAEFFVFDDVKYKADPYNTGFKLDSSELPSNDDTDYETGNLGHRPRVKGGYFPVPPIDSCQDMRSEMLTVLSEMGVTVEKHHHEVAAAQHELGVKFDALVRNADKMQIYKYVVHQVANAYGKTATFMPKPIFGDNGSGMHVHLSIWKDGKPTFAGDEYAGLSESCLYFIGGIIKHAKSLNAFTNPSTNSYKRLVPGYEAPVLLAYSARNRSASCRIPFGTNPKAKRVEVRFPDPTANPYLAFAAMLMAGL

SEQ ID NO: 66185 - protein, 317 aa, Oceanobacter sp. RED65
MSISRSAGSLWRTIKLWVDAEQQDAPLKDGAESREMNWLRVMPFIFIHLACIAVIWVGISPVAVAVCLLMYWVRMFAITAFYHRYFSHRSFKTNRFWQFCFAILGNSASQRGPLWWAAHHRKHHKHSDEDEDLHSPVKHGFWWSHVGWFTCDAAFKTDYSVVKDWAKFPELKFLNRYDSLVPVLMAVCMFALGVVLNALWPNLGTSGWQMLIWGYFISTVLLFHGTFTINSLCHQWGKRRFETRDDSRNNFWLALITLGEGWHNNHHRFATSARQGFYWWEIDISYYILKAMSKLGIIYDLTPVPEKILREGREKGK

SEQ ID NO: 66186 - protein, 393 aa, Candidatus Kuenenia stuttgartiensis
MNTQEIQKIYERYVIPNYIRNPILLVKGNGVEIWDAEGKRYLDLFSGWAVSLLGHCHPATVKAIQNQAAKLQHAPNIYYTEPQGMLAKYISEKSFGGQCFFCNSGAEANEAAIKLARIHNSARGKYKIITFSDSFHGRTIATVTATAQPKYHKGFAPLVEGFSYVPFNDMEALRNAIDDKTCAIMLETIQGEGGINIATNEFLRDIRNICNEKGLLLILDEVQCGMGRTGKYFAYQHYGIEPDIMTLAKALGGGVAIGAMTAKKEVAKDLVPGSHASTFGGNPLACAAGVAVFETIEKENLLDNTKEMGEYAMEQLRLLKTQCNIIKEIRGVGLMIGIELAINGSTIIKECIQAGLFLNCTHDTVIRFMPPLNVKKEHIDEGLGILKSVLSNY

SEQ ID NO: 66187 - protein, 299 aa, Oryza sativa (japonica cultivar-group)
MFSFRKKHASRFDSDDIEQQEAKIQELRAALGPLSSSGKKYCTEACLRRYLEARNWNVDKSRKMLEESLKWRTAYRPEDIRWPEISVESETGKMYRASFVDREGRTVVIMRPAKQNTSSHEGQVRFLVYTLENAILSLPEDQEKMVWLIDFTGWTLANATPIKTARECANILQNHYPERLAIGILFNPPKVFEAFWKVVKHFLDPKSIQKVNFVYLKNEESMKILHKYIDPEVLPVEFGGKNNVVYSHEEYSKLMVKDDIKMASFWASDTKTDHVNKVINEHSVPEVTQQSSLVAAKAS

SEQ ID NO: 66188 - protein, 184 aa, Triticum aestivum
  misc_feature (23)..(23): Xaa can be any naturally occurring amino acid
QAINLHSTAVAPTVMACSATSVXPFPGVKSTAGLPVNRRSNGVSLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 66189 - protein, 732 aa, Anabaena variabilis ATCC 29413
MPIPRVSCLISASHREGVIVLLSGSTPCPGLFYATPAQDGILSRIRIPGGIINSKQCQAIADIADEYGGGYVDVTNRANIQIREIRADIDSPVLKRLQELGLGSRNTGVDQIRNIMTSPTAGIDPQELIDTRSFVRSWDSYITENSALSRLSAKFSVCFDGGGLVSVSDRLNDITFAATLVENRVYFRLCLSIGAKGKPPIDTGILLSPEECLPVLMALTEVYLAHTDAHNKRKPRLREVVNSLGLDNYLQEVEKLLTISFGGKNLTPLPPSLVGKGEKTKHFSPLLVGEGLGERSHTKYHHIGIHPQHQQNLYYIGLVLPLGRLETWQLKSLADLSAKYGNGTLRLTPWQNLLLTDIPQQWLTEVQSHILGLGLDFSAANIKSGLVACSGIQGCAAAATDTKSHALALADYLESHITLEHPVTIHFSGCDKSCAHHGDSDITLLGVNNETGEGYQVYVGDRDSREKFGREVHPYIAVAELPTTIEQILGMYKNEYAKPDESFGQCTNHHETPQLKQLFPQANPMSDYIHDANEIYRNSFAIIRSEANLDILPPDIAKVAVRLIHACGMTDIVTDLGYSATAAQSGRAALAVGAPILCDCRMVADGVTRRRLPADNQVICTLNEPEVPELAKKLGNTRSAAALELWIPHLEGAVVAIGNAPTALFRLLEMLDAGCPKPALILGFPVGFVGAAESKAALAADSRNIPYMTLHGRRGGSAIAAAAVNALATEEE

SEQ ID NO: 66190 - protein, 325 aa, Ensifer adhaerens
IGGWKAINESDMVLMPDPETAHMDPFFAQSTMVIICDILDPVSGESYNRDPRGTAKKAEAYLKASGIGDTVFVGPEAEFFVFDDVKYKADPYNTGFKLDSSELPSNDDTDYETGNLGHRPRVKGGYFPVPPIDSCQDMRSEMLTVLSEMGVTVEKHHHEVAAAQHELGVKFDALVRNADKMQIYKYVVHQVANAYGKTATFMPKPIFGDNGSGMHVHLSIWKDGKPTFAGDEYAGLSETCLYFIGGIIKHAKSLNAFTNPSTNSYKRLVPGYEAPVLLAYSARNRSASCRIPFGTNPKAKRVEVRFPDPTANPYLAFAAMLMAGL

SEQ ID NO: 66191 - protein, 130 aa, Halobacterium salinarum
MTANDPLSDALSGIDNAESVGHLTHTVAPASNMVGSVLEVFYDRGYIDGFEFVDNGKAGRFEVELKGAINECGPVNPRYSVGADGFEQWEKRYLPARDYGSLVVTTSHGIMSHYEAREAGIGGQVIAYVY

SEQ ID NO: 66192 - protein, 325 aa, Ensifer adhaerens
IGGWKAINESDMVLMPDPETAHMDPFFAQSTMVIICDILDPVSGEAYNRDPRGTAKKAEAYLKASGIGDTVFVGPEAEFFVFDDVKYKADPYNTGFKLDSSELPSNDDTDYETGNLGHRPRVKGGYFPVPPIDSCQDMRSEMLTVLAEMGVTVEKHHHEVAAAQHELGVKFDALVRNADKMQIYKYVVHQVANAYGKTATFMPKPIFGDNGSGMHVHLSIWKDGKPTFAGDEYAGLSETCLYFIGGIIKHAKSLNAFTNPSTNSYKRLVPGYEAPVLLAYSARNRSASCRIPFGTNPKAKRVEVRFPDPTANPYLAFAAMLMAGL

SEQ ID NO: 66193 - protein, 166 aa, Triticum aestivum
  misc_feature (97)..(97): Xaa can be any naturally occurring amino acid
MGGGAWPFLVGACEDDCWIWPSITQRAYQAAEIIAAANSINRSKIVPEYSFLDARGLGAYEGKRLEALPEVYASDNISPDIKPPPTYDGTPNESVAXDVFVRVTRLMSILETQYSGDTVVIVSPDSDNLSILQAGLIGLDLRRHDSLFFQLGEVRAVDPASIPEYK

SEQ ID NO: 66194 - protein, 398 aa, Mycobacterium avium 104
MLGIVLAGGEGKRLYPLTADRAKPAVPFGGAYRLIDFVLSNLVNARYLRICVLTQYKSHSLDRHISQNWRLSGLAGEYITPVPAQQRLGPRWYTGSADAIYQSLNLIYDEDPDYIVVFGADHVYRMDPEQMVRFHIDSGAGATVAGIRVPRSEATAFGCIDSDESGRIRKFVEKPLDPPGTPDDPETTFVSMGNYIFTTKVLIDAIRADADDDHSDHDMGGDIIPRLVDDGMAAVYDFSDNEVPGATDRDRGYWRDVGTLDAFYDAHMDLVSVHPVFNLYNKRWPIRGESENLAPAKFVNGGSAQESVVGAGSIISAASVRNSVLSSNVVVDDGAIVEGSVIMPGARVGRGAVVRHAILDKNVVVGPGEMVGVDLERDRERFAISAGGVVAVGKGVWI

SEQ ID NO: 66195 - protein, 184 aa, Zea mays
MDLPPFPRQLVHRSGYSSPTVYFIHQNQRNCAIRFYNAQLMSATDSCGAYCLMRGHGIHLMRHINFRLVIDKETGKPKGYGFCEYKDEETVLSACRDLHGYEINGRQLCVDFAENGRNTYSNREKVDNPQNYYRRAITTTLEFFINTSSCIVFIHVNDNSCASSDYYVSPVAISYKHVYICTTA

SEQ ID NO: 66196 - protein, 480 aa, Mycobacterium avium 104
MDHDAAVRTDGHGRRADVIRVISPHTERPVAEVDAATPSDVDAAVAAARAAFDAGTWSRGGPSHRIAAIRRLADIYDRRRAEMAETITAEIGAPISFARRAQVGLPAFMIRAFCDLAERHPWQETRPGFFGSDVYVRREPVGVVAAIVPWNMPQFLIVTKLIPALLAGCTVVLKPAPESPLDALLLAEMISEADLPPGAVSVLPGDAALGAYLAGHRGVDKVSFTGSTAAGRAVAAACAANLTKVSLELGGKSAALVLDDAPPDKVAAGVRAASLSNSGQICNALTRVLVPQARHDDYVDALAAHMGGLRVGDPADPDTDLGPLVSRRQQQRVRDYIRIGQQEGARLVVGGADMPDGLDRGWYVRPTLFAAAGNAMRIAREEIFGPVITVIPYRDDDEAVAIANDSDYGLAGSVWSDDTDRALALATRIHTGTVGVNQGYTMDPFAPFGGVKASGYGRELGPEGLDGYLDTKSIAVAPSG

SEQ ID NO: 66197 - protein, 419 aa, Xanthomonas oryzae pv. oryzae KACC10331
MAGAAMGQGTLFCSVRAQPPGGFAYTRVPPFLVRTGTMPLTTKLPKVGTTIFTVMSQLAAEHGAVNLGQGFPDFAVPQRLVDELTKAMAAGHNQYPPMPGVATLRQAIAGKAQRCYGAQVDADTEITVTSGATEAIFNAIHAVVRASEDVIVLDPAYDCYEPAIDLAGARAVHVALDPQTFAVDWDALRAAITPKTRLLMINSPHNPSGAVLSADDMQTLTELLRGTEIFLLSDEVYEHIAFDGRRHESVLRWPELRERAFVISSFGKTYHCTGWKIGYAIAPPALTAEFRKVHQYNTFTSFGPAQHAFAAMIRDEPEHDEQLGAFYQAKRDRFREQLLTTRLKPLPVPGGYFQLVDYSAISDLPDTAFVKWLTVEKGVAAIPLSPFYERAPAGQRLARLCFAKNDATLDAAIERLQKL

SEQ ID NO: 66198 - protein, 321 aa, Desulfitobacterium hafniense Y51
MKKGMTLYLGIDTSAYTTSLAIVDEQAELVYENRKILTVPEGERGLAQSAALFQHVQNLPQLVTAVPPQYWEKVSALGVSTAPRPIQESYMPVFLPGYGVAAAMASARCIPLVETSHQEGHLAAGIASSKLKEPHFLAIHISGGTTELLEVHHTQPGKLDIQLLGGTTDLHAGQFVDRVGVRLGLPFPAGKSLEELARQADPGAAAWLPSAVRGFEVSFSGVETAAQRLIDQGKNPADVARAVEGCIVRTLGKLLQAGMEKTTLSEILIVGGVASNQFIRKELKKRLARHANLHWAEPDWSRDNAIGVALLALEKVRGCII

SEQ ID NO: 66199 - protein, 293 aa, Oryza sativa
MATRLGREARGERWVQGIAAYVHGGGRLGTPDRERWRWGEVTRLRKGAEVGREYGRSRWEYDGQETLPGDGTPTPWYSTGIRTMRVPAAVTGGCGCGVDGGGGCCRGGGKLADWEEGKDDEMKSVVVKGWTRMAQVVPLHDNASAEDDDDDEEDDDEDDDDDDDEDDEEEAAPPYVMAVDDSSVDRAVITALLRRSKYRVTAVDSGKRALEILGSEPNVSMIITDYWMPEMTGYDLLKKIKESSELKQIPVVIMSSENVPTRISRCLEEGAEDFLLKPVRPADISRITSRMLQ

SEQ ID NO: 66200 - protein, 216 aa, Triticum aestivum
  misc_feature (41)..(41): Xaa can be any naturally occurring amino acid
  misc_feature (107)..(107): Xaa can be any naturally occurring amino acid
  misc_feature (153)..(153): Xaa can be any naturally occurring amino acid
TPFPPPVPTLLCLNKWKPDVTCDDQEDISQDGSRLWAIDKXPNIAQPPAGWERQIRIRGEGGTKFADVYYTSPTARKLRSLVEVDRYLQENPEYGAQGVTLAQFSFXQIPRPLRQNYVKKRPKNASPSDEATTRPLHPVEVNPISWGCPSGKXRLRASGPASHADEKPVGSADVELVRKRKAEGSEPGEADANNHVSDAPETKLEDAQNGDATTTA

SEQ ID NO: 66201 - protein, 415 aa, Candida boidinii
MSLSSKLSVKDLDCTGKRVFIRVDFNVPLDGDKITNNQRIVAALPTIKYVLEQKPKAIILASHLGRPNGEVNPKFSLKPVAAELESLLGEKVEFLKDCVGPEVESAVNSAAPGSVILLENLRFHIEEEGSAKKDGVKVKADKADVEKFRKQLTSLADVYVNDAFGTAHRAHSSMVGFELPQRAAGFLMAKELEYFAKALENPVRPFLAILGGAKVSDKIQLIDNLLDKVDILIIGGGMAFTFNKIAQNMEIGKSLFDEAGAATVPDLLAKAKKNNVKIVLPVDFVTADKFDAAANTGYATVEQGIPAEWQGLDCGEKSIKLFTETIGEAKTIVWNGPPGVFEFEKFAKGTHAMLDACVKSCAAGNTVIIGGGDTATVAKKFGGADKLSHVSTGGGASLELLEGKELPGVVFLSNK

SEQ ID NO: 66202 - protein, 376 aa, Candida boidinii
MDGEDVAALVIDNGSGMCKAGFAGDDAPRAVFPSIVGRPRHQGIMVGMGQKDSYVGDEAQSKRGILTLRYPIEHGIVTNWDDMEKIWHHTFYNELRVAPEEHPVLLTEAPMNPKNNREKMTQILFETFNVPAFYVSIQAVLSLYSSGRTTGIVLDSGDGVTHVVPIYAGFSLPHAILRLDLAGRDLTDYLMKILSERGYTFSTTAEREIVRDIKEKLCYVALDFDQELQTSSQSSSIEKSYELPDGQVITIGNERFRAPEALFHPSVLGLEASGIDQTTFNSIMKCDVDVRKELYGNIVMSGGTTMFPGIAERMQKEITALAPSSMKVKIIAPPERKYSVWIGGSILASLSTFQQMWISKQEYDESGPSIVHLKCF

SEQ ID NO: 66203 - protein, 253 aa, Oryza sativa (japonica cultivar-group)
MESAPASRVRREDVARAVAALLRWLQHHPTPAPEPIYLLVTLKRAPARRFEHTLRLPRSPFPSISLVSDRLPADLPDDIDPLPSPALGSLPPAARRGLVLVDRRLRVRPGGKGKAAAKAARVVPVDLADQAWAESAREAARRVELRVEGGTCRAVRVGHAAMAREEAVENVVAAVEAAAACVPRKWRNVRALHVKAPESVALPLYSAVGTGGGDDGGNGEAEDAKRKGVAVKEQGIVKRRKKSSSVSVGGDQL

SEQ ID NO: 66204 - protein, 434 aa, Fusobacterium nucleatum subsp. nucleatum ATCC 25586
MVFKNSIDLYKKAVELIPGGVNSPVRAFKSVNREAPIFIKKGQGAKIWDEDDNEYIDYICSWGPLILGHNHPKVIEEVKKIIENGSSYGLPTKYEVDLAELIVDIVPSIEKVRLTTSGTEATMSAVRLARAYTQRNKILKFEGCYHGHSDALLVKSGSGLLTEGYQDSNGITDGVLKDTLTLPFGDIEKVKEILKNKDVACVIVEPIPANMGLIETHKEFLQGLGKVTEKTGTILIFDEVISGFRLALGGAQEFFGITPDLTTLGKIIGGGYPVGAFGGKKEIMDLVAPVGRVYHAGTLSGNPIASKAGFATISYLKENPNIYKELEEKTNYLIDNIEILAKKYSVNVCVNSMGSLFTIFFVDIDKVENLEDSLKSNTENFSIYFNTMLENGIVIPPSQFEAHFLSMAHTKKELNRTLEVIEMAFKKIGEKSGK

SEQ ID NO: 66205 - protein, 201 aa, Aspergillus niger
MNPEYDYLFKLLLIGDSGVGKSCLLLRFADDTYTESYISTIGVDFKIRTIELDGKTVKLQIWDTAGQERFRTITSSYYRGAHGICVVYDVTDMDSFNNVKQWLQEIDRYATEGVNKLLVGNKSDMEDKKVVEYTVAKEFADSLGIPFLETSAKNASNVEQAFLTMARQIKERMGTATVNNKPTVQVGQGQGVQSGSAGGCC

SEQ ID NO: 66206 - protein, 321 aa, Glycine max
MSNEKAPSSASSSSYELSKGINGLDKVILRDARGSSAEVYLYGAHVTSWKNDHAEELLFLSSKAIFKPPKPIRGGIPICFPQFSNLGPLDSHGFARNQFWTIDDSPPPFPTSTSNKAFVDLILKPSEDDIKIWPHSFEFRLRVALGPGGDLLMTSRIRNTNIDGKPFSFTFAYHTYFSVSDISEVRVEGLETLDYLDNLQKRERFTEQGDALTFESEFDRIYLSTPTKIAILDHEKKRTIVLRKDGLPDAVVWNPWDKKAKAMSDFGDDEYKYMLCVEAAAIEKPITLKPGEEWKGRLELSTVSSSYCSGQLDPKRVIQGS

SEQ ID NO: 66207 - protein, 573 aa, Thermoanaerobacter tengcongensis MB4
MLKGVAASPGIAIGKAFLYTKEKVTINVEKIEESKVEEEIAKFRKALEVTQEEIEKIKEKALKEFGKEKAEIFEAHLMLASDPELIEGVENMIKTELVTADNAVNKVIEQNASVMESLNDEYLKERAVDLRDVGNRIIENLLGVKSVNLSDLEEEVVVIARDLTPSDTATMKKEMVLGFATDVGGRTSHTAIMARSLEIPAVVGLGNVTSQVKAGDLVIVDGLEGIVIVNPDEKTVEDYKSKKESYEKKVEGLKQLKDLPAETPDGKKVMLAANIGTPKDVASALANGAEGVGLFRTEFLYMDRNSLPSEEEQFEAYKEVVEKMGGRPVTIRTLDIGGDKELPYLDMPKEMNPFLGYRAIRLCLDRPDIFKTQLRAILRASAYGNVQIMYPMISSVEEVRKANSILEEVKAELDREGVKYDKEIKVGIMVEIPSAAVTADILAKEVDFFSIGTNDLTQYTLAVDRMNEHVKEYYQPFHPAILRLVKMVIDAAHKEGKFAAMCGEMAGDPLAAVILLGLGLDEFSMSATSIPEIKNIIRNVEYEKAKEIAEKALNMSEAREIEKMMKDVIKDIG

SEQ ID NO: 66208 - protein, 874 aa, Phaseolus vulgaris
MFQVPGVSGILNPGGHGHNKIKGTVVLMRKNVLDFNSVPDLTKGNVGGVIGTGLGVVGSTVDTLTAFLGRSVSLQLISATQSDENGKGKVGKDTFIEGIITSLPTLGAGESAFYVRFEWDGSMGIPAAFHIKNYCQVEFTSRSLTLEDVPNQGTIRFVCNSWIYNANIYKKSVRTFFANHSYVPSETPAALVHYREEELKNLRGDGTGERVEHDRIYDYDVYNDLGNPDKAAALARPVLGGSTLPYPRRGRTGRAKTKKETDPNSEKPDDFVYLPRDEAFGHLKSSDFLAYALKSVSQDVLPVLTDAFDGSLLSLEFDNFAEVHKLYDGGVTLPTGFLSKYAPIPIVKEIFRSDGEQFLKYPPPKVMQVDKSAWMTDEEFARETIAGVNPNVIKILKEFPPRSTLDTQAYGDHTSIITKEHLEPKLGGLTVEQAIENKKLFILDHHDYLIPYLRRINSSTTKTYATRTIFFLKDDGTLAPLAIELSKPHSQGDEHGPVSEVYVPAYEGVEAYIWLLAKAYVVVNDSCYHQIVSHWLNTHAVVEPFVIATNRQLSVVHPVYKLLFPHYRDTMNINSLARKSLVNADGIIEKTFLWSRYSMEMSSVIYKDWSLVDQALPNDLIKRGVAVADPSAPHGVKLVIEDYPYASDGLEIWDAIKSWVEEYVAFYYKSDEALQKDPELQAWWKELVQVGHGDLKDKPWWPKMQSRGDLVAVSTTLIWIASALHAAVNFGQYPLGGLILNRPTISRRFMPVEGSAEYAALAKNPEKEFLRTITGKKETLIDLTVIEILSRHASDEIYLGERDGGDHWTSDAGPLEAFKRFGKKLAEIEEKLVKKNNDETLRNRTGPAKMPYTLLYPSSEEGLTFRGIPNSISI

SEQ ID NO: 66209 - protein, 523 aa, Zea mays
MAGGGVAALGVKTERAAQYKGRMTLAVATTCLVAAVGGAIFGYDIGISGGVTSMDPFLEKFFPVVFHRKNSGGKNNYCKYDNQGLAAFTSSLYLAGLVASLVASPVTRNYGRKASIVCGGVSFLIGAALNVAAVNLAMLILGRIMLGVGIGFGNQAVPLYLSEMAPAHLRGGLNMMFQLATTLGIFTANLINYGTQNIKPWGWRLSLGLAAVPALLMTLGGLFLPETPNSLIERGRVEEGRRVLERIRGTADVDAEFTDMVEASELANTVEHPFRNILQPRNRPQLVMAVCMPAFQILTGINSILFYAPVLFQSMGFGGNASLYSSVLTGAVLFSSTLISIGIVDRLGRRKLLISGGIQMIVCQVIVAVILGVKFGAEKQLARSYSVAVVVVICLFVLAFGWSWGPLGWTVPSEIFPLETRSAGQSITVAVNLLFTFAIAQAFLSLLCAFKFGIFLFFAGWITVMTVFVYVFLPETKGVPIEEMVLLWRKHWFWKKVMPDMPLEDGWGAAEGHAAPASNNHKG

SEQ ID NO: 66210 - protein, 149 aa, Spinacia oleracea
MAZZLTDEQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYEEFVKVMMAK

SEQ ID NO: 66211 - protein, 138 aa, Aspergillus niger
  misc_feature (106)..(106): Xaa can be any naturally occurring amino acid
  misc_feature (108)..(108): Xaa can be any naturally occurring amino acid
  misc_feature (131)..(131): Xaa can be any naturally occurring amino acid
WDTAGQERFRSLIPSYIRDSSVAVVVYDISNAKSFQNTRKWIDDVRGERGNDVIIVLVGNKTDLNDKREVTTAQGEEEAKKNGLMFIETSAKVGHNVKQLFRRIAXAXPGMEVSHRRHQMIDVNITRKETXTNDGCAC

SEQ ID NO: 66212 - protein, 110 aa, Gibberella zeae PH-1
MSDAPVAKKAEGSNSKSVEGKKKFEVKKWNAVALWAWDIVVDNCAICRNHIMDLCIECQANQASATSEECTVAWGICNHAFHFHCISRWLKARSVCPLDNRDWEFQKYGR

SEQ ID NO: 66213 - protein, 198 aa, Glycine max
  misc_feature (127)..(127): Xaa can be any naturally occurring amino acid
  misc_feature (164)..(164): Xaa can be any naturally occurring amino acid
  misc_feature (183)..(183): Xaa can be any naturally occurring amino acid
  misc_feature (191)..(191): Xaa can be any naturally occurring amino acid
  misc_feature (196)..(196): Xaa can be any naturally occurring amino acid
NDSVLSLAFFVTLCTCLLCGNSYDDHLSLPSQLYDYDSVSCTDTDPNLNYMPVIGILTHPADSASGRLNNATGVSHIATSYIKYVESGGARVIPLIYNESPDNLNKKLHLVNGVLVSGGWAASGTYXDTLGSIIKKVSEYYDAGDHLLVIALHLGGYLMMKIVXEHTDMLEPCTATSLPSTLXIVEDSDAXGSLLXRF

SEQ ID NO: 66214 - protein, 755 aa, Debaryomyces hansenii CBS767
MSNSISVQNELVESFKNAINLELQSDLLLTNSYLTSYSPKKLHQLGLAIINLVVTNIKNGLGGKTIIELEIDPALKSNDTEIQLGSLRVGDIIKLDKMSNANTSETIQFKKALENSSKKKRGTDEEGKCQDESLDAVLIRINSKTVTISIEEDNSEEKVLSLYNNTFNDNIRMWIVKLSNSITYKRMTTAMNKLSELTSSNKSEIIQYLLGESQYAKKSSGRSLKQKHFFNPNLNTSQKEAINFAINESAITIIHGPPGTGKTYTLIELIKQLTFNNDEKVLVCGPSNISVDTILERLSPIFNEEEVHTDKKKSRRAVKKSTSAGKNPEELIRIGHPARLLGSNLQHSLDILSKTNYDTGSNDNKEILKDIEKDISDTLGKVKKCRNYAERRALWSDLKTYKKELRVRERKIVQDLLVGAKVVLSTLHGAGSYELTSLYKEPTLNFDHDHPLFDTIIIDEVSQSLEPQCWIPLVNHLGCKRLVIAGDNMQLPPTVKSKDDLDALMRKLNIKDGVADLELTLFDRLIRDHNGSQFKKLLDTQYRMNEDIMRFPSNELYDGNLKAHDSVRSLTLEDLPSVKPTDDTSIPCVWYDTQGGNFPERASDDDSRAMAESTGSKYNDMEVLVVEQHLQNLLQAGITPADIGVISPYNAQASLLKKTLQLRQIDGIEVSTVDGFQGREKEAIIISLVRSNPNREIGFLADRRRLNVAMTRPKKHLCIIGDLELMATSGKKYLKNWSQYAENEYEIRYPDLGDY

SEQ ID NO: 66215 - protein, 460 aa, Bacillus clausii KSM-K16
MNVLEKEKGTYTSDVHEYVQHVYETVKQRNPYENEFHQAVKEVLDSLLPVLAKRPQYIRQAILERIVEPERMISFRVPWVDDQGNVQVNRGFRVQFNSALGPYKGGLRFHPSVNTSIIKFLGFEQIFKNALTGQPIGGGKGGSDFDPKGKSDGEIMRFTQSFMSELSKYIGPDTDVPAGDIGVGAKEIGYMFGQYKKMRGRFEAGVLTGKDIAYGGSLARKEATGYGTVYFVEEMLKEKGHSFAGSTVVVSGSGNVSIYAMEKAMHLGAKVVACSDSEGYIYDKRGINLETVKRLKESEKKRISEYVNEHPQAHFFQGCSDIWSVPCDIALPCATQNEIDENTATVLVSNGVKAIGEGANMPSTLEAVNVFHEHGVLFAPAKAANAGGVSVSALEMAQNSARLSWTFEEVDAKLQDIMKTIYRDCIEAAKENDAPGNLVVGANIAGFVKVADAMIAQGVI

SEQ ID NO: 66216 - protein, 439 aa, Oryza sativa (indica cultivar-group)
MAASPAAAAAAATVSSFVSPSSFSSVNFRFEAFKTKVPRNANMAKLQAGYLFPEIARRRAAHLLKFPDAKIISLGIGDTTEPIPDVITNAMAERAHALSTVDGYSGYGAEQGEKKLRAAIAATYYADLGIEETDIFVSDGAKCDISRLQVLFGSNVKIAVQDPSYPAYVDSSVIMGQTGLYQEDVQKYGNIEYMKCSPENGFFPDLSSVPRTDIIFFCSPNNPTGAAASRDQLTKLVKFAKDNGSIIVYDSAYAMYISDDSPKSIFEIPGAKEVAIETASFSKYAGFTGVRLGWTVVPKELLFSDGHPVAKDFNRIVCTCFNGASNISQAGGLGCLSPEGLKAMSDVVGFYKENTKIIVDTFTSLGFNVYGAKNAPYVWVHFPGRNSWDVFAEILEKAHVVTTPGSGFGPGGEGFVRVSAFGHRENIIEAARRLKQLYK

SEQ ID NO: 66217 - protein, 196 aa, Candidatus Pelagibacter ubique HTCC1002
MSRIGKVSRKTKETSISVEVNIDGKGQYKIDTGIGFLDHMLEQLSKHSLIDLKVKAKGDTHIDLHHTTEDTGIAIGEALKKALKDFKGIKRYAHAMIPMDETLTRVAIDVSNRPYLIWKVKLKVERLGEMDTELFKEWFQAFSQSAGITLHMENIYGDNSHHIIESCYKALARSLRIALEIDPRNKKSIPSTKGSL

SEQ ID NO: 66218 - protein, 454 aa, Arabidopsis thaliana
MGDHHDFINSGSWWKVSSSSSPSSSSSMRASSIESGGSAVFHDKLHHHSLATDHHLQMIGLGLSSQSPVDQWNQSLLRGDSKAETSFGVMLQENLNLDATSNANANTTSSTSSYQLQESDSSHHHQALWRDPQSDFKPQILTSGGNRGFFLDHQFSPHGSSSTDSSTVTCQGFAVDNSSNAMYAATTTTPNSSSGMFHHQQAGGFGSSDQQPSRNHQQSSLGYSQFGSSTGNYDQMASALPSTWFLRSSPPPKPHSPLRFSNNATFWNPAAAGNAGAPPPHDASSNFFPALQPPQIHPQSFDEQPKNISEIRDSSSNEVKRGGNDHQPAAKRAKSEAASPSPAFKRKEKMGDRIAALQQLVSPFGKTDAASVLSEAIEYIKFLHQQVSALSNPYMKSGASLQHQQSDHSTELEVSEEPDLRSRGLCLVPVSSTFPVTHDTTVDFWTPTFGGTFR

SEQ ID NO: 66219 - protein, 211 aa, Synechococcus elongatus PCC 6301
MAPLSLSLPLDQLRFDERGLLPAIAQDYLDGTVLMLAWMNREALEKTLETGEVWYWSRSRQELWHKGATSGHFQKLQAIRYDCDSDALLLTIEQIGDIACHTGERSCFHRDVDVVTPPPADILTEVYRVVCDRRDRPSEASYTSKLFAGGDNKILKKIGEEAAEVVMACKDDDADGLAGEAADLFFHTLVALAQHNVDLRSVYRKLQERRR

SEQ ID NO: 66220 - protein, 152 aa, Oryza sativa
  misc_feature (125)..(125): Xaa can be any naturally occurring amino acid
VAKRLEKFKTTIFTQMSMLAIKHGAINLGQGFPNFDGPDFVKEAAIQAINAGKNQYARGYGVPELNSAIAERFLKDSGLQVDPEKEVTVTSGCTEAIAATILGLINPGDEVILFAPFYDSYEATXVMAGANVKAITLRPPDFSVPLEELKAA

SEQ ID NO: 66221 - protein, 349 aa, Gibberella zeae PH-1
MDVVLEVVDTFIADYAYAYFYPKRLAPYDFPSPSNTTDTSAKAFSTWIYKPATQFITLEPPEQAYMSSWDRDNPLRQALTLYLITWIFGLLVYFIVATLSYIFIFDKRTFEHPRFIKNQVRMEIIAANKAMPVMAIITAPFFLLEVQGYGKLYDTTEDGPGLWYDFFQFPLFLLFTDFCIYWAHRWLHHRLVYKYLHKLHHKWIMPTPFASHAFHPLDGFTQSLPYHIFPFIFPLQKMAYVALFVFVNLWSVMIHDGEYLTNNPVVNGAACHSLHHSRFEVNYGQFFTAFDRMGGTYRMPEQWMFERDMKMSEGRWKKEIEKVDELIEEIEGSDNRTYTDSAPIMKKTQ

SEQ ID NO: 66222 - protein, 885 aa, Ashbya gossypii ATCC 10895
MEKLSGEFKGSPPYFNEDKDSSSLSPSLPSQDDKKYKYNVSADAQETKEVLTEDQLIYITTRMGYEHATDLEHIPESVRYLESKLADLDVEKCCEIIDVHIKEHDQDPNLSTEDWNDLVRFSKRDFDPKNPQQVFELKVVAAIFHYYSPYVEVRAVASPVDDPTIPVETFRAYFLATLWVVIGSGFNMFFAQRQPAISLGVFAVQMLVYPCAVLWVRVMPCWGFKVFGRRIALNIESQWSEKEQMFVTLLYSITNGAFYSEYNIVTQQIHYKSPMSYAYQFLLSFSLQFLGFGLAGIMRRYVVYPSIALWPSSMTTIALNKALLSSDHSNGIGRKKMFYITATAIFVYNWFPTYLFEALSTFNWMTWIKPDNFSLATVTGGINGVGLNPISTFDWTNIGTSSLYLPFRVTLTTYLGGLLAALVTLGVYYMNYRECQFLPIFTQSLYNNRATSYRVEEILTEDRKLDEQKFQKYGFPYYTAGNIVAYGCFMCVYTALVVTSILQQGAFYGRVYKTWILDLWSLRKPSSWRAVFSNDKHVLDDFHDSHSRMMRKYKEVPEWWYMTIFIVSIVIGIIVVKVFKTNTPVWGLFLAVALNFVLLLPITLLQATRGVTIGLNLLLQMISGLALPGNPYALMFIKAFGYNIDGQADNYLGNMKLAHYAKIPPVPLFRGQLLMVLIQIFVNLGVINWQLHNIENYCDPKQRFKFTCPGIRTYFNASVMWGAIGPKRIFEHVYPIMKWCWLIGACVGLFFGLWKKLSIMYKKIPYPDRFSPVIFIIGMLSFGPPYNLQYTTSGLYVGFISMCYMKRYHLRVWERYNYVVAAGISCGLVFSAIVMFFTVQWKGVEISWWGNTVSYAGLDYARVPLLNVTETERGYFGPELGQIPG

SEQ ID NO: 66223 - protein, 263 aa, Brassica oleracea
MPRLSNAAVITTNAILALIGLATLCFSVYLFIEGPSQCQRFIQNPLIVTATLIFFISSLGLIAALYDNYIIITLYLFFLFLSILLTLIFSIFIFLVTNSSAGKAFSDKGIGNVKTGDLQNWIGDHFLQGKNWEGIKRCMADSSICRFRPRDVDFDAKHLSHVKFGCCRPPVECGFEAKNATWWTVPATSTAEIKEDCKTWSNTQSQLCYSCETCKVGVYKGIRKRWRILLVFNLLLILLVVLLYSWGCCVRKNNRVPWKRRFL

SEQ ID NO: 66224 - protein, 195 aa, Claviceps purpurea
MAVVATIKCVVVGDGAVGKTCLLISYTTNKFPSEYVPTVFDNYAVTVMIGDEPYTLGLFDTAGQEDYDRLRPLSYPQTDVFLVCFSVTSPASFENVREKWFPEVHHHCPGVPCLIVGTQVDLRDDPSVREKLAKQKMAPVKKEEGDKMARELGAVKYVECSALTQFRLKDVFDEAIVAALEPPMPKKKSLKCLIL

SEQ ID NO: 66225 - protein, 428 aa, Zea mays
MAAASFTAAKFLAPVAARSGGERAPPLPAGASSSSFARTLRRGAVHHPRLRTALAVSSDLLAGNKAAQAAAAHPAVTREEALELYEDMVLGRVFEDMCAQMYYRGKMFGFVHLYNGQEAVSTGFIKLLNQADCVVSTYRDHVHALSKGVPARSVMAELFGKATGCCRGQGGSMHMFSAPHNLLGGFAFIGEGIPVATGAAFAAKYRHEVLKESGPDGLDVTLAFFGDGTCNNGQFFECLNMAQLWKLPIVFVVENNLWAIGMSHIRATSDPEIWKKGPAFGMPGVHVDGMDVLKVREVAKEAIERARRGEGPTLVECETYRFRGHSLADPDELRKPDEKTHYAARDSITALKKYIIEQNLATESELKSIEKKIDDVVEEAVEFADASPHPPRSQLLENVFADPKGFGIGPDGKYRCEDPKFTQGTAQV

SEQ ID NO: 66226 - protein, 555 aa, Oryza sativa (japonica cultivar-group)
MGGYEYATNGYHRGMEDDYEDEYYSEDPYDEEGEGAGQEYAEEDDEPPEGQQEFLQIRERLKEQIRRKAQAASASAAGRSSSSHDRKPQSTFGSFFGPSKPVISQRVIEERKSLKELQNTASMSRDRRPSAKEIPSSSKVQSKTNGHHHKQKIVNEAKRKAEALKDNRDYSFLLSDDADISPSPMEKPVARSSLSQKSDRESTHSAVKSRAPTGQTARLSNGYGLKNTLSSQRHTEGRVDSNRKVAGANRERVVLPDNGRMHSVVRNGSTQATTSKAASQKLPSKAPIANRPPIKSVSDQSLRANHSASKQLLSQNGRPQSSQSQRMQSTSHGQRPHQPVQSQWPLQSLQGRRPQQSPQNTRPQLMSKSQRPQQSLQRQRPQLSSQNERLESSERQRPPSQSYRPQSSQGQRPSSVQGRQYSEQRRIQANDRVKSAERQIRPPSKPMPSRQIPSNGMRDAHAKKKQPMKRRFNDLSEDEEDPLAMIRSMFRYDPSKYAGRDDDDSDMEADFATIEMEEQRSARIAKEEDDEQLRLIEEEERREQERKRRKMARGR

SEQ ID NO: 66227 - protein, 473 aa, Oryza sativa
MSALFAASRCASLRVMRPQCSHIAAASLLLSRWYSSKFPPHTVINMPALSPTMTQGNIASWSKKEGDQLAPGEAIAEIETDKATMDFEFQEDGYLAKILMGDGSHDIPVGKPIAVYVEESNDVAAFENFTAEDAGEGEAKPAESKEEPKQESKEESKDTSKESKAAPAKSESKSSSTPKPSGRIIASPLAKTIALEKGISLKNVKGSGPNGRIVAKDLENIKESAAAAPAAAAAAAPVGASYTDTPLTNMRKTIASRLLQSTQQSPSYIVSSEMSVSKLLKLRQSLNASAEDRYRLSVNDLLIKAIAKASLRVPEVNSAWLGEQGVIRTYNYVDVSVAVATPTGLITPIVKNADTKGLATISAEIKDLGKRAKANKLAPEEFQGGTVTLSNLGMNHAVTSFTSIINPPSCAIFAVGTVTKKAVPSDVNEQGFIFDDVMNITGTFDHRLVDGALGGEFMKALKKIVENPLEMLV

SEQ ID NO: 66228 - protein, 229 aa, Brassica napus
  misc_feature (205)..(205): Xaa can be any naturally occurring amino acid
MAMMVSVSNSFLTFNSPNHLRTSRRRRFCAMATTGVRVTEGEGNLPKLVLTSPDKSEAEIYLFGGCVTSWKVASGKDLLFVRPDAVFNKIKPISGGIPHCFPQFGPGVIQQHGFGRNMDWSVVDSENAADNAAVTLELKDGPYSRSMWDFAFHALYKVVVGADCLSTELKITNTDNKPFSFNTALHTYFRASVTGASVRGLKGCXTLNKDPDPKNPLRSEDRMQSFSGL

SEQ ID NO: 66229 - protein, 238 aa, Zea mays
MSAASKKLFQAARSLVLSASNRSVLAAEGRTAALATLTNFGRKTLPTAYLSYHKQGSHHAASGWGAIAAAVPAAVYMLQDQEAHAAEMERTFIAIKPDGVQRGLISEIMSRFERKGYKLVAIKLIVPSKEFAEKHYHDLKERPFFSGLCDFLSSGPVLAMVWEGEGVIKYGRKLIGATDPQKSEPGTIRGDLAIVVGRNIIHGSDGPETAKDEIALWFEPKELVSYTSNAEKWIYGVN

SEQ ID NO: 66230 - protein, 221 aa, Yersinia kristensenii
MNSHSTDKRKKITRIGIGGPVGSGKTAIIEVITPILIKRGIKPLIITNDIVTTEDAKQVKRTLKGILDEEKILGVETGACPHTAVREDPSMNIAAVEEMEERFPDSDLIMIESGGDNLTLTFSPALADFYIYVIDVAEGEKIPRKNGPGLVQADILVINKIDLAPYVGASLDVMESDTKVVRGERPYILTNCKTGQGIEELVDMIMRDFLFTHVQPQGEHA

SEQ ID NO: 66231 - protein, 596 aa, Prochlorococcus marinus subsp. pastoris str. CCMP1986
MIKVEKVKKKKEIAKQEIVCLANGLEVSKFENFKKGSEFLKEPLASELKNESDHFTNDAVQLLKFHGSYQQDNRENRKPGKSKDWQMMLRLRSPGGEIPGNLFLSLDELSDKLGNGTLRVTTRQAFQMHGIRKDNLKEVIKSIVNSMGSTLAACGDINRNVMAPAAPFETAEYITARTLAVKVADLLTPMAGQGTFLELWADGDLEYTIKPDKEIEENRKLQFKENVFSGTKKEPLYGSTYLPRKFKCAVTVPGDNSVDLLTNDIGIVAFTSKEGSFEGCNFYIGGGMGRTHNNEETFARIADPLGYVENKDTYELIQSIVAIQRDYGDRKSRKNSRMKYLLHRKGIKWFKKILSDKYFRKEIKPLRKEPENKLIDYLGWHKQNEDYFFVGLPLLSGRLSGKKKSLIRDLVKENDLYLRLTPNQDILLCNIPNKNKSKIKKALKKIGYDNLNDINEIQRHALACPALPLCGLAMTEAERILPEVLTRIENLLTDMNIEKTILFRMTGCPNGCTRPYMAELALVGSGQNKYQLWLGGSKNLQRLAKPYLQRMELDDLERTIQPLLELWKKSSAEKDFGDFINNQTESFITNLLSEIN

SEQ ID NO: 66232 - protein, 379 aa, Bacillus clausii KSM-K16
MKAVTFQGKKQMEPKEVPAPSIQQDTDIIVRITASGICGSDLHLYHGGIVPETDYVVGHEPMGIVEEVGPMVKSLKKGDRVVIPFNVSCGECFFCQHQMESQCDNSNGNPHSDAGGLFGFAEQFGNYPGGQAEYLRVPYGDFTSFKLPAESELDDEQVVLLSDVIPTAYWSVKHAGVSTGDTVIILGCGPIGLMAQKFAWLHGAKRVIAVDQVAHRLEHGKRTNLVETYNFSNTPDIGKQLYEDTEGGADVVIDCVGMDGTVPPGETFGSSGDNQFGTIQPIVTASEAVRKFGTVQITGVYGSEANQFPINDFFTRNVSLKMGQAPVVHLMPTLYTMIERGTIDPTDIITHRMGIEDAPDAYRIFDQKEDGNIKTIFKL

SEQ ID NO: 66233 - protein, 376 aa, Ashbya gossypii ATCC 10895
MSTAELDASKLKVIRKEEPTVFEQNADFTFGRLFIDHMLVVEWKRESGWQAPEIRPYGNLSLDPSACVFHYGFELFEGMKAYRTEDGRVTLFRPEMNAARMNRSAARIGLPQFDAEQLVELIGKLVELDRQFVPQRPGYSLYIRPVMIGTSASLGVTAPDSALLYVIACPVGPYYKSGFSAVRLLATDNVTRAWPGGFGDKKLGGNYAPCIPSQEEAARLGYHQNLWLFGPEKYITEVGTMNAFFVFKDSTTGKKELVTAPLDGTILEGVTRDSVLTLARERLSPEEWDVSERYYTISEVAERAAKGEVVEAFGCGTAVVVSPIKEIGWNDQAIKIPLLPGEETGEFTKQVAHWISEIQYGKVEYNNWSRTIADLK

SEQ ID NO: 66234 - protein, 157 aa, Medicago truncatula
MACNKGQQHARKTKKKQVKDELDRLKQAEKKKRRLEKALATSAAIISELEKKKQKKKEEQQRLDEEGAAIAEAVALHVLLDEDSDDSYKVECKTWDDYNNNLDFFMSGKRACFPNLDGSTWSVTSQNGKWSISFRTVRKQCTRTTLRSRMGSYKILC

SEQ ID NO: 66235 - protein, 230 aa, Medicago truncatula
MAKVTLHVYDLTNGSEKTNNTVVHINKIFKNGIGLGGIFHGAVQVYGDDEWSFGSCEEGTGVFSCPSRKNARYTYRQSLVLGKTNYNIFMVNQILRELSKEWPGNSYDLFSKNCNHFCDEFCARLGVPNPPGWVNRFANVGDITMEVAGCTASRFRQAKTEIVSASKSACRFLFCVTNNVKTDMDDSPRGESLGVQAVWMKKVITNGVKPSTSTSSEAGTSSEIEPQQQI

SEQ ID NO: 66236 - protein, 295 aa, Glycine max
MANWRKQQGESHHQVGQWRSSYNRKPPLGDKWHSTVPAWERKFCTSIGSVPWRKLVESKKYMHLFEHVVNWDDSAGKEAFDNAKTRYWAEINGVPCNISPPDPNIFIDEVDWNATVDPQLILDVETELAKVPNEELRKNDHEIVMIGGALFLNEQKLPCTGWDDDYAAEGPKPFDPNSAVQGWGENLQEHNGVESGKLNHAPAEHAGEHVAPAEPAKEDFSLAEPAKEDFSLAEHAKGHEWQDWRNDSWGWNQRENYGGGGGGDLHKMGRGRNGGGGYGNWGTWDGYQKERQHVM

SEQ ID NO: 66237 - protein, 283 aa, Desulfitobacterium hafniense Y51
MLSKSFGGVGLVKHFAVIGDPIAHSLSPLMHNAGYKALNLAADYQKFQVSPEDLQEAVFGLKALGFSGWNVTVPHKETILPFLDELTEEAVRAGAVNTVKVDKGRLIGHNTDGSGFVRSLQEHMELDECKQIVILGAGGAAKGIAMALAPFGAQLCLMNRTPERGAELVEKILEGGGQARQEPWGRGEWLAQADCVIQTTSIGLKKEEYPFSLAGIRPGTLVVDIIFNPWETPFLHSAKAMGCKTVNGIDMLLYQGVNAWEFWLEDKAPVESMRKALYQALAV

SEQ ID NO: 66238 - protein, 439 aa, Klebsiella pneumoniae
MHDKYDVLIIGGGPGGYVAAIRAGQLGLRTVLVEKQHLGGICLNWGCIPTKALLHGAEVAHTITHASQLGISVGEVNVDLQKLVQFSRTVSQQLTAGVAYLLKKNGVRVIDGTARLRGKGQITVEDARGEARDYRADHVILATGARPRALPGIAPDGEHIWTYFEALRPKLLPKSLLIIGSGAIGVEFASLYNDLGCKVTLVELASQILPVEDAEVSAAVRKSFEKRGIQIHTQTLVTQVQLTDTGVRCTLNNTGGEYSQDVERVLLAVGVQPNIEDLGLETLGVELDRGFIKTDAACRTNVFGLYAIGDVAGPPCLAHKASHEGVLCVETLAGVEGAHPLDRDYVPGCTYARPQVASLGLTESTALARGRPIRIGKFSYQSNGKALVSGETEGFVKTIFDAETGELLGAHMVGAQVTEQIQGFASPVTWRPQTKASCR

SEQ ID NO: 66239 - protein, 149 aa, Catharanthus roseus
MAEQLTEEQIAEFKEAFSLFDKDGGGCITTKELGTVMRSLGQNPTEAELQDMTNEVDADQNGTIDFPEFLNLMARKMKDTDSEEELKEAFKVFDKDQNGFISAAELRHVMTNLGEKLTDEEVDEMIREADVDGDGQVNYEEFVRMMLAK

SEQ ID NO: 66240 - protein, 326 aa, Arabidopsis thaliana
MRSTCKKWYVLTKDQRFAKKRGKEFLMIMNRRVYLIGVNLHNNIDLSIKCRGRLISRDETAQGFYVSQVFHCNGLLLSVSGKTIDDTRLVVCNPYGVKPKWINPKDNYGRLDIFSLGFDKLCGSYKILRIYDFDNKLQIYDLSSNSWMIPRDTLGRDIEYMQNGVSSKENTYWCARDKQSQYCFLFCFDFTRERFGPRLPLPFNGAYVSLSAVKEEQLAVLFQPSDKSEIEIWVTNKIEPEEVSWSVFLKVEMKLRVLSWNFLIDKEKKFAVVFDKDKAKGFKTNYDIAYVIGENGYYRRVDLRESPNKPLCRIVSCYVPSCVQIE

SEQ ID NO: 66241 - protein, 454 aa, Lupinus luteus
MASRPIVPLQPQQAKGEGVIGGRRKQENKNGAANGKNRVVLGDIGNLDRVKGANINLNRPITRSLCAQLLAKAEAGENDKNLAIPNVTGPKPQVADGVVAKRRVAPKPAEKKVTAKPKPVEIVEISSGKEVQKDKSANKNKEQGDALSKKKSQTLTSVLTARSKAACGLTEKPKDQIIDIDAGDSRNELAAVEYIEDMYKFYKLAENENRPHQYMDSQPEINERMRAILVDWLIDVQTKFDLSLETLYLTINIVDRFLAVKTVLRRELQLVGVSAMLMASKYEEIWPPEVNDFVCLTDRAYTHEQILVMEKIILGKLEWTLTVPTTFVFLTRFIKASVPDQELENMGHFLSELGMMHYATLVYCPSMVAASAVFAARCTLNKTPIWNETLQLHTGYSEEQLMDCARLLVSFHSTLANGKLKVLYRKYSDPQRGAVSMHPPAKNLMPESSCGSRV

SEQ ID NO: 66242 - protein, 197 aa, Clostridium acetobutylicum ATCC 824
MEEKRTAFIERKTTETSIEVDINLDGEGKYDIDTGIGFFDHMLELMSKHGLIDLKVKVIGDLKVDSHHTVEDTGIVIGECINKALGNKKSINRYGTSFVPMDESLCQVSMDISGRAFLVFDGEFTCEKLGDFQTEMVEEFFRALAFNAGITLHARVIYGKNNHHMIEGLFKAFGRALSEAVSKNTRIKGVMSTKGSI

SEQ ID NO: 66243 - protein, 278 aa, Synechococcus elongatus PCC 6301
MSSAAQNAIALLIEMAESGEIDPWDVQVVDVFDRFLEQLQQRPSLTPLTDFSRSRYEADLSESGEAFLYASILILLKADALARLEFPPAEVLEEFVESLDDLAAMPQLPAKLEQQLRRRAVALPPQQRRVTLSDLIEQLEQVAQSLADPPARSRRRQPKPAPRRQAIQAITHLAHQENLAETAAALGDFLQRQWSALQPENDWLNFEDLVQLWSQTQAGDHHLDGDRVGAFWALLFLAAQSIVELQQESLYSPLWIRCLTPFGNPIAVPFEPTASASV

SEQ ID NO: 66244 - protein, 215 aa, Phalaenopsis sp. SM9108
MAICNVFFRYCSEKNIELKEGNFTLSYDTNIPRQAGLSGSSAIVCAALNCLLDFYKVRHLVKVQIRPDLILSAERELGIVAGLQDRVSQVYGGLVYMDFSKENIDKLGHGIYIPMDIDLLPPLHLIYAENPSDSGKVHSTVHKRWLDGDQFIISSMEEVAKLALDGHKALTERNNSELAKLMNSNFDLRRKMFGDDVLGALNIQMVATARVQCCC

SEQ ID NO: 66245 - protein, 164 aa, Oryza sativa (japonica cultivar-group)
MAAEKKEVADAAAGSGSDTILLISSDGEHFNVPSAAASLSQLVSNMIEDDCTTNGVPLPNVASKVLAKVIEYCIKHAAAGEEEEKDLKSFDAEFIDVDKNMLYDLLLASNFMNIKSLLDLCCQHTANLIKGKSPEQIRKEFGIKNDFTPEEEEEIRKENTWAFE

SEQ ID NO: 66246 - protein, 389 aa, Synechococcus elongatus PCC 6301
MKAMILAAGKGTRVRPITYTIPKPMIPILQKPVMEFLLELLKEHGFKEVMVNVSHLAQEIESYFRDGQRFGVEVAYSFEGRIEDGQLIGEALGSAGGMKRIQDFSPFFDDTFVVLCGDALIDLDLTEAVRWHKEKGALATIVMKTVPREEVSSYGVVVTDSDGRIQAFQEKPSVEEALSTTINTGIYIFEPEILNYIPSGQEYDIGGDLFPKLVETGAPFYGISMDFQWIDIGKVPDYWQAIRSVLNGEVRNVAIPGKQVRPGVYTGLNVAIDWDSVAIEGPVYIGGMTRIDEGVRIVGPAMIGPNCHICKGATIENSVIFEYSRLGSGVRLVDKLVFGRYCVDRNGNAIDVQAAALDWLITDARRAEPVQPSAEHQAIADLLGSNVLP

SEQ ID NO: 66247 - protein, 200 aa, Oceanobacter sp. RED65
MQINYQKAQFLISAPSIRQCPEDNGAEVAFAGRSNAGKSSALNTLAQQNKLARTSKTPGRTQLINFFEIEEGLRLVDLPGYGFAKVPERMKREWQKNMSEYLEQRKSLKAMVLVMDIRHPLSEFDLMMCQWALDCNMPTHILLTKADKLKKGPANSTKLKVKKELKEMGDLLTVQTFSALKRDGVDQLRSRLNVLLTGED

SEQ ID NO: 66248 - protein, 437 aa, Desulfitobacterium hafniense DCB-2
MEGFKIKSVKARQVFDSRANPTVEVDITLKDETVGRGIVPSGASTGLFEAVELRDGEETFDGKGVSKAIHHVNEQLAPLLLDIDVRDQKAIDSRLIEIDGTPNKSRLGANAILGCSMAACWAGANYYKVPLYRYLGGSAANKLPVPMVQIIGGGAHADNAIDIQDFLVIPTSAPTFSEGYEMVVNVYNAAKMIFKGAGKPVSIADEGGLWPTGFQSNEEGLKLLCESIELAGYTPGQDLGIALDIASSEFYDPERGTYRLELEEKTLTKEEMVGMLSDWVDKYPIISIEDGMSELDWEGNLLLTQKLGKKIQLIGDDLFTTNIERIRKGVEMKVDNAVLIKMNQIGTITETIETIEFTQNHGYLPVVSARSGETEDCTIVHLAIATNAGQLKVGSAARSERTAKWNEVLRIEEALGSSARYPSKGVFAAAGIQFNQY

SEQ ID NO: 66249 - protein, 344 aa, Arabidopsis thaliana
MFSCIACTKADGGEEVEHGARGGTTPNTKEAVKSLTIQIKDMALKFSGAYKQCKPCTGSSSSPLKKGHRSFPDYDNASEGVPYPFMGGSAGSTPAWDFTNSSHHPAGRLESKFTSIYGNDRESISAQSCDVVLDDDGPKEWMAQVEPGVHITFASLPTGGNDLKRIRFSREMFDKWQAQRWWGENYDKIVELYNVQRFNRQALQTPARSDDQSQRDSTYSKMDSARESKDWTPRHNFRPPGSVPHHFYGGSSNYGPGSYHGGPPMDAARTTTSSRDDPPSMSNASEMQAEWIEEDEPGVYITIRQLSDGTRELRRVRFSRERFGEVHAKTWWEQNRERIQTQYL

SEQ ID NO: 66250 - protein, 115 aa, Clostridium acetobutylicum ATCC 824
MEYKKILEMMDFSKGLIPAIVQDDENGEVLMLAYMNEEALKRTVDTKRTWFWSRSRKSYWNKGETSGHFQYVKSIGIDCDGDTILIKVKQVGAACHTGNRSCFYRSFEFEDGGAK

SEQ ID NO: 66251 - protein, 422 aa, Ashbya gossypii ATCC 10895
MGQLLSHPLTEKTIVYNDYLLEANGKHANLPDGSMKPYAKERHHRHLHLRRQFTENKSQEVVLTDTSSEITKEHASCTQFFNCVGSMQGYRMTQEDAHLVSNCDTQLVASFRNPMNNNAVEKLRISVFGVFDGHGGDECSQFLADSEKGLLKWIKYSFENHEYCSISDSASTASSRRAFCTVEGLISQIFRDAFALQDKDLHCHFANSPCGSTAVVAAIINSETLYVVNCGDSRCILASMNSCIKTMSFDHKPQHIGELIRINDDGGTVSLGRVGGVLALSRAFGDFQFKRSVAYKDSQLTNSIRRYIPAAEAQVTVEPDVLTHSCASAQDQLKPQALCIMTPIYSNKALTQFIKYHLTLGLTLDDIVTKVLDHGLAGADSNTGVGFDNMTIIIIVLNKPGETLSQWYAKMKMRMEQEKGLV

SEQ ID NO: 66252 - protein, 431 aa, Prochlorococcus marinus subsp. pastoris str. CCMP1986
MKRVLAIILGGGKGSRLYPLTKMRAKPAVPLAGKYRLIDIPISNCINSGINKMYVLTQFNSASLNRHIGRTYNLSAPFGQGFVEVLAAQQTPDSPKWFEGTADAVRKYQWLFQEWDVDEYLILSGDQLYRMDYSLFVQHHRDNKADLTVAALPVDESQAEGFGLMRTDDLGNIKEFSEKPTGEKLKSMAVDTSKFGLTKESASEKPYLASMGIYVFSRKTLFDLLNKFPSYTDFGKDIIPEALSRGDTLKSYVFDDYWEDIGTIGAFFESNLALTQQPKPPFSFYDEKFPIYTRPRYLPPSKLVDAQITDSIVCEGTILKSCSILHCVLGVRSRIESDSVIEDTLVMGSDFFESLEERIELRKGGGTPLGVGEGSTIKRAILDKNARIGDNVVIVNKDRVEEADKPDVGFYIRNGIVVVVKNATIANGTII

SEQ ID NO: 66253 - protein, 600 aa, Coccidioides immitis RS
MPTISVDKAALFKALGQEYTTEQFDELCFEFGLELDEDTSNSERPIVNGVQEPPQLKLDIPANRYDLLCFEGIALMLNIFRGKTVLPNYRLVTPPNGALQTIVVKKETANIRPYISGAVLRNIHFDKARYDSFIALQDKLHQNLARQRTLVSIGTHDLDKLQGPFSYEALPPKDINFVPLNQNTSMNGEELMNFYEKDKHLGKFLHIIRDSPVYPIIYDSKRTVCSLPPIINGDHSKITLDTRNVFMEITATDKTKVEVVNNIMVAMFSQYTSEPFTIEPIQVVSEHNNETRQVPNIKPRLTQASISYINQCCGLNLSAQEICDLLKKMAYIAKPSKSSADLIDVEVPITRADVLHEADIMEDVAIAYGFNELPRSFPSKSGTIAQPLPVNKLTDIIRTEAAMAGWSEVMPLILCSHDENFAWLNRKDDGNTAVKLANPKTVEFQVVRTSLLPGLLKTIRENKSHTVPMRIFEVSDVAFKDMRLERKSRNERHFAAAWYGRTSGFEVVHGLLDRVMAMLKSAFIVGEEGLDNPDVSGSRYWIEELEDPTYFPGHAASIHVCIGGKEHVIGTFGILHPTVLEKFELKYPVSTLEMNIEVFL

SEQ ID NO: 66254 - protein, 191 aa, Arabidopsis thaliana
MGKKRKSTATSLDEVDRTVYASFRTAANSLSQLYTQSMNHQKLSFQAGERHGLEKLYQWIWRQQEGGSRVTPMDIVNYIQNELECCIDEPPISPRAPPPQPTMHVTNPGLMTTSGTSFPTAVPVVRSEQCENQAKNSVFSNALSSPIRRSLQNYQIPQGGYTSGGTTRSSEVNRGSNSPGSIDSSMDMHAE

SEQ ID NO: 66255 - protein, 516 aa, Clostridium perfringens str. 13
MNTLNDILSKEIEEFREKGHKFLNKEMTVGEFKKASGGMGVYAHRGGKEFMVRLRVPSGVAGLSLLEEAYNWAKKYNLEKIHLTTREAIQLHGISIDAVCDIMQEGLNKGIYTRGGGGNFPRNVALNPLSGVQIGETFDVTPYALASNAHYMSKIYTYNLPRKIKTAFSNTEEDSAHCTVTDLGFLAVENNGKRAFKLYIGGGLGRNPRTSVEFDELIDEKDVLYCLEAMTNLFVAEGDYKNHGKARIRYIVERMGEEEFKNCFRKHLEEVKAKGGLDLKVEDIKYSKKGEKTNIKHERLIPQKQEGLYTVLFHPVGGQLSLDVLKELIEKIEKIEEVEVRLGMDENLYVRNLNGKEAEAILDFTQGKGGETLAERSVACIGTPTCQMGVLESQKTLREFVELLKENSIKEGLLPRVRFSGCPNSCGMHEIGDIGFAGKKKKVGDVLSNVFELHFGGKLGIGETRLGDYYGDILQDKVPEFLIKVAKAVEAKNSTFEEWIKDNSEEFKAIVEEYNV

SEQ ID NO: 66256 - protein, 616 aa, Coccidioides immitis RS
MEGQAENDELYPIAVLIDELKHDDVLLRLNAIHRLSTIALALGPERTRDELIPFLDESIEDEDEVLTALSEELGGFVEYVGGPEYAHVLLSPLENLAAIEEPLVREKAVESLNKICEQLSPRQIEEHFIPLTVRLSKVDWFTSKISATGLYCAPYKSASPAHQQAMRQQFGQLVHDDTPMVRRQAANNLAKFVKEMQTPVIIEEMIPLFQYLANDDQDSVRLLTVEILISIAEEIPKEQQSSHGVLLTSLRSLFEDKSWRVRYMVADRFEKIAKAVDDQVVNRDLVPAFVKLLKDTEAEVRTAIAGQIPGFCSLLDRETLLNEIMTSIEDLVSDQSQHVRAALGTQISGLAPILGKEETISHLLPMFLQMLKDDFPDVRLHIISKLELVNKVIGIELLSQSLLPAIVQLAEDKQWRVRLAIIEYIPLLASQLGVKFFDEQLNSLCLGWLGDSVFSIREAATQNLKKLTELFGVDWANDSIIPKVVAMGQHPNYLYRMTTCFAISTLAPVITLKMIEGSILPILDRLSKDDIPNIRFNVAKSYAVLIDILQRLPEDGTISELEKSDQAKSPSPRNQSIIQHQILPHLEQLKQDEDVDVRYFATTAAGNYGEAMQTSP

SEQ ID NO: 66257 - protein, 241 aa, Prochlorococcus marinus str. MIT 9303
MRPLPGANAVETLCTGLDGLLERAADYYVQGARFANWRAALQITSDGCPSDLSIRENSWGLARYARCVQESGLVPIVEPEILMDGNHSIEQTARAQERVIREVYQACLVNDVLLEGTLLKPSMTVKGTDCAKKEDPKTVASLTVRTLERSVPSSVPGITFLSGGLSEEPASVHLNEMNCIERKSRWTLVFSYGRALQHSCLKAWAGSDIAAGQKVLIARAQANSEASLGQYLAGSQPSSDE

SEQ ID NO: 66258 - protein, 290 aa, Streptococcus pyogenes MGAS315
MDKLARIDEAIRRYYKTTSNGVSEELIDAILYSVDSGGKRIRPLILLEMIEGFGVSLQNAHFDLAAALEMIHTGSLIHDDLPAMDNDDYRRGRLTNHKQFGEATAILAGDSLFLDPFGLIAQAELNSEVKVALIQELSLASGTFGMVGGQMLDMKGENQALSLPQLSLIHLNKTGKLLTFPFKAAALVTDQAITVRQQLEQAGMLIGHAFQIRDDILDVTASFEDLGKTPKKDLFAEKATYPSLLGLEASYQLLTESLDQALTIFQTLENDVGFKPQIITKLIEGLRLNA

SEQ ID NO: 66259 - protein, 204 aa, Triticum aestivum
MACLHDHECGDHNCAADWSLYNHIDIPKVVALNESVAGSVKSVFKSWDQRLETSGGFLESNEGDPELLVFIPFTSDVKIKSIAVVGGADGTSPSRMRAFINREGIDFSDAQNMQPVQEWELAENLQGVLEYQTRYSRFQGVANLTLHFPDNFGGDTTKIYYIGLRGEATQNKRDVVATIVYEVMPNPSDHKTKSETGGGFSHVE

SEQ ID NO: 66260 - protein, 340 aa, Brassica napus
MDHEADAFRTDLMTITRFVLNEQSKYPESRGDFTILLSNIVLGCKFVCSAVNKAGLAKLIGLAGDTNIQGEEQKKLDVLSNDVFVKALVSSGRTSVLVSEEDEEATFVESSKCGKYCVVFDPLDGSSNIDCGVSIGTIFGIYTMEHSDEPTTKDVLKPGNEMVAAGYCMYGSSCMLVLSTGTGVHGFTLDPSLGEFILTHPDIKIPKKGNIYSVNEGNAQNWDGPTTKYVERCKYPKDGSPAKSLRYVGSMVADVHRTLLYGGIFLYPADKKSPNGKLRVLYEVFPMAFLMEQAGGQAFTGKKRALDLVPKKIHERSPIFLGSYDDVEEIKALYAEEEKN

SEQ ID NO: 66261 - protein, 315 aa, Ralstonia solanacearum GMI1000
MVAKRSVLSSAAADVLVVGSLNMDLVIRTPCLPRPGQTVAAPALETIPGGKGANQAVASARLGSRVAMLGCVGDDPHGMALREGLLREGVDTAMVTAHAGAPTGIACVTVADNGQNTIVIVAGANRQLTPAMIDAQRAAFERAKVIVCQLESPPDAVERALLLGQRLGKTVILNPAPAAGPLPTPWLAACDYLIPNETEAALLTARRVDSPEAALNAAADLHAQGARHVIVTLGARGVAYVDATTRLLMPAHPAQAIDTTAAGDTFVGALATALAEGAAPVEAIQFGLAAAAVSVTRLGAQPSIPFRSELASPVQ

SEQ ID NO: 66262 - protein, 362 aa, Arabidopsis thaliana
MMMSNLPKDLVEEILSRVPFKYLRAIRSTCKNWYDLSKNRSFANKNIDKAAVSGEKEFLMITQFNVFWVGVNLHRSQNNSFDLSIQLKAKIVSRDKKDDLFQKSQVIHCNGVFLCVREKMLVVLNPYWGQTKRIMPRPPFGCFDRYALGYDKSSGSHKILRLFGVNQNNLNIYDLSSSSWMIPDGTLERDMEYMKQGVSLNGDTYWYAKDKESIDWYLLCFDFTRERFGTPLPLPFSNEGYTLHKGYKSLSALKEEKLAVLLWDTMVIWVTNKIEPDAVSWSIFLKLDMEPSIYCRYGNFFIDEEKKVAVVFEKDSSSWSWMYNPNYNKAYIAGENGYFKSVNLLKSPNTLQLGHLVCSYAL

SEQ ID NO: 66263 - protein, 110 aa, Clostridium acetobutylicum ATCC 824
MDKNEILSKLYNVIEDRKNNPIEGSYTNYLFEKGIDKILKKVGEETTEVIIASKDDNKEDLINEICDVIYHTLVLLNYKNIKLEDIEKELQKRNEKILNKKQERRPIENI

SEQ ID NO: 66264 - protein, 662 aa, Clostridium acetobutylicum ATCC 824
MNIDELSINTIRILSAEAIQKANSGHPGTPLGAAPVAYTLWSKYLKHNPSNPKWVNRDRFILSAGHASMLLYSLLHLFGYKISIDDLKNFRQWESITPGHPEYGVTPGVEISTGPLGQGIANGVGMAIAEAHLASKFNKQGFDIVDHYTYVLSGDGCMMEGIASEAASFAGTLGLSKLIVIYDDNDISIEGNTDIAFKENVGERFKAYDWNVINVEDGTDVSSLSKAIEKAKQQNDKPSIIIAKTVIGFGSPNQGTAGVHGSPLGETGVSGLKKNLNWNYEEEFYVPEEVKEHIKKLQKTFEENESNWNELLNKYKEKYPDLFDEFNAWMNGEVKVKLDEIDAFKELEKPMATRDSSGKALNIIANVVPNLIGGSADLAPSNKTYMNDKGDFSSDDRSGSNLHFGVREHAMAAIANGVSAHGGLKIFVSTFFVFSDYMKGAMRMSALMNLPVVYVLTHDSIGVGEDGPTHEPIEQLAALRSIPNLTVLRPCDSKETVEAWKYALEREDGPTALVLTRQKLPLYNETGKGLLKGAYTLKDSKKDVPDMLLMASGSEVELVYEAQEELLNKGIDSRVISVPSFELFDKQDKAYKESVMPSSVRARVAVEAASSFGWHKYTGIDGEIISIDHFGASAPAETLFEVFGFTKENVIKTSEEVLKNNK

SEQ ID NO: 66265 - protein, 283 aa, Clostridium perfringens str. 13
MELWYTEEHTDKVRFSIKVDEQLYSGKSDFQRIDVFKSQEFGTFFTLDGLMMVTEKDEFIYHDMIVHVPMATNPNIKNVLVIGAGDGGTVRELTRYETIEKIDMVEIDKLVVDVCREYLPQTANKLDDPRVSLFFEDGLKFVRSVENKYDLIIVDSTDPFGPGEGLFTREFYGNCFKALKEDGILVNQHESPYYEEYARGMKRAHKRIKECFPVCRVYQAHIPTYPSGHWLFGFASKKYDPLNADIEKWNDLGLKTKYYNTDLHKGCFALPNYVKEMLENVDE

SEQ ID NO: 66266 - protein, 377 aa, Bacillus clausii KSM-K16
MKAVTYQGMNHVEVSTIKAPEIQDPEDVIVRITSTAICGSDLHLYQGNMYTPKGFVIGHEPMGIVEETGPEVTKVKKGDRVVIPFTVACGHCPYCQNHQESQCDRSNPHYDSGGLFGYSEKFGDYPGGQAEYLRVPFGNYTPFRLPDDCELEDEQVLFLSDVLPTAYWSVVHAGVKKGDTVIVLGCGPVGLMTQAFAWQQGAERVIAVDYFDYRLEKARQMNHTETFDFTKDKDTGETLKELTKGGADVVIDCVGMDGKKSPLEMVEQKLKLQGGTLGPIQIATKAVKKCGIVQLTGVYGGNYNLFPLGAFFSRNVTLKMGQAPARAYMETLYEQISKGLINPTSIITHKLALSDAPKGYDLFNNKKDGCIKVVLKP

SEQ ID NO: 66267 - protein, 275 aa, Arabidopsis thaliana
MCIAVFLWQSHPLYPFLLFLNRDEDHNRATEALRWWEDGETVGGRDLVGGGTWLGCTRHGRLAFLTNFKEASSFPAAKSRGDLPLRYLQSEKSPAEFAEEIQDEISLYNGFNLVVAHVLSKSMIYITNRPPHGDKLVTQVSPGIHVLSNANLDSPWPKCLRLREGFQQLLAENGSGEFPVKTMVEEVMTNTVKDEETELPHVFTPETEYHLSSIFVDMQRPTGRYGTRSISAIIVKSHGDGGGDGEICFYERHLEEGDSWKEHTQQFVIIQNQSI

SEQ ID NO: 66268 - protein, 198 aa, Triticum aestivum
MASHDDDTMPEETQGYKFSQPKQSLAEYQQMDAGDESLQRYKESLGLGGGTDISDPNDPRVCIILSLTMDSPGRPPVTIDLSTPGSETTLKDKPFNIKEGAKFTMSAKFKVQHEILSGLHYVQVVKRKGIRVSKDSEMIGSYAPSTDKQPTYIKKFQEEEAPSGMLARGHYNAISSFVDDDKKKHLEFEWSFDIAKDW

SEQ ID NO: 66269 - protein, 221 aa, Yersinia rohdei
MTSHSTDKRKKITRIGIGGPVGSGKTAIIEVITPILIKRGIKPLIITNDIVTTEDAKQVKRTLKGILDEEKILGVETGACPHTAVREDPSMNIAAVEEMEERFPESDLIMIESGGDNLTLTFSPALADFYIYVIDVAEGEKIPRKNGPGLVQADILVINKIDLAPYVGASLAVMESDTKVVRGERPYILTNCKTGQGIEELVDMIMRDFLFTHVQTQGEHA

SEQ ID NO: 66270 - protein, 443 aa, Arabidopsis thaliana
MDRISSLPDEILEHILSFLSTKEAALTSSLSTRWKNVFVFVPSLHLDYARQHENPREFIDFVDFVNTLFNRKGNSPIKKLALKIHLKDNQSLQNQTHVQSWIHRVLSRGGVTDLDLFITFKGKFQLVPLLIFKSNTLVKLRLGRGFTIKLCHENVYLPMLKTLCLDTVDFDGDHNVFETLLPRCPLLEELVLEDQRWKQWCGSVSSPSLKRLRIRFFHIPIISLDVPGLVYLELSCIFGSKYANVNLDSLVEARLNHWVEEQELRKLRDGSSHLVPADMMDLITGIRKVKVLHLTSDALELFYFSGQELPMFDNLVYLSIASDKKQGWQILPLLIKNSPNLETLVFKGLEHYTTKQCGDACVCSGILGKSSSCLSSSRVKVLEIWSYQGTSKELKQMGHFLMKLQFLELVKIRAVSNLQVPIDIQYLLKLPRASSNCKIQAIF

SEQ ID NO: 66271 - protein, 467 aa, Zea mays
MAFSARRSLATSLSHHFSGRLYPSISHLVPSHHEHSDPAPSPSPVPQPRPQSSQQSAPPFPSALPRPSRSRALAPFPLPFALHLAAHRYSSAPAPDSEVLADSAAAAPVSELLSDGVASAAASVSTPPLPYPGEVAAAAAESFPPVAALQHLLDAVQSFTGLNWWATIALTTLMIRLATVPLLINQMKSMMKLNEMRPEIEAINEEMRNSTDPRSMEVGKQKLGELFLRHGVTPLTPLKGLFIQGPIFMSFFFAISNMVEKVPSMKGGGVYWFTDLTTPDNLLILPVLTSLTFLATVELNMQDGMEGNHMLKPMKKFSRFFGVLFVPFTIGFPKAIFFYWVTSNFFSLVYGAVLRNPAVRLFLNLPRLESQPTTAEVQPLNLSGGPEPSPGVDSPITDKETEQSSSVLSPGVDSPIADKECEQSSPAVSPEVNSPMVDKESEQSSSVLCDRIRDLEIRAKATGESRE

SEQ ID NO: 66272 - protein, 885 aa, Medicago truncatula
MPTWWGKSSSKETKKKAGKESIIDTLHRKFKFPSEGKRSTISGGSRRRSNDTISEKGDRSPSESRSPSPSKVARCQSFAERPHAQPLPLPDLHPSSLGRVDSEISISAKSRLEKPSKPSLFLPLPKPSCIRCGPTPADLDGDMVNASVFSDCSADSDEPADSRNRSPLATDSETGTRTAAGSPSSLVLKDQSSAVSQPNLREVKKTANILSNHTPSTSPKRKPLRHHVPNLQVPPHGVFYSGPDSSLSSPSRSPLRAFGTDQVLNSAFWAGKPYPEINFVGSGHCSSPGSGHNSGHNSMGGDMSGPLFWQPSRGSPEYSPIPSPRMTSPGPSSRIQSGAVTPIHPRAGGTPTESQTGRADDGKQQSHRLPLPPLTVTNTSPFSHSNSAATSPSMPRSPARADSPMSSGSRWKKGKLLGRGTFGHVYIGFNSQSGEMCAMKEVTLFSDDAKSLESAKQLMQVDDKLYIYLEYVSGGSIHKLLQEYGQFGELAIRSYTQQILSGLAYLHAKNTLHRDIKGANILVDPNGRVKVADFGMAKHITGQYCPLSFKGSPYWMAPEVLLFLFWVIKNSKECSLGVDIWSLGCTVLEMATTKPPWSQYEGVAAMFKIGNSKELPTIPDHLSNEGKDFVRKCLQRNPRDRPSASELLDHPFVKGAAPLERPIMVPEASDPITGITHGTKALGIGQGRNLSALDSDKLLVHSSRVLKNNPHESEIHIQRNISCPVSPIGSPLLRSRSPQQRSGRLSPSPISSPRTASGASTPLTGGSGAIPFSNHLKQSVYFQECLGSMPKSPNGVYINGSSHHDSNIDIFQRMQAGSHIKSELVSSDNDALGKQFVRSPHAEPYDFQSVLADRVGRQLLGDHVKINPSFDPSPSSSMLNRTNGL

SEQ ID NO: 66273 - protein, 299 aa, Oryza sativa (indica cultivar-group)
MARKFRREIERERRTLAAAWEESRARVSRSRVVEGCSRVSLKKKKKKSFYAFAIDGAWAVLGLMCSSYGPRYTGLRIPHCHGPFAVRMAHLSLGGGDVNGPSQKGKHVFSKAEFHVLILGVHKAGKTTLLEKVKSIYLKEEGLPHDRIVPTVGLNIGRIEDANVKLVFWDLGGQPGLRTIWEKYYEEAHAVIYVIDSAAASSFEDAKSALEKVLHHEDLQGAPLLIFANKQELPAAVTEEELARHLHLKELDERPYMFQAGSAYDGTGIKAGIDWLVEEMERSKRTEVLMARTETAEKI

SEQ ID NO: 66274 - protein, 343 aa, Bradyrhizobium japonicum USDA 110
MRAVVIHAPKDLRIDSYPDPAPGPGEVRVKIANGGICGSDLHYYHHGGFGVVRIQQPMALGHEIAGVVAAVGDGVTSVKPGTRVAVNPSKPCGKCLHCQEGMRNQCLDMRFLGSAMRFPHVQGGFREFLTIDATQAVPIADELSLAEAAVAEPLAVCLHAGKQAGPLLGKRVLITGCGPIGALMILVSRFGGASEIVVTDVADAPLAVARKLGATHAINVATHATALDPWRAGKGVFDTLFEASGNQAALRTALDVLRPGATLVQLGLGGEMTLPINSIVAKELQLRGTFRFDPEFELAVRLMGEGLIDVKPLITATMPFENAVAAFELASDRSQSMKVQLSF

SEQ ID NO: 66275 - protein, 139 aa, Glycine max
WKYRVVGSVAALLLLLAIVVPFTQTQTQSARDKAAMAEDAGPLVGGISDSPMGQENDLDVIALARFAVSEHNNKANALLEFENVVKVKKQTVAGTMHYITIRVTEGGAKKLYEAKVWEKPWENFKKLEEFKLVEDVPSA

SEQ ID NO: 66276 - protein, 356 aa, Oryza sativa (indica cultivar-group)
MGVLCFGASNILLCAEDSSSVLGLGGFGGGGGEVAAELGCGGGGGFDFFGFGGGAVFPIDSDEFVALLVEKEMDHQPQRGYLEKLELGGLECSWRKDAIDWICKVHSYYNFGPLSLYLAVNYLDRFLSSFNLPHDESWMQQLLSVSCLSLATKMEETVVPLPMDLQVFDAEYVFEARHIKRMELIVMKTLKWRLQAVTPFSFIGYFLDKFNEGKPPSYTLASWCSDLTVGTLKDSRFLSFRPSEIAAAVVLAVLAENQFLVFNSALGGSEIPVNKEMVMRCYELMVEKALVKKIRNSNASSSVPHSPITVLDAACFSFRSDDTTLGSSQSNSNNKDYNSQDSAPASKRRRLNTTPI

SEQ ID NO: 66277 - protein, 461 aa, Borrelia hermsii DAH
MEYSIMKKLFNFLKPAPHIKRVHKELEESLYKKYRFQIFMSIFIGYAGFYLTRKIFAFAMPALEKDGFSKGQLGTILSGVSIAYGFSKFIMGNVSDRSNPRYFLALGLFLTAIITIIFGLFPWKSIESTIIAAILMFILMFVNGWVQGMGWPACGRTMVHWWSRKERGLTVATWNLSHNIGGGAAGIISSWALFYFKEWQAILYVPTGLVIGIAIFVLLALRDTPQSVGLPPIEEYKNDYPDNYTEKAEEELNTKDIFVKYVLNNNLLWYIAIANAFIYFVRYGVLDWAPSYLLQVKHFSIKNSGWAYSLYEFSAIPGTIACGWISDKIFKGRRSETGIIFITATLIAIIIYWQLPENNPTLTTVILAIIGFLIYGPVMLIGLHALDLAPKKAAGTAAGFTGLFGYIGGSVTASAITGIVLQHFNWDVYFYLLITACIFAIIFMSLTLKKEKKINDTNKLQ

SEQ ID NO: 66278 - protein, 555 aa, Thermoanaerobacter tengcongensis MB4
MKSDIEIAQEAKMLHIRDVAAKLGIEEDYLEYYGKYKAKISPALWDKIKDRKDGKLILVTAITPTPAGEGKTTTTVGLGQALAKLGKKAMIALREPSLGPSFGIKGGAAGGGYSQVVPMEDINLHFTGDIHAITAAHNLLAAMIDNHIHHGNELNIDIRTITWKRAMDMNDRALREIIVGLGGKANGYPRQDGFIITVASEIMAILCLSHDLMDLKRRLGDIIVAYDKDGSPVTARDLKADGAMAVLLKDAIKPNLVQTIENVPAFVHGGPFANIAHGCNSLIATKYGLKLADYLVTEAGFGADLGAEKFFDVKARFGGLTPNAAVVVATVRALKMHGGVKKEDLQKEDVEAVRRGIENLEKQVENVRKFGVPVVVALNKFVFDTEREIEEVRKACDRIGVDMAVAEVWEKGGEGGIELAEKVIKAADTPSNFRFLYDVNLPIKDKLHIIATEIYGADGVEYTASALKDIANIEKLGLDKMPIVVAKTQYSLSDDPKLLGRPRGFKITVRELRISRGAGFIVALTGDIMTMPGLPKHPAAENIDIDENGRIKGLF

SEQ ID NO: 66279 - protein, 310 aa, Aspergillus oryzae
MASFFLNITCPNRACLAAGNSAQLLGKHVIAGVSPRTVFTPGRRPQSTQSSLVTKSSWTHPVYTTSQLHSIQTAHRNAKDWSDRMALGTVRFLRWGMDLVTGYHHSHPRDAHSPRFRMTEEKWITRFIFLESVAGVPGMVAAMLRHLKSLRRMRRDYGWIETLLEEAYNERMHLLTFLKLSQPGPAMYFMVLAAQCVFFTGFSLAYLISPRICHRFVGYLEEEAVITYTKAIQELDKGNLPLWSNMEAPAMAIKYWQMPEGQRSIRSLLLCVRADEANHRDVNHTLGNLNQDSDPNPFSAKFRNALKEAS

SEQ ID NO: 66280 - protein, 318 aa, Prunus persica
METFPVVDLSQITGEKREAAMEKMNDACENWGFFELVNHGISHELMDTVEKLTKEHYKKCMEQRFKEMVASKGLEAVQSEIHDLDWESTFFLRHLPVSNISQIPDLDEDYRKVMKEFAVELEKLAEQLLDLLCENLGLEKGYLKKAFYGSKGPNFGTKVSNYPPCPKPDLIKGLRAHTDAGGIILLFQDDKVSGLQLLKDGQWIDVPPMHHSIVINLGDQLEVITNGKYKSVMHRVIAQPDGTRMSIASFYNPGDDAFICPAPALLEKETENISAYPKFVFDDYMKLYSGLKFHAKEPRFEAMKAMESTVNLDPVATV

SEQ ID NO: 66281 - protein, 342 aa, Synechococcus elongatus PCC 6301
MVQERTLPSFQASQAQVSREEGLRIYEDMVLGRTFEDKCAEMYYRGKMFGFVHLYNGQEAVASGIIKAMRSDDYVCSTYRDHVHALSAGVPARQVMAELFGKETGCSRGRGGSMHLFSAEHNLLGGFAFVAEGIPVATGAAFTTAYRRNALGDTSADQVTACFFGDGAANNGQFFECLNMATLWKLPILFVVENNKWAIGMSHERATSDPEIYKKGPAFGMPGVEVDGMDVLAVRAVAQEAIARARAGEGPTLIEALTYRFRGHSLADPDELRSKEEKEFWLARDPIKRFAAHLTEFNLATHEELKAIDKKIEALVAEAVEFAISSPEPKPEELTRYIWAED

SEQ ID NO: 66282 - protein, 357 aa, Prochlorococcus marinus subsp. pastoris str. CCMP1986
MKRYKVVLLSGDGIGPEISEISITILKKLSKKYGFNLDIKEEYFGGIAYEKHNDPAPKETLDQCKASDAVLLACVGDVKYDTLPRELRPESGLLKLREALNLFANIRPVKIRKSLLDSSSFKKEVIENVDLIVVRELIGGIYFGQPRGEITQTKIKKAFNTMVYDSNEIERITEVAIKIANQRSKKICSVDKSNVLEVSQLWRDTVSLVASKENDLALSNMYVDNAAMQLVKDPGQFDVILTSNLFGDILSDLAAMITGSIGMLPSASLSNSGPGVFEPVHGSAPDIAGKNIANPIAMALSTSMMLKIGLNEIEAADDIEIAIDNVLSKGYRTSDLDNGNCQVLSCSEIGEKIIQEI

SEQ ID NO: 66283 - protein, 463 aa, Pseudomonas putida KT2440
MQTHKNNLSHGLKSRHVTMLSIAGVIGAGLFVGSGRAIAEAGPATILAYILAGGLVVLVMRMLAEMAVASPDTGSFSTYADLAIGKWAGYTIGWLYWWFWVLIIPIEANIAATIINSWVPQLEIWVLSLVITLLLTATNLFSVKNYGEFEFWLALVKVVAIVSFIALGVCAIFGLLPGAGVSGVSRLWDTGGFMPNGFGAVLSAMLITMFSFLGAEVVTIAAAESDEAGKHISKATNSVIWRITLFYILSIFIVIALVPWTDPRLATEGSYVTVLDTLGVPNAKAIIDFVVLTSVTSCLNSSLYTASRMVYSLSRRGDAPACAQITSRSGTPVVAVLLSTGAAFLAVIANYLVPAKVFGFLMASSGAIALLVYLVIAISQLRLRQRLTAQGKTLGYRMWLFPWLTWGVILFISGVLVLMLFRPDHRLEVVSTMVLAVLVVCSGVLVTRRRARGGAVAGVGQGA

SEQ ID NO: 66284 - protein, 430 aa, Oryza sativa (indica cultivar-group)
MEQTNAAASSAKPIRCRAAVSRAAGQPLEMEEVEVAPPRAHEVRIKIICTSLCHTDITFWRMEGLHPSIFGHEAVGHTKVKMLIISRVLYPFHNKKSNQKSSKLTGGRIPFSPSVVESVGEHVREVAVGDTVVPVFTAQCSECPDCLSDRSNICSKLPDVHGFMPRDGTTRFSSASTGEPIRHFLSVSSFVQYTVVDVSHVVKLDANFPPAMACLLSCGISTGVGAAWKVAAVEPGSSVAVFGLGAVGLAVAQGARMRGATRIIGVDLNPDKFDVGKRLGITDFINPNDTGGKTVSEVIKEMTGGGGADYCFECIGSASVMAEAFQSSRMGWGKTILLGVIGSMAPIGIPPQDLLPGRSVIGSLFGGIKPKNDIPMLAQKYLDKELELEEFITHEMGFEEINRAFELLTQGKSIRCIIWMDGAKVIDNGE

SEQ ID NO: 66285 - protein, 371 aa, Methylovorus sp. SS1
MAKKDYYEVLGVNRDASDEEIKKSYRKLAMKYHPDRNPDNPKAEESFKEAKEAYEVLSDEQKRAAYDQYGHAGVDPSAGPGPRQGFGNFADAFGDIFGDIFGGGGGNRRSNVYRGADLRYNMEISLEDAARRTETKIRIPVMSECETCHGSGARPGTQPVTCTTCGGHGQVRMQQGFFSVQQTCPKCHGSGKMVKEPCPSCQGAGRVKKHKTLSVKIPAGVDEGDRIRLSGEGERVNGGPPRDLYVVVHLKQHDIFQRDGGNLHCEMPISFTTAALGGEIEIPTLDGHAKMKIPPETQTGATFRLRGKGIKPLRTNDPGDLMCHVVVETPIKLTERQKELLREMEEINLQDSDKHSPRAKGWMDKVKDFFQ

SEQ ID NO: 66286 - protein, 146 aa, Cryptococcus neoformans var. neoformans B-3501A
MSFTALHRLSTLSTHIIRAPISTRYFATTQTAKIGSSISTPNMTADVKSLVDKAIADNKVVVFSKTYCPYCKRAKSYLAEDTKDIEILELDEREDGAAIQAYLKELNGQGTVPHVYINKEFIGGSSDLLKLSHEQVKQKISAAASA

SEQ ID NO: 66287 - protein, 206 aa, Glycine max
GFGMVFKGTLSDGTVVGVKRILESDFQGDAEFCNEVEIISNLKHRNLVPLRGCCVAEENENYDERGSQRYLVYDYMPNGNLEDHLFLSTDSQKAKGSLTWPQRKSIILDVAKGLAYLHYGVKPAIFHRDIKATNILLDADMRARVADFGLAKQSREGQSHLTTRVAGTHGYLAPEYALYGQLTEKSDVYSFGVVALEIMCGRKALD

SEQ ID NO: 66288 - protein, 350 aa, Thermoanaerobacter tengcongensis MB4
MSIMDGLMTAVVKQYHKEGADIVKKEIPKIGPDEVLIKVKATSICGTDVHIYVWNEWAKSRIKPPKTMGHEFVGEVVEIGENVTSVKVGDLVSAETHIVCGKCRACRTGNAHICENTLILGVDTDGAFAEYIKVPESNVWINDKNIPLEILSIQEPLGNAVHTVFSGDVVGKSVAVIGCGPIGMMAIPLLKRTGAAAIFAIEPADYRRELAHKLGATRVINPLREDVVSIIKSETEGYGADVVLDFSGNPTAIRQGLEYIAKGGRMSILGLPDNEVPIDITNNVVFKGITIQGITGRRMYDTWYTVKGLLKSGLAEDLKPIITHTFPLTEYQKGMELMIKGQCGKVVLYP

SEQ ID NO: 66289 - protein, 559 aa, Bacillus licheniformis ATCC 14580
MKSHLSDIEIAQRTELKPITEIARKLNINDEEIECFGCTKAKISLKIFERLKEKPDGQVILVTSINPTPAGEGKSTVTVGLSQALWQIGKKSIVAMREPSLGPTMGLKGGAAGGGYSQVLPMEDINLHFTGDMHAITAANNALAAFIDNHIHQGNELNIDIRKIVWKRALDLNDRALRETVVGLGGKANGFPREDGFDITVASEIMAVLCLARDLADLKKRLASMIVAYTVDGQPVTAGMLGVQGALALLLKDAIKPNLVQTVEGTPALVHGGPFANIAHGANSLIATKTAAKLADYVVTEAGFGADLGAEKFMHIKTRAGGFTPGAVVIVATVRALKMHGGTPLADLKQKDLEALKRGIANLAKHIETIDAFGLPYVVAVNRFVQDTEDELEAVLGWCRDNGHPAALCNVWEEGGKGGTDLAREVIHVMEQKDNRFSYLYELTDSIEDKLAKISRTVYGAEGVEFTEKAKKQLLELKKNGLDGLPVCVAKTQYSLSDDPGKIGRPQDFSITVRELKPSRGAGFIVALTGSILTMPGLPKHPAALKMDVDESGRAKGLF

SEQ ID NO: 66290 - protein, 169 aa, marine gamma proteobacterium HTCC2207
LQPLLVVVMGVSGTGKSTLANEIAQRSGLTYVDADSFHSAEAIAQMSQGIPLTDTQRAPWIERIYNHLCEYESASKGCILAYSGLKQQHRNLIFSAYKNSAGVLLQADPDLITERLANRRDHFMPAQLLSSQLAEMEPFDNKTPLLRLNTADSVEQLLVQFSDFVDLLN

SEQ ID NO: 66291 - protein, 334 aa, Clostridium acetobutylicum ATCC 824
MKKNHTITLIPGDGIGPEVTGAAKKVIEAAGVSITWDIVEAGAKVMDEYGTPLPEYVLESIKKNKIALKGPITTPVGSGFRSVNVALRQTFNLYANVRPIKTYEGIPTRYKDVDLIIVRENTEDLYAGIEHKIGDYAAESIKIITREASERIADFAFDMAVKQNRKKVTAVHKANIMKFSDGLFLDCARKVAEGYKEKEFEDMIVDAMSMKLVQNPEKYDVLVMPNLYGDILSDMAAGLVGGLGVAPGANIGKEISIFESIHGSAPDIAGKNIANPTAAILSGVMMLRYIGELEAADKIDNAIKVVLKEGTKVTSDLGGNATTDEFANEVIKNI

SEQ ID NO: 66292 - protein, 119 aa, Triticum aestivum
MSAMETDAPDAPPPAPAADAGAGSSSRKPGKRFEIKKWNAVALWAWDIVVDNCAICRNHIMDLCIECQANQASATSEECTVAWGVCNHAFHFHCISRWLKTRQVCPLDNSEWEFQKYGH

SEQ ID NO: 66293 - protein, 297 aa, Aggregatibacter actinomycetemcomitans
NRDHYRIFNDDMQGTGAIVMAAVFSGLKVTKQNFAEQRLVVYGAGTAGTGMADQISAAMQRDGLSREEAKKRVWLIDINGLVTDDMPNLPDYQQEYARPAAEAAAWAKTDGKIGLLEVVKQVKPTILIGTSTDHGAFTEDVVKALCAGVERPILLPLSNPTERIEVMPTDAVQWSDGKALISVGIPVPPVPYKGVNYQIGQANNAMLYPGLGLGVIVSGAKQVTDGMLLAAAEAVASQVNPQDEGASLLPPVDNLRASSATVAVAVAKQAVKDGVAANTSDNWVQAVQDAMWQPEYR

SEQ ID NO: 66294 - protein, 193 aa, Zea mays
  misc_feature (49)..(49): Xaa can be any naturally occurring amino acid
ARAGVLFMSSWPLFSNSTEARYFAAVVPFLNSMRLLIYGLRLYTDEALXELLRGPLYYVLVLLFSVLVFWRESPIGIVSLSMMSGGDGFADIVGRRYGSAKLPFNRKKSWAGSISMFISGFLLSAMMMLYFSSLGYIDVIWEEALGKLALVALAATVVECVPVTEVVDDNISVPLATMLVAFLLFSSNRPIVN

SEQ ID NO: 66295 - protein, 548 aa, Leifsonia xyli subsp. xyli str. CTCB07
MLRMSEPLPEPADAPSARTPGEEKARVADAVAAVAADLRARAGTVTGAAADVLEAQSMMAEDSTLADDVSSRIDSGKTAERAVFEGFAVFRDMLIGLGGYMGERATDLDDVSQRVIAALEGRAAPGVPESDEPYVLVAHDLAPADTALLDLDKVLGLVTREGGPTSHTAILAREKAIVAIVGVASADTLTDGTEVIVDARAGIVTASPDTAQSAEAQRRIDERAAALSGGLGPGALADGTSVPLLANLGSAEGAGKALAAGAEGVGLFRTEFLFLDQRLAPTVEQQREQYAAVLRAFPGQKVVVRVLDAGADKPLEFLNDAHEDNPALGLRGLRALRSNEDILREQLTALAEADAQTGADLWVMAPMVSTVEETRYFVELASEFGLKTAGVMVEVPSAALLAGRVLQKAAFVSIGTNDLTQYTLAADRLLGSVASFQDPWHPAVLRLIGETGKAGAATGKPVGICGEAAADPLLAVVLVGLGATTLSMSTTAIADVRLSLKRYTLEQARGLAEIALAADGAAEAREAVRLAATASTSPAHPDRNEAPE

SEQ ID NO: 66296 - protein, 260 aa, Bacillus cereus G9241
MLKSYRAVLVSLSLLLVFVLSGCSNAAPIDAHSTGIWDHYFVYPISFMIQFVAHHIPGASFGIAIIIMTLVIRSAMIPLAVSQYRSQAKMKKMQPELQKLKKKYGDVSKDLEKQKQYQKEMSELMKSGGWNPLAGCWPLLIQMPIFSALYYAISRTEEIRTSSFLWVNLGHADPYHILPIIAALTTFIQMKVFQSNITPGEQVQMLKMQQIMMPAMILFMGFAAPSGLVLYWITGNLFTMTQTIVLRKIMEREELQLQKA

SEQ ID NO: 66297 - protein, 181 aa, Arabidopsis thaliana
MASSMFSSTAVVTSPAQATMVAPFTGLKSSASFPVTRKANNDITSITSNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTEA

SEQ ID NO: 66298 - protein, 357 aa, Oryza sativa (indica cultivar-group)
MESTLITITRSPILPCPFSRRPASPARCFAGVRRSRRAAASASFFSPAGGRGGGDAGAGSSLSSAAAAAALGEAAAAGGGGSDSEAILLSVQGMMCDGCAASVKRILESQPEVTSATVDFKEAKAVVLTTAEVKAAEDWQKQCGEKLANHLGTCGFESCLQGTTADDLSPLFEKYGEVVDIYIPRDRRTGDSRGFAFVRYKYEDEAQKAVDRLDGRVVDGREIMVQFAKYGPNAERIHKGKIMETVPRSRGRSRSRSPRRGYRDDYRERDYRKWSRSRDRYGRDRYRERDYRRRSRSRSYTPDDYRRRGRDSVSPARRSLSRSYSPDDYRKRGKHRMNGVELLMSRGCSVPDDGRLR

SEQ ID NO: 66299 - protein, 425 aa, Thermoanaerobacter tengcongensis MB4
MPNKVYEIEETPPIKQMVPLSLQHVFAMFGATILVPLLTGLDPSVTLFTSGLGTLIFHLMTKGKVPAYLGSSFAFIAPIIAATKQFGLKGAFFGMFAAGLVYVVVFIIISLTGIDWLEKLLPPVVVGPVVMIIGLSLAPVAIAQAQKDLATALFTAALIIIFSMFGKGFIKVIPILLGTIGGYIFAITRGLVDFGPVAKASWIAIPKFSFLTGHTPEVAWGAVALVAPLALVAIIEDLGHVLVIGNIVERDLIKNPGFHRVMLGNGLATSIAALFGGPPSTTYGENIGVLAITRVYSSKVIQGAAIIAILLSFIQKIGALIEVIPQAVMGGVTIILFGMIAAAGMRTLVENKVDFSDSRNLIIASVILTLGVGGIKIPLGNFVFEGIGPATLAGILLNLVLPKINLGEEKMTEKVKSSKEAVQKA

SEQ ID NO: 66300 - protein, 387 aa, Candidatus Pelagibacter ubique HTCC1002
MKLAKNLQRLGTESAFSVLAEAKKLEAQGKPMIHLGLGQPDFKTPQHVVDAAKKALDEGHHGYVLSNGILECRQAVTRKIKKLYNKDIDPERVLIMPGGKPTMYYAIQCFGEPGAEIIHPTPAFPIYESMINYTGSTPVPYDLTEDKDLKFDPEKILSLITDKTRLLILINPNNPTGSFVEKSAIDVLAEGLKKHPHVAILSDEIYSRQIYDGKEMPTFFNYPDLQDRLIVLDGWSKAYAMTGWRMGWSVWPEELIPHVNKLIINSVSCVNAPSQFAGIAALDGPDDAIHEMMVKFDQRRKLIHEGLNSLPGVECSLPGGAFYAFPKVIGTGMNGSEFAKKCMHEAGVAIVPGTAFGKTCQDYVRFSFAASQDNISNALENIKKMLG

SEQ ID NO: 66301 - protein, 366 aa, Oryza sativa (indica cultivar-group)
MTNHAGFAADDAVTASVPVQAAQGGRHFPPFLAPSSRLTDCKKAAAHVDLAGAGGVATVPGSWPRHAKPVSGAELDDWMEKHPSALAWFESVAAAAKGKEIVVFLDYDGTLSPIVADPDRAFMSDEMREAVRGVAKHFPTAIVSGRCIDKVFDFVKLEELYYAGSHGMDIRGPTAAASEYNHNMKAKQGDAVTFQPAADFLPVIEEVYHVLKERMASIRGSLVENNKFCLSVHYRCVDEAEWGVLDGKVRAVIEGYPDLRLSKGRKVLEIRPVIDWDKGSALQFLLKSLGYEGRNNVFPIYIGDDRTDEDAFKVLRNMGQGIGILVTKVPKETAASYTLREPSEVKEFLRKLVKIKINGDKGLIGK

SEQ ID NO: 66302 - protein, 197 aa, Oryza sativa (indica cultivar-group)
MAAGKGKGKEGECDMAAAAAEAEKKGEGSTVSRGAAGERVVEDSGGGRRTIHLKSKDGKQHDVTEASARLSKTIAGMILAGGGADQCIPTPDIDHDTLRVVMQYCDKHAADDADEEDLKEWDEDFVDELDQDALFDVIAAANYLDIDGLLDLTCKRVADTIKGKTPEEIRKEFNIVNDLSKEEEEEIRRENPWAFEQ

SEQ ID NO: 66303 - protein, 663 aa, Oryza sativa (indica cultivar-group)
MAAGNGGEAAVVGEGEGATASEVVEKMVSQAVVEKALWEAFEKVVSEAVEKKSEGAMASEVVETMVSQAVVEKALWEAFEKVVSEAVEKKGGGAVVSEGAVEKVESEVVEETVLDSAEKASASAGEEEEESSDGEPVEVTEASARISKVIGDKIDAGRGGEAIPLPHVDNKTLKKVIEYCDEHANENSDTDEQKEELKNWDKAFIDELDEDDGSFLFLVLLASSYLKIDGLLDLTYQRVADNSKAKTTEEIRKAFSTIEIELSDKEEEEQQQEEEIRPENHLKNFISEMYGLTDLVDEEEDGRGDDDRDAPADRDDRARGRRRGRRGHNNDHPRANQNWRCRDRDDDDWDERGRDFGRGRGEQRAIDQDYRRERTRSPRQRDRGGHSRHGGRRHHAGATDVDNVTDPVYPEPHLAEISLPSRQQELHTEVCKFRLLHALHTSPFRTQEIPASPPTSTGDQLLCLALVADKAMAAPPPTAMEDLAIRSSTGTEAWFSGTAWKPVPVARVFGRIREALPATPAVETPTTYQQIEEALMRLELAAAAARTPGDDTLLPQPMSPAPLAASPPRRLEDLASDAGADKILPAPLPRGAASPRDDPDASHPAPVGAGAGLAAGTRILAMRHRRTVHLASVGYHCVAAALDASISAVGRPHKEGEAPAEAA

SEQ ID NO: 66304 - protein, 465 aa, Roseovarius nubinhibens ISM
MTQDKAQGGQNMSVNPNSIEARDVAYHMHSYTNARAHQENGPVVIDRGEGAYVFDSTGKKYFEAMSGLWSAGLGFGEERLVKAASNQMAKLPYYHNFNSKSHGPAIDLAEKLISIAPVPMSKVFYTNSGSEANDTVMKLIWYRSNAMGTPEKKKIISRQRGYHGVTIASASLTGLPNNHRSFDLPIANVLHTGSPHHYRDAQDGETEEAFASRRAEELEQMILAEGPETIAAFIGEPVMGAGGVIVPPATYWEKIQAVLRKYDILLIADEVICGFGRTGQMFGSQTFGIEPDILVMSKQITSTYFPLSAFMMNERVFEPIADETNKIGVLGHGFTGGGHPVGAAIALETLAIIEERDLVARAQEMGAHMQSRLRGLSDHPLVGEVRGVGMIAAVELVLDKAAKTGGETPGALGVQANRRLEAKGVISRNMMDAMAFCPPLISAQADLDFMVDALAETLDEMQAAM

SEQ ID NO: 66305 - protein, 483 aa, Burkholderia xenovorans LB400
MNAVLRDHPAFRAEALRLKGERVTRPRTLDVFDPYTGTRVGTVPLASVDDVRAAFEYAAAYQAQLTRYERSQILERAASIMRERTEEASDLISLESGLSKQDSRYEIGRVADVLKFASIEALRDDGQSFSCDLTPHGKKRRVFSQREPLAGVIVAITPFNHPMNQVAHKIAPAIATNNRVLLKPSEKVPLSALYLADVLYEAGLPAPMLQVLTGDPREIADELITHPLAELVTFTGGVAIGKYIAARAAYRRVVLELGGNDPLIVLDDADLERAATLAVQGSYKNSGQRCTAVKRMLVQKSVAADFTDLVVEKTRAWTFGDPFDASSQMGTVIDVAAAQLFEARVNEAVASGARLLTGNQRNGALYAPTVLDGVDPSMTLVREETFGPVSPIITFDTLDDAIRISNGTAFGLSSGVCTNRQDAITRFINELRVGTVNVWEVPGYRIELTPFGGIKDSGLGYKEGVQEAMKSFTNLKTFSLPWE

SEQ ID NO: 66306 - protein, 259 aa, Rhizobium leguminosarum bv. viciae 3841
MQSLENAVQDDDATQEMLSLVLEEPDHWAMFLDIDGTLLNLAPTPDAIEVPEALPGQLHRLSNKLGGALALVTGRSLAYADELFKPFAFPTAGLHGAEIRNAAGMQTIEATPEFQALKHALTAEAEHYPGVLIEDKGAAVAAHYRLAPEYEKVLEERMHHYAEVAGSNWALQLGKMVFELRPARSSKGDALERFFQSDPFKNRSPITIGDDLTDESMFAIANARGGLSVRVGAIGAPSCATSRLSSSALVRNVIAALAA

SEQ ID NO: 66307 - protein, 715 aa, Salmonella typhimurium LT2
  misc_feature (140)..(140): Xaa can be any naturally occurring amino acid
MKKVVTVCPYCASGCKINLVVDNGKIVRAEAAQGKTNQGTLCLKGYYGWDFINDTQILTPRLKTPMIRRQRGGKLESVSWDEALNYVAERLSAIKAKYGPDAIQTTGSSRGTGNETNYVMQKFARAVIGTNNVDCCARVXHGPSVAGLHQSVGNGAMSNAINEIDNTDLVFVFGYNPADSHPIVANHVINAKRNGAKIIVCDPRKIETARIADMHIALKNGSNIALLNAMGHVIIEENLYDKAFVASRTEGFEEYSKIVESYTPESVEEITGVSAQEIRQAARMYASAKSAAILWGMGVTQFYQGVETVRSLTSLAMLTGNLGKPSAGVNPVRGQNNVQGACDMGALPDTYPGYQYVKFPENREKFAKAWGVESLPAHTGYRISELPHRAAHGEVRAAYIMGEDPLQTDAELSAVRKAFEDLELVIVQDIFMTKTASAADVILPSTSWGEHEGVFSAADRGFQRFFKAVEPKWDLKTDWQIISEIATRMGYPMHYNNTQEIWDELRHLCPDFYGATYEKMGELGYIQWPCRDTSDADQGTSYLFKEKFDTPNGLAQFFTCDWVAPIDKLTEEYPMVLSTVREVGHYSCRSMTGNCAALAALADEPGYAQINTADAARLGIEDEALVWVHSRKGKIITRAQVSDRPNKGAIYMTYQWWIGACNELVTENLSPITKTPEYKYCAVRVEPIADQRAAEQYVIDEYNKLKTRLRESAMG

SEQ ID NO: 66308 - protein, 386 aa, Aspergillus oryzae
MTFPPAPAANIGPYPIRAYTGWMETNDSCGIDWTKLGLAVTDLVNGHVESTYSVTTGEWTSPKFVEDPYLRIHGLAPALNYGQQVYEGLKAYRSATDQILLFRPRFHAARMQHSAEVVSIPAVPTDHFLECVNLAVARNAEWVPPHASGAALYVRPVLLGSAAHFALTPPAEFTFCVYVQPFSTYHGIAPLPAVVLEDFDRAAPRGTGHAKIGGNYAPVMKWSEKAKKEGFPMTLHLDSATHSEIDEFSTSGFLGAKMDGDKPVLVVPKSDNIIGSVTSDSCMQIARSLGWTVEHRSVKYEELATFKEVMAVGTAAALVPIRSITRKSRDDHFVYTEEKSAGPVCQQLYAALTKIQRGEAEDQFGWREEVKGTSDVGSSGSFCIIM

SEQ ID NO: 66309 - protein, 138 aa, Cucurbita moschata
MGMGMLEVHLISGKGLQAHDPLNKPIDPYAEINYKGQERMSKVAKNAGPDPLWDEKFKFLAEYPGSGGDFHIFFKVMDHDAIDDDDLIGEVKIDIKDLLAEGVRKGWSKIPPRMYQVLLLNLYFKGEIEVGVSFQRQG

SEQ ID NO: 66310 - protein, 138 aa, Cucurbita moschata
MAMGMLEVHLISGKGLRAHDPLNKPIDPYVEINYKGQERMSKVAKNAGPDPVWNEKFKFLAEYPGSGGDFLILFKVMDHDVIDGDDYIGDVSIDVKDLLVEGVRKGWSELPPRMYQVIAHKLYFKGEIEVGVSFKRQG

SEQ ID NO: 66311 - protein, 150 aa, Cucurbita maxima
MGMGMMEVHLISGKGLQAHDPLNKPIDPYAEINFKGQERMSKVAKNAGPNPLWDEKFKFLAEYPGSGGDFHILFKVMDHDAIDGDDYIGDVKIDVKNLLAEGVRKGKSEMPPRMYHVLAHKIHFKGEIEVGVSFKLQGGGGCGGCNPWEN

SEQ ID NO: 66312 - protein, 504 aa, Arabidopsis thaliana
MQNPSTVTQESAAPVFDFFPRLRGLTSRNRSPCSNSDGYALSSSNALYFNGFRTLPSRRMGKTLASLSFNTKSSAGSSLRRFISDFNSFIRFHCDKVVPESFASVGGVGLSSDENGIRENGTGGVLGEEGLPLNGVEADRPKKVLILMSDTGGGHRASAEAIRAAFNQEFGDEYQVFITDLWTDHTPWPFNQLPRSYNFLVKHGTLWKMTYYGTSPRIVHQSNFAATSTFIAREIAQGLMKYQPDIIISVHPLMQHVPLRVLRSKGLLKKIVFTTVITDLSTCHPTWFHKLVTRCYCPSTEVAKRAQKAGLETSQIKVYGLPVRPSFVKPVRPKVELRRELGMDENLPAVLLMGGGEGMGPIEATARALADALYDKNLGEAVGQVLIICGRNKKLQSKLSSLDWKIPVQVKGFITKMEECMGACDCIITKAGPGTIAEAMIRGLPIILNGYIAGQVSRECTVRGGKRMWEILKITERDIEDCSGLVWTGIERVGDNVTECIEAG

SEQ ID NO: 66313 - protein, 443 aa, Leptospira interrogans serovar Copenhageni str. Fiocruz L1-130
MNQNKPTSKLISDFWKGKTSEELFERAKKVSPGGVHSPVRSFRSVGGTPVFFASAKGATLTDISGKEYIDYCLSFGPLILGHRDPEIEEVVRETTEIAWSFGAAEPYSLELAELISSRVPWAEKVRFVNSGTEAVMSALRVARAATGREKILKFDGCYHGHLDSLLVKAGSGLAGESSSDSAGISATSIANTLVLPLDDEASVERVFETEGKNIAALIIEPLPANYGLLIQRKEFLLKIVETARKYGTLVVFDEVISGFRVGFQGMSGLLGIWPDLVTYGKIIGGGFPVGCYAGKKDLLDLVAPSGPVYQAGTLSANPFGMRAGLATLKKAQRDSIYSVLDDRTKIFTDTMTKLLNKKSNQEWEAVIHSSLFWFRKKTQQPIRRIDLIPEGHKESFAKVFHTFLKNGIYLAPSGYEVGFLSWAHDDEIIAKTLEIADKALKTF

SEQ ID NO: 66314 - protein, 138 aa, Cucurbita maxima
MGMGMMEVHLISGKGLQALDPLNKPIDPYAEINFKGQERMSKVAKNAGPDPIWNEKFKFLVEYPGSGGDFHILFKVMDHDAIDGDDYIGDVIIDVQNLLAEGVRKGWSELPPRMYQVLAHKIYFKGEIEVGVFFQRQG

SEQ ID NO: 66315 - protein, 204 aa, Brassica napus
VDPRVRERTVFYRERAAEMYSALPYALAQVVCEIPFVLIQTTYYTLITYAMMCFEWTVVKFFWFFFVSFFSFLYFTYYGMMAVAITPNQQVAAIFAGAFYGLFNLFSGFLIPRPRIPKWWIWYYWICPVAWTVYGLIVSQYGDQEDTIKVPGMMEDPTIKWYIENHYGYDPNFMGSIAAVLVGFTVFFAFMFAFGIKMLNFQQR

SEQ ID NO: 66316 - protein, 613 aa, Xanthobacter autotrophicus Py2
MPNFLPLATTPLETPLLRAIRDIHTRFTPLHDGEVASYIPELGKADPDHFGIAVATTDGHVYEAGDTAVPFTIQSVSKAIVYALALDMLGSEKVEAAIGVEPSGEAFNSIRLKADNRPFNAMVNAGAICCSGLLAEAAGDEAFELIRTTLSRFAGRELEVDDAVFQSERQTGDRNRAIAYLLRTYGGVRGDVDHILDTYFRQCSVLVTARDLAVMGASFANHGVNPVTGEMVASNYAVARTLAVMISSGMYDFAGEWIYRVGVPAKSGVGGGILAALPSQLGLGIFSPRLDAHGNSVRGLRTCSALSDAFDLHMLSRRDDVRTCIAADYDFRTVPSKPGRQPHEQSILEQRSGSIRVLELAGKLSFATMDYVTRRLTDPAGVPAFLILNLHRVSTITDAGLRLFTGLIRNQLPASTTTVIAGVEGNSPVAPQVKAMKEEGVRVRIFPTYDAAVDWAEDQIVYRHGGFSQIGIEADLSGQALLAGLSPQELADLSRLGTRVVFDAGTRIIDANEPPARVYFLVRGMVSVRSMHDVRLSTLIPGMAFGELALIDQPRSADVWADTEAVCLEISAEQFRAFQETHARAADRIMRNLAILLAGRVRMATARIDMLTG

SEQ ID NO: 66317 - protein, 235 aa, Kluyveromyces lactis NRRL Y-1140
MRLFHNQHVFDYSWDYITAANWKKYPNEVSTHVVAVDVLRRELDISGKVLTSERLITCKQSVPQWVMMLVGGSNISYVREVSVVDLNEKSLILRSCNLTGSSLLKVYETVKYMPHPDDPQNRTLFKQEAQITAYATFTKVCNKIEEWSVNRFHENAEKGKRGFDSVLKVLDESWKQTDKIMDGLAEKVDETVVDIKKTTDILIKETEKKSSKLASYYQYFSNAFRRSNDMTRDGS

SEQ ID NO: 66318 - protein, 190 aa, Bacillus anthracis str. A2012
MLVAPYYNKPSQEGMYQHFKAIAESTPLPVMLYNVPGRSIVQISVDTVVRLSEIENIVAIKDAGGDVLTMTEIIEKTADDFAVYSGDDGLTLPAMAVGAKGIVSVASHVIGNEMQEMIAAFQAGEFKKAQKLHQLLVRVTDSLFMAPSPTPVKTALQMVGLDVGSVRLPLLPLTEEERVTLQSVMQSIPR

SEQ ID NO: 66319 - protein, 225 aa, Oryza sativa (indica cultivar-group)
MAKEKGKAVMPMEVDQVEDEREAETVVEAVQKAVYDALEKVEMMEEEGEAAVAEAADKLLEEAVEKAVTEALEEALEEAGWDAAEKALSDDLEKVSLEAESARMITLESSDGEAVKVKEASARLSKTIGNIIDDGRGDEAIPLPDVSYKTLKKVVEYCDKHADEKSDTDEQKEELKNWDKAFIDELAEDDDSLVKVIMASNYLKIDGLHNLASQCKTTREQIGKA

SEQ ID NO: 66320 - protein, 279 aa, Prochlorococcus marinus str. MIT 9303
MLFRPLLALVLAFCLTFVAAPSSVSAAITDGAGNSDFVVGNERSNARFGNIVNTGRANDCPTIAAGSSGSISIGSGDTLSDICLQPTEVFVKVSPTKRKKADFAKTKIISPSNNTTIEQVFGDISGSGAFAEKGGIDFQLITVLAPNGEEVPFVFSAKDMQVDSNSSSISVGTEFKGTTRTPSYRTSNFLDPKSRALTTGVDYAQGLVALGGDDKDLQTENVKRYIDGKGQITLSVDSVDAGSNEFAGTFVALQTADTDMGSKEARDLKISGVLYGRKG

SEQ ID NO: 66321 - protein, 546 aa, Pseudomonas oleovorans
MLGQMMRNQLVIGSLVEHAARYHGAREVVSVETSGEVTRSCWKEVELRARKLASALGKMGLTPSDRCATIAWNNIRHLEVYYAVSGAGMVCHTINPRLFIEQITYVINHAEDKVVLLDDTFLPIIAEIHGSLPKVKAFVLMAHNNSNASAQMPGLIAYEDLIGQGDDNYIWPDVDENEASSLCYTSGTTGNPKGVLYSHRSTVLHSMTTAMPDTLNLSARDTILPVVPMFHVNAWGTPYSAAMVGAKLVLPGPALDGASLSKLIASEGVSIALGVPVVWQGLLAAQAGNGSKSQSLTRVVVGGSACPASMIREFNDIYGVEVIHAWGMTELSPFGTANTPLAHHVDLSPDEKLSLRKSQGRPPYGVELKIVNDEGIRLPEDGRSKGNLMARGHWVIKDYFHSDPGSTLSDGWFSTGDVATIDSDGFMTICDRAKDIIKSGGEWISTVELESIAIAHPHIVDAAVIAARHEKWDERPLLIAVKSPNSELTSGEVCNYFADKVARWQIPDAAIFVEELPRNGTGKILKNRLREKYGDILLRSSSSVCE

SEQ ID NO: 66322 - protein, 207 aa, Oryza sativa (indica cultivar-group)
MAKGSGEAAAAAAAAEGKGEEPVAAAVVEMEGEDAVVPEAVAADAEKAEEKESGSRMITLKSNEGKAFVVTEASARQSTTIGHMIDDDCTREAVPLPNVDSKTLEKVIEYFDEHANNKADTDDEKAALDKFDKDFIGELDGDKAFLFHVTMAANYLHAQGLLDLTTQCIADTIKGKTPEEIRTAFNIAYDLTEEDQEEIKEEDAWAF

SEQ ID NO: 66323 - protein, 454 aa, Listeria innocua Clip11262
MKYVIVGTSHAGFEAVQTLLKKDSDAEIVVFEAGSTASFLSCGIQSYLEDISKSLDELHYANEASYKEQGVDIRMNTSVIAINPETKEITTRTTDGVEATESYDKLLLSPGGVPGTIPNVDDQHENIFYLRGRNWADKVKNRMSSAKKAVVVGAGYIGIEAAIAYAQAGIDVTVVDFVDSILPTYLDSEFTSLLTKHMEEKGMKIKTGEGVKEFKVNENNEVTAVVTDKGTYEADTVIISVGVRPNTQWLKDTLTLDGRGFVEVNEHMETSVKDVYAAGDATAIPFAPTNDKAYIALATNARRQGVIMARHASGDADAKIGRVNGTSGLAVFDYKFATTGIKDANANSYQGNVKSVYKEDLIRPSFMHDEEKVLMKLHYDADNGRILGAQLMSTYDILQAINAVSVAIEAEWTVDQLAQADFFFQPEFSRPWNFLNVLAQEAQGQPYGADTMLF

SEQ ID NO: 66324 - protein, 236 aa, Oryza sativa (indica cultivar-group)
MAAAAEDAAAAEEEEEKESGSSRMITLKSNDEKLVEVTEASARQSRAIANLIDDGCADVIPLPNVDSKTLAKVIPYCDEHGRANSGTDEERAALGRFDADFVGELDKDKASLIDVIMAANYLNIQGLLDITCQRVADTIGSATAEKIREAFDIEDDLTEAEKKEIREENAWAFDGIPCLLVGIWFDGGIPIQEIRLQICNISQWVLSCLVKLNPIPCMCSAHAFFRITQMVSCFVV

SEQ ID NO: 66325 - protein, 173 aa, Desulfitobacterium hafniense Y51
MKALDFDKYIRVIDDFPKPGISFKDITTLLKDGEAYRAAVDAIVERVRESQPDLIVGPEARGFLLGAPVAYALGIGFVPVRKPGKLPGKTVSETYELEYGSDTLEVHADAIQPGQRIAIVDDLLATGGTTSATARLIEKTGAQVAGMSFLIELGFLEGRKRLEGYEVFSLIKY

SEQ ID NO: 66326 - protein, 128 aa, Brassica napus
  misc_feature (2)..(2): Xaa can be any naturally occurring amino acid
  misc_feature (10)..(11): Xaa can be any naturally occurring amino acid
  misc_feature (22)..(22): Xaa can be any naturally occurring amino acid
  misc_feature (26)..(26): Xaa can be any naturally occurring amino acid
  misc_feature (35)..(35): Xaa can be any naturally occurring amino acid
  misc_feature (53)..(53): Xaa can be any naturally occurring amino acid
  misc_feature (65)..(65): Xaa can be any naturally occurring amino acid
  misc_feature (71)..(71): Xaa can be any naturally occurring amino acid
  misc_feature (83)..(84): Xaa can be any naturally occurring amino acid
  misc_feature (86)..(86): Xaa can be any naturally occurring amino acid
  misc_feature (93)..(94): Xaa can be any naturally occurring amino acid
  misc_feature (99)..(99): Xaa can be any naturally occurring amino acid
  misc_feature (101)..(102): Xaa can be any naturally occurring amino acid
  misc_feature (105)..(107): Xaa can be any naturally occurring amino acid
  misc_feature (111)..(111): Xaa can be any naturally occurring amino acid
MXSSMLSSAXXVTSPDQATMVXPFTXLKSSAAFPXTRKANNDITSIASNGGKXSCMKVRTPVGKXKFETLXLTFPDLTEVELXXEXDYPSPHXXIPCVXFXXEHXXXHRDXREAPPYAHVEFPTPSRF

SEQ ID NO: 66327 - protein, 134 aa, Oryza sativa
DNVITVASNILKDAEKICSVRERCTPKPLDVNDQDGLRALLKDADIVISYVPAFLHPKIAEVCIAESRNMITASYISPQLAALDDQVKHKGLTFLNEIGFDPGIDHCATMKIIDEVNSHGGKIIEYESYGSGLP

SEQ ID NO: 66328 - protein, 597 aa, Bordetella parapertussis 12822
MQHIRNFSIIAHIDHGKSTLADRLIHRCGGLAEREMSAQVLDSMDIERERGITIKAQTASLQYKSQDGTVYNLNLIDTPGHVDFSYEVSRSLSACEGALLVVDASQGVEAQTVANCYTAIELGVEVLPVLNKMDLPQADPEAARQEVEDVIGIDASEAVLASAKTGMGIDEILESIVARVPPPKGDPSAPLQALIIDSWFDNYVGVVMLVRIVNGVLKPKDKILLMASHATHLCEQIGVFTPKSQPRPELSAGEVGFVIAGIKELEHAKVGDTITLAGKPAAEPLPGFKEVKPQVFAGLYPVESSEYDQLRDSLEKLKLNDAALMFEPEVSQALGFGFRCGFLGLLHMEIVQERLEREFDMDIITTAPSVVYEVEQRDGTVVTIESPSRMPEIAKIADIREPIVKVTLFMPQEYVGPVMTLCNNKRGVQLNMSYHGRQVHLTYEIPLAEIVLDFFDKLKSVSRGYASMDYEFVEYRSADVVKVDLLINGDRVDALAMIAHRNNARYRAREVVSRMRGLIPRQMFDVAIQAAIGAEVIARENVKALRKNVLAKCYGGDISRKKKLLEKQKAGKKRMKQVGSVEIPQEAFLAILQVEDK

SEQ ID NO: 66329 - protein, 441 aa, Streptococcus agalactiae 2603V/R
MTLNAKGESNQILVDKEVHSTNLLLDIDEKPELFQGLLLSFQHVFAMFGATILVPLILGMPVSVALFASGCGTLIYQVATKFKVPVYLGSSFAYITAMALAMKQMHGDISAAQTGILFVGLIYVVVATVIKFVGNSWVDKILPPIIIGPMIIVIGLGLANSAVTNAGFVAKGDWRKMLVAVVTFLIAAFINTKGKGFIKIIPFLFAIIGGYILSIILGLVDLSPVEKAAWFELPKFYLPFKTGLFHSYKLYFGPEMLAILPISIVTIAENIGDHTVLGQICGRNFLKKPGLNRLLIGDGLATAFSALIGGPAETTYGENTGVIGMTRIASVTVIRNAAFIAIAFSFFGKFTALISTIPSAVLGGMAILLYGVIASNGLKVLIENRVNFAEVRNLIIASSMLVLGLGGAVLDLGALTLSGTALSAIVGIILNLILPKESMKS

SEQ ID NO: 66330 - protein, 317 aa, Arabidopsis thaliana; identical to SEQ ID NO: 1044

SEQ ID NO: 66331 - protein, 599 aa, Corynebacterium diphtheriae NCTC 13129
MSAASANSVTNPSAWENSEIHPKHSYSPIVSGDLEVPETEIQLDDSPTGPNDPVRIYRTRGPECDPTVGLKPLRAQWIDSREDTEEYAGRERNLADDGRSAQRRGAASLEWKGVKPTPRRAKQGKRVTQMHYARQGIITKEMEFVALREHMDPEFVRSEIARGRAIIPNNINHPESEPMIIGRKFLTKINANIGNSAVTSSIEEEVSKLRWATRWGADTVMDLSTGDDIHTTREWIIRNSPVPIGTVPIYQALEKVNGVAEDLTWEIFRDTVIEQCEQGVDYMTIHAGVLLAYIPLTTKRITGIVSRGGSIMAGWCLAHHKESFLYEHFDELCEIFAQYDVAFSLGDGLRPGSVADANDAAQFAELKTIGELARRAWEYDVQVMIEGPGHVPLNMVQENNELEQKWAHDAPFYTLGPLVTDIAPGYDHITSAIGAAHIAMGGTAMLCYVTPKEHLGLPNRDDVKTGVITYKLAAHAADVAKGHPGARAWDDAMSKARFEFRWHDQFALSLDPDTAIAYHDETLPAEPAKTAHFCSMCGPKFCSMRISQDIRDMFADKIADLGIPQVGGDAEAGMAAKSEEFVAQGSQLYSEVRDNAAHA

SEQ ID NO: 66332 - protein, 307 aa, Clostridium perfringens str. 13
MDINLDALVEANRRYTKEGHVATYIPALAKVNPDQLGVCIYDLKENKEFSAGEYDVRFAIESISKVPTLILAILDNGIEKVFSEVGTEPSGFAFNSIMNMQINHKNKPSNPFINAGAIKVVSLLKGKNDEERFKRILDFYRKIMNDDEITLDTEIYLSERETGDINRSLAYYMKGNGIMEGDVTDILDSYFKQCSVLVTAKDLARLGAVLANEGVMPWNGERLFSVETATVVKSLMTTYGLYDESGAFSVHIGLPSKSGVGGGILSSVPNKCGIGLFSPALDVSGNSVASMKLLKEIADKLKLDIFR

SEQ ID NO: 66333 - protein, 537 aa, Alternaria solani
MQTHLLILAAVVLLIIHIVNNFLIKPLQTLLKSRRLGCGPVPFEPTRWPLDIDTIRRSLKADKEQRTPDFVAGRFETMGRYTWGLSLLGTSNLITAEPRNVQALLATQFDDFIMGTARRTNLKTALGRSIFAVDGKAWHRARETMRPIFSRENVSRLELLEEHVQTMLQIIETKDEGLTTDANDRAWSAPVSLAVLLPRLTMDSATELFLGQSTHSLKKALARQQQKSGNEEHDADSFDHAFERMLAILGTRMRLRSLYWLYGNKELQKCINALHAFVDSAIDAADQARKSGSSQLRYDFLETLRTRCSDRAEVREQVLGLLAAGRDTTASLTAWVFYCLVRNPRVYKKLRDTVLAEFGPYSTNPGQKITFEKLKGCTYLQHVLNETLRLHSVVPFNSRCAARDTTLPVGGGPDGSMPVFVPKGTEVNFSTHVLHRRKDLWGEDADEFVPERWEKKRPGMTWQYVPFNGGPRICIGQQFALTEAGYVLVRMVQRYDVIEGLDIDVERDWHNFTVVCSPGSPVARDAAVMCRLRVAVE

SEQ ID NO: 66334 - protein, 461 aa, Oryza sativa (japonica cultivar-group)
MPSGSATQFRYTQTPSKVLHLRNMPWECTEEELVELCKPFGRVVNTMCNVGANRNQAFVEFADQNQAISMVSYYASSSEPAQVRGKTVYIQYSNRQEITNNKGTGDSSGNVLLVTFEGVQPNDISIDVIHLVFSAFGFVHKIATFEKAAGFQALIQYTDAPTALEAKNSLDGRSIPRYLLPEHVPTCHLRITFSAHKDLNIKFQSHRSRDYTNPYLPVNPTAIEGIAQPTLGPDGKIKEPESNVLLASIENMQYAVTVDVLHTVFSAFGTVQKIAMFEKNGGMQALIQYPDITTAAVAKQALEGHCIYDGGYCKLHLSYSRHTDLNVKAHDERSRDYTVSSDPSAQMQAAAQAPGPSTPGVAWQNTAPSASFYGSTAAATPVGQVPAWNPNMQAGAFGSASSAYPTQPMMPGSVPHYPGIGSSSGALPVSFQASHQMPQYGVPPAAPHHAPPAGQPMYFPK

SEQ ID NO: 66335 - protein, 469 aa, Bacillus subtilis
MNQSQSGLKKELKTRHMTMISIAGVIGAGLFVGSGSVIHSTGPGAVVSYALAGLLVIFIMRMLGEMSAVNPTSGSFSQYAHDAIGPWAGFTIGWLYWFFWVIVIAIEAIAGAGIIQYWFHDIPLWLTSLILTIVLTLTNVYSVKSFGEFEYWFSLIKVVTIIAFLIVGFAFIFGFAPGSEPVGFSNLTGKGGFFPEGISSVLLGIVVVIFSFMGTEIVAIAAGETSNPIESVTKATRSVVWRIIVFYVGSIAIVVALLPWNSANILESPFVAVLEHIGVPAAAQIMNFIVLTAVLSCLNSGLYTTSRMLYSLAERNEAPRRFMKLSKKGVPVQAIVAGTFFSYIAVVMNYFSPDTVFLFLVNSSGAIALLVYLVIAVSQLKMRKKLEKTNPEALKIKMWLFPFLTYLTIIAICGILVSMAFIDSMRDELLLTGVITGIVLISYLVFRKRKVSEKAAANPVTQQQPDILP

SEQ ID NO: 66336 - protein, 466 aa, Clostridium perfringens str. 13
MFLCCFYLLELNARRVGSFAYFYTLPLKKFVEGKDMKLFGSMKVEENELYVGGVKASALSKEYGTPLYVIDEELVRSNCRRYYNAMKCEEIGNRVTYAGKAFINMSMCNLVNEENLYLDVVSGGELYTAYKAGFPLERIYFHGNNKSDYEIDLGVRLGIGRFIVDNIHELEVLNSIAQEYGRVQKVYLRITPGVEAHTHEYIKTGQLDSKFGFPVIGDTVYDAIKRAMELEYIELNGLHCHIGSQIFDLEPFEDTTEIMLNLINDIKETLGYEIKELDLGGGFGIYYTEGDKPKEIEEYCSVIINKADEICRKLNMNVPILSIEPGRSIVGNAGLTLYTVGAIKEIPNIRKYVSVDGGMSDNIRPALYSANYESLIANRVFDNSKEIVTVAGKCCESGDVLLNSIEMPRMETGDILAIMSTGAYGHSMANNYNRIPKAAVVSVSNGISKVMCKRETYEDLLRNECF

SEQ ID NO: 66337 - protein, 661 aa, Thiobacillus denitrificans ATCC 25259
MPTRTDLSNAIRALAMDAVEKAKSGHPGAPMGMAEIAETLWNHHMRHNPVNPKWADRDRFVLSNGHGSMLIYALLHLTGYDLSMDDLKQFRQLHSKTPGHPEYGYAPGVETTTGPLGQGITNAVGMAMAEKVLAHEFNKPGHSIVDHHTYVFLGDGCMMEGISHEACALAGTWKLNKLIAFWDDNGISIDGHIEHWYTDDTAKRFEAYGWQVIPNVDGHDVVAIEAAIQKAKASSDKPTLICCKTIIGKGSPNKAGTHDVHGAALGHDEVEATRKNMGWNSPAFEVPADIYAGWDAKTKGQGLETLWNNKFAEYKKAFPAEAAEFERRMKGELPANWKAHVAEKLAAINAKGETVATRKASQIAINALASALPEFLGGSADLTGSNLTNWEGCHPVRHGKPGNYISYGVREFGMAAIMNGMALHGGLLPFGGTFLMFSEYSRNAIRMAALMKQRVIHVFTHDSIGLGEDGPTHQPVEQTATLRMIPNIDVWRPCDTVETMVGWAHSVERTDGPTCHILSRQNLPFMQRDDATLASIAKGGYVLKDAAGAKAVIIATGSEVELAVKAADTLAAEGIAVRVVSMPSTNTFDRQDAAYRESVLPKGLPRVAVEAGVTDFWRKYVGLEGAVVGIDTFGESAPAPALFKHFGITAEAVAAAVKSVL

SEQ ID NO: 66338 - protein, 873 aa, Arabidopsis thaliana
MVDNSNNKKRKEFISEADIATLLQRYDTVTILKLLQEMAYYAEAKMNWNELVKKTSTGITSAREYQLLWRHLAYRDSLVPVGNNARVLDDDSDMECELEASPGVSVDVVTEAVAHVKVMAASYVPSESDIPEDSTVEAPLTINIPYSLHRGPQEPSDSYWSSRGMNITFPVFLPKAAEGHNGNGLASSLAPRKRRKKWSAEEDEELIAAVKRHGEGSWALISKEEFEGERTASQLSQVYFLVSSVKKDIWGQHCMGICDAVYLAYICNLAEFTYLQRWGAIRRRTDTSNTSTQTGLQRTEAQMAANRALSLAVGNRLPSKKLAVGMTPMLSSGTIKGAQANGASSGSTLQGQQQPQPQIQALSRATTSVPVAKSRVPVKKTTGNSTSRADLMVTANSVAAAACMSGLATAVTVPKIEPGKNAVSALVPKTEPVKTASTVSMPRPSGISSALNTEPVKTAVAASLPRSSGIISAPKVEPVKTAASAASLPRPSGMISAPKVEPVKTTASVASLPRPSGIISAPKAEPVKTAASAASSPRPSGMISAPKVESVKTTASMPRPSGIISAPKAELVKSAASAASLPCTSGIISSPKAELVKSAASAASFPRPSSMLSAPKADPVKIVPAAATNTKSVGPLNLRHAVNGSPNHTIPSSPFTKPLHMAPLSKGSTIQSNSVPPSFASSRLVPTQRAPAATVVTPQKPSVVAAATVVTPQKPSVGAAATVVTPQKPSVGAAANVVTPQKPSVGSAATVVTPQKPSVGAAVTVTSKPVGVQKEQTQGNRASPLVTATLPPNKTIPANSVIGTAKAVAAKVETPPSLMPKKNEVVGSCTDKSSLDKPPEKESTTTVSPLAVAATKSKPKDEATVTGTGLKEL

SEQ ID NO: 66339 - protein, 333 aa, Thiobacillus denitrificans ATCC 25259
MAIKVGINGFGRIGRMAFRAIAKDFPDIEVVAINDLLDPEYLAYMLKYDSVHGNFKGDIAVEGNNLIVNGKKIRLTAEREPANLKWNEVGAELVIECTGFFLTKETCQKHIDAGAKKVVQSAPSKDDTPMFVYGVNHEKYAGEAIVSAASCTTNCLAPIAKVLNDNWGIKRGLMSTVHAATATQKTVDGPSSKDWRGGRGILENIIPSSTGAAKAVGVVLPELKGKLTGMAFRVPTSDVSVVDLTVELEKPAKYADICAAMKKASQSGDISKTLGYTDEKVVSTDFRGNGFSSIFDAEAGIALDDTFVKVVSWYDNEYGYTCNMLRFVQHVAK

SEQ ID NO: 66340 - protein, 520 aa, Oryza sativa (indica cultivar-group)
MAVRRRRPGPVAAAVLLLLAVATQAAASPIKTVVVVVMENRSFDHMLGWMKRLNPEIDGVTGGEWNPTNASDPSSGRVYFGEGAEYVDPDPGHSFQEIRQQIFGSDDASGPARMDGFVQQARSLGDNMTAAVMNGFSPDSVAVYRELVGEFAVFDRWFASVPSSTQPNRLFVHSATSGGATSNNPELLAKGYPQRTIFDNVHDAGLSFGVYYQDVPAVLFYRNLRKLKYLTKFHPFHGAFRDHAARGSLPNYAVVEQHYMDSKSHPANDDHPSHDVFQGQMLVKEVYETLRASPQWNQTLMVVTYDEHGGFYDHVPTPVTGVPSPDGIVGPPPYNFAFDRLGVRVPAIVISPWINKGTVVHGPNGSPTATSEYEHSSIPATVKKLFDLPQDFLTKRDAWAGTFESVVQGRTEPRTDCPEQLPMPMRIRLTEANEEAKLSEFQQELVQLASVLNGDHQLSSLQDTIRDRMNVREGIAYMRGAVKRFFEAGMSAKRMGVDDEQIVKMRPSLTTRTSPAIEQP

SEQ ID NO: 66341 - protein, 424 aa, Bacillus licheniformis ATCC 14580
MVADQNTGHTEENTHDVLKSTQTVIHKALEKLGYPEEVYELLKEPIRFLTVKIPVRMDDGSVKIFTGYRAQHNDAVGPTKGGIRFHPGVTEKEVKALSIWMSLKCGIIDLPYGGGKGGIICDPRDMSFPELERLSRGYVRAISQIVGPTKDVPAPDVFTNSQIMAWMMDEYSRIDEFNSPGFITGKPLVLGGSHGRESATAKGVTICIKEAAKKKNIDIEGASVVVQGFGNAGSYLAKFMYDAGAKVVGISDAYGGLYDPEGLDIDYLLDRRDSFGTVTKLFNDTITNKELLELECDILVPAAIENQITAENAHNIKAKIVVEAANGPTTLEATKILSDRDILLVPDVLASAGGVTVSYFEWVQNNQGFYWTEEEVEERLEKMMVKSFNNIYEMAHNRRIDMRLAAYMVGVRKMAEASRFRGWI

SEQ ID NO: 66342 - protein, 393 aa, Thiobacillus denitrificans ATCC 25259
MAFIRVTDLDLAGKRVFIRADMNVPVKDGKVTSDARITASMRTIEHCMRAGAKVMVTSHLGRPTEGEFKEEDSLKPVVDVIAQKLGKNVRLIREWTEGGFDVANGELVVLENCRVNKGEKKNVDETAKKYAALCDVFVMDAFGTAHRAEASTHGIAKFAPTAAAGILLTEELDALAKALANPARPMVAIVGGSKVSTKLTVLEALSEKVDQLVVGGGIANTFLAAMGKNVGKSLCEHDLIPTAKTLIEKMAARGASIPIAVDVVCGKKFDANEPAVLKSADEVADDDMIFDIGPKSAQELADIIAKAGTIVWNGPVGVFEFDQFGEGTKTVSMAIANAPGFSLAGGGDTIAAIQKYDIYDKVSYISTAGGAFLEYLEGKVLPAVAILEERAQG

SEQ ID NO: 66343 - protein, 503 aa, Prochlorococcus marinus str. MIT 9303
MGKEHFFLELEPPEERLRRAPHVVIIGGGFAGVRACKALANTEVRVTLIDKRNFNLFQPLLYQVATGLVSKGDVATPLRQLVGRQFNVQVLLGEVTQLNPQDKQIVFNNKSLSYDYLVLATGSGSTYFGHEEWRSFAPPMKILEHAEEIRRRLLMAMEQAEQTPDPNARQFLQSVVVVGAGPTGCEMAGAVSELMRNAMSREFKQLNPDQTKIYLVDPGERVLRAMPEMLSKSARTTLESLGVEMVFKGRVQSMQPGEVMISTPNGDQCLQAATVIWTAGVRPSHLGRNLADSIGCELDKGGRIVVEPDFAVAGHPEIRVVGDLCSYRHTTNQTPLPGMAGPATQAGGFVGKDIAALVSGSSRPTFNWFDFGSMAVLDRVAAVADLRGFKFSGGIGWMCWALAHLAFMPNPENRITLLFKWLVAVVSQQRSSMLLTGMPSQHIDIDAPDAHFPMQPGLGPSIAAPDAALQAAMKYYSTQIAGIASQPMAAKEGSEEDSTAAIK

SEQ ID NO: 66344 - protein, 302 aa, Halobacterium sp. NRC-1
MATETDLEELRRGSELVKRGFAKMQKGGVIMDVVNREQARIAEDVGAVAVMNLEAVPADIRKRGGVARMADPASLTGIIEEVSIPVMGKSRIGHRKEAEILQAVGADMIDESEVLTPADDEYHIDKREFTAPFVCGARNLGEALRRIDEGAAMIRTKGEAGTGDVNQAVHHQRNIKSAIRKLEGMDYEERDMWARDHEAPRELVHETAEMGRLPVVNFAAGGIATPADAALMMHHGCDGIFVGSGIFGAENPEAMGRAVVDAVNNHDDPERLAEIASNIGEGMQGDPNADLPEDERMQDRGN

SEQ ID NO: 66345 - protein, 434 aa, Bacillus cereus G9241
MVVKFTKSEALHKEALEHIVGGVNSPSRSFKAVGGGAPVAMERGKGAYFWDVDGNKYIDYLAAYGPIITGHAHPHITKAITTAAENGVLYGTPTALEVKFAKMLKEAMPALDKVRFVNSGTEAVMTTIRVARAYTGRTKIMKFAGCYHGHSDLVLVAAGSGPSTLGTPDSAGVPQSIAQEVITVPFNNVETLKEALDKWGHEVAAILVEPIVGNFGIVEPKPGFLEKVNELVHEAGALVIYDEVITAFRFMYGGAQDLLGVTPDLTALGKVIGGGLPIGAYGGKKEIMEQVAPLGPAYQAGTMAGNPASMASGIACLEVLQQEGLYEKLDELGAMLEKGILEQAEKHNIDITLNRLKGALTVYFTTNTIEDYDAAQDTDGEMFGKFFKLMLQEGVNLAPSKYEAWFLTTEHTKEDIEYTIEAVGRAFAALANNK

SEQ ID NO: 66346 - protein, 692 aa, Xanthobacter autotrophicus Py2
MSLIASTGFAEAGNALARPNSGDGTPSARLNSGDGFASARRMADAIRFLALDAIAKAEDGHPGAPLGGAELATALFTRHFKCNPADPAWFDRDRFVLSNGHGSMLIYAVLHLAGYAGMPMEEIRRFRELGAHTHGHPERDVALGIEVTTGPLGQGIANAVGMAVAEAFLSATYGPELVDHRTYAVVGDGCLMEGIAHEVISLAGHLKLGKLTFLWDDNRMTDDGGTHFAISEDVRARFRIAGWQVIDADGHDVEAVSAALILAHQDPRPTMIACTTVLGKGLPRLEGKRGAHGGRVFPEDVVEARAAAGWTHGPFEVPQDVAAAWQAGTGERNRPSYEAWQARVAALPADKRAEFERLVRGELPAGVLSALSAHAEALAAAAPAQSSNQSTADIVDLLAGLVPELLPGAPDLEGPTNCKRGLDAFTAENPAGRYIHYGIREHAMGSMMNGMVAHGGVLPLGATYLVFSDYMRPSLRMSALMELPVITLYSHDSIGIGKNGPTHQPVEFLASLRAMPNMAVFRPADAVETAECWQLALARRDGPSSIICSRQALPAQRSDAGENRSARGAYVLRAAEGGPRRVTLIATGSEVDVAVKARDLLQAEGIPTAVVSMPCWEIFGEQDEAYVWEVLGPGTVRVAVEAAVKLGWERWIGADGAFVGMNSFGASGPADELFRHFGITPAAVGDAARARL

SEQ ID NO: 66347 - protein, 344 aa, Xanthomonas campestris pv. vesicatoria str. 85-10
MAAISRSAYASASPDVPVATSFVAADVGGTHVRVGHMLQTRDAAIELSHYRTYRCAEHASLQAILEDFLQQRRRVDAVVIASAGVALDDGSFISNNLPWTISPSRIGTALAVRDVHLVNDFEAVAYAAPQMEQRAVLQLSGPTPRHARANGPILVVGPGTGLGAALWIDAKPRAIVLATEAGQVALASTHPHEYALLQRLLRGRHYLPLEHVLSGPGLLHLYHAVCELHGATPLHRLPAAVTHAALHENDALARECLQIFCGLLGSAVGDMALAYGAAGGIYLAGGFLPTIGQFLAGSTFAERFLDKGNMRAVLERIPVKLVEHGQLGVLGAANWYLQHHTELS

SEQ ID NO: 66348 - protein, 360 aa, Heliobacillus mobilis
MHPLTEKTELRGLLPEEMAQTLQEWGHPAYRGKQIFKWVQSRAVREAAEMTDLPQALRSKIEAERWLRPLALSCCRVSKDGTEKYLWQLADGELIETVLMPYRRSQTRDRVTVCLSTQAGCPLGCKFCATGQQGFRRNLTAGEIVSQVLDITHRKGQSDPDFKVTNLVFMGMGEPFLNYEQVRRAIELFTHPEGQNIGQRRITVSTSGIVPGIERFARENWEINLALSLHAADDQLRSQWMPVNRQYPIEKVLNACRRYWEQGRRRLSVEYALIEGVNDRLEDARQLGKLFTRWPIHLNVIPVNPVTESGARRPDKARMVQFLDELKRQGIDAVIREERGVDIEAACGQLRGAAHGEGET

SEQ ID NO: 66349 - protein, 157 aa, Triticum aestivum
HVQLGQLSAKLPPLQHCLLVPNSARGRELVSEKEAALAAVPNDSPTIFDKIIKKEIPSTVVYEDEKVLAFRDINPQAPTHILIIPKVKDGLTGLSKAEERHIEILGYLLYVAKVVAKQEGLEDGYRVVINDGPSGCQSVYHIHVHLLGGRQMNWPPG

SEQ ID NO: 66350 - protein, 347 aa, Flaveria linearis
YIGLRQRRASGKEYAELMNEFMSAVKQNYGEKVLIQFEDFANHNAFDLLEKYRTTHLVFNDDIQGTASVVLAGLISALKLVGGSLADHKFLFLGAGEAGTGIAELIALEISKQTNAPLEETRKKIWLVDSKGLIVRSRLDSLQHFKKPWAHDHEPVNKFLDAVKAIKPTVLIGSSGAGQTFTKEVVEAMRSFNEKPIILALSNPTSQSECTAEQAYTWSEGRTIFASGSPFAPVEYNGKVYVSGQSNNAYIFPGFGLGLIISGAIRVHDEMLLAASEALAEQVTQEHFDNGLIYPPFTNIRKISAHIAAKVAAKAYELGLASRLPQPENLVAYAESCMYSPKYRNYR

SEQ ID NO: 66351 - protein, 340 aa, Streptococcus agalactiae 2603V/R
MTVNLDWDNLGFAYRKLPFRYISHFKDGKWDDGKLTDDATLHISESSPALHYGQQAFEGLKAYRTKDGSIQLFRPDQNAERLQRTADRLLMPHVPTDKFIAAVKSVVRANEEFVPPYGTGATLYIRPLLIGVGDIIGVKPAEEYIFTVFAMPVGSYFKGGLTPTNFIVSKEYDRAAPNGTGAAKVGGNYAASLLPGKYAHEKQFSDVIYLDPATHTKIEEVGAANFFGITKDNQFITPLSPSILPSITKYSLLYLAKERFGMEAIEGDVFVDELDKFTEAGACGTAAVISPIGGIQNGDDFHVFYSETEVGPATRKLYDELVGIQFGDVEAPEGWIYKVD

SEQ ID NO: 66352 - protein, 264 aa, Triticum aestivum
  misc_feature (239)..(239): Xaa can be any naturally occurring amino acid
  misc_feature (248)..(248): Xaa can be any naturally occurring amino acid
AGRRRCLFKYSAYESGLGVKTVGWSPCGQFLAVGSYDQSVRILNHLTWKTFAEFTHAASIRSPYNAAVFKEVDDPFQLDMSELCLSEGLSRNMRDNGTENGSEGGSRVKYAVMDVPITVPAQKPASDKPNPKQGIGMLSWSSDSHYFFTRNDNMPTVLWIWDICRLELAAVLVQKDPIRAAAWDPTCPRLVLCTESPHLYMWTPSGACCVNIPLPNFRIVDLKWNSAGSCLLLKDRDSXCCAAIVSAXPEEEPDEQTDETSEDE

SEQ ID NO: 66353 - protein, 94 aa, Zea mays
NVYINKLSGDIHEEVETHNRMLDRMGSDMDTSRGFLSGTVGKFKTVFGAISTGFLLDQVESSPGESFVGLGRVQEHSENGRADLVVPCRVYIYS

SEQ ID NO: 66354 - protein, 287 aa, Triticum aestivum
METERRASSGKRASGAPPKVVAVLAGLLERAAKRGDAVDGDGSGSAAFRGPTEKKPEIGVRRYAERIYRYAGCSPACFVVAYAYLDRLAAPSLEAESAAVAVDSYSVHRLLITSVMVAAKFMDDIHYNNAYFARVGGVEVREMNGLELEFLFALRFRLNVTPEDFASYCAALEGEMMANNHAAAAVSAGGHGLGLGLAGGGGRSGRRGRRHHHGLRGGCSGICGRDHPMTRRQRTSEPASVRGGQNGQCLCYDSFIYFSFFILASWWGVYQVRCQLNVYISIFLSYR

SEQ ID NO: 66355 - protein, 385 aa, Oryza sativa
MAKASVVVPEQVGAAAAAQVGCPCPGTTLFPYPPPRAGIAVRRKCLQAAQQLELGAGLRGGWVESMRASSPTHAKAAAALAAGVDEEHAAWMARHPSALGEFEKVVAASKGKQIVMFLDYDGTLSPIVDDPDAAFMSETMRMAVRSVAKHFPTARARARCPARRFEFVKLAELYYAGSHGMDIKGPASRHAAAKSPPHNKGVLFQPASEFLPMIEQVHQRLEQATSSIPGAQVENNKFCVSVHFRCVDEKSWGALAETVRRVVREFPRLRLSQGRMVFEVRPTIKWDKGKALEFLLDSLGTCSFLLDSLGFADCRDVLPVYIGDDRTDEDAFKVLRRRGQGVGILVSKHPKETSASFSLQEPAEVMEFLLRLVEWNRLSRTRLRL

SEQ ID NO: 66356 - protein, 1099 aa, Prochlorococcus marinus subsp. pastoris str. CCMP1986
MPQRGDLKRILILGSGPIVIGQACEFDYSGTQACKALRKAGYEIVLVNSNPASIMTDPEIANKTYIEPLTPEIVSQIILKEKPDAILPTMGGQTALNLAVKLSESDFLTNNNVELIGADLKAINKAEDRKLFKESMENINVNVCPSGIASDLFEAREVSKQINSYPLIIRPAFTLGGVGGGIAYNLEEFNDLCKSGLDESPSNQILIEKSLIGWKEFELEVMRDTADNVVIICSIENLDPMGVHTGDSITVAPAQTLTDREYQRLRDLSLKIIREVGVETGGSNIQFAVNPKNGDVIVIEMNPRVSRSSALASKATGFPIAKIAALLSVGYTLDEIINDITKKTPACFEPSIDYVVTKVPRFAFEKFKGSSNILNTSMKSVGESMAIGRSFEESFQKALRSLEIGIFGWECDSIEDFNNDNDLKNNLQNPTAERILIVKKAMESGKTNSYINEITNIDLWFIEKLRNIFNFQNEFLKGNELTRIDRDLMLNAKQLGFSDQQIAKLTNSEFFEVRNYRKKLKVLPLYKTVDTCSAEFSSETPYHYSSYEEAFLHNNLNINDNEISADNHKHLKKIMILGGGPNRIGQGIEFDYCCCHASYQASSNGYQTIMVNSNPETVSTDYDTSDILYFEPVTLEDVLNIIEAENPYGLIVQFGGQTPLKLSLPLSNWLESYEGIKCKSKILGTSPHSIDIAEDREEFTKILEELNIRQPLNGIARNEKEAMLVANNIGFPLVVRPSYVLGGRAMEIVKDKNDLSRYIKEAVKVSPDHPILLDQYLSNAIEIDVDALCDKTGSVVIAGLMEHVEPAGIHSGDSACCLPSISLSQETIETVKKWTKLIANRLNVVGLINLQFAIRNHSNEENQLFILEANPRASRTIPFVSKAIGKPVAKLATQLMQGSSLKDINFTKELIPKYQAVKEAVLPFKRFPGSDALLGPEMRSTGEVMGLADNFGLAYAKSELAAGNGVPSEGVAFLSTNDLDKDKLEYIARELIVLGFKLVATKGTAKYLFNLGIEVDEVLKVHEGRPNIEDSIRSGLIQLVINTPVGSQALHDDAYLRRASLEYNIPTFTTIPGAKAALQAIKSLRLNKIDTLSLQEIHN

SEQ ID NO: 66357 - protein, 193 aa, Oryza sativa
  misc_feature (143)..(143): Xaa can be any naturally occurring amino acid
  misc_feature (171)..(171): Xaa can be any naturally occurring amino acid
MNIKGGGRVPVPPAGAGTLVKLVVLGGTAVYAAVNSLYNVEGGHRAIVFNRIQGIKDKVYPEGTHFMIPWFERPIIYDVRARPNLVESTSGSRDLQMVKIGLRVLTRPMPEKLPTIYRTLGENFNERVLPSIIHETLKAVVAXQYHASQLITQRETVSRAIRTILTERARXFNIALDDVFVTRLSFGRSSSFY

SEQ ID NO: 66358 - protein, 356 aa, Escherichia coli CFT073
MMSQKYLFIDRDGTLISEPPSDFQVDRFDKLAFEPGVIPELLRLQKAGYKLVMITNQDGLGTQSFPQADFDGPHNLMMQIFTSQGVQFDEVLICPHLPADECDCRKPKVKLVERYLAEQAMDRANSYVIGDRATDIQLAENMGINGLRYDREILNWPMIGEQLTKRDRYAHVVRNTKETQIDVQVWLDREGGSKINTGVGFFDHMLDQIATHGGFRMEINVKGDLYIDDHHTVEDTGLALGEALKIALGDKRGICRFGFVLPMDECLARCALDISGRPHLEYKAEFTYQRVGDLSTEMIEHFFRSLSYTMGVTLHLKTKGKNDHHRVESLFKAFGRTLRQAIRVEGDTLPSSKGVL

SEQ ID NO: 66359 - protein, 200 aa, Nicotiana plumbaginifolia
MASSSHNNLNAKLVLLGDMGAGKSSLVIRFVKGQFLEFQESTIGAAFFSSTLAVNNATVKFEIWDTAGQERYHSLAPMYYRGAAAAIIVYDITSSDSFARAKKWVQELQKQGNPNMVMALAGNKADLEDRRKVTAEEARLYAEENGLFFMETSAKTAVNVNAIFYEIAKRLPRAQPAQNPAGMVLVDRAAEGTRATSCCT

SEQ ID NO: 66360 - protein, 230 aa, Prochlorococcus marinus subsp. pastoris str. CCMP1986
MHMTCADTKKYLEEFLPLIEEIPNDRKIVIAPPFTAISTFSNYTNFDYLNIASQNIHWEDKGAFTAEISPNMLIEHKVKYAIVGHSEPRKYFSESDEQINKRAVFAQSSGLTPIVCVGETLEQRERGEADRVITRQVEQGLENTDPSNLIVAYEPIWAIGTGKTCEASDANKICALIRSLIGFSDVIIQYGGSVKPNNIDEIMSMSDIDGVLVGGSSLDPISFSRIANFE

SEQ ID NO: 66361 - protein, 417 aa, Halobacterium sp. NRC-1
MSASYVIIGDGIAGSSAAEAIHEEAPDADITVLTDEGETLYNRILIKEYAKGKLPEAPISIHDPEWYDERDIDIQLNTLVTRINPDAHTVETHEGTEIEYDKLLVAAGGTPNDLPVENADADGVHHFWTFEDARRIREHAEAADTGVVVGAGLLGIDLAAICGGQDVDAKYLMRGNRWWRYALSEAGAEIIHEGLREKGVEPVFESGVDHFEVDDDGALAAAVDGNGVRHDADFAGVAIGLDFNVEILQDTDATIENGVHVDEYMRTEVDDIYAAGDITQYWDTILDERAQNGSWGSAKQQGALAGRTMLADSGHDVEIEPFRWVSSYSITHFDFPFLSFGFPTIGDETCERSYGDNEWRRLAFKDGQLVGGVLIGNLAPQSKYKQLIKEEAVVADQQDVLLQDNFEMDELGAATQQ

SEQ ID NO: 66362 - protein, 353 aa, Glycine max
  misc_feature (129)..(129): Xaa can be any naturally occurring amino acid
MMAESGEEEIVGKPVQELLLNPENLPKNYIYEEGGAGFRDALVPSQDDDIPVIDLHRLSSSSISQQELAKLHHALHSWGCFQAINHGMKSSFLDKVREVSKQFFQLPKEEKQKCAREREPNNIEMAMIXSENQRLDWTDRVYLKVLPEDERKFKFWPQNPYDFRSIVLQYTESMRLLSEVIIKAMAKSLNLEEDCFLNECGERADMFLRFNYYPPCPMPDHVLGVKPHADGSTITFLLQDKEVEGLQVLKDDQWFKVPIIPDALLINVGDQIEIMSNGIFRSPVHRVVINKAKERLTVAMFCVPDSEKEIKPVDKLVNESRPVLYRPVKNYVEIYFQYYQQGKRPIEASKITF

SEQ ID NO: 66363 - protein, 242 aa, Solanum lycopersicum
IIAAARRIDRLQSLCDEINSNSSNGSTKSSQDLRAVAIELDVSANGSAIEAAVQKAWDAFGRIDGLVNNAGFRGSVLSPLELSEEEWEKIHKTNLRGAWLVTKYVCMHMRAANQGGSIINISSIAGINRGQLPGSLAYTSSKEALNSITKVLALELGPYKIRVNSISPGLFKSEITEGLIQKDWIKNIELRTIPLRTHGTSHPALTSVVRYLIHDSSEYVSGNMFIVDAGATLPGVPIFSSL

SEQ ID NO: 66364 - protein, 320 aa, Heliobacillus mobilis
MQSRLFQDIQNDLAKVEAELAKYADTSLPTLTAASSHLLHAGGKRLRPAFVLLAGRFHNYSLERLLPLAVAMEMIHMASLVHDDVVDESKTRRGIPTVKARWGNRISIHTGDHLFARSLLLIAELNDDKISEVLAKVSVEMCKGEIQQMSGTFDVNQTFRDYLFHIKRKTALLISASCQLGAMAVKADPSIVRALKMYGHHLGMAFQVTDDILDLTADEAELGKPVGSDLRQGIITLPILEALWETKDPLLRLLVAKRDKSQEEVGQAIEIIKNSGAIDRSQKIARRYLEKAKDELKRLPPVPTRDSLASIAEFIEKRTY

SEQ ID NO: 66365 - protein, 211 aa, Solanum habrochaites
LSDLLSQEKRAEDLQKLLVQLRPFFSLIPKAKTAKIVNKGIVDAVAKIPGTSELQITLCKDIVQWARSEKRTFLRQRVEAKLAALLMENKEYSEALTLLSGLIKEVRRLDDKLLLVEIDLLESQLHFSLRNLPKAKAALTAARTAANAIYVPPAQQGAIDLQSGILHAEEKDYKTAYSYFYEAFEAFNALENPQALYSLKYMLLCKIMVSQ

SEQ ID NO: 66366 - protein, 118 aa, Aspergillus nidulans FGSC A4
MAKLFIGGLAWHTTDDVLREGFSRYGTIEEAVVVKDRDTNRSRGFGFVRFASEPEADAAMGAMNNQEFDGRIIRVDKASERPAARNGGFQGRGGYNSPADGGYRGGGAGGWRNQAPGP

SEQ ID NO: 66367 - protein, 339 aa, Pseudomonas syringae pv. phaseolicola 1448A
MKTFSKVMTGTLLALSIGSAFAAGDPVIEHNTQAFLDALNSGTGKPIEQLSPKDARAVLVGAQAGVKLTLPKADVSEKTINVDGQPISLNIVRPAGVKGTLPVFMFFHGGGWVLGDFQTHERLVRDLVVGSGAVAVFVNYTPSPEAHYPTAINQAYAATRWVAEHGKEINVDGKRLAVAGNSVGGNMAAVVALMAKEKGTPALRYQVLLWPVTDANFDNDSYNQYAEGHFLTRNMMKWFWDNYTTDAAQRNEIYASPLRATTEQLKGLPPALIQTASADVLRDEGEAYARKLDQAGVPVTAVRYNGMIHDYGLLNVVSQVPAVRSAILQASQELKEHLK

SEQ ID NO: 66368 - protein, 305 aa, Arabidopsis thaliana
MTLYIRREASKLWRRFCSEITTEIGLLAENWKYLLAGLLCQYIHGLAARGVHYIHRPGPTLQDSGFFVLPELGQDKGFISETVFTCVFLSFFLWTFHPFIVKSKKIYTVLIWCRVLAFLVACQFLRVITFYSTQLPGPNYHCREGSELARLPRPHNVLEVLLLNFPRGVIYGCGDLIFSSHMIFTLVFVRTYQKYGSKRFIKLLGWVIAILQSLLIIASRKHYTVDVVVAWYTVNLVVFFLDKKLPELPDRTTALLPVISKDRTKEESHKLLNGNGVDPADRRPRAQVNGKDSNGGHTDNATNGT

SEQ ID NO: 66369 - protein, 502 aa, Secale cereale
MDGGGEHSEALKNYYLGKILGVGTFAKVIIAEHKHTRHKVAIKVLNRRQMRAPEMEEKAKREIKILRLFIDLIHPHIIRVYEVIVTPKDIFVVMEYCQNGDLLDYILEKRRLQEDEARRTFQQIISAVEYCHRNKVVHRDLKPENLLLDSKYNVKLADFGLSNVMHDGHFLKTSCGSLNYAAPEVISGKLYAGPEIDVWSCGVILYALLCGAVPFDDDNIPNLFKKIKGGTYILPIYLSDLVRDLISRMLIVDPMKRITIGEIRKHSWFQNRLPRYLAVPPPDMMQQAKMIDEDTLRDVVKLGYDKDHVCESLCNRLQNEETVAYYLLLDNRFRATSGYLGAHYQQPMESASPSTRSYLPGSNDSQGSGLRPYYRVERKWALGLQQSRAPPRAIMIEVLKALKELNVCWKKNGDCYNMKCRWCPGFPRVSDMLLDANHSFVDDCAIKDNGDANSRLPAVIKFEIQLYKTKDDKYLLDMQRVTGPQLLFLEFCAAFLTNLRVL

SEQ ID NO: 66370 - protein, 668 aa, Ustilago maydis 521
MSLKVQLPHSSLCRIGQRTTGAQGGLSSDKAAQKEKVGPLKSGLLFSYMQNFCALQTRLRRPSRTTELDTMDFKPFLTLQHFRPQGFAGDVLAPGASYNQTWNTMASKFNGRGGNRVETGKVLEAASESLKETVPLLQLVVRARHHPLLVFLVGLFLGTIYLLYRYWDCAVGCERRPDLKGPKGLPLIGNLMWALKNRDPLSYQVYAQQKYGYGNTHTLPGLGRLIDISRPDWIEHVQKIKFSNYVKGEQFHDQMRDVLGDGIFTSDGERWKMQRKVASRIFTVSSFKAIITQTIREDCALVEQLIETYARQGTVFNLQELYFKFTLSSFVKIAFSQDIKSLSEPDRPDTFGDAFNYAQKVLDMRFVQPWWKIAERFNETGRKMRAARKIVEEFTTNIVEARRKESEAMGEKSKPESSRKDLLDLFMAYRSSDGQRLSNQQLKDTILNLMIAGRDTTAEALSWMSWHMLTKPDVYDRIRHEIDATLEEEGEQAGLEIDYDVFEQHTAKLTTFQETLRLHPSIPKNIRRALQDDVLPNGGPRVRKGDLMLYSDWAMGRNPDIWGPDACEFKPSRWTDQETGSSIKYSQFQAHFFNGGPRLCLGQKLASYEVVQLIHHIFAKFDLELIDLGPGRSAGFGKVPDYLNSLTHPMKRPLMVKATLRCCKEGTR

SEQ ID NO: 66371 - protein, 1042 aa, Halobacterium sp. NRC-1
MTEDSRTILLIGSGPIQIGQAAEFDYSGAQACRALQEEGARVVLVNSNPATIMTDPEMADAVYIEPIEPDAIAEVIEQEDPDGVIAGLGGQTGLNVTAALAEQGVLDEHDVDVMGTPLDTIYATEDRDLFRQRMADLGQPVPASTTIALGDDETATDIDEGALRERVDDAVEAVGGLPVIARTTYTLGGSGSGVVHDFEALVDRVRTGLRLSRNAEVLVTESITGWVELEYEVMRDAGDSCIIVCNMENIDPMGIHTGESTVVTPSQIIPDDGHQEMRNAAVAVIRELGIQGGCNIQFAWRDDGTPGGEYRVVEVNPRVSRSSALASKATGYPIARVTAKVALGKRLHEIDNEITGQTTAAFEPAIDYVVTKVPRWPNDKFPEVDFELSTAMKSTGEAMAIGRTFEESLLKALRSSEYDPSVDWATVSDDELAADYLQRPSPDRPYAVFEAFERGFTVGDVNDHTGFREWYLQRFQNVAAASAAASEGDVATPAALGYTNSAVAALASDGGDVAVDDVAATAPERTFKQVDTCAGEFAASTPYYYSARSQGSTGSDVRADRDAHSVVIVGGGPIRIGQGVEFDYCTVHAVRALREAGIDAHVVNNNPETVSTDYDTSDGLFFEPITAEEVADVVEATNADGVMVQFGGQTSVDVGAPLEAELERRGLDCEIMGTDVDAMDLAEDRDRFNRLLDERDISQPDGGSATSVAGALELAAEVGYPVLVRPSYVLGGRAMEIVHDDDELRRYVEEAVRVSPEKPVLVDEFLADAVELDVDAVSDGEDVLVGGVMEHIESAGVHSGDSACVIPPRGLGDDILARVREVTTEIARALDTVGLLNVQLAVQDGEVYVLEANPRSSRTVPFVSKATGVPIAKLAAKVMAGESLADLDASEGVPEQYSVKEVVLPFDRLPGSDPRLGPEMKSTGEVMGTASDPGMAYWKAQVAASNAPVPGSTAVVDLLVEGLGERFEVVTVKDVPAAIRRGEVEFLVSDDRDALTAAVEAEIPYVSTVAAAEAMREGIAAADGAREAMPVADRPVNDETWG

SEQ ID NO: 66372 - protein, 183 aa, Zea mays
  misc_feature (175)..(175): Xaa can be any naturally occurring amino acid
TPDLVDFNWDDLGFQLIPTDFMYLMSCSSDGVFMNGKLVPYGSIELNPAAAVLNYGQGLLEGLRSHRKEDGSILLFRPHENARRMEIGADRLCMPAPSVEQFLEAVKLTVLANKHWVPPFGKGSLYIRPQLIGSGAMLGVAPAPQYTFIVFVCPVGHYFKGGLAPISLLTEEEYXCAAPGGTG

SEQ ID NO: 66373 - protein, 670 aa, Oryza sativa (indica cultivar-group)
MLRAVHVLAIAAAVLTLAPLAASYPWQACNGSSNYTANSAFQRNLGVLAAALPGNASTSPDLLANATVGGAPDTVYALAFCPPIDNQNASGCRACVASAFADARSLCPNNRGAHIIYDGCVLTFSGRDFLGAATNPADMERKLRNTENVTVSDVGEFNGAIYEVLNATADYTAAAARRFGTGEISFDPTYPVIYSMAWCTPDMAPGRCRACLADTIAQMHAYFNPNAQGARLVGVRCAARYEIYPFYTGRGMVQVPVSRPPAVPGTPGKKSKTGKILAIVLPIVAALLASAMICFCCWRRRTKATKLSLSYSSRSEDIQNIESLIMDLPTLRIATDNFAENNKLGEGGFGAVYKGSFPGGQTIAVKRLSQSSGQGIGELKNELVLIAKLQHKNLVRLVGVCLEQEEKLLVYEYMPNKSLDTFLFDPEKRKQIDWAKRFMIIKGITGGLQYLHEDSQLKIIHRDLKASNVLLDANMNPKISDFGLARLFGDDQSQETTNRVVGTYGYMAPEYALRGQYSIKSDVYSFGVLLLEIITGRKNSDSYNSEQAVDLLSLVWEHWAMKTITEMVDPYLRSDSSSLDEILRCIHVGLVCVQEDPMDRPTLSMINIMLDGNTVSAKAPSRPAFFTEMLGNINIGSSMYSQPYPVTDSTAKHSMAMSLNDVTVTEPEPR

SEQ ID NO: 66374 - protein, 647 aa, Oryza sativa (indica cultivar-group)
MHGGGARALAAAFVLALLAAAPAASEVVCSGRRYAANSSFDASLQQVARTLPGNASSSPLLFATLAVAGEAYALALCQGGTSAGSCNYCVAQTMRDGEHACAGDADVAMYDDICTVRFSDRDFLAATTNSPEKLVVAGSQSQKLVPSAAGRFYRLVGELLDATADYAVANSTARFATGDVGVGGYFDGEPFSKIYALAQCTPDLTPAQCRACLASAMEEMTRQVFAASSPGGKVIGERCGLRFEVFSFYTVDAMVHLQVAMEGKKKSTPVLAIVLPIVFAGLLTIIIVSFYIWRKKRLPTKTPLIENTEDLEDFESIFIDLSTLQSATSNFDESNRLGEGGFGVVFKGVFPDGQEVAVKRLSNCSNQGLGQLKNELSLVAKLQHKNLVRLIGVCLEEGEKVLVYEYMPNKSLDTVLFDPEKSKQLDWGKRYNILYGIARGLQYLHEHSQLKIIHRDLKASNILLDSDMKPKIADFGMAKIFGDDQTRNATSRVVGTLGYMSPEYAMRGQYSTKLDVFSFGVLVLEIVTGRRNSYAVVSEHCEDLFSLVWRHWNEGTVTEIVDPSLGNHYPRGDILKCINIGLLCVQQNPVDRPPMSAIILMLSSGTVTLQAPYRPAYIFGRNRSYTETMDVPLPSGPHSSITELEPR

SEQ ID NO: 66375 - protein, 84 aa, Glycine max
  misc_feature (23)..(23): Xaa can be any naturally occurring amino acid
  misc_feature (37)..(37): Xaa can be any naturally occurring amino acid
  misc_feature (47)..(47): Xaa can be any naturally occurring amino acid
  misc_feature (49)..(49): Xaa can be any naturally occurring amino acid
  misc_feature (57)..(59): Xaa can be any naturally occurring amino acid
  misc_feature (62)..(62): Xaa can be any naturally occurring amino acid
  misc_feature (73)..(73): Xaa can be any naturally occurring amino acid
  misc_feature (81)..(81): Xaa can be any naturally occurring amino acid
AEQDFLNMYFKDKYRPIPNVYNXLVLAMLWRHPENVXLDKVKGSKPXRXTGKEENMXXXDIXMLVKKWWDVYXDETLDYSXPLS

SEQ ID NO: 66376 - protein, 178 aa, Glycine max
MDNMACNKGQRLRKAKKKQVKDELDRLKQAEKKKRRLEKALATSAAIISELEKKKQKKKEEQQRLDEEGAAIAEAVALHVLLGEDSDDSCNVVINDCECKTWNYNHKLGLFMDERRACFPHLDGGTWSVSAESGKWSFTSGPLEKNVYEPLYEEAGWGPTGFSVDLIAACKAANFLLE

SEQ ID NO: 66377 - protein, 471 aa, Xanthomonas campestris pv. vesicatoria str. 85-10
MSSWLRRKSIDQVTVHETGRQLVRSLSWPHLIALGIGAIVGTGIYTLIGVGADKAGPAVLLSFVAAGIVCACAALAYAEMATMMPAAGSAYTYSYTALGESIAWVVGWSLVLEYSLVVSTVAVGWSGYFVGFLQWLGVGLPHELIAGPHAGGIVNLPAVVITFLVAGLLMAGTKESATLNAVLVVLKIIALGVFVAIALPAFNSANLQPFMPYGFSKAMGPDGVERGVMAAAAIIFFAFYGFDAISTAAEETKNPGRDLSIGIVGSMIGCTLIYVLVALAAVGAMSFTVFGKSPEPLALILRELGHGKAALVIGAVAIIALPTVLLAFLYGQSRIFFVMSRDGLLPRGLSKVNARTGTPVAITLFTAVLVAALAGVARLDEIAALANAGTLAAFTAVAACLLVLRVREPGRARAFRTPLAWVVGPVAIGGCLYLFWSLPSKTQVWFLLWNALGVVVYLAYGRRNSRLNQAG

SEQ ID NO: 66378 - protein, 532 aa, Synechococcus sp. RS9917
MSFPDFSASDAQTQWQRFCDLLWFHDDLGMWLDVSRMHVNSADLDALAPQFDQAFQAMQALEGGAIANADEQRQVGHYWLRHPQLAPSPDVADHISAEIDQIEQFGKAVIAGEIKAPNGAAFTDVLWIGIGGSGLGPLLMIRALQNQGEGLPFHFFDNVDPNGMSRVLAGLGEAIKTTLVITVSKSGGTPEPHLGMEQARHRLEACGGDWPGQAVAITMKNSHLDQQAQQEGWLQRFDMFDWVGGRTSITSAVGLVPGALIGANIRDFLAGAAQMDEATRLADLRRNPSALMAASWFVAGEGKGKRDMVVLPYRDRLEVFSRYLQQLVMESLGKRLDRSGAEVHQGIAVYGNKGSTDQHAYVQQLRDGVDNFFVTFIEELTDVEDIPEINGERPGDFLDGFLQGTRSALTEGGRQSISISMRHLDARRLGALIALFERAVGFYGELVNINAYHQPGVEAGKKAAAAILKLQGQVEALLADGVSRSAADVQQAIGASPVEPIFWILRHLCANKRGYIAQGSWDQPASLRFSKA

SEQ ID NO: 66379 - protein, 356 aa, Triticum aestivum
MAASDESPMVRPTVQELTAAGVEEPPRQYVLPEQDRHGDLLAADEFPEPTPLIDLSRLTDADEAERLRAALQTWGFFLATNHGIEDSLMDAMMSVSREFFRQPAEEKQKCSNLVDGNGKDYQVEGYGSDKVVSEDQVLNWSDRLHLRVEPEDERNFAKWPSHPESFRDVLQEYASRTKKIRDLVLRSIAELLEIDEDYFVNQISNKASGFARFNYYPPCPRPDLVLGLRAHSDGGLLTILFNDDTVGGLQVQRDGRWYNVSAKPHTLLINLADCLEIMNNGIFTSPIHRVVTNIKKDRLSLAVFYAVDAETMLEPAPGLLDDKRPPRYRKMLAKDFVAGLFEHFRQGKRFINTLKI

SEQ ID NO: 66380 - protein, 726 aa, Coprinopsis cinerea okayama7#130
MWLLSRLLSSVANMPDWIKFQTAPLALGFLTSAISVFWDYALRHFYLEAVIYDRDPSFTWMVTWITNHPAWSSTQSSFEISTSHSGVDDGPKPMPFPGDEELPEKPTDQGSLYLLPKPGSWYRIRHGSSVISFFIEAGSNDSFRVAKTLRLRIYSFNAKSLLRKIATEAKATYRSTVGKVPEVWFYRPGGFDPRWEVTSHKPRRAIDTVILEPGRSEAIVSDVKDFVSSGDWYRARGIPFRRGYLLHGPPGTGKTSIVGAIAGELGLDVYCLALSARDLDDEKLSKLVNRVPPQSILLIEDIDAAVSPAPRQHGARNENPHVNSPPGPMGPDSAPVMGPGQVDNSEAPRTGVTLAGLLNALDGVDSAEGRILFATTNYPDRLDSAIKRPGRMDRHFYIGLTTRPQAKELFKKFYPTFPKGSRSEFVASGSLDSIAEADDVNERLELETLATTFANIVPENTYAMAALQGYLLTYKSDPYGACNSDNFKQFMDELSTDLKAKGDDEQTGDTAGSRVSGAAPRSPPANLNLSLPDAEPTDRLVQVPWWNHALTSPWVTPPSSEPPVIPSPGSPVPYQCFSPSSMLSTSAPTSVAPGPSTGLRAFEDFEAEYEEMRSAVARMAVHIWDVDRGVSALARRLASASGDSEESLLLRSASRQPCRHPDVDDAMRNLLSKSVGDGESPRSREGGPVTQVVPATESTSRRSLDSDRLSYLDGLASLFGEGAQPE

SEQ ID NO: 66381 - protein, 295 aa, Coprinopsis cinerea okayama7#130
MSPSTTYSKSSATTAGRGYLNGSPLKSKSLASGVDGKAAGGMETLSLIEASKRLAAYTAVDQHVKPEHRIIGIGSGSTVPYVVDRIVQQGVELNAGRVFIPTGFQSRQLIVAAGLTLGDVDQYPTIDITIDGADEVDHNLNCVKGGGACHLREKVLAEAAHTFILVADYRKNVQFLGTNYLSGVPIEVVPFAYNKVLHNLHHSLGSPKAALRMAIKKAGPVVSDNGNFIIDAPFTQEQLADPYTVLAQIKMLTGVVEVGLFCKMAKAAYFGNEDGSVTVRWDDGRVEVVPSATSA

SEQ ID NO: 66382 - protein, 1681 aa, Coprinopsis cinerea okayama7#130
MAVADDTKADLLKVSILGKESIHCGFHLTPYIVQTVLTTLPSSTYVLITDDNIAKLHLNKFEEAFAKGIEKSAANPKPRFLSHVIPPGETSKSREGKARIEDFLLFHKCTRDSVILALGGGVIGDLVGFVAATFMRGVRFCQIPTTLLAMVDSSVGGKTAIDTPHGKNLIGAFWQPEYIFIDAAYLETLPTREFSNGMAEVVKTAAIWDEKEFTSLESRSAELFAAIQTPSTNYAGRTLETRSEAQKLLLSTIAASIGVKAHIVTIDERETGLRNLVNFGHSIGHAIEAVLTPTILHGECVSIGMILEAELSRQLGILTQVGVGRLTRCLKAYNLPTSLSAPLIASLPQASLLTVPRLLDIMRIDKKNSGTNKKIVLLKRIGETYEQKASIVEDKAIEKTLAEAVTVVPSIPTGNVKGSPGEVRMSTPGSKSISNRALVLAALAKGTCRLRNLLHSDDTQVMMAALHELKAHGGETLVVEGGEGTLTVPTPGKELYLGNAGTAARFLTTVCALAQPAPASVQPPSTNTVITGNARMKQRPIGPLVDALRANGCSIGYRESEGCLPLSIPPNSFKGGKIQLAASVSSQYVSSILLCAPYAQDANGVTLELVGGEVISQPYIDMTIAMMKTFGVEVTRRTDASGKLLDIYDIPRGTYVNPPVYNIESDASSATYPLAVAAITGTKCTIENIGSSSLQGDAKFAVEVLQKMGCEVHQTADETTVQGPPLGQLKAIEEVDMEVMTDAFLTASVLAAVANGGENKAMKITGIANQRVKECNRIRAMMDELAKFGVHTTEQELGLTIYAVPISQLKKNVSVHCYDDHRVAMAFSVLSTVVEGAIIEEKRCVEKTWPGWWDDLENKIGIKVEGVDLAGLRAESSSAGVKESKPIDNSSILLIGMRGTGKTHIGQLAAASLPGWSFVDADHYFESKLKTGVKDFVKNEGWEKFREEELAVLAELIGLGVDGKAVSSPSSYSKNHVISLGGGIVETPAARSLLKAYLAKGGRVVHITRPIDEIVRYLNVETARPAYEEPILDVWKRREPWYKECSGWEFGNVVVEAPQGQAQAANVEAGPGKTKCVKTLAGRNEVKRFFGHLAGINPNFTHGGSVEGQQRRTYFLCLTYPDVRHAFPYIDELTEGADALELRVDLLKDAKAPEAPFPSVAYVKDQVTALRRVTGLPIIYTVRTKAQGGAFPDGNAKEYKELVEAGVRLGVEYLDVEVASIFSDKEVADLSKRTKKAGSTLVIASWHDWSGKMQWDGEDVKRKYDEARKFGDLVKIVGKAEKLEDNFKLLSFVKSATSLPNSPPIIAINMSTLGQSSRILNTTFTPVSHPLLPTKAAPGQLSFKQIQQALHLLGLLPSKHFHLFGTPIAHSMSPTLHNTGFELLGLPFKYGLLESKEVDCKEVRDVISDKEGFGGASVTIPFKVDVIELLDELTESAKEIGAVNTIIPVHRSSINAQGQEETTRVLVGDNTDWVGIRVCITQRVSEGELRNENTSGLVIGAGGTARAAIYALQDLGVPVIYLFNRTKEKAEDLAKAFVGGADKKWNGQLVVLDKLGGGWGDVGVAPRVIVSTVPASATALPSASTAAIAGQVDKSTNQIVLPADVFAYTSGSAVVVDMAYKPAETPLLKLAKELKEEGNWACVQGLEVLLEQGYIQFEKWTGRRCPKEQVSTRVWEKYGEV

SEQ ID NO: 66383 - protein, 260 aa, Candida glabrata CBS 138
MEGGRREIEGRRHFLKRNMVAEITNQDQFTELTTQNVQDKLIAIYFHTSWAEPCKAISELYRAISEDESNKDVSFLAVDADEQAEIAELFEISAVPYFVLIRNGTILKELSGANPKEFLAALEECRRAGTESKSKESNGAVEDDEDSEDSEEETEEEMNMRLTKLVNAAPVMLFMKGNPSEPKCGFSRQIVGILREHQIRFGFFDILRDDTVRTNLKKFSDWPTFPQLYINGEFQGGLDIIKESLEEDPDFFQHTIRVNN

SEQ ID NO: 66384 - protein, 395 aa, Ustilago maydis 521
MTTRTATSTSTTVHGHLGDLKLRNAAITGPHLQPKAAKQDLADTKPDSARTFPGLGFKLSPTEERLRAKRNWGFLETAYDNSKVMGLTTHFVTITMAIVFNKSWLAKPVYDWLNTYDRFTIHTVHTWILLSTCQLLVIGLFALTDLSGRPSWLARYRMQPHKPPTLAQYKKLIPVVLFNLVVVNTISNIIYYPLAEWRGIQTTYETLPSGKKLVAQWLVCLLMEDIGFYTVHRALHHPRIYKYIHKKHHEFSAPIAGASTYAHPLEHYFSNLVPILVGLLITRAHISVQYLFFTGLMIGSHVQHSGYNRFANYCAVRVAPVPFLTCALVHDWHHYFNTENYGPVGLLDAIFKTNKTFKAWTSETVAAFHGDRAKARQAALEKLAQIEAEEQERIR

SEQ ID NO: 66385 - protein, 397 aa, Rhodospirillum rubrum ATCC 11170
MASFKTIDDLDVNGKRVLVRADLNVPIRDGVVTDTTRIDRSAETILALASRGACVVVCSHFGRPKGKRVPEMSLRPIVEPLSRALGGVPVAFAEDCVGPAAELVVNGLAPGEVALLENLRFHDEEEKNDPAFAQKLADLCDLYVNDAFSSAHRAHASTEYIARLVPAAAGRLMQAELEALGKALDNPERPVAAIVGGAKVSTKLELLGNLVSKVDMIIIGGGMANTFLFAQGIEIGASLCEKDMADTARAILEKAAAAKCEIVLPIDAVVASAFKEGAENHVVAIDAVPADKMILDVGPQTAQAVIAKLGECKTLVWNGPFGAFEIKPFDAATNTVAQAAAQATAEGRLLTVAGGGDTVSALANAGVEDKFSYVSTAGGAFLEWLEGKTLPGVAALL

SEQ ID NO: 66386 - protein, 305 aa, Halobacterium sp. NRC-1
MVDVDSFVEDARAEISEALGDETAIIALSGGVDSSTAAALAYEAVGDQLVPVYVDTGLMRKGETDEIREVFDYMDSLRVVDASDRFFDELAGVTDPEEKRHAIGEQFIREFETVAEEVDATQLVQGTIYPDRIESEGTIKSHHNVGGLPERVGFEGIVEPMRDLYKDEVREVARHLGLEEIISERMPFPGPGLAVRVIGEVTPEKVAVCREATHIVEDELEAYEPWQAFAAVLGRATGVKGDNRVHGHVVAVRSVESRDGMTARAQELEWETLQRLQSRIAGTIDEVSRVVYDVTHKPPATIEYE

SEQ ID NO: 66387 - protein, 335 aa, Rhodospirillum rubrum ATCC 11170
MAVRVAINGFGRIGRLVLRALVESGRKDVEVVAINDLGSPEANAHLIKFDSVHGVLPGDVSVSGDVMTIAGTPVKVLAERDPTKLPWGDLNIDIVMECTGIFSDREKAKVHLEAGAKRVLVSAPSNGADLTVVYGVNHDKLTKDHLVVSNASCTTNCLAPVAQVLHSVFGIEHGFMTTIHSYTGDQRTVDTLHKDLHRARAAAVSMIPTTTGAAKAVGLVLPELAGKLDGTSIRVPTPNVSVVDLKVVLSKTATAEAIGAAMKEAAAGKLKGVLGINELPLVSIDFNHNKNSSTFDLPQTKVVQGTFARVLSWYDNEWGFSNRMLDTAVEMGKLI

SEQ ID NO: 66388 - protein, 224 aa, Candida glabrata CBS 138
MRLFQNTCEFAYPWDQVTAANWNKYPNEVSTHVVAVDVLRRELSASGRQLVTERLITVKQSVPRWVLLVVGASKQSYVREVSTVDLDTRTLTMRSCNLTFWNIMKVYETVKYMPDAVNPDKTVFKQEAQISVCGTLGRFCNKVEEWSVQRFGENAKKGKMGFDLVLKVFNEHWNQINSDIENVFNETVEDVRSTAGNLIKETERTYSNILGTNQEIFSEAFNKK

SEQ ID NO: 66389 - protein, 392 aa, Synechococcus sp. CC9311
MPGPPSLSHRALALQPSLTLAISARAKALQQKGVDVCSLSAGEPDFGTPDFIVEASIQALRDGITRYGPAAGDPELRAAIAQKLSLENNIPTKTDQVLVTNGGKQAIYNLFQVLLNPGDEVIIPAPFWLSYPEIVRLAGGNPVTVPSSASDGFGLDLNKIEQSITPLTKVLVLNSPGNPTGRVLCLSELEALAELVRRHPHLMVMSDEIYEYLLEEGESHHSFAAVAPDLRERCFVVNGFAKGWAMTGWRLGYLSGDSTVIKAAAALQSQSTSNVCSFAQRGALAALQGSRDCIRAMAASYNTRRAELCNGLQQMKGITLVPPRGAFYAFPRLPDSITDSLAFCERALEEEGLAIVPGGAFGDDRCVRLSCAVSRETISDGLSRFQNLLTRR

SEQ ID NO: 66390 - protein, 306 aa, Lactobacillus plantarum WCFS1
MNKVTVLGSLNVDSILRFKRFPKPGETLPLTGKSVAGGGKGANQAIAAARAGAQTTFIGKVGTDQEGAFMVQQLTNSGVNDQYVQHSNVASTGSAFILLDSSSENRILIDGGTNQQVTAEDVERAQPAISASTFLIAQFETPIAATIRGFELAQAAGQKTILNPAPATTTVPAELLATTDLIVPNETETETLTGVHITDEQSMIQGAQKLQALGVANVIITVGSKGAFWMRGAEHGFVPAYKVEAVDTTAAGDTFIGALSSVLMPDFSNLAAAVRFANRASSIAVQKLGAQPSIPTKEAIEAAERA

SEQ ID NO: 66391 - protein, 184 aa, Medicago truncatula
MATSSIKKEVYSVWAIPPEDVRDRLTKLMTSLRSDFGGPQFEPHMTVVGAIELTPDDALKKLRSASEGVKSFQVTVDRVSAGTFFYQCVYLLLHPTPQILETNAHCCTHFGYKNSTPYMPHVSLVYGDLTDEEKQKAQERANILDNSLSGLSFQISKLALYKTDTEDKSLKSWEKIAECTLTPN

SEQ ID NO: 66392 - protein, 274 aa, Zea mays
  misc_feature (137)..(137): Xaa can be any naturally occurring amino acid
RGRPGYCWRERERERERERERERERERRLRRWNQAMGDADAYAKRVLLTAAGDTVSRGIASTLTKHGCRLVLLGDEGALAATEEEARRCGVGGGCVELVGLDFKACGEAAADAAVDRAWRCFAGLDAFVNCYSYEGXAKRFQDTKSGGSIVFLTQIIGAERGLYPGAAAYGTSLGAIHQLVRLCAMELGKHKIRVNAACRGLHLQDKFPVSVGKEKAEKATAEVMPLRRWLDPEKDLASTVLYLVGDESRYMTGTTIFVDGAQSIVRPRLRSFM

SEQ ID NO: 66393 - protein, 665 aa, Aspergillus nidulans FGSC A4
MTVAMLLENVVASAKAYFEKQKERHITPLPLKLATPVPSDIAISRSQYPKPITQVASEIGIASHELEPYGHTKAKVSLEVLNRLSHRRNGRYILVCGITPTPLGEGKSTTTLGLSQALGAHLNRVAFANVRQPSQGPTFGIKGGAAGGGYSQVIPMDEFNLHLTGDIHAITAANNLLAAAIETRMFHEATQKDAALYKRLVPEKKGKREFKPIMFKRLKKLGINKTDPNELTEEEINRFARLDIDPSTITWRRVLDVNDRHLRGITVGQAPTEKGLTRETGFDISVASECMAILALSSDLADMRERLGRMVVATSKRGEPVTCDDIGAGGALAALMKDAIKPNLMQSLEGTPVLVHAGPFANISIGASSVLADRVALKLAGTEPEEDHEAKTGFVVTEAGFDFTMGGERFFNIKCRSSGLSPDTVVIVATVRALKVHGGGPEISPGAPLHEVYRTENTEILRKGCVNLKKHIENARQYGVPVVVAINRFETDTEAEIAIIREEAISAGAEDAVSANHWAEGGAGAVDLAKAVIIASSKPKDFKLLYDLNGSIQERIERIGKAMYGAEKVEFSELAQKKVDTYTAQGFSNLPICIAKTQYSLSHDPALKGAPTGFTVPIRDVRLAVGGGYLYALAADIQTIPGLPTAPGYLNVDIDPETGEIDGLF

SEQ ID NO: 66394 - protein, 356 aa, Triticum aestivum
  misc_feature (277)..(277): Xaa can be any naturally occurring amino acid
MVGGGEFKGTMVQQMVCGGTSNANIIMSGLMPCAEEEQEESTNMPLMSSSPSMACSHDHQLLYHSSGQVPDVRDSAATSPASFQGGQEESQMPESWSQMLLGGLVGDHESDLLSKGLEEGPMAARAGAPAYSFYGHGGGEEIQASGPNSRLSQMLLAFSPRSCITSNLDGGLLDFSNGTAPAPAPELWNQQSDNSSESNSTATASAPKKARVQAASSSGQSILKVRKEKLGDRITALHQIVSPFGKTDTASVLQETIGYIGFLLGQIEALSYPYLGXGTGASVRHQAQLNHGDHINASAEAARPQQDAQDGEGKKSDLRSRGMCLVPVSCITSRLGADSASDFWQPAPPLTGIILR

SEQ ID NO: 66395 - protein, 1635 aa, Mycosphaerella graminicola
MATGGSASTPIVGDYNPERVEQLFDIPRPEQGNIYVEAENAARTPSGAQESQLSGSTPGINTADHADDSYLTANGREAAESINDDKKSSGFNSDDDQPINAEERNILRRLATNSRRSMNNTNEDPEALQRTGTLDGLGMDDPVFDPNSPRFDLYKWLKLTLKLVNDEDIKIKRSGLAFKDLHVSGSGSALNLQPTVSSMLSAPLRIGEMFSMAKKPHKQILRSFDGLMKSGELLIVLGRPGSGCSTLLKSLTGQMHGLTMDEKTTIHYNGIDQKQMIKEFQGEVIYNQEVDKHFPHLTVGQTLEHAAALRMSQQRPLGTSRQSAVEYLTQVVMAVYGLSHTYNTKVGNDFVRGVSGGERKRVSIAEMALAGSALAAWDNSTRGLDSATALTFIKALRLNADLVGSAHAVAIYQASQAIYDLFDKAIVLYEGREIFFGKASVAKKYFEDMGFYCPSRQTTGDFLTSVTNPAERQLREGYEDRAPRTGDDFEKYWHDSPEYQTLQKEIQGHTKEGSTPSATSSGTSKLSAASKNDNQAKHARPKSPYVVSVPMQIKLNTKRSWQRIWGDKAQTFTPMIFNVIIALIIGSIFFNSPPATSAFTARGAVLFFAILINALSAISEINSLYDQRPIVEKHKSYAFYHPATEAIAGIVMDVPLKFVVAVCFNLVLYFMSGLRREPAQFFLFFLIAFVSTFVMSAVFRTLAALTKTISQAMALSGVMVLALVIYTGFVVPTKYMKPWFGWIRWINPIFYAFEILVANEFHAREFECSQFIPTYTQFGGETFICSVVGAVAGELTVTGDAYIAEMYGYYYSHVWRNFGILLAFFFAFMVIYFVAVELNSSTFSTAEVLVFRRGHVPAYMQNIDKPGKEDGEAAAAEKGPEKGDEGGDVSAIPPQTDIFTWRDVDYDIEIKGEPRRLLDHVSGWVKPGTLTALMGTSGAGKTTLLDVLAQRTTMGVVTGNMFVNGAPLDDSFQRKTGYVQQQDLHLETSTVRESLRFSAMLRQPRTVSKQEKYEYVEEVIKMLNMEDFAEAVVGVPGEGLNVEQRKLLTIGVELAAKPKLLLFLDEPTSGLDSQSAWAICAFLRKLADAGQAVLCTIHQPSAILFQEFDRLLFLRKGGHTVYFGDIGKNSRTLLDYFESNGARDCGEEENPAEYMLEIVGDDSSDWVGTWNDSKEARRGTAGDRTHSQGTLLRGEELDRRQRRPLRPRRIRHAFRRPTQDGHSPRVPTILAYAELPVRENGSLHRRWSLHRFLLLLRDATLQGMQNVIYSLFMLTTIFSTLVQQIQPLFVTQRSLYEVRERPSKAYSWKAFLIANMVVEIPYQIIAGILVYATFYYPVVGIQSSERQVLVMLLCIVLFVYASTFAHMCIAAMPDAQTAGAIVTFLFFMALIFNGVMQPPSALPGFWIFMYRVSPFTYWVASMASAMLHDRQVTCSDTEISTFQPPQGQTCGQYMQPYLEGGAAGYLQNPDATADCGYCSIRVADTFLSGVGISWSNRWRDFGLVWVYVFFNLGMAVFLYWFFRVRSHSKKTSKKSKKSGDKKGAAAVAGTEKDDKKVKKTDTSSSSEGNTPAAASVDPEKDAEAQRSGSTTSAKAVKRQTSRTAGLTRTVSEMGQSVLTTNKGRSRANERNAHVY

SEQ ID NO: 66396 - protein, 472 aa, Roseovarius nubinhibens ISM
MQTNMLINGEMVAGQGAALPVLDPATGTQVAEVAEATPEQIAAATRAAHEAFESYRLSTPSERAAHLLAVADVIEANIEELAELETLDVGKPWPMARDEEMPLTIDTFRFLAGAARTMGGSAAGEYVAGHTSMIRRDPIGPVASIAPWNYPLMMAAWKIAAPLAAGCTMVLKPSEITPLATLRLAELLADVLPRGVLNVIHGGGASVGDALINDPRMEGISITGSPATGMAAMRAASRQIRHVHLELGGKAPVIVLGDADIGALAETIRYGSFFNAGQDCAQPCRLMVEASVYDKVLQAVTDQVGQIRIGAPRAEGTEMGPIVSEIQRDRVAGFIDRARGHAEIATGGASGEGPGYFYQPTVVANVDNDAEIAASEVFGPVVTLSRIKDADEALRIANAAPYGLASSVWTRDLSAAMRLSSQLRYGMTWVNTHGVPTPEMPWAAMKGSGTGCDMSIYALDAYTSVRHVMVAH

SEQ ID NO: 66397 - protein, 329 aa, Burkholderia xenovorans LB400
MPVTRIPIIDLAGVRAGDPQALQRVAQEIREACTTIGFFYIVNHGVPQALIDAAAQAARRFFAFPVETKRRAAVNHRHRGFNALGDATMYQAKRPDYKEFFSIGLELPEDDPDVLAGQALRGPNNWPDFMPELRPALYGYYEAVGACGADLLRAVAVSLGVEEQFFAPRYTKRMQRTQMVYYPPQPPQSDEDQFGVAPHTDYGCITLLWQDQVGGLQVREIANDTWVDAPPVEGSFVVNVGDLLARWTNDRFRSTLHRVINASGRERYSIATFYDPTYGARVDPRDLGTNETDLKYQPVAAGDYILGRINDSMGYRKKRAAEGAQGTPA

SEQ ID NO: 66398 - protein, 319 aa, Arabidopsis thaliana
MEKEADNKFRWVIKNFSSLGSERVFSDIFVVGSCKWRLMAYPKGVRDNRCFSLFLVVTDFKTLPCDWKRHTRLRLNVVNQLSEELSILKETQMWFDQKTPAWGFLAMLPLTELKAENGGFLVNEEVKIVVEVDVVEALGKLEESEEATQPLKKVKLEAFVESKGLLKETSSVKEEIIDVNVFHVLPSQVEFVSRVFERYPEIASIFQAKKQHLRTACMYVLLSLIETLCKSLEELSNDDLVGGDNALQYLKFSGFKVDWLEKKLEEVKEKKKEEQIGETRMQEMKVFKQKCSDIEALMEREKSKLLVTRGSPLTLDDVL

SEQ ID NO: 66399 - protein, 223 aa, Streptococcus agalactiae 2603V/R
MDELKKLAGVTAAKYVKNGMIVGLGTGSTAYFFVEEIGRRVKEEGLQVVGVTTSNRTTEQARGLGIPLKSADDIDVIDVTVDGADEVDPDFNGIKGGGGALLMEKIVATPTKEYIWVVDESKLVETLGAFKLPVEVVRYGSERLFRVFKSKGYCPSFRETEGDRFITDMGNYIIDLDLKKIEDPKQLANELDHTVGVVEHGLFNGMVNKVIVAGKNGLDILEK

SEQ ID NO: 66400 - protein, 402 aa, Synechococcus sp. CC9311
MAKRSLAKLNTSDLSGKRVLVRVDFNVPLNDAGAITDDTRIRAALPTINDLIGKGAKVILAAHFGRPKGQVNDKMRLTPVATRLSELLSKPVTKTESCIGPDAEAKVNAMANGDVVLLENVRFFAEEEKNDADFAKQLAGLADVYVNDAFGAAHRAHASTEGVTKFLKPSVAGFLMEKELQYLQGAVDEPKRPLAAIVGGSKVSSKIGVLEALIDKCDKVLIGGGMIFTFYKARGLAVGKSLVEEDKLELAKELEAKAKAKGVELLLPTDVLLADNFAPDANSQVADVTAIPDGWMGLDIGPDAIKVFQAALADCKTVIWNGPMGVFEFDKFAAGTNAIATTLAELSGKGCCTIIGGGDSVAAVEKAGLAEKMSHISTGGGASLELLEGKVLPGVAALDDAA

SEQ ID NO: 66401 - protein, 250 aa, Pisum sativum
DDEMLVDGFRRCEKWMRSDIVDSKGSKTTSWFKRFIGREQKPEVTWPFPFAEGRMFVLTLRAGVDGYHVNVGGRHMTSFPYRTGFTLEDATGLAVKGDLDVHSVFATSLPTSHPSFSPQRVLEMSETWKASALPEDTIKLFIGVLSASNHFAERMAVRKTWMQAAEIKSSDVVVRFFVAMNPRKEVNAVLRKEAAYFGDIVILPFMDRYELVVLKTIAICEFGTKNVTAAYIMKCDDDTFIRVGHCPEGN

SEQ ID NO: 66402 - protein, 541 aa, Ustilago maydis 521
MISLVQHSFDFFETRLGLAVGFIITLALVYRDRAVFVAKCDHIKGPPGLPLLGNTLQVFKEAADPLQAMLSRSAVYGLPNTMTVLGMGRAINITRPDWIQHVQKTNFSNYVKGPKLHTCLKDLLGDGIFNADGHSWKAQRKVGSNIMTMSNLKNLVAGVLDAQSQRFSDLLQQAAKQGTPIDLQKAYFDFTIQTFLRIAFSTDLETVQSTRIATRSEQQKAAQHLSFADAFDLAQRLTVRRINRPWWKLTRRWEPSEKKLEHAIRTIDRYLYPLIERRSQNKSKADKRHADLLDLFLSYRDDQDQPLTPKQLRDALLNYLLAGRDTTAESLSWASFELLRHPEVVHDLRQELMSHSIWFDPHQKIDDDDAEQRSSSFELSHTKQLHHVRSIYHESLRLHPSVPRSSKIALQDDVLPGGVVVPKDTTVIWSDWLLARNKSVWGDDADEWKPRRWLNAEGEFINESPWKFHAFNGGPRTCLGIQLAQFQGMYMLSRIFSDFDLELESDRGLHFEPEVENTLTLPMKHPLMVRVYTRAKTSRAP

SEQ ID NO: 66403 - protein, 354 aa, Botryotinia fuckeliana
MAEFVRAQIFGTTFEITSRYSDLQPVGMGAFGLVCSAKDNLTGSNVAVKKIMKPFSTPVLSKRTYRELKLLKHLKHENVISLSDIFISPLEDIYFVTELLGTDLHRLLTSRPLEKQFIQYFLYQILRGLKYVHSAGVVHRDLKPSNILVNENCDLKICDFGLARIQDPQMTGYVSTRYYRAPEIMLTWQKYDVEVDVWSAGCIFAEMLEGKPLFPGKDHVNQFSIITELLGTPPDDVIHTIASENTLRFVQSLPKRERQPLASKFTQADPLAIDLLEKMLVFDPRARIKAAEGLAHEYLSPYHDPTDEPAAEERFDWSFNDADLPVDTWKIMMYSEILDYHNVINDAQNLTESQ

SEQ ID NO: 66404 - protein, 658 aa, Rhodospirillum rubrum ATCC 11170
MCGLTGYWTRGGDGRGRGEMTALVLRMAGALAHRGPDGDGAWVDEDAGLALGHRRLSIVDLSPAGQQPMVSADGRLALAYNGEIYNAAELRPELEAAGIVFRGHSDTEVLLEGFARWGVVPTLRRAIGMFAFALWDRKERRLTLGRDRLGIKPLYVADHGGTLLFASQPKGMMPHPSWRGEVDREGLAAMLRLSCLPAPRSIFKGVSQLAPGTVVRFEADGRRSEEVFWSLEEVAARGVAQARSQPARPESASLAVEHLESLLLDAVRRRLIADVPVGAFLSGGVDSSTVVALMRKVASGPVKTFSIGFAEEGWDESVHAAAVARHLGTDHRELVVSPDEVPAIVGDLPRWYDEPFADASQIPTLLVSKLARSEVTVSLSGDGGDELFAGYNRHVQGQRLWDLAQRIPTVGRDLGAALIEAPSPGFWQRAVGLLPAGRRPPQAADKPAKIARLLRARSPEALYRTLVGAMPSAEVPLAGVSLAAEERWYAASAEGVDSFVDRMRLLDAKGYLPDDILTKVDRASMAYGLEARVPLLDHRVVEFAWSLPPEMLIREGQGKWLLRRVLHRHVPRALIERPKMGFGVPLAAWLRGPLRGWAEDLLDPQTMAVQGLIDPAPVRRWWLDHLAGRRDTHDRLWPVLSALSWHHHWKSAGAFTAA

SEQ ID NO: 66405 - protein, 88 aa, Glycine max
  misc_feature (46)..(46): Xaa can be any naturally occurring amino acid
  misc_feature (59)..(59): Xaa can be any naturally occurring amino acid
  misc_feature (66)..(66): Xaa can be any naturally occurring amino acid
QKDKLLGGLLADGFDEQSCLSRYHSATYSKGLSGNPSSDLISRLRXYEALHKKCGPFTXCYRIQCXGHVSQSPECKYVVWISYSGLGN

SEQ ID NO: 66406 - protein, 586 aa, Medicago truncatula
MEEELVDGKVDWKGRRAVRHKHGGMKVSLVILGAFALENMATFALAVNFVSYFVGFMHYELADAANMVTNFMGVCYMLSIVVAVFADTWIGRHKSVLISGCFEFLGLALLTVQAHYPNLKPAICNLYDKNAVCEKISGNHEAFLLIGLYLLAFGSAGLKASLPAHGADQFDEKDPKETRQMSSFFNGLLLAICVGGSVSLTFNVWIQDNKGWDLGLGISTIAIVFAMITFAFGLPLYRIHVAQRTNPIVEILQVYIAAIRNRNLSLPADSGELYEIEQDKEALMEIEYLPHRDIYRFLDKAAIERKSDVQLEKQENPSPWKLCRVTQVENAKIFLSMIPVFFCTIIMTLCLAQLQTFSVQQGFTMDTRITKHFNIPPASLPIIPVVFLIFIIPFYDRICVPLLRKFTGIPTGITHLQRIGVGLILSCISMAIAAIIEVKRKNVARDNNMLDAVPGVQPLPLSIFWLSFQYFVFGIADMFTYVGLLEFFYSEAPKGLKSTSTCFLWSSMALGYFLSSIMVQIVNSATKNVTASGGWLAGNNINRNHLNLFYLLLSLLSLINFFVYLVVSKRYKYRPQGHAIKGVDSQ

SEQ ID NO: 66407 - protein, 544 aa, Aspergillus nidulans FGSC A4
MASLSPAQSGGASAPQSVEKISRLAQDYKFNPAVPLRYWLRTAATLVREARIYLREGHDEQAYLLLFRHAQLVLVHLADHPDLKDGKDVREERKALIAAEKEVKQNLEILEKLKPRINKRYERHTQLMRERQSRMSSSAAVSPAASSQPSPPPDPALSGVAEPLEAGKDNELAVKLARTEISRRATVRNAMRQGGLSGEDDSSRRAAGIWGDWEEALQRNERRDPDDLSRRIQEVRLNLEGRPQISSKSVTRPLADVSSTPTYKYPTVPRQKALDVPSVPVDIPKTEARELTKPPVLPPKESFQTSQPSGLELPPRPDKISQAVPPASAAAVPTKVPGDDKRKGLDPSSFTFKPSAYLENGTPLRTVFLPPQLRSHFLSLAASNTRKNLETCGILCGTLISNALFISRLLIPEQISTSDTCETVNESAIFDYCDSEDLMVLGWIHTHPTQTCFMSSRDLHTHCGYQVMLPESIAIVCAPSQTPNWGVFRLTDPPGLKSVLSCTQTGLFHPHAETNLYTDALRPGHVFEANGLEFETVDQRVNKS

SEQ ID NO: 66408 - protein, 305 aa, Synechococcus sp. RS9917
MHQFLPYAWFEGRCIPFSEAKVSVATHALHYGTGAFGGMRAIPDPQRADHVLLFRADRHARRLSQSARLLLTDLSETTVMEALTAMLRANRPTTPIYLRPFVYTSDLGIAPRLHNIETDFLIYGLELGDYLSPEGVSCRISSWTRQEDRSLPLRGKISGAYITSSLAKTEAVLSGFDEALLLNSRGKISEASGMNLFIVRDGVLITPGVDQDILEGITRASVIELARSMGITVVERPVDKTELFIADEVFLTGTAAKITPVRQLESTTLSSERPLMHALRERLVAITEGRDPDYEHWVTRIDLNG

SEQ ID NO: 66409 - protein, 506 aa, Zea mays
MLPSFVSPTASAAASVTPPPRPIPGSYGPPVLGPLRDRLDYFWFQSQDEFFRKRAAAHRSTVFRTNIPPTFPFFVGVDPRVVAIVDAAAFTALFDPDLVDKRDILIGPYNPGAGFTGGTRVGVYLDTQEEEHARVKTFAMDLLHRSARTWSADFRASVGAMLDAVDAEFGKDDGSDKKPSASYLVPLQQCIFRFLCKAFVGADPSADWLVDNFGFTILDIWLALQILPTQKIGLVQPLEELLIHSFPLPSFLIWPGYYVLYRFIEKHGAEAVAYAEAQHGIGKKDAINNILFVLGFNAFGGFSVFLPFLVAKVGGAPALRERLRDEVRRAMVGKDGDGDGEFGFATVREGMPLVRSTVYEMLRMQPPVPLQFGRARRDFVLRSHGGAAYQVTAGEVLCGYQPLAMRDPEVFERPEEFVPERFLGDEGARLLQHLFWSNGPETAQPGPGNKQCAAKEVVVDTACMLLAELFRRYDDFEVEGTSFTKLVKRQASPSVAQAAAAAGAQQ

SEQ ID NO: 66410 - protein, 494 aa, Ammi majus
MKMLEQNPQYLYFFSLFLVTIFLYKWLTLKKTPLKNLPPSPPQYPIIGNLHQIGPDPQASLRDLAQKYGPLMFLKFGTVPVLVVSSADAAREALKTHDLVFADRPYSSVANKIFYNGKDMVFARYTEYWRQVKSICVTQLLSNKRVNSFHYVREEEVDLLVQNLENSHSKVANLTELLIEVTGNVVCRVSVGSGDKVDSYKILILEIMDMLGYSRSIEDFFPLLGWVDWLTGLRGKVAEAAKGVDTFLEGVLKEHLSTTGSKYNDFVSILLEIQEADAGSSMDNECIKSLIWDMLGAGTETISTALEWTLAALIKNPDAMFKLQNEVREIGKGKSKISEADLVKMNYLQAVMKESMRLYFTAPLLVPREARQDIKFMGYDISSGTQVLINAWAIARDPLLWDKPEEFRPERFLNSPIDYKGFHYEFLPFGAGRRGCPGIQFAMCINELVVANLVHKFNFELPDGKRLEDLDMTAASGITLRKKSPLLVVARPHV

SEQ ID NO: 66411 - protein, 796 aa, Aspergillus nidulans FGSC A4
MFMLRNVSKFIFGDNSKESIIDIPQGQLYLVRPLSPKGYSELIFKDAAASIRRTGQEFQYQLVIQRAYEEGEEELAEDESGEGLSDSLDKDEKAFLLDQNLHFRSEVREGGSKILAWRDLSGDAGDLFEFICDPSVPSDKVSTFELAACQCQYERKYRRSAQKATQEELLEFSFDEERPIPSASPVASPTKTRAHSVASADSTMVRDAEYTRSKKQLAAPALGDEPTVAPPSAAQPEAREVLTKERAELHLFDFQSGTFVMQDPDVTATVTEVGDWQYWLQISGKDKDWLGQAVVADINPVFNFEYLSFIFNHYDGIGSAYSWLLRFKDQETEERFQQGLLQALWEQLNETKWTKVKDNDKDYVLDAFQDLTMEDADAADQEEEEEEEEEEEEANDGQRSEHYDSDEEQDDVVTRDEDGNINSQLAVGYKHDRSFVVRGSKIGVFKHTPDNNLEFSTNISKVETPKGKLFSPKKVMLHAEDSNLILQNGDDPKSLYRMDLEYGKIIDEWKIHDDIPVQTFAPESKFSQMTSAQPFVAASHNALFRVDPRVAGNKLVDAELKQYASKNDFSALATTEKGYLAVASNKGDIRMFDRLGINAKTHIPALGEAIIGLDVSADGRWVLATCRTYLLLIDALQKDGKNEGKLGFERSFAKDSKPQPRRLGLTPAHVAQFQHETKKPISFTPARFNTGVDTEETSIVTATGPFIVTWSLKKVVAGRKDPYTIKRYSEDVMADNFRFGSDKNVIVALPNEVNMVARKALQRPTRESIAGPVTPSRRATRWGSRLGRDDIVNSPY

SEQ ID NO: 66412 - protein, 509 aa, Ammi majus
MALFLYLIIPCTIILLHQLYHKLRFKLPPGPRPWPIVGNLYDIEPVRFRCFNNWSKTYGPIISVWFGSTLNVIVNNTELAKEVLKDKDQQLADRHRSRSAAKFSRDGQDLIWADYGPHYVKVRKVCTLELFTPKRLEAIRPVREDEVTAMVESIYKDCTNSDTIGKSLLVRQYLGGVAFNNITRLAFGKRFVNSEGVMDEQGKEFKSIIANGLKLGASLATAEHIQWLRWLFPLEEEAFAKHGARRDNLTRAIMEEHTLARQKSGGTKQHFVDALLTLQSKYDLSEDTIIGLLWDMITAGADTTAIVVEWGMAELIKNPRVQEKAQEELDRVIGYERVLTELDFSNLPYLQCVAKEALRLHPPTPLMLPHRANANVKIGGYDIPKGSNVHVNVWAVARDPAVWKNPLEFRPERFLEEDVDMKGHDYRLLPFGAGRRVCPGAQLGINLVTSMLGHLLHHYSWAPPSGLSSDEIDMSESPGMVTYMKTPLQAVPTPRLPSQLYKRLAVEDM

SEQ ID NO: 66413 - protein, 478 aa, Roseovarius nubinhibens ISM
MYSYPELKLFINGEWRGAAEDMAVVNPATEEELGRLPKAGISDLQEALAAAEQGLRLWSRTPPRARADIILRAAALMRERQEEIAQSITAEHGKPLPQARLEVIRGVEFFEWDAGEAMRVYGRVIPAAPGSHISVHHHPIGVVAAFSPWNFPMSQPARKIAGALASGCSIILKAAEETPAGAIHIVRAFEDAGLPAGVLNLIFGTPSEISGYLIPQPSVRLVALTGSTAVGRQLTALAAQSDTRVLMELGGHAPVIVCEDTDVERAAISGAVRKMRNAGQVCTSPTRFFIHQDIFEQFAEAFTRRAAATVVGNGVEPGVEMGPLANDRRVPVLSALVEDAVAKGAELRCGGAAMGERGYFFAPTVLANVPDNARIMQEEPFGPIAILNPVRDLDEAIARANAVPYGLAGYGFTNRADYMARLVDEVEVGNLSINTLEASLPETPFGGVKASGYGREGGTEGLESYLTIKNVWHSAEIR

SEQ ID NO: 66414 - protein, 255 aa, Triticum aestivum
  misc_feature (172)..(172): Xaa can be any naturally occurring amino acid
  misc_feature (217)..(217): Xaa can be any naturally occurring amino acid
MGRKFFVGGNWKCNGTVEQVESIVNTLNAGQIASTDVVEVVVSPPYVFLPTVKGKLRPEIQVAAQNCWVKKGGAFTGEVSAEMLVNLGVPWVILGHSERRSLMGESSEFVGEKVAYALAQGLKVIACVGETLEQREAGSTMAVVAEQTKAIAGKIKDWTNVVVAYEPVWAIXGTGKVATPAQAQEVHANLRDWLKTNVSPEVAESTRIIYGGSVTGXASCKELAGQPDVDGFLVGGASLKPEFIDIINAATVKSA

SEQ ID NO: 66415 - protein, 199 aa, Pisum sativum
LDEYSKFHGYSPAVVTGKPIDLGGSLGRDAATGRGVLFATEALLNEYGKSISGQRFVIQGFGNVGSWAAQLIDEKGGKIVAVSDITGAIKNSKGIDIPSLLKHTKETRGVKGFHGADSIDSNSILLEDCDVLIPAALGGVINRENANEIKAKFIVEAANHPTDPEADEILKKKGVVILPDIYANSGGVTVSYFEWVQNI

SEQ ID NO: 66416 - protein, 1072 aa, Bacillus cereus ATCC 10987
MPKRLDINTILVIGSGPIVIGQAAEFDYSGTQACQSLKEEGYKVILVNSNPATIMTDTATADKVYIEPLTLEFVSRIIRKERPDAILPTLGGQTGLNMAVELAKSGVLEECGVEILGTKLSAIEQAEDRDLFRTLMQDLNEPTPPSEIIHNLDEAYSFVNEIGYPVIVRPAFTLGGTGGGICHNEEELIEIVTSGLKHSPVTQCLLEKSIAGCKEIEYEVMRDSNDNAIVVCNMENIDPVGVHTGDSIVVAPSQTLSDREYQMLRNTSLRIIRALGIEGGCNVQLALDPYSFQYYVIEVNPRVSRSSALASKATGYPIAKLAAKIAVGLTLDEIVNPVTQKTYACFEPALDYVVSKIPRWPFDKFESANRTLGTQMKATGEVMSIGRNLEESLLKAVRSLELGIYHLELDHLKELDKETMKKRIIKADDERLFIVAEAIRQGVTKEEINEWCEMDFFFLQKVENIVNMEREVKANVGNMEVLQTAKEMGFSDHYIAAAWNKTEREIYDMRKENNMTPVFKMVDTCAAEFESATPYYYSTYAEENESIVTDRKSVVVLGSGPIRIGQGVEFDYATVHSVWAIKEAGYEAIIINNNPETVSTDFSISDKLYFEPLTIEDVMHIIDLEKPEGVIVQFGGQTAINLAAKLEEHGVKILGTSLEDLDRAEDRDKFEAALTKLGIPQPVGKTATTVEQAVAIAEEIGYPVLVRPSYVLGGRAMEIVYRQEELLHYMKNAVKVHADHPVLIDRYMVGKEIEVDAISDGENVFIPGIMEHIERAGVHSGDSIGVYPPQSLSEKLKEQIIEHTIALGKGLNIVGLLNIQFVVFENQVYVIEVNPRASRTVPFLSKITGVPMANVATKVILGQDLVEQGYGTGYHPEEKEVYVKAPVFSFAKLRSVDTTLGPEMKSTGEVMGKDLTLEKALYKGLVASGINIPTHGSVIITVADKDKEEAMEIAKRFHEIGYNLLATAGTAQSLTEQNIPVQVVNKIDSEDYNLLDIIRQGKAQFVINTLTKGKQPARDGFRIRRESVENGVACLTSLDTTRAILRVLESMTFSAHSMKEITQTKRHEVVHA

SEQ ID NO: 66417 - protein, 206 aa, Oryza sativa (japonica cultivar-group)
METELCSSRVLSPPRYESGDEELSVLPRHTKVIVTGNNRTKSVLVGLQGVVKKAVGLGGWHWLVLKNGVEVKLQRNALSVLEPPTGNEDDDDIDGNNSFCSSSDMGDKDMDYSSIEYHKPTKPRVRHTRPWSSCIKSSNRGNFHPSTKLRTRVNLTKLGTPTLWRYWKHFNLVSMNPNPSKEQLFHGVQQHFQSQAAKRLKTLYRS

SEQ ID NO: 66418 - protein, 396 aa, Pseudomonas syringae pv. phaseolicola 1448A
MTAQISRKRICILPGDGIGIEVMEAALPVIAALHLPFDLIPADIGWECWKREGETVPAQTWEVMASCDATLLGAITSKPLAEAEAELPLALQGRNRRYVSPVIQLRQNLDLYANVRPVTDMTGEDRFRFVVIRENTEGLYAGLDFGHVPDALVPLLEEREALGAPWQREGQEDATVTLRLQTRSGLTRIFEYAFDYARKNNFTRVTFVDKPMVLRHSSAFARGIFEEIAQRYPDITGVIENVDAVALWMVQRPERFGVIVAENMFGDILSDLGAGVMGGLGFAPSGNFGNSGAYFEPVHGSAPAHAGLNKANPSAMFMAIALMLEHLGYPAQAACITHAVSLVSQSGVRSYDLGGSHTTDQVGEAIVLQGIELQAGSVGYRAEQASVQGERYVSAL

SEQ ID NO: 66419 - protein, 519 aa, Nicotiana attenuata
MAVATATATLSSSSSLPFHSLHQQFPSKYFTVRPITVSLSEKIPAVTQSSEFTKLPIRTIPGDYGLPLIGPWKDRQDYFYNQGKEEFFRSRIQKYKSTVFKTNMPPGNFISSNPNVVVLLDGKSFPTLFDVSKVEKKDLFTGTFMPSTELTGGYRVLSYLDPSEPTHEKLKKLLFFLLSSRRDYIIPQFHESYTELFKTLEKEMEKNGKADLNSANDQAAFNFLARSLYGANPVETKLGTDGPTLIGKWVLFQLHPLLTLGLPKVLDDFLLHNFRLPPALVKKDYQRLYDFFYESSTAVLNEAGNFGISRDEACHNLLFATCFNSFGGMKIFFPNMLKWIARAGVELHIRLANEIRSAVKSAGGKITMSAMEKMPVMKSVVYEALRIDPPVASQYGRAKRDLMIESHDGVFEVKKGEMLFGYQPFATRDPKIFDRPDEFVPDRFVGEEGEKLLKHVLWSNGPETESPTVENKQCAGKDFVVLVSRLLVTEFFLRYDTLDIDVGTSPLGAKITITSLKRA

SEQ ID NO: 66420 - protein, 439 aa, Bacillus licheniformis ATCC 14580
MFLHGTSRQNERGHLEIGGVDVLSLAERYGTPLYVYDVALIRERARKFQKAFKEAGLKAQVAYASKAFSSVAMIQLAEQEGLSLDVVSGGELFTAIKAGFPAERIHFHGNNKSPEELAMALEHQIGCIVLDNFHEIAITEDLCKRSGQTVDVLLRITPGVEAHTHDYITTGQEDSKFGFDLHNGQVEQAIEQVLRSSAFKLLGVHCHIGSQIFDTAGFVLAADKIFEKLAEWRETYSFIPEVLNLGGGFGIRYTKDDEPLAADVYVEKIIEAVKANAEHFGFDIPEIWIEPGRSLVGDAGTTLYTIGSQKEVPGIRKYVAIDGGMSDNIRPALYEAKYEAAVANRMNDACHDTASIAGKCCESGDMLIWDLEIPEVRDGDVLAVFCTGAYGYSMANNYNRIPRPAVVFVEDGEAQLVIQRETYEDIVKLDLPLKSKVKQ

SEQ ID NO: 66421 - protein, 69 aa, Chlamydomonas sp. HS-5
MDESNATCGKRLDSIGVENTEENRRAYRDLLLSTPGLGQYISGAILFEETLYQCTKDGKTFVQVMNDQG

SEQ ID NO: 66422 - protein, 454 aa, Rhodospirillum rubrum ATCC 11170
MTPAARVQCAIDLLVDIDATNRPADGIASAFVRARRFMGSKDRRAVTALAWSTLRHRARLSWLIDRFGGTPKARALVIAHLLVVERQSAEDVRMLFITRAQHAPQPLTDAEERLVDGLAGKPLEFREMPADVRLEVPDWLPPLLEPLFGERLEDELRALQAEAPLDLRVNALKSDRESARLALAREQVDTRPGALSPCALRAEGRPNVAITAPFCDGLVEVQDEGSQMVALLCAVAPGMSVLDLCAGAGGKTLALAAGMENKGTLVATDISEGRLARAQTRLQRAGVHNVTRKVLDPETRKWLKRRKASFDVVLVDAPCSGTGTWRRNPDARWKLTPDTISALNAEQSALLDRAAALVKPGGRLVYATCSLLPAENEAQIAAFLERRDDYRALPVAETWAKVSPAPYPGAADVSWLRLTPASHGTDGFFVSILERQPRETADQPDETAPIPEDA

SEQ ID NO: 66423 - protein, 478 aa, Solanum lycopersicum
MSGNHRGGGAMAGLIVVLLTVYFTTFSYGSPTILSDLNAPKFRHSRLAKSAIQRQTSNEEQSRLWTPLEHQGWKPCTKSDAASIVVAKILNATLVIPQLEVNPVWQDSSSFEDIFDVDHFINALKDDVAIVKELPDEFSWSTREYYGIAIRPTRIKTAPVHASANWYLENVSPVLQSYGIAAIAPFSHRLTFDNMPKYLQHLRCKVNFQALAFVPHIRQLGDALITRLRFPPSEDNMVSNNYLREVTDLKPKQGVGKFAVLHLRFDKDMAAHSACDFGGGKAENLALAKYRQVIWGGRVINSQFTDEELRSQGRCPLTPEEVGLLLAALGFDNNTRLYLASHKVYGGERRVSALRSLFPLMEDKKSLASSEERALIKGKASLLAAVDYYVGMHSDIFVSASPGNMHNAMVGQRTYNNMKTIRPNMALLGQLFLNKTLTWPEFQESVIEGHQNRQGQIRLRKPKQSLYTYPAPDCMCQA

SEQ ID NO: 66424 - protein, 235 aa, Heliobacillus mobilis
MRREGYELAVSKPSVIFRKDDEGNLMEPLEQLIIDVPEEYMGVVMEKLGTRRAEMTNMVNNGTGQVRLEFIIPARGLIGYRTEFLTDTRGFGIMHHLFHGYGEHRGEIPGRTKGAAVAFEHGTATAYALGYLQERIAFFITPGTDVYQGMIVGENAREQDMDVNVAKAKHLTNMRASGSDGTIKLEPPRILSLEDALEWIDDDELVEVTPLNIRLRKRLLDPTQRERAKKNQTLR

SEQ ID NO: 66425 - protein, 197 aa, Clostridium perfringens SM101
MKIKSSEFIISAVKREQYPDDNLPEIAFVGRSNVGKSSIINSLTNRRGLAKVSQTPGKTRLINFFLLNKDFYLVDLPGYGYAKVSKKEKASWGATIERYLLNRGPLKKVVLLVDCRHKPTADDVQMYEWIKHYGYEVVVIATKSDKISNNQIGKSEKLIKETLGLPKDYKLKFFSSLNKKGKDELVDYLFDDLVEEI

SEQ ID NO: 66426 - protein, 528 aa, Sclerotinia sclerotiorum
MLGAIASIGGFMFGYESGQISFVQMSDFLDRFGENGELSAVRQGTIVAILCAGTLVGCLGSSYLCDTIGRRYTISSSAFFYIIGVIIEITSSTHWVQFAMGRFTAGLGIGALSTSVPMYQSESVPKNIRGAVVSSYQLLITLGIWTAYMINYGTHSAYTNSAQWRIPNGLSALWAIILGTAVLFMPESPRFAYRIGREDEARKNMALLNGVDPYSPLIDSEIQEIEQKLAAEREGGDHPWYEIFTGPRMLYRTLLGMVLQAGQQLTGANFFFYYGTTIFKSGGISDSYVTSIILGTVNVVATIGGLWIVKNCGRRKALMVGAAEMFVCMLIYSFVGHFKIQGQANAQAPGAVLICFTCIYIVGFATTWGPLVWAIVGELYPARYRASCMALATASNWLFNFLISFFTTFITNDIDYYYGLVFAGSLFALFWIVYFFVIETKDRSLEEIDTMYVLHVNPRTSSTWDPKSLGAEGVKGVDTDGMFLTTGGKDIKKSEMAGRPMLEHDERRFPETAGGAASQEHKPEIMNA

SEQ ID NO: 66427 - protein, 427 aa, Bacillus cereus ATCC 10987
MEQKPVLDVNEVPKPGKWLFLSIQHLFAMFGSTVLVPFLTGLNPSVALISSGLGTLAFLLITKGQVPAYLGSSFAFIAPIITAKTAGGPGAAMLGGLLAGLVYILISIGIKKSGSKWIMKLLPPIVVGPVVMVIGLALAHTAVNMAMNGADGKYSFTHFSVALVTLAITIICSIFGRGFFSIIPVLLGIIGGYIFAYFQGLVDLKPVAEAKWFVVPDFTVPFVTYTPEFSWKIVLLMVPVALVTISEHIGHQIVLGNVIKRDLIEKPGLHRSIFGDGVATLIASLIGGPPNTTYGENIGVLAITRAYSVYLFIGSAVFAIMFGFIGKISALIHSIPTPVMGGVSILLFGVIASSGLRMMVDDKTDLSDKRNLMIASVILVIGIGGAVLHVGESFQVEGMALAAIVGVLLNLLLPETKQIKQSKQIAS

SEQ ID NO: 66428 - protein, 431 aa, Roseovarius nubinhibens ISM
MFDFDMLGLAPALNEALTRAGFSEPTPIQNQAIPLALEGHDILGLAQTGTGKTLAFGLPLINHLLAEPGKPAPKTAKALILAPTRELVNQIADSLRNLTDGTRLRVATVVGGQSINRQITFLARGTDILVATPGRLIDLMDRRAVDLGSVRHLVLDEADQMLDLGFIHALRKIAPRLGTPRQTMLFSATMPKQMEELSRAYLENPRKVQVSPPGKAADKITQSVHFLEKPAKPSKLREILSRDMDALTLVFSRTKHGAEKLMKGLVADGYNAASIHGNKSQGQRDRAIKAFRAGEINVLVATDVAARGIDIPGVAYVINYDLPDVPDNYVHRIGRTARAGREGEAIAFCSSEEADLLRQIQRLMKIDIPVASGTLPQGAADEARGAKPGGNRRRGGRGGPPAANRGGKPAHTKPGGQSKGRRPRRRSAAAS

SEQ ID NO: 66429 - protein, 295 aa, Coprinopsis cinerea okayama7#130
MNKATEEVSKNLQQIKAMLLGDGEPVPEVVAQLAQETYNTDLLLLLVQNIARFEFEARKDVVQIFNNLLRRQIGSRWPTVEYLSSKPDIVFAALAGYENEEVALNTGMILKEMLRHEPLAKILLYSDQFYKFPHYIESTTFGISCDAFANFKETLTRHKPMVAEYLDRHYDRFFSSLTTLILSTNYVTKRQSLKLLGEILLDRANFNVMTRYIANEGNLKMMMNLLRDKSKNIQFEAFHVFKVFVANPKKPPQIEAILRRNKEKLLNFLKNFHNDKEDEQFTDEKQFLIVQIQGL

SEQ ID NO: 66430 - protein, 172 aa, Streptococcus agalactiae 2603V/R
MDLNNYIASIENYPQEGITFRDISPLMADGKAYSYAVREIVQYAADKDIDMIVGPEARGFIVGCPVAYALGIGFAPVRKPGKLPREVISADYEKEYGLDTLTMHADAIKPGQRVLIVDDLLATGGTVKATIEMIEKLGGVVAGCAFLVELDGLNGRKAIEGYDTKVLMNFPG

SEQ ID NO: 66431 - protein, 508 aa, Coffea canephora
MALLLILLPVAFIFLAYSLYERLRFKLPPGPRPKPVVGNIYDIKPVRFKCYAEWSKLYGPIFSVYFGSQLNTVVDTAELAKEVLKDNDQQLADRYRSRPSARMSRNGQDLIWADYGPHYVKVRKLCNLELFTPKRLEGLRPLREDEVTAMVDSIFKDCTIPENKGKSLLMRNYLGSVAFNNITRLTFGKRFMNSEGVVDEQGQEFKGIVSNGIRIGAKLSVADHIPWLRWMFVGENEDLDKHNARRDKLTRMIMEEHTLARQKSGNTKQHFVDALITLQKQYELSDDTVIGLLWDMITAGMDTTTISVEWAMAELVKNPRVQHKAQEELDRVIGSDRIMTEADFAKLPYLQCVAKEALRLHPPTPLMLPHRANANVKIGGYDIPKGSIVHVNVWAIARDPAAWKNPLEFRPERFLEEDVDIKGHDYRLLPFGAGRRICPGAQLALNLVTSMLGHLLHHFTWSPPTGVSPEEIDLEESPGTVTYMRTPLQAVATPRLPAHLYNRVPVEL

SEQ ID NO: 66432 - protein, 508 aa, Coffea canephora
MALFLLLLTFIFILPPYYLYQKLRFKLPPGPRPLPVVGNLYDIKPVRFRCFADWSRAYGPIISVWFGSTLNVVVSNAELAKEVLKENDQQLSDRHRSRSAAKFSREGQDLIWADYGPHYVKVRKVCTLELFSPKRLEALKPIREDEVTAMVESIYKDCTLREGSGQSLLVKKYLGTVAFNNITRLAFGKRFVNSEGVMDEQGKEFKEITANGLKLGASLAMAEHIPWLRWLFPLDEAAFAKHGARRDRLTRAIMEEHRLAREKSGGAKQHFVDALLTLKDKYDLSEDTIIGLLWDMITAGMDTTAISVEWAMAEVIKNPRVQQKVQEELDQVIGYERVMIETDFSNLPYLQSVAKESLRLHPPTPLMLPHRSNASVKIGGYDIPKGSNVHVNVWAVARDPAVWRNPLEFRPERFLEEDVDMKGHDFRLLPFGAGRRVCPGAQLGINLVTSMLGHLLHHFNWAPPHGLSPDEIDMGESPGLVTYMRTALRAVPTPRLPSHLYERVAVDM

SEQ ID NO: 66433 - protein, 445 aa, Thermoplasma volcanium GSS1
MPEDVVEKTLKKLDQDKVEFLQMQFTDIVGNVKSLTVPKNRFENALTEGVVFDGSSVAGYAQIEESDMRAIPNLDSYTLLPDEFGKSRVVRFVCNVYSPDGSRFPGDPRYVLEKLLEKVHKEGNEFFVGPEFEFFLFKRDANGNPTTEPSDYGGYFDNTPLDSASDIRQQIVRELYELGYQPEAAHHEVAYGQQEIDLRYAPALKMADRIVMLKSIIKNVAERNGLYASFMPKPINGVNGSGMHIHQSIMSFDEKVNRFYDKNAKYGLSDYAMHYLGGILSHINEGSAILASTVNSYKRLIPGYEAPVYISWANKNRSALIRIPAGEGTRKRMELRCPDPAGNPYLQFAVILGMGLDGIEKKIDPPEPIEKDIFHMTKEERLQEGITSMPESLGEALHHLRNSKLMRDILGDHVYENFLTVKQREWDQFRSYVGEWEIKKYLPTL

SEQ ID NO: 66434 - protein, 850 aa, Candida albicans SC5314
MMKGFKNRLTRNKGQSTNKKTEKKDKEREKEREKPEKRSSSPSSLSLNTSSSSSQSSKNLMTNTSGSLKSNSPSPSRNNSSTSAGSIKSTASNITMTSASSPQGSPSQSSPKIVVNNEEDISGNVFGSPSQPTDNNPSTSSGSTTTGTGTGAASALSPGSSTPLNASANAHTSNVPSISASGPAPSFNLNHPITPTPTSPNSSLGFHNQFEGKATHSQHSAQPHYSQLTPNIASPGKENIDIDLIVTPKRHSSSRFEPTSSDRYQEIVKLPNFDEVLPEEQIQLFIQKIDQCNTMFDFSDPTFDIRGKEIKRITLQELIGFISNNRFTYTDEMYKHVVTMFKKNLFRPIPPPVNPIGDIYDPDEDEPVSELAWPHMQAIYEFFLRFIESPDFQHQVAKQYIDHEFILRILELFDSEDPRERDCLKTTLHRIYGKFLSLRSFIRKSINNVFLQFVYETERFNGIGELLEILGSIINGFALPLKEEHKIFLVRVLIPLHKVKCLSLYHPQLAYCIVQFLEKDPSLTEDVIMGLLRYWPKVNSPKEVMFLNEIEDIFEVMEPNEFIKIQIPLFAQLSKCISSPHFQVSEKVLCYWSNEYFLTLITENAEVVLPIIFASLYELTNATQAGIENGIMNQKLAQFPNATTDANGNLIDNGLVLQDLQQGIAPSMNNPSHPHYNIFQVHASINNNNNNNGNNNNNNDGSINNPDSMNIHTDSNGNEMSDEEYYDSFTGMGGGNGGPGGTNPNNPLGDDFGGAFDDGTGGLLQHNSATSNWNRSIHSLAYGALKVFMDHNPILYDHCTVLYHQSLAEQKQREANRKEGWKRVEELVRQIKNKKNLESQQPQHPASGVI

SEQ ID NO: 66435 - protein, 124 aa, Zea mays
  misc_feature (86)..(86): Xaa can be any naturally occurring amino acid
MATQSPHVLVVDHSRVDCLVASIVLNSFNIRVTVAGGAMEALEFLDANNSHVDLILTDYCMPDMTGYDLLREVKESPRLKHIPVVXTCTDVIPERIIECFEGGAEEYMIKPLKVSDVPRILSYM

SEQ ID NO: 66436 - protein, 347 aa, Rhodospirillum rubrum ATCC 11170
MKVTGVVLERQGALSLRDIDIPGTLAPGANEVRIAIKSVGICGSDVHYFKHGRIGDFIVTEPMILGHEASGVVEEIGSAVTHLRVGDRVCMEPGVPDFSSIETLRGMYNLDPSVRFWATPPYHGCLTAEVVHPASLTYRLPDSVSFAEGAMVEPLAIGVYAAAKAQIRPGDIAVVTGAGTIGMMVVFAALAAGCAEVIVSDVAAEKLALLASHPEVTTVDLTRESLADAVAARTDGRGVDVFFEASGSTRPYETMIDLIGRGGRIVLVGMPQEKPQLDVVALQVKEISLTGTFRYANVWDRTLKLLGSGKIDLKPLISATFPFSDSVRAFDRAAQHLPSDVKIQISL

SEQ ID NO: 66437 - protein, 984 aa, Staphylococcus aureus subsp. aureus MRSA252
MQEHLVVTLDGKDYLVEPGTNLLEFIKSQDTFVPSICYNESMGPIQTCDTCTVEIDGKIERSCSTVIDRPMTVNTVNNDVKDAQKEALDRILEKHMLYCTVCDYNNGDCEIHNTMDAWGLQHQTYEYKEKPYEKDYGPFYRYDPNQCILCGRCVEACQDIELNETIRIDWDREHPRVIWDNDVPINESSCVSCGQCATVCPCNAMMEVNMEGNAGYMTDTEPGSLAAMIDLTKKAEPGYGPLFAISDSEAEMRKERIKKTKTVCTYCGVGCSFEVWTKDREILKVQPSHDSPANKIATCVKGKFSWGHINSDQRLTKPLVRKNGEFHEVEWDEALNVIADNFTSIKEKHGPDALSFISSSKATNEESYLMQKLARQVIGTNNVDNCSRYCQAPATKGLFRTVGHGGDSGSIEDLEKAAMSVLIGTNTAEAHPVIASRMKRAQKLFGQKIHVFDIRKHEMAERADRFYQPKPGTDLAWLSAVTKYIIDHDLHDKAFIEEWVEDFDEYYKSLETFTMAFAEEATGIPEAELIKFAEECAKAESVVICWAMGITQQDIGSDSSTAISNLLLVTGNYRRPGTGAYPLRGHNNVQGCSDIGSMPDKITGYQSIEADDIRAKFEKEYGVKLNPKAGKDNHEMVEGIHDGQIHSLYLYGEDTGIVDSNINFVQAAFEKLDFMVVQDEFLTFTATYADVVLPASPSLEKDGTFTNTERRIQRLYQALKPLGDSKPDWKIFQAIANKLSFDWNYKHPSEIMDEIARLTPLYAGVSYERLEGFNSLQWPVHPDGTDEPILYLEGFNFDNGKAKLFPLSFDNYFKQDEVYDIHVNNGRLLEHFHEGNMTYQTPMLKYKVPRAFVEISPELAEDRGIHEGAEVKLISETGEAVLQVHVTDRVKGKEIYIPLNNDAMENGDLGAINLLTNSDVDQYTDTPSYKRTSCRMEVITKRGKSPLNPNNFRVNKKRHPQYSVQVQKKWERPDYVFPGNQVDK

SEQ ID NO: 66438 - protein, 429 aa, Xanthomonas campestris pv. vesicatoria str. 85-10
MSLHIDTIALLAALPQVRDRCEGPICAYVYDLAALDTHAAWMRAQLPAQCELFYAAKANAEPPILQTLAAHVDGFEAASGGELAWLHAQQPQAPLLFGGPGKLDTELAQAAALPDCTVHVESLSELERLAAIAAHAGRCVPVFLRMNIAVPGAQSTRLMMGGQPSPFGLDPSDLDAAVRRVQANPSLRLEGFHFHLMSHQRSAAAQLHLVAAYLHTVQQWRQTYALGPLRVNAGGGFGVDYLAPDASFDWARFCAGLPAVLREHGTDLRLRLEPGRYLSASCGWYLMEVLDLKRSHGAWFAVARGGTHHFRTPAAQAHDHPFRVLRGERAPVLRDTPVTLVGQLCTPKDVLARQQPVAALAPGDCLAFPLAGAYAWNISHQHFLMHPAPQMVFLPATHYLGNATSPDRCTGNRMSARNSASATVSGSSR

SEQ ID NO: 66439 - protein, 347 aa, Mannheimia succiniciproducens MBEL55E
MMEIKTLSCVVRGPKDVGVMEQSINYDESSKEQTLVKITRGGICGSDLHYYQYGKVGNYEIKHPMILGHEVIGTVVKTNAPDLYVGQKVAINPSKPCLTCKYCLSGDTNQCETMRFFGSAMYNPHVDGGFTQYKVVDNSQCIDYPQDVSDDIMAFAEPLAVTIHAAKQAGDLAGKRVFVSGVGPIGCLAVAAIKASGAKEIVVSDLSRRCLDLALEMGATKALNAKDDFSEYMAHKGEFDVSFEASGHPSSIERCLAVTKARGTIIQIGMGGAIPEFPIMTLIAKEICLKGSFRFIEEFNTSVEWLSSGKVNPLPLLSATFPYTELEKALIIAGDKDNISKVQLSFE

SEQ ID NO: 66440 - protein, 251 aa, Heliobacillus mobilis
MRKTIIAGNWKMHKTIAEAVTLAEAIKSQNPNPTVEIVICPPFTALAEVAKAVQGSPVAVAAQNMHWEVQGAFTGEVSPAMVKDAGCKYVVLGHSERRQYFGETDETVNKKVKAAIAHELIPIVCVGETLEQREAGQTEDVVATQTKGGLAGLSAQEVADLVIAYEPVWAIGTGRTASDDDAQQVNAYIRSVVAEVFGKEAAEAVRIQYGGSVKPSNAENLLAKGDIDGALVGGASLKIEDFQGIIDGAKA

SEQ ID NO: 66441 - protein, 171 aa, Mannheimia succiniciproducens MBEL55E
MTQGKSFILMGVSSTGKTSVGTEVAHRLGLKLIDGDDLHPRANIIKMGEGKPLNDEDRAPWLERIRDAAFSLEQKSEVGVIICSALKKKYRDLIRQGNERVKFLFLYGSYELILERMRQRKGHYMKEEMLKSQFDTLEVPQADEADVIHIDIDGSFEEVVQRCITALKPYL

SEQ ID NO: 66442 - protein, 556 aa, Clostridium perfringens SM101
MKNDIEIAQSAKMEPIINIAKKIGLEEDDIELYGKYKCKISLDVIKRLENNKDGKLVLVTAINPTPAGEGKSTVTVGLGQALNKIGKNTVIALREPSLGPVFGIKGGAAGGGYAQVVPMEDINLHFTGDMHAITSANNLLCAAIDNHIHQGNLLRIDSRRIVFKRVMDMNDRALRNIVVGMGGKINGFLREDGFMITVASEIMAILCMASDLEDLKERMGNILIAYNLDGEPVYAKELEIEGAMALLMKDAIKPNLVQTLENTPAIIHGGPFANIAHGCNSIIATKTALKMSDITITEAGFGADLGAEKFLDIKCRYGNLNPDCVVLVATIRALKHHGGVKKDELNISNVDALNKGMKNLEKQIENIKAYGVPVVVAINKFITDSDEEVKAIEDFCKNIGVEVSLTEVWEKGGEGGIDLANKVIKTMENEPSNFKMIYDSEESIKDKILKIVQTIYGGKGVNYTPQALKQIAEIEKFNLDKLPICMAKTQYSLSDNPSLLGRPENFDITIKEVRVSNGAGFIVVLTGDVMTMPGLPKVPAANRMDIKDNGEIVGLF

SEQ ID NO: 66443 - protein, 225 aa, Triticum aestivum
MASSSSPASSRPPGPFALGLESSANKIGIGVVSISGQILSNPRHTYITPPGHGFLPRETAQHHLVHLLPLLRAALAEADASPADLACICYTMGPGMGGPLQVAAASARALSLVWGKPLVAVNHCVAHIEMGRAVTGAVDPVVLYVSGGNTQVIAYSEGRYRIFGETIDIAVGNCLDRFARILKLSNDPSPGYNIEQLAKKGEKFIDLPYVVKGMDVSFSGILSFI

SEQ ID NO: 66444 - protein, 514 aa, Synechococcus sp. RS9917
MTYSLTTPLYYVNDRPHLGSTYTTIACDALARFQRLEGETVLFVTGVDEHGQKIQRTAAEQGIEPREHCDRITARYLEAWRQWGISNDRFVRTTEPRHRPLVQAFFQRCEAAGDIRSGRQTGWYCVGCEEFKDEPAEAKEPCCPLHQKPLEWRDEENLFFCLSHFQERIETLINQPGFIAPASRRKEIQNFVAGGLRDFSISRVNVAWGLPVPGHEGHTFYVWFDALLGYLTALLDDGGDVDLNRLGAAGWPADVQVIGKDILRFHAVYWPAMLMSAGLPVPKRVFGHGFLTREGQKMGKSLGNVLDPEVLLERCGADAVRWYLLRDIQFGDDGDFQQQRFTDLVNNDLANTIGNLLNRTASMARKWFNDAVPPIDSTASAGHALQADAEQTIERVRQAMPELHFQQACEAILSLAIQANGYLNAQAPWRQMKQPGNEASVASDLYAVLECCRLVGLLLQPLVPDLSQRILDQLGEAPVASTWKERLIWGKLRAGSPLTQPQPVMARLELDAPL

SEQ ID NO: 66445 - protein, 310 aa, Clostridium perfringens SM101
MNKICVLGSMNMDLVLKVKDMPKVGETILSKSFQKIAGGKGANQAVAAKRSGAEVFMISKIGKDENGRELRDKLVEDNIDVKYVFEDRIEPTGMALIMVNDNGNNSIIVNAGSNMTLTKDEIHSAENLIKESDIIISQFETPEDITIEAFKIAKENGKVTILNPAPAKKIKDQLLKYTDIIVPNETEAELLTGIEIKDIEDAKKAGDIFLDKGVKFIIITLGEKGAALIGKDFCEIVLAYRVNAIDTTAAGDSFIGGLSSKLDTKNLGRETLSSSIRFGNKVSSIAVQRKGAQPSIPYLHEVLEVYKGEE

SEQ ID NO: 66446 - protein, 470 aa, Rauvolfia serpentina
MEHTPHIAMVPTPGMGHLIPLVEFAKRLVLRHNFGVTFIIPTDGPLPKAQKSFLDALPAGVNYVLLPPVSFDDLPADVRIETRICLTITRSLPFVRDAVKTLLATTKLAALVVDLFGTDAFDVAIEFKVSPYIFYPTTAMCLSLFFHLPKLDQMVSCEYRDVPEPLQIPGCIPIHGKDFLDPAQDRKNDAYKCLLHQAKRYRLAEGIMVNTFNDLEPGPLKALQEEDQGKPPVYPIGPLIRADSSSKVDDCECLKWLDDQPRGSVLFISFGSGGAVSHNQFIELALGLEMSEQRFLWVVRSPNDKIANATYFSIQNQNDALAYLPEGFLERTKGRCLLVPSWAPQTEILSHGSTGGFLTHCGWNSILESVVNGVPLIAWPLYAEQKMNAVMLTEGLKVALRPKAGENGLIGRVEIANAVKGLMEGEEGKKFRSTMKDLKDAASRALSDDGSSTKALAELACKWENKISST

SEQ ID NO: 66447 - protein, 297 aa, Nocardia farcinica IFM 10152
MPLTGPIVLSDNRYGKSENRIVRIHRDGPRHEIRDVTVSTRLRGDFADAYVTGDQSAVLPTDSQKQTAYAYAKTQGLHHIEDYGLALAEHFVRDIAPVHAARVEIDEFAWERARVGPGEHDHTWVRRGPEVRTAAVTVTGTGSWVVGGVRDLVLLKSTGSEFAGFLRDEFTVLAPTDDRMLATALTARWRFADTAAVDWAATYTGVRARLIEVFATHHSKALQQTLFEMGSAVLADFPVLAEIRLVAPNRHHFDYDLSPFGIANHGEVYYAADRPYGLIEAALRRADAPDAGQAWEL

SEQ ID NO: 66448 - protein, 463 aa, Triticum aestivum
DVLARYEALGWHTIWVQNGNTGYDDIRAAIKEAKEVKDKPTLIKVTTTIGYGSPNKASTHSVHGSALGSKEVEATRKNLSWAHEPFHVPDEVKRHWAHHLDEGASLEAEWNAKFAEYEKKYQHEAAELNSIVSGKLPDGWDNALPKYTPESPADATRNLSQQCLNALAKVIPGFLGGSADLASSNMTLLKMFGDFQKDTPEERNIRFGVREHAMGAVCNGIAVHSPGLIPYCSTFFVFTDYMRAPIRLSALSESGVIFVMTHDSIGLGEDGPTHQPVEQLFSLRAMPGILMLRPADGTETSAAYRIAVINRKRPSILALSRQKLPQLEGTSVEGVAKGGYVISDNSSGNKPDLILISTGSELEIAEKAAGQLRKEGKSVRVVSLVCWELFEEQPEEYKESVLPSEVTSRISIEAGVTLGWEKYIGQKGKAIGIDRFGSSAPAGRIYKELGLTVENLIATAKSL

SEQ ID NO: 66449 - protein, 109 aa, Nocardia farcinica IFM 10152
MSTPGTSTLSTHVLDAVRGVPAAGVAVTLYAGAEPVASGATDADGRIGGLAEVSPGTYRLVFDTGAYFAAQGTPTFYPEVAITFAVTEERHHHVPLLLSPFAFSTYRGS

SEQ ID NO: 66450 - protein, 172 aa, Nocardia farcinica IFM 10152
MTHPAPAGIAAFDALPAAAATAALLEVCASPEWARRVVAGRPYGTAERLYAAAERVLADLPEREIDRALAGHPRIGEQPGGAAASHEQAGVAGADAATRAALAAGNRAYERRFGRIYLVSAAGRSADELLAILEARLRNDPEVETRVLREELAKINRLRLGRLPAVTGEDPV

SEQ ID NO: 66451 - protein, 266 aa, Glycine max
VGLPKRAPIDSNLLKLLIPVAVCHALGHVTSNVSFAAVAVSFTHTIKALEPFFNAAASQFILGQSIPITSWLSLAPVVIGVSMASLTELSFNWVGFISAMISNISFTYRSIYSKKAMTDMDSTNIYAYISIIALIVCIPPAVILEGPTLLKHGFNDAIAKVGLVTFVSDLFWVGMFYHLYNQVATNTLERVAPLTHAVGNVLKRVFVIGFSIIVFGNKISTQTGIGTAIAIAGVALYSFIKARMEEEKRQAKQHKRKVVNLEDVLH

SEQ ID NO: 66452 - protein, 430 aa, Synechococcus sp. CC9311
MLDSLDLVIDTIVAREVLDSRGNPTVEAEVLLEGGASGRAIVPSGASTGAHEAHELRDGGDRYMGKGVTKAVDHIEERIAPALCGLSALDQGSVDAAMLELDGSDNKSGLGANAILAVSMATARAAANGLGLPLYRYLGGPMATLLPVPLMNVINGGAHAANNLDFQEFMLVPHGAPNFREALRMGTEVFHTLKNLLSERGMSTSVGDEGGFAPDLGNEEAGEVLVQAIEKAGYKPGEQISLALDVASTEFYSDGRYAFSGGSYSSAEMVDQLEQLVNRFPIISIEDGLAEDDWEGWALLTERLGKRVQLVGDDLFVTNTKRLQRGIDANTANSILIKVNQIGSLTETLQAIDLAGRSGYTSVISHRSGETEDTTIADLAVATRAGQIKTGSLSRSERVAKYNQLLRIEDELGDQAVYAGATGQGPRGRD

SEQ ID NO: 66453 - protein, 1252 aa, Streptococcus agalactiae 2603V/R
MKRKDLFGDKQTQYTIRKLSVGVASVATGVCIFLHSPQVFAEEVSASPANTAIAESNINQVDNQQSTNLKDDINSNSETVVTPSDMPDTKQLVSDETDTQKGVTEPDKATSLLEENKGPVSDKNTLDLKVAPSTLQNTPDKTSQAIGAPSPTLKVANQAPRIENGYFRLHLKELPQGHPVESTGLWIWGDVDQPSSNWPNGAIPMTDAKKDDYGYYVDFKLSEKQRKQISFLINNKAGTNLSGDHHIPLLRPEMNQVWIDEKYGTHTYQPLKEGYVRINYLSSSSNYDHLSAWLFKDVATPSTTWPDGSNFVNQGLYGRYIDVSLKTNAKEIGFLILDESKTGDAVKVQPNDYVFRDLANHNQIFVKDKDPKVYNNPYYIDQVQLKDAQQIDLTSIQASFTTLDGVDKTEILKELKVTDKNQNAIQISDITLDTSKSLLIIKGDFNPKQGHFNISYNGNNVMTRQSWEFKDQLYAYSGNLGAVLNQDGSKVEASLWSPSADSVTMIIYDKDNQNRVVATTPLMKNNKGVWQTILDTKLGIKNYTGYYYLYEIKRGKDKVKILDPYAKSLAEWDSNTVNDDIKTAKAAFVNPSQLGPQNLSFAKIANFKGRQDAVIYEAHVRDFTSDRSLDGKLKNQFGTFAAFSEKLDYLQKLGVTHIQLLPVLSYFYVNEMDKSRSTAYTSSDNNYNWGYDPQSYFALSGMYSEKPKDPSARIAELKQLIHDIHKRGMGVILDVVYNHTAKTYLFEDIEPNYYHFMNEDGSPRESFGGGRLGTTHAMSRRVLVDSIKYLTSEFKVDGFRFDMMGDHDAAAIELAYKEAKAINPNMIMIGEGWRTFQGDQGQPVKPADQDWMKSTDTVGVFSDDIRNSLKSGFPNEGTPAFITGGPQSLQGIFKNIKAQPGNFEADSPGDVVQYIAAHDNLTLHDVIAKSINKDPKVAEEEIHRRLRLGNVMILTSQGTAFIHSGQEYGRTKRLLNPDYMTKVSDDKLPNKATLIEAVKEYPYFIHDSYDSSDAINHFDWAAATDNNKHPISTKTQAYTAGLITLRRSTDAFRKLSKAEIDREVSLITEVGQGDIKEKDLVIAYQTIDSKGDIYAVFVNADSKARNVLLGEKYKHLLKGQVIVDADQAGIKPISTPRGVHFEKDSLLIDPLTAIVIKVGKVAPSPKEELQADYPKTQSFKESKTVEKVNRIANKTSITPVVSKKADSYLTNEANLPKTGDKSSKILSVVGISILASLLALVGLSLKRNRHLK

SEQ ID NO: 66454 - protein, 133 aa, Triticum aestivum
DNLQDRARFTEQGDAIVFESELDRIYLGTPSKIAIIDHEKKRTFVVRKGGLPDAVVWNPWDKKAKAMSDFGDDEYKRMVCVEAAAIEKPVTLKPGEEWTGKLELSAVPSSYYSGQLDPDRVIQDSTVPEDSIS

SEQ ID NO: 66455 - protein, 436 aa, Arabidopsis thaliana
MKGRISKIGSYAISSSIRDQHQQPCISCTTFNILAPIYKRLSHKDQSLRESDNRAYWLGRNHRIIDWLLYERSSIICLQEFWVGNEELVNLYEKRLGDAGYLSYKLGRTNNRGDGLLTAVHKDYFRVVNSRDLLFNDCGDRVAQLLHVELVPPYSQYDAHQEVLIVNTHLLFPHDSTLSIVRLQQVYKILQYVESYQKEVNLSPMPIILCGDWNGSKRGHVYKFLRSQGFVSSYDTAHRYTDSDAHKWVSHRNHRGNICAVDFIWLLNPNRYRKLLKTSWSEAVFGMFRYLLRRASLTAEDAFAFLKTDNDGDHITFMGFCETLRQLNLTGHCNGLTTKEIKDLWTQADIDGNGLLDYKEFQQRIWNQTWSEQRDAEDGEAKGNQEQTVGFSVKNAVLFPPEVEKGMWPENYSLSDHARLTVVFSPIRMPCSQLVS

SEQ ID NO: 66456 - protein, 405 aa, Halobacterium sp. NRC-1
MPDDASDLADRVQAGDLRLYELDDETDADTAAAARRAVLERETDADTDALGAFAFDADQAADTAVENLTGGAQLPLGVAGPVALSGGAADGEYYLPMATTEGALVASVNRGCSAITAAGGANARVTKTGMTRAPVFRVADVTEGAEVAQWADDNTDALAAAAESTTSHGELTDVTPYVVGDNVYLRFRYDTKDAMGMNMATIATEAASELVEDETPAELVAVSGNLCTDKKPAAINAVEGRGRTVTADVTIPQDVVEERFDTTPAAIEEANTRKNLIGSAKAGSLGFNAHAANVVAAVFLATGQDAAQVVEGANAITTVEARDDALYASVNLASLEVGTVGGGTTLPTQREALDVLGVRGGGDPAGANADALAEIIAVGALAGEINLLAALASRRLSAAHADLGR

SEQ ID NO: 66457 - protein, 853 aa, Oryza sativa (indica cultivar-group)
MSAAQQQKHEVDRATVAGAVAALFKWMRARAAEAPPNLLADERDDLLLLQLSLRRIPPSPTTKPRLLPLPHPVIVPGESASICVISDDRPKSRSPAASDLLDASRSHHLPVSEVIPLSALRTDYRPYESRRRLAASHDLFIADRAVLPLLPRVLGKAFYSTKKAPVAVDFARTGWLEQVRKVMNSTFLYLRTGTCSGIKVGRLDMKEEDTVENVMAAVEAAVENVPKKWANVRSLHLKAVDSVALPIYQAVPELGMKIEVRFAQLEGEVGSGEVIDASEAGAALKGVGKKKAKKALKHVEEENAGEEAAQESGKRKRGKKQLAEDLMEQDIQDVSEKRKKVKEGTPAAETPKISKKGKEKSKRALDKEGEDASVEEASNKKKKGKKEVVSDVGEKNSKVKKSNGDKEKRRTRLRIADAKRPQEEHVFGYIDWIPEHHGFQFSPCYKRSLPATERYIRGEAPLLSVSNSTEDQTPNGLSEAIVVRKGLSSICQRFPSFLHDFRLGQQLAFHLRELCSAVASEIHAKLARFLHRFWTTLQGSSKDIGWLKRTKTLPCSVDGLFSNHSPLYFVNTKRIFSKMGLTCHIARIHSEASVEKNARELKLYIEELYWGSGKQVLLLGHSKGGVDAAAALSLYWSELKGKVAGLALVQSPYGGTPIASDILRKGQIADKETRRIMELIICKLIKGDIRALEDLTYDKRRDFISKHKLPVDELPIISFHTEASTAPTMLVTLSRVAQAELLPWLPLPRFLSSSEYAESLLASLKLPVVVPASAAMAVSALHLRLRYGERSDGLVTRRDAEVPGSVVVRPERRLDHAWMVHSTLRKDHAEADATQMCEALMAMLVEIGRKKCC

SEQ ID NO: 66458 - protein, 232 aa, Oryza sativa (japonica cultivar-group)
MASSSDPWMKEYNEASRLADDINSMIADRGSLPQSGPEIIRHTSAIRRKITILCTRLDSLEALLSKIPPKSLSDKELHKRQDTLSNLKSKTKQMATSFNMSNFANREDLLGQNKKAADDMSRVAGLDNQGIVGLQRQIMKEQDEGLEKLEETVLSTKHIALAVNEELTLHTRLIDDLEDHVDVTNSRLQRVQKRLAILNKRTKGGCSCMCLLLSVVAIVILAVIVWLLIKYM

SEQ ID NO: 66459 - protein, 508 aa, Halobacterium sp. NRC-1
MQAALVILDGWGLGDHDRRDAVRAADTPTFDEYAERGAFGTLTTSGRDVGLPDGQMGNSEVGHLTIGAGRVVKQAYTRIEDAIAAGDLCGNDAISGALDHVADTGGTLHVMGLVSDGGVHADQQHIHALVECAAGRGVEAAVHAFTDGRDTSPTGGEDYLADLEAVADEHGTGDVASVSGRYYAMDRDQNWARTKRAYDAITRSDGVAHHAAAAVDAVTDSYERGDTDEFVEPTTIEGGAALSDGDAVVFANFRADRARQLTRLLADIHPADWDADGIETNPPAVPVVTMTEYDETFDCPVAFPAAEPTDTLGAVLAAHDHTQLRVAESEKYAHVTYFLNGGREVAFDGETRTIVDSPDVPTYDEQPAMSAPAVTDTVLDALAGDDPDVLVLNYANPDMVGHTGDFDAAIEAVEAVDRELGRLVPALNDAGAHAFLTADHGNADDLGTPADPHTAHTFNPVPFVSLPPASGDTAAVRDGGALRDIAPTLLDVLGIDRPTVMTGASLLE

SEQ ID NO: 66460 - protein, 284 aa, Saccharomyces cerevisiae
MTPSTPPRSRGTRYLAQPSGNTSSSALMQGQKTPQKPSQNLVPVTPSTTKSFKNAPLLAPPNSNMGMTSPFNGLTSPQRSPFPKSSVKRTLFQFESHDNGTVREEQEPLGRVNRILFPTQQNVDIDAAEEEEEGEVLLPPSRPTSARQLHLSLERDEFDQTHRKKIIKDVPGTPSDKVITFELAKNWNNNSPKNDARSQESEDEEDIIINPVRVGKNPFASDELVTQEIRNERKRAMLRENPDIEDVITYVNKKGEVVEKRRLTDEEKRRFKPKALFQSRDQEH

SEQ ID NO: 66461 - protein, 444 aa, Mannheimia succiniciproducens MBEL55E
MAERKYFGTDGVRGKVGTFPITPDFALKLGWAAGKVLASQGSRQVLIGKDTRISGYMLESALEAGLAAAGLSAAFIGPMPTPAVAYLTRTFRAEAGIVISASHNPYYDNGIKFFSAQGTKLPDEIEEAIEAMLEQPIDCVESAELGRASRIKDAAGRYIEFCKGTFPTELSLSGYKIVVDCANGATYHIAPNVMRELGAEVIEIGTSPNGMNINEKCGATDIKALKAKVLETKADVGLAYDGDGDRIMMVDHLGNVVDGDQILFIIAREDLRAGKLKGGVVGTLMSNMSLEISLKTLGIPFIRANVGDRYVLEKMVENDWKLGGENSGHIIIADKNTTGDGIIASLAVLTAMAQHKLSLNELASAVKLFPQVLINVRFSGGTNPLESDAVKAVAAEVEKRLAGKGRILLRKSGTEPLIRVMVECSDAELARKSAEEIVEAVKAN

SEQ ID NO: 66462 - protein, 112 aa, Triticum aestivum
  misc_feature (10)..(10): Xaa can be any naturally occurring amino acid
  misc_feature (24)..(24): Xaa can be any naturally occurring amino acid
  misc_feature (28)..(28): Xaa can be any naturally occurring amino acid
  misc_feature (55)..(55): Xaa can be any naturally occurring amino acid
  misc_feature (65)..(65): Xaa can be any naturally occurring amino acid
  misc_feature (68)..(68): Xaa can be any naturally occurring amino acid
  misc_feature (71)..(71): Xaa can be any naturally occurring amino acid
MAPTVMASSXTSVAPFQGLKSTAXLPVXSRRSNGASLGSVSNGGRIRCMQVWAIXGIKKFETLSXLPXLNXEGLLKQVDYPDPLQSGWPFPLSLNKRSGFQSFRAKNAVSPG

SEQ ID NO: 66463 - protein, 759 aa, Bacillus anthracis str. Ames
MNTPTQTPSLSETMKEWHYALAYEIKHWKTIGGSKISIMNGRFLYTDYESTVYVFQLISEVSLPEGSPIRIEFDGEEATGEVLSVHGLEIELKLNDYIQGEIREAVLYSEPWQLLEQLQERLKEARKDKLKRNRIKRLVDGTSSPKHIEKMKNPKNELAYRAFYNPTTYVWGPPGTGKSYNLSRIISAHYQKGKSVLVLAHSNAAVDVLMSEVTKQIEKKKKWTPGEIVRYGYSQHEHIRNHETLLASKLVETTNGSWGEERLYLEETRQELREKILSYKATSADKKRMQEIESDLRKQRAKIKEVEKEYIENAKVIGATLSKCAIDSLIYERTFDLVVVDEVSMAFVPQIALAASLGKRIVVCGDFLQLPPIAMANHELVRKWLGEDMFYHAGIVESVNKSEAHPNLFMLQEQRRMHADISKFTNSFIYKNRVYDHPSVSERKELAQLQPFANEASVLFDTSQMGAFSLKDAASGSRFNIMSGLVAMQMMLIGLLDGVQSIGIVTPYRAQSRFLSTCIREMLQRTKYQNIPVLAATVHKFQGSERDMMIFDTVDSYPQERPGVLFFDHKNHRLVNVAVTRARGKFIQLSDCHYMCKNLSRKQALSQLTAHIERHGDVYDRTTSRQLWERKISKRLRWFMEMNLEEPKGLLKDILAAKRKIVISLPSTKQVDKRVWQALMRTNAQITVYSDGPVPLKNVKLQRQNKAFPFIVIDDEIFWAGAPLTSQMMFEGSTEFPYVCARLQAPETIGVLKGFLDIR

SEQ ID NO: 66464 - protein, 785 aa, Oryza sativa (japonica cultivar-group)
MSRSHLISCPRFRVSQRTADADGRVDGGQHMNPNDEAGERMHPCVQVQRTYNGFGSGYLPKLSLLGFVAAPLCRGASVQDVLCRLMIAAVTSLSHPSTASSAKFDGRRSEERRKKGLIVAAASSALTSIPLSLLAMSRNLESPVQTQMAVSALNRALSSEYPSKSRSEGRASGWKRIFVQTDTGCVLAVQLDRGDNAHTVKRKLQLALNVPTEESSLTFGDRVLKNDLSTIRNDSPLLLTKTFMHRSSSTPCLSPTGKDIQQQRDRGGPIELLVCPSRCSRTKQLVKDVARAIRNGVDPIPVNSGLGGAYYFRNSKGENAAIVKPNDEEPFAPNNPKGFTGKALGQPGLKRSVRVGETGFREVAAYLLDYDNSANVPPTVLVKISHPVFNVNECVSSANMKASKDYPGAVSKIASFQQFIPHDFDASDHGTSSFPVSAVHRIGILDIRIFNTDRHAGNLLVRKLTGPGKFGNQTELIPIDHGLCLPECLEDPYFEWIHWPQASIPFSDDELDYIANLDPMKDADMLRMELPMIHEACLRVLILSTIFLKEATSFGLCLAEIGEMMSREFTGMEDQPSELEVVCMEARRLAIEREESSTEIDSGDEDAIQFELDCEDDHEMLKAQPAYHFELKGGSSRNPLSKLDEAIEEEEDDIEEEESNAEKLGYPKAINKWLPNISKLSTSLNGVRLGDKIQCQLPAAPKIMDPVKIFEGNSNHSGSQVGNWRSANEQLPTSASFVKLADMGSETWALFLEKFQELLPEAFRSRKCGAAGQRARQRLGTSCQF

SEQ ID NO: 66465 - protein, 308 aa, Mycobacterium avium subsp. paratuberculosis K-10
MADRLPDDAFTAPQVVDPGLRKVARFLPRGYALHRGLKLQRAIMNLMGNAGRLRTVPVVAVNEHVTVRLHRPPNLAEHAPALLWIHGGGTVMGRAAQDDKYLRKLSHRTGVAIAAVEHRLAPEHPYPAPVEDCYAALLWLARQPWVDPERVAVGGASAGGLFAATLAQRAHDRNDVKIAFQMLVYPMLDDRTGAQRDGPRRLMWTESDNQLAWQWYLNGADPDEAAPARRKDLSGLAPAWIGVGTLDLFYPECLEYARRLREAGVPAQEEIVPGAFHAFDQIVDKAPISAKFFESQCDFLRGALAPNG

SEQ ID NO: 66466 - protein, 574 aa, Saccharomyces cerevisiae
MAVEENNMPVVSQQPQAGEDVISSLSKDSHLSAQSQKYSNDELKAGESGSEGSQSVPIEIPKKPMSEYVTVSLLCLCVAFGGFMFGWDTGTISGFVVQTDFLRRFGMKHKDGTHYLSNVRTGLIVAIFNIGCAFGGIILSKGGDMYGRKKGLSIVVSVYIVGIIIQIASINKWYQYFIGRIISGLGVGGIAVLCPMLISEIAPKHLRGTLVSCYQLMITAGIFLGYCTNYGTKSYSNSVQWRVPLGLCFAWSLFMIGALTLVPESPRYLCEVNKVEDAKRSIAKSNKVSPEDPAVQAELDLIMAGIEAEKLAGNASWGELFSTKTKVFQRLLMGVFVQMFQQLTGNNYFFYYGTVIFKSVGLDDSFETSIVIGVVNFASTFFSLWTVENLGHRKCLLLGAATMMACMVIYASVGVTRLYPHGKSQPSSKGAGNCMIVFTCFYIFCYATTWAPVAWVITAESFPLRVKSKCMALASASNWVWGFLIAFFTPFITSAINFYYGYVFMGCLVAMFFYVFFFVPETKGLSLEEIQELWEEGVLPWKSEGWIPSSRRGNNYDLEDLQHDDKPWYKAMLE

SEQ ID NO: 66467 - protein, 293 aa, Staphylococcus aureus subsp. aureus MRSA252
MAAQDPRTKFKTTDYEKQEQEVPGLQSEMTPAPDCGETSYQGNQRLQGYKMLVTGGDSAIGRAAAIAYAKEGADVAINYLPSEEQDAQEVRQVIEESGQKAVLIPGDIRDEQFNYDLVEQAYQQLGGLDNVTLVAGHQQYHDDIHGFTTEAFTETFETNVYPLFWTVQKALEYLKPGASITTTSSVQGYNPSPILHDYAASKAAIISLTKSFSEELGPKGIRVNCVAPGPFWSPLQISGGQPQSKIPTFGQKTPLGRAGQPVELCGTYVLLASEESSYTTGQVFGVSGGVQID

SEQ ID NO: 66468 - protein, 377 aa, Zea mays
  misc_feature (51)..(51): Xaa can be any naturally occurring amino acid
MSRVAGSRLLPRISALSFCTASPATAAASSSSSTAAVAAAAATASEASSTXAETHPSQPPQTARKPWGALKFAAFAAVSTAVGGTGYVSYAYSLEEVDQMTRELRKKSKQPIPEDASGFERFQAMAYSAAMKVPVAAIELYLDVRSQIEDQIRGFSEPVSDKLLPDLAPQEQHVLTLVLDLNETLVYSDWKRERGWRTFKRPGVDAFLEHLGRFYEIVVYSDQLSMYVDPVVDRLDPKGNIRHRLSRVATKYENGKHYRDLSKLNRNPAQVLYISAHAKESSLQPENSVEIKPWKLENDDTQLLDLIPFLEYVAMARPSDIRAVLASYQSGDIAAEFIERSKEHQRSVDIFLCSITFLYLIDGNLNVDVPNSTSVKL

SEQ ID NO: 66469 - protein, 167 aa, Vitis vinifera
MFPMVTGFMNYGQQTVRAARYIGQSFMITLSHANRLPVTIQYPYEKLITSERFRGRIHFEFDKCIACEVCVRVCPIDLPVVDWKLETDIRKKQLLNYSIDFGICIFCGNCVEYCPTNCLSMTEEYELSTYDRHELNYNQIALGRLPMSVIDDYTIRTILNSPQITSE

SEQ ID NO: 66470 - protein, 806 aa, Coccidioides immitis RS
MASYNPPGHLPVPVPKRRRVAILTSGGDAPGMNGVVRAVIRMSIHCGCEAYAIHEGYEGLVQGGELIRRMHWEDVRGWLSRGGTLIGSARCMSFLQREGRLKAAKNMVTRGIDALIVCGGDGSLTGADVFRSEWPGLLDELVKKGELTANQTSPYKTLNIVGLVGSIDNDMSTTDATIGCYSSLHRICEAVDEVFDTAASHQRGFVIEVMGRHCGWLALMSAISTGADWLFIPEMPPRDGWEDDMCEIITQARKRRTIVIVAEGAQDRSLNKITSDAVKAILSNRLKLDTRVTVLGHTQRGGPACAYDRWLATLQGTEAVRAVLEATPDSPSPIITIRENKIERGSLIDAVAATKKVAKCVAEKRFEEAMQLRDSEFKAYHRAYINTTTPHHPKMLLPQEKRMRIAIIHVGAPAGGMNPATRAAVAYCIARGHTPVAIYNGFPGLCRHHADKPLGSVREVNWLESDSWVNEGGSEIGTNRGLPSEDMPTTAYCFERYKFDALFIIGGFEAFTAASQLRKARKDYPSLKIPIVVLPATISNNVPGTEYSLGSDTCLNTLVNFCDVIRQSASSSRRRVFVIETQGGRSGYIAVMAGLAVGAYAVYIPEEGIDIKMLARDIEYLRHNFATDRGASHAGKIILRNEKASSTYTTQVIADMIKEEAKGRFESRAAVPGHFQQGGKPSPMDRIRALRLALRCVQHLESFSGRSRDEIDADEMSSVVIGIRGSEVVFGPMSGEEGLEATNTDWEHRCPRNQFWMKLRNLVDTLSGRPSESKDGKVKLADDEGWDSGAVSDPCHLCGTPKIAIG

SEQ ID NO: 66471 - protein, 393 aa, Vitis vinifera
MNVPATREDLMIVNMGPHHPSMHGVLRLIVTLDGEDVIDCEPILGYLHRGMEKIAENRTIIQYLPYVTRWDYLATMFTEAITVNAPEQLGNIQVPKRASYIRVIMLELSRIASHLLWLGPFMADIGAQTPFFYIFRERELVYDLFEAATGMRMMHNYFRIGGVAADLPHGWIDKCLDFCDYFLTGVAEYQKLITRNPIFLERVEGVGIIGVEEAINWGLSGPMLRASGIQWDLRKVDHYECYDEFDWEVQWQKEGDSLSRYLVRIGEMVASIKIIQQALEGIPGGPYENLEIRCFDRARDPELNDFEYRFISKKPSPTFELSKQELYVRVEAPKGELGIFLIGDQNVFPWRWKIRPPGFINLQILPQLVKRMKLADIMTILGSIDIIMGEVDR

SEQ ID NO: 66472 - protein, 229 aa, Solanum tuberosum
MAAILARKSLSALRSRQLVLAGHTIEGTNGYNRTLLGTRSFATKHSFSTDKDDEEREQLAKELSKDWNSVFERSINTLFLTEMVRGLMLTLKYFFEKKVTINYPFEKGPLSPRFRGEHALRRYATGEERCIACKLCEAICPAQAITIEAEEREDGSRRTTRYDIDMTKCIYCGFCQEACPVDAIVEGPNFEFATETHEELLYDKEKLLENGDRWETEIAENLRSESLYR

SEQ ID NO: 66473 - protein, 565 aa, Arabidopsis thaliana
MKIPEEEVALLEDYVSDSVDHRGFPAGKSSTGGWRSAWFIIGVEVAERFAYFGIACNLITYLTGPLGQSTAKAAVNVNTWSGTASILPILGAFVADAYLGRYRTIVVASLIYILGLGLLTLSASLIIMGLSKQRNDASAKPSIWVNTLFFCSLYLVAIGQGGHKPCVQAFGADQFDAEDPKEVIARGSFFNWWFLSLSAGISISIIVVAYVQENVNWAFGFGIPCLFMVMALAIFLLGRKIYRYPKGHHEEVNSSNTFARIGRVFVIAFKNRKLRLEHSSLELDQGLLEDGQSEKRKDRLNFLAKAMISREGVEPCSGRDVDDAKALVRLIPIWITYVVSTIPYAQYITFFTKQGVTVDRRILPGVEIPAASLLSFVGVSILISVPLYERVFLPIARKITKKPFGITMLQRIGAGMVLSVFNMMLAALVESKRLKIAREHGLVDKPDVTVPMSIWWFVPQYLLLGMIDLFSMVGTQEFFYDQVPTELRSIGLSLSLSAMGLSSFLSGFLISLIDWATGKDGWFNSNLNRAHVDYFYWLLAAFTAIAFFAFLFISKMYVYRRLDQV

SEQ ID NO: 66474 - protein, 79 aa, Lactobacillus fermentum
MKRAVRIGVGGPVGSGKTQLIERLTRRIHNDYNVAVITNDIYTKWDAEYMAKNSVLDEDRIIGVETGGCLTLLFVKMLQ

SEQ ID NO: 66475 - protein, 104 aa, Cryptococcus neoformans var. neoformans JEC21
MTADVKSLVDKAIADNKVVVFSKTYCPYCKRAKSYLAEDTKDIEILELDEREDGAAIQAYLKELNGQGTVPHVYINKEFIGGSSDLLKLSHEQVKQKISAAASA

SEQ ID NO: 66476 - protein, 878 aa, Clostridium perfringens SM101
MNYLEVKKDIYWVGSLDPELRVFDIIMYTPYGTTYNSYVVKGSEKIAVFETVKEKCFDDYLSKLNSLGIDPKSIDYIVVDHTEPDHAGSVEKLLELSPKAKVIGSMQAIEFLKDIVNKDFEYIVVGDNDTISLGNKTLQFISAPFLHWPDSMYTYIPEDKALITCDSFGSHYSCEEVFNDLVPNEEEYLDALRYYYDCIFGPYKPYVLKAIDKIKDLDIELVCPGHGPILRQDPWKIINTYKEWSTPVKPKINGDKKVTIPYVSAYGYTKELAEEIAKGIQCEHNVEVKLYDLTYSKQEDVLADIGESDGILFGSPTIVGELLPPIRILLANLNPIIHGGKYAAAFGSFGWSGEAVPRIEARLKELKMNIFGPGLRIKFKPSTTELKEAFEFGRDFSRTMFGEKELDYAPNNATETKEVLTGNGKTRYWKCLVCGEIFESPVCPEVCPVCGAGKEQFIEVEMDTFEKNDTNDNFVIIGNGAAGFYAAKTIREINSTASVKLLSSEEVSSYSRPNLSDLLNEEMNLDTFYLAKSSWYKENNIEELLGVTVTSIDKDAKKVILKDGTEIPYTKLILANGSHNFIPPFRIKNNDEEVTLNCENIHEFKGIYSIKDLKDTFDVKEEMKEAKKAVVIGAGPLGLEAAWEMKLAGLDVTVVEFLPNLMNNQLDQEGADIFKNQVSDCGITFITSEECTEIITKDSKLTSLKLKSGKTLDADILLVSTGIRSNIELAKETGIECNRGVIVNERMETSVKDIYACGDVAEFNGLVYGNWPAAIEMGKTAGANACEAEKAFENFTPSIILDALNTHVFSAGLIRFNDSSYEKISSKDESKGQYTKLFFKDNILVGGIIVGDISKAGQIIIAIDNKLSKAAALSNDLL

SEQ ID NO: 66477 - protein, 240 aa, Zea mays
MEEPPPGSSKAAAARAPRVVGVLAGLLERAAERGDTATPTPAGSAFRGRALPGIPVRRYAERIYRYAGCSPACYVVAYVYLDRLARGQCDSGAGEDEDEDEAAVVGIDSYTVHRLLITSVLVAAKFMDDRHHNNAYFARVGGVEVAEMNALELRLLFALRFRLNVAPDTFARYCAALECHVDTPDAGGPVPQMPPSSHVDGEEAVTSSKGKVAAAGGGSVVVQRSHRQRRAVVQIMTTAQ

SEQ ID NO: 66478 - protein, 374 aa, Spinacia oleracea
MMQPLLTIPPPLPTTSLFDTSFLKHEDNIPSQFIWPDDEKPCSETPPELEVPPIDLGGFLSGDPVAVSKATTLANEACKWHGFFLIVNHDIYFELLVKAHEAMDYFFSQPFSQKQKALRKQGDHCGYASSFLGRFATKLPWKETLSFRYYDDDDDKSSKMVQNYISNLMGTDFQEFGRVYQEYCKAMSKLSLGIMELLGMSLGVGRNYFREFFKGNDSIIRLNYYPPCQKPELTLGTGPHCDPTSLTILHQDHVGGLEVFVDQKWYSIRPNQKAFVVNIGDTFMALSNGKYKSCLHRAVVNSKTPRKSVAFFLCPRGNKVIRPPIELGHPRVYPDFTWPLLLEFTQKHYRADTKTLDSFTKWLQKRSTEDERVK

SEQ ID NO: 66479 - protein, 467 aa, Nocardia farcinica IFM 10152
MTSHYDVVVLGAGPGGYVAAIRSAQLGLRTAVVEQKYWGGVCLNVGCIPSKALLRNAELAHIFHKEAKTFGISGDVSFDFGAAFDRSRKVADGRVKGVHFLMKKNKIDEFDGKGTFVDANTLSVELSKGGTESITFDNVIIATGTVTKLLPGTSRSANVVTYEEQIMTRDLPGSILIVGAGAIGMEFGYVLKNYGVDVRIVEFLDRALPNEDADVSKEITKAYKKLGITITTGAAVQSIDDDGTKVTVAIKDNKSGSVETVTVDKVLQAVGFAPRVEGYGLENTGVALTDRGAIAIDDNMRTNVPHIYAIGDVTAKLQLAHVAEAQGVVAAETIAGAPTLTLGDYRMMPRATFCQPQVASFGLTEEQARAEGYDVKVATFPFTANGKAHGLGDPTGFVKLISDVRYGELLGGHLIGPDVSELLPELTLAQKWDLTVNELTRNVHTHPTLSEALQEAFHGLAGHMINF

SEQ ID NO: 66480 - protein, 475 aa, Bacillus cereus ATCC 14579
MQQPTNEKLHRTMKSRHLFMIALGGVIGTGFFLGSGYTINQAGPGGAILSYLVGGFIMYLTMLCLGELTVAMPVSGSFQKYATKFIGPGTGFMIGWLYWLGWAVTVGLELTSIGLMMKRWFPNVDVWVWCLVFGVILYASNAISAKSYAELEFWFSSIKVITILAFVVLGGSALLGFISYDGKEAAPLFSNFVSNGGLFPNGLAAVLLTMITVNFSFQGTELIGIAAGESENPEKTIPRAIRNTVWRIMLFFILTMTILVGLISWKEAGVIESPFVVVFDKIGIPYAADIMNFVIITALLSVANSGLYAATRILWSLANEGMAPTSFQKVNKRGIPITALVVTIAVAGLSLFTSFLAEDTVYMYLLSIAGLSAVSSWIIIALSQLRFRSQYIKGGGKLEDLKYRTPLYPIVPILALITNSIVVISLAFIPEQRMALYCGIPFIIFCYIYYYISKKRQKPMKVEMEKTNETNNQTR

SEQ ID NO: 66481 - protein, 577 aa, Ostreococcus tauri
MASAARATRRGIVALGRAAVDARSGRRRSAVAATRSNARATRGKAARAFGPTYVTTPIYYVNDQPHIGHVYTSTVADAYARYARARGADVFFLTGTDEHGLKVEQSADKRGIEPQALADENSQKFRDVMTSYDISFDDFIRTTDARHERQVRALVEALQERDAVYLGQFEGWYDEGQEEYYTESKAKELDYKSPISGKDMVRSSEENYYFRLSKFQKELEALHADNPEFLTPSARRNEMIQRLNEGLNDVPISRTNFKWGIKMPEDEKHVIYVWIDALMNYITAIGVGDGKDDAVYSERSKYWPASVHIMAKEISWFHSVIWPALLMALDLPLPQRVHAHAFWIREGRKMSKSLGNFVDLACMDRFKEHYGLDAIRYYLAVEGPIGANDANFSADRVQEIYSSDLVNTLGNSVSRTTAMVNKYFDGEVQSEELNGARVTFENWDMPARTSACVEDALKAYDKLDLPRAAAAAKQIIMDVDVFITETEPFRMAKDASKRAELSACLYQCLESLRIACVLLEPLMPNKMAEFDAGVGLGEGTMDERTTWGGLKPGTKVQKLALFPRVEGLNEQGEPMKA

SEQ ID NO: 66482 - protein, 386 aa, Bacillus sp.
STHFDVIVVGAGSMGMAAGYYLAKQGVKTLLVDSFDPPHTNGSHHGDTRIIRHAYGEGREYVPFALRAQELWYELEKETHHKIFTQTGVLVYGPKGGSAFVSETMEAANIHSLEHELFEGKQLTDRWAGVEVPDNYEAIFEPNSGVLFSENCIQAYRELAEAHGATVLTYTPVEDFEVTEDLVTIKTAKGSYTANKLVVSMGAWNSKLLSKLDVEIPLQPYRQVVGFFECDEAKYSNNAHYPAFMVEVENGIYYGFPSFGGSGLKIGYHSYGQQIDPDTINREFGAYPEDEANLRKFLEQYMPGANGELKKGAVCMYTKTPDEHFVIDLHPKYSNVAIAAGFSGHGFKFSSVVGETLAQLATTGKTEHDISIFSLNRDALKKEAVK

SEQ ID NO: 66483 - protein, 201 aa, Synechococcus sp. CC9311
MRTGEIHRVTGETDVSVRLGLDGSGRCQASTGVPFLDHMLHQISSHGLIDLEITASGDTHIDDHHTNEDVGIAFGQALSKALGDRRGIYRFGHFVAPLDEALVQVVLDCSGRPHISWGLTIPTQKIGTYDTELVKEFFVAVVNNSGLTLHIRQLDGVNSHHIVEACFKAFSRALRMATEIDPRRSGLVPSSKGVLEQAGGS

SEQ ID NO: 66484 - protein, 228 aa, Staphylococcus aureus subsp. aureus MRSA252
MKDVKALKLMTLNDVLSQINGDMTLGIGTGSTMELLLPQMAQLIKERGYNITGVCTSNKIAFLAKELGIKICEINDVDHIDLAIDGADEVDPSLNIIKGGGGALFREKVIDEMASRFVVVVDETKMVQYLGETFKLPVEVDKFNWYHILRKIESYADIKVERRVNEDVAFITDNGNYILDCKLPKGIDPYKFHEYLIHLTGVFETGYFLDMADQVIVGTQEGVKILEK

SEQ ID NO: 66485 - protein, 368 aa, Synechococcus sp. CC9311
MSQDIAVGAAAGIDHKLANGESPMGAHAERLSSLVTTQRASVDRETGLALYRDMTLGRRFEDKCAEMYYRGKMFGFVHLYNGQEAVSTGVIGAMKRQHDWFCSTYRDHVHALSAGVPAREVMSELFGKETGCSKGRGGSMHLFSKPHHMLGGFAFIGEGIPVALGAAFTSRYKRDAMGDSSSDSVTAAFFGDGTCNNGQFFECLNMAQLWKLPILFVVENNKWAIGMAHDRATSDPEIWRKAAAFGMAGEEVDGMDVLAVRAAAERAIERARAGEGPTVLECLTYRFRGHSLADPDELRAEEEKQFWAKRDPLKAFERDLVSDGLVSADELRAIEKEIDAEVQDCVDFALNAPEPDGSELTRYIWAED

SEQ ID NO: 66486 - protein, 334 aa, Streptomyces avermitilis MA-4680
MTTVALKPATMAQALTRALRDAMAADPAVHVMGEDVGTLGGVFRVTDGLAKEFGEDRCTDTPLAEAGILGTAVGMAMYGLRPVVEMQFDAFAYPAFEQLISHVARMRNRTRGAMPLPITIRVPYGGGIGGVEHHSDSSEAYYMATPGLHVVTPATVADAYGLLRAAIASDDPVVFLEPKRLYWSKDSWNPDEPGTVEPIGRAVVRRSGRSATLITYGPSLPVCLEAAEAARAEGWDLEVVDLRSLVPFDDETVCASVRRTGRAVVVHESGGYGGPGGEIAARITERCFHHLEAPVLRVAGFDIPYPPPMLERHHLPGVDRILDAVGRLQWEAGS

SEQ ID NO: 66487 - protein, 455 aa, Streptomyces avermitilis MA-4680
MAQVLEFKLPDLGEGLTEAEIVRWLVQVGDVVAIDQPVVEVETAKAMVEVPCPYGGVVTARFGEEGTELPVGSPLLTVAVGAPSSVPAASSLSGATSASSASSVSSDDGESSGNVLVGYGTSAAPARRRRVRPGQAAPVVTATAAAAATRVAAPERSDGPVPVISPLVRRLARENGLDLRALAGSGPDGLILRSDVEQALRAAPTPAPTPTMPPAPTPAPTPAAAPRGTRIPLRGVRGAVADKLSRSRREIPDATCWVDADATALMHARVAMNATGGPKISLIALLARICTAALARFPELNSTVDMDAREVVRLDQVHLGFAAQTERGLVVPVVRDAHARDAESLSAEFARLTEAARTGTLTPGELTGGTFTLNNYGVFGVDGSTPIINHPEAAMLGVGRIIPKPWVHEGELAVRQVVQLSLTFDHRVCDGGTAGGFLRYVADCVEQPAVLLRTL

SEQ ID NO: 66488 - protein, 936 aa, Aspergillus nidulans FGSC A4
MPSRAASPALSENEFDITGALFQNDSDSDAETQKPTKRKKVPAAPNVNLDFLGEANAGDSDEDDEAFIAEKQTSANRKSANLKGRTVKKGGGFQAMGLNANLLKAIARKGFSVPTPIQRKTIPVIMEDQDVVGMARTGSGKTAAFVIPMIEKLKSHSTKFGARGLILSPSRELALQTLKVVKELGKGTDLKSVLLVGGDSLEEQFGMMAGNPDIVIATPGRFLHLKVEMNLDLSSIKYVVFDEADRLFEMGFAAQLTEILHGLPSTRQTLLFSATLPKSLVEFARAGLQDPTLVRLDTESKISPDLQNAFFSVKSAEKEGALLYILNEVIKMPTGPTEASLRLKEKGPEDSKNKKRKRAEMERAVNMKESPTKHSTIVFAATKHHVDYLYSLLREAGFAVSYVYGSLDQTARKIQVQNFRTGISNILVVTDVAARGIDIPILANVINYDFPSQPKIFVHRVGRTARAGRKGWSYSLVRDADAPYLLDLQLFLGRKLVLGRESDQVNFAEDVAVGSLPRDGLSQTCEWVSRVLDDDADIFAQRAVSTKGEKLYLRTRNAASAESAKRAKQVVTSDNWTAVHPLFQDEASNLEAEREKMLARIGGYRPQETIFEVQNRRGGKGGKASEPDEALDSIKRVRSTLEAKKKQRAQAEELEATTNTDGAEVDGDAFSDLEGDNANIPDNMSLASESDLEVTFSSYNTTDKASKSNSNSKSDSTPTTLFQNPEYFMSYTPANTSLAEDRAYGVHSGTNANFASATRNATMDLQADEGGKGFGEPRTLMRWDKRHKKYVSRQNDEDGSKGTKLVRGESGAKIAATFRSGRFDAWKKGKRVGRLPRVGEAETPGLAADLGGSGGSFGGKRFRHKSEKAPKAADPLRGDYEKMKKKAEAARERAASKVGGVTSGGKSEIRNTDDIRKARKLKQKRREKNARPSRKK

SEQ ID NO: 66489 - protein, 249 aa, Medicago sativa
MPIRNIAVGTPQEATHPDTLKAGLAEFISTFIFVFAGSGSGIAYNKLTNDGAATPAGLISASIAHAFALFVAVSVGANISGGHVNPAVFGAFVGGNITLLRGIVYIIAQLLGSIVCSALLVFVTASSVPAFGLSEGVGVGPALVLEIVMTFGLVYTVYATAVDPKKGNIGIIAPIAIGFIVGANILVGGAFTGASMNPAVSFGPAVVSWSWSNHWVYWAGPLIGGGIAGLVYEVLFINSTHEQLPTTDY

SEQ ID NO: 66490 - protein, 148 aa, Xanthomonas campestris pv. vesicatoria str. 85-10
MRAGLNRADQSPVAPPAARATIVFDGVCLLCNGWVKFLLRHDRRGRYRFAAMQGQAGRALLQQHGLDPDDPLSFLLVDATGAWTDSDAIVRVLAGLGGLWRLSGVLRLIPRRVRDLGYRLIARNRYRWFGRSDHCMLPTPEQHARFLD

SEQ ID NO: 66491 - protein, 660 aa, Bacillus halodurans C-125
MSKEQKTFYLTTPIYYPSDKLHIGHAYTTVAGDAMARYKRLRGYNVMYLTGTDEHGQKIEQKAEAKGLTPKQFVDEIVSGIQDLWKKLDISYDDFIRTTEERHIKVVQQIFEQLLDQGDIYLGDYEGWYSIPDETFYTETQLVDKEYDADGNLIGGKSPDSGHPVEKVREQSYFFRMSKYADRLLQFYEENPQFIQPESRKNEMINNFIKPGLEDLAVSRTSFTWGVPVPRDPKHVVYVWIDALSNYITALGYGSDQQEKYENYWPADVHLVGKEIVRFHTIYWPIMLMALDLPLPKKVFGHGWLLMKDGKMSKSKGNVVDPVPLIDRYGLDALRYYLLREVPFGSDGVFTPEAFVERVNYDLANDLGNLLNRTVAMIEKYFDGKIPSYVKDGTPFDADLVELVYSTVKKVEDAMEEMEFSIALTAIGQLISRTNKYIDETQPWVLAKDESKREQLGAAMYHLAESIRYVSVLLQPFMTKAPQKIWEQLGIDSSLTTWESLETFGQIPGNTNVQKGQPLFPRLDVEEEVAHIKSLMGGSKKPEEAPKDEKEESDEITIDDFSKVELRIAEVIDAEPVKKADRLLKIQLDLGYEKRQVVSGIAKYYSPSDLIGKKVICVTNLKPVKLRGELSQGMILAGSEGDQLRLATVDGALPNGSLVK

SEQ ID NO: 66492 - protein, 577 aa, Aspergillus nidulans FGSC A4
MMDQHPLPFLTHSPIDPGSIDGEKATAYARGVLNRLNAALAASDTEALENCFYSDQASWKDQLALTWHLRTFRCHNTIAASFLDTARLRGLSSGITIDGEAVFLSATPALVCPESPIAYSPSLQDAMNFETDVFIIGAGNAAIALSACLKALGVESVMADRNAHPGDNWARRYDCMRFHVPTAFCDLPYMYRATVYDEELRSPHLLTRQDLTSQVRRYVNSFNLNTLHLAEIQWTEYDELAKKWTIAFQTPAGQCKATSSHLVLATGIGSLKPNIPYIAEPHIYKGISIHSAEYKNAKLLKEQGVKSVVLIGSANTAFDVLENGHSAGLNATMVARSPTYIVPLEYVYHQASLGTYDTESMQPIISSSHCQHLWTDSCVVDCFPRSHRLNWNDTPQSRQPGPCSQQSRTNGSFRESTCLDTDAIIWCTGFADSNVVTTATEILGGKSDVTVANTKIDDQTGRAHVLTPGGIASHLDTTWGVDEEGEIRGMWKRHSHVESIWIMGGYTQQHWWYSRILALQIKAALQVKVGSKDNNSALKGIVSSTLRSIASSCSGRDYYGLSSQGRDKDAISSNTAR

SEQ ID NO: 66493 - protein, 348 aa, Nocardia farcinica IFM 10152
MTEPAPRQAAATGLPRTGREFLLAARPDGVPTADNFALVTRPVPEPAPGQVLVRNTWMSVDPYMRGRMDDRPSYIEPFRLGAPLEGSAVGEVIASRAPAVPVGTTVTHFAGWRDYAVLDATAVTPVDPDLAPPWQYLGALGTTGLTAYAALTDVAPVRPGDTVFVSAAAGAVGSVAGQLAKLLGAGRVIGAAGGPAKTALLREEFGFDAALDHRAGDLAGQLAAAAPEGIDVYLDSVGGGHLRVAVEAMRPRGRIALVGAISGYNGAAAEPGPDLFKAATREVSLRGMLVNSYFDRFGEYIGKAAGWLARGELRTRQTVHEGLEQAPTALLGVLSGANVGKMLVRLAD

SEQ ID NO: 66494 - protein, 482 aa, Glycine max
  misc_feature (323)..(323): Xaa can be any naturally occurring amino acid
MGARCSKFSLCWWPSHLKSNLHNLSDNDDDGKRDENDPRGGFSEYSLDQLRVATSGFSPDNIVSEHGEKAPNVVYRGMLEDDRLVAVKRFNKSAWPDSRQFLDEARAVGQLRSERLANLVGCCCEGEERLLVAEFMPNETLSKHLFHWEAQPMKWAMRLRVALYLAQALEYCSSKERALYHDLNAYRILFDQEANPRLSCFGLMKNSRDGRSYSTNLAFTPPEYLRTGRITPESVVYSFGTLLLGLLSGKHIPPSHALDLIRGKNFLLLMDSCLESHFSNDDGTELVRLASRCLQYEPRERPNVKLLVTALTPLQKETSIGVXSSKETVSLTPFGDACSRRDLTAIHEILEKIGYKDDEDVANELSFQMWTNQIQETLNSKKQGDSAFHARDFSTAIDCYTQFIDGGTMVSPTVYARRCLCYLMNDMAQEALGDAMQAQSISPTWPTAYYLQAAALFTLGMDNDAQESLKDGTTLETRKYRN

SEQ ID NO: 66495 - protein, 321 aa, Arabidopsis thaliana
MVKGSQKIVAVDQDIPIIDMSQERSQVSMQIVKACESLGFFKVINHGVDQTTISRMEQESINFFAKPAHEKKSVRPVNQPFRYGFRDIGLNGDSGEVEYLLFHTNDPAFRSQLSFSSAVNCYIEAVKQLAREILDLTAEGLHVPPHSFSRLISSVDSDSVLRVNHYPPSDQFFGEANLSDQSVSLTRVGFGEHTDPQILTVLRSNGVGGLQVSNSDGMWVSVSPDPSAFCVNVGDLLQVMTNGRFISVRHRALTYGEESRLSTAYFAGPPLQAKIGPLSAMVMTMNQPRLYQTFTWGEYKKRAYSLRLEDSRLDMFRTCKD

SEQ ID NO: 66496 - protein, 1338 aa, Pseudomonas putida GB-1
MANSEVRSVCPYCGVGCGIVMSVADGKVGKISGDKQHPSNFGRLCTKGLTAHLPLSAAGRMADAYVRQQRSQPPVRTSMDQAITDTAMRLRGIIDQHGADAVALYVSGQMSLEAQYLANKLAKGFIRTRHIESNSRLCMASAGSGYKLSLGADGPPGSYQDFEHADVFLVIGANMADCHPILFLRLLDRVKAGARLIVVDPRRSATADKADLFLQVRPGSDMALLNGFLHLLQRNGHTNPDFIARHTEGWDELPPFLDDYTPERVAAITGLAEADIIQAADWIGSASNWMSCWTMGLNQSIHGTWHSNAICNLHLATGAICRPGSGPFSLTGQPNAMGGREMGYMGPGLPGQRSALVATDRAFVEQQWQLAPGSLRSEGGEGTVALFEQMKAGEVKACWIICSNPVASVANRQQVIDGLREAELVITQDAFLDTETNRYADILLPAALWAEGEGVMINSERNLTLMPRAVQPPGQSLPDWQIIARVACAMGYADAFDYPDAEAVYEEIRRFHNPLTGYDLRGIGYAELRTQPRQWPCAPGREQARSPLRYLNDGSSQALLLDAQGQRPALAFPTASGKARFFARPWLPAPELPNDDYPMVLNTGRVQHQWHTLTKTGKVPALNKLEPGPFVEIHPEDAARLGVAEKDQVAIRSRRGQAVLPARISDRVMPGNCFAPFHWNDLIGEQLAINAVTCDAVDPLSLQPAFKHCAVALERVASERIDALDLNTATSEPARMPTATLSRLLGLDTLPTPVLAEEERHYLQGFLLGLDQARAEGVPALPASAPLAANRRLFVDGLLAGLFAQPATAPPAALTVPLHQVLWASQTGNGELLAERCAERLRGAGLSVQLRCMEAVSPSQLQGAASVVLIASTFGDGDAPDSAAAFWQALQGEGGAHCAELPYAVLALGDSSYDQFCGFGRKLDLRLAELGGRRLLQRVDCEPDFDEAFAGWLEALLAELGSATAPLPASDPAPVAAYSKQQPWAATLRENRLLNGPGASKETRQLVFDLSGSGFTYAAGDALGVWPRNCPALVDELLALTQLDGQALVELKGQPAMPLAEALQAHLEIAKVSPQQLQAFAGNAPDLQRLLQPACKAELQDWLWGRQLTDVLRAFPQQLPLAHWLELLKPLQPRLYSISSSPLAHPEQVHLTVSTVRYGKRKGVCSSFLADRAQALKVAIFPQVSKHFRLPEDDNVPVIMVGPGTGIAPFRAFLEEREARGAKGGNWLFFGEQYAATDFYYREQLQAWQAGGHLRLDTAFSRDQAEKIYVQQRLREQGAQVWQWLEAGAYFYVCGDAQRMAKDVDAALREVIAVHGKVDADAYVETLNKAKRYRRDVY

SEQ ID NO: 66497 - protein, 366 aa, Zea mays
  misc_feature (153)..(153): Xaa can be any naturally occurring amino acid
  misc_feature (164)..(164): Xaa can be any naturally occurring amino acid
  misc_feature (176)..(176): Xaa can be any naturally occurring amino acid
  misc_feature (207)..(207): Xaa can be any naturally occurring amino acid
  misc_feature (216)..(216): Xaa can be any naturally occurring amino acid
  misc_feature (226)..(226): Xaa can be any naturally occurring amino acid
  misc_feature (242)..(242): Xaa can be any naturally occurring amino acid
  misc_feature (298)..(298): Xaa can be any naturally occurring amino acid
  misc_feature (307)..(307): Xaa can be any naturally occurring amino acid
  misc_feature (311)..(311): Xaa can be any naturally occurring amino acid
  misc_feature (333)..(333): Xaa can be any naturally occurring amino acid
  misc_feature (340)..(340): Xaa can be any naturally occurring amino acid
SESESEAASRRQGEMGKGAQGSDAAAAGGEVEENMAAWLVAKNTLKIMPFKLPPVGPYDVRVRMKAVGICGSDVHYLREMRIAHFVVKEPMVIGHECAGVVEEVGAGVTHLSVGDRVALEPGVSCWRCRHCKGGRYNLCEDMKFFATPPVHGXSLANQVGAPGXHLCFKLPDGVSXLEEGAMCRPADRGACTRAAARGVGAPSAVLXVGAGPIGLXVSLLAGRAFXAPRVVVVDVDHHRLAXARSLGPGPCPAGVPPPRGDLADKGERIRTAMGSDIDVSLDCARFNKNMSTALEAKXPPRKSSLCXICHXQMTLPLTSSGAPEGGLVGLIPXKDTWRLXSTFLRTGRGRARHLSPHAFGFFQREG

SEQ ID NO: 66498 - protein, 665 aa, Yarrowia lipolytica CLIB122
MTHQRDNDADRDNSGNPREEYAEDNSPDSPDSPDQPPSQRRSERGRQTETIPIIVRQEENWGPDFWRDPPGTHLMRDTLKNRAMFYSLARQGFYPPMCRYERRKMQHLVRPPTRGLPYSKERLAALNEALRKLEDPNAVFDPDFEADLIAEYEGDLQAQREAVIRAEQSARRRARLEVRREAQQAELAARRARQEAHRQSSLGDAAPRSAYFDQSALDAMSRVAAGSSAEAEESADERPESSGRPRKRRKIAIDDEDSDERPHTWSGTGWDDHQKIAPDLQESGGFPDQDGDDVFLDASDEFDDSPVSAPVVSPRDFENLYEDDSSDEPIASSSRDVPRPSAPFNQTTHVGSDVSQSPRRSVPNYQPRPVFVKESAPDPDGPSDSSSGEESDDNNKPNRDKGKAPASSSDDISASESDPSYSPPSKAPATTLEQQKVASLDRSGLAEESVPNPDGPSSSRSGEENRTHDTENNGSVVPNSSIPQVHDADERSNAASQPEQPTPYLPGSDVADDPRGSEASLVRGTPTDQNTANNASIRLTRELESLTQQPTKPKPNTGNNTRRQGTGGKGLGKGGAKRHRKVIKDVIQGVTKPSLRRIARRGGVKRISTQIYEEGRTMLKIFLENLIKDAVAYTEHAKRKTVTSLDVVYAAKRRGRPIYGYGWSR

SEQ ID NO: 66499 - protein, 125 aa, Glycine max
MAFWQARDFLFCGVCGTLLDFNSHRYASCPLCGFKRKAKEIEGKETRYAVTAEDIRRELKIKPFVVLESAPNMDIVVQRSLTERACPECNHHELEYYTKQLRSADEGQTIFYECPECGHAFNENT

SEQ ID NO: 66500 - protein, 449 aa, Bacillus cereus ATCC 14579
MFFTQLFKPAPHAERLPADRVDSEYRKLRLQVFLGIFIGYAGYYFVRKNFSLAMPYLIEQGFSKGELGVILSAVSIAYGLSKFLMGIVSDRCNPRYFLAAGLFLSGIINIIFGSFSFITTSIILMFVLQFLNGWVQGMGWPPCGRTMVHWFSISERGTKMSIWNVAHNVGGALMPSLVTLGLYFFADDWKSIFYFPGILSILVGIYVLITMKDTPQSCGLPSIEEHTGEYPPDEKVKDRERELSVKEILFKYVLNNKFLWYIAIANVFVYFVRYGVVDWAPTYLVEEKSFTHSSSRTAYALYEWAGIPGTLLCGWMSDKLFKGRRAPAGILFMVGVFIAVLVYWLNPPGNPMVDSIALVAIGFLIYGPVMLIGLHALDLAPKKAAGTAAGLTGFFGYLGGAAFASAAMGFIVDAFGWDGGFILLLASCVLAMFFLALTLNTGSVKSKQA

SEQ ID NO: 66501 - protein, 566 aa, Geobacillus kaustophilus HTA426
MEKPWLAHYPPEIPHTLDYPKKTLSDYLRETAEQFGDHEAIDFFGKTMTFRELYEQALTFAHYLRTIGLKKGDRVAIMLPNCPQAVISYYGTLLAGGIVVQTNPLYTEYELEYQLNDSGASVLVTMDLLYPKAEKVKGRTPVKHWIVTRMQDYLPTVKKWLYPLVQRKQNMPIVRIEESETVHMFRTIVSQKETAPIGVDIDPVEDVALLQYTGGTTGHPKAAMLTHRNLIANTLMCAHWVYKCEKGKETVLGVLPFFHVYGMTTVMNLSVMMASKMVLLPRFDVKQTLKAIERTRPTMFPGAPTMYIALLNHPDLPKYDLSSINVCISGSAPLPVEVQEQFERATGGKLIEGYGLTEASPVTHSNFLWDGERVKGSIGVPWPDTDAKIISLETGEEAKPGERGELVVRGPQVMKGYWNRPEETEQVLRDGWLYTGDIGYMDERGYFYIVDRKKDVIIAGGYNIYPREVEEALYEHPKVQEAAVIGVPDPYRGETVKAFVVLKPGEMCSEQELDAFMRQRLAAYKVPRIYEFRSELPKTAVGKILRRVLVEEEKKKLDKSAELPVK

SEQ ID NO: 66502 - protein, 336 aa, Salmonella enterica subsp. enterica serovar Typhi str. CT18
MKAAVVTQDHQVDVTEKTLRPLRHGEALLKMECCGVCHTDLHVKNGDFGDKTGVILGHEGIGVVAEVGPGVTSLKPGDRASVAWFYEGCGHCEYCNTGNETLCRNVKNAGYTVDGGMAEECIVVADYAVKVPEGLDSAAASSITCAGVTTYKAVKISHIKPGQWIAIYGLGGLGNLALQYAKNVFNAKVIAIDVNDGQLKLAEEMGADLTINSRTEDAAKIVQEKTGGAHAAVVTAVAKAAFNSAVDAVRAGGRVVAVGLPPEAMNLDIPRLVLDGIQVVGSLVGTRQDLTEAFQFAAEGKVVPKVALRPLEDINVIFKEMEQGQIRGRMVIDFRR

SEQ ID NO: 66503 - protein, 562 aa, Ostreococcus tauri
MLSRSFSLGAAYAGALSLARALVTLDVATMFARPTPTDAASRVRRRVRDARAIAGGLRTAFEPVPTPGCFESPYPRVVTRQTRLRATPRTPPIARAHRAAHGLPRRPRVPPTSPGMRSKRRWASVSHGSFICLECSGIHRSLGVHVSFVRSVGMDSWSEAQLKKMSAGGNGTLNAFLARHGIEKSCDVASKYNSAAAAAFRDKVKTESEGGRWIEPKNIERGVKNVDGGAAKMGGAAMGGRGGGDDWAWGEGGTNAPRARPGQEYTQADYMRSASNKDAFFAKQQALNASKPEGLHPSQGGKYVGFGSGGGAPPRREDDIDAIIGQVTNVTSKLGQFTMSAANRAAQATSSIVSNISDGDYDALQHRAKHTATAAASKASELAQTGWSFFKTASQQAMKSFETLTSDIPTTGFDDGSSGRRSGDVGWNNGGNGWNGGDDEYRGDPIAAQRDDFFARKQAENAGRPANLPPSQGGKYAGFGSQSSFQSAQSQPQSQRSFSRSQSYSQPPPRQASGHSSRHSSRPPSRSASVHDEWGVSDSEDQPASSKKSAEEDDWGDADWGT

SEQ ID NO: 66504 - protein, 577 aa, Salmonella enterica subsp. enterica serovar Typhi str. CT18
MPGTVIRKRVSNMETTTKKARSLYIPYAGPVLLEFPLLNKGSAFSVEERRNFNLSGLLPEVVESIEEQAERAWLQYQGFKTEIDKHIYLRNIQDTNETLFYRLVQNHLEEMMPVIYTPTVGAACERFSEIYRRARGVFISYPNRHNMDDILQNVPNHNIKVIVVTDGERILGLGDQGIGGMGIPIGKLSLYTACGGISPAYTLPVVLDVGTNNQQLLNDPLYMGWRHPRITDDEYYAFVDEFIQAVKQRWPDILLQFEDFAQKNAMPLLTRYRDEICSFNDDIQGTAAVTVGTLIAASRAAGSQLSEQKIVFLGAGSAGCGIAEQIIAQTQREGLSEDAARQNVFMVDRFGLLTDRMPNLLPFQAKLVQKCDNLQHWDTENDVLSLLDVVRNVKPDILIGVSGQTGLFTEEIIREMHKHCPRPIVMPLSNPTSRVEATPQDIIAWTEGNALVATGSPFSPVIWKDKVYPIAQCNNAYIFPGIGLGVIASGASRITDEMLMSASETLAKHSPLVNNGEGLVLPALKDIQVVSRAIAFAVGKMAQQQGVAVKTSAEALQQAIDDNFWKPEYRDYRRTSI

SEQ ID NO: 66505 - protein, 556 aa, Neisseria meningitidis FAM18
MEKIWLDSYEKGVSAEIDITQYNSISDVFRQSVEKFARLPAFQNMGKTLTYAETGKLATDFASYLQNVLKLPRGERVAIMMPNVLQYPIALFGILQAGLVAVNTNPLYTPRELEHQLKDSGTTAIIVLENFANTLELVLPRTQIKHVIVASVGEMFGLLKGSLINFIIRKIKKMVPEYRIRETVSFQTALKEGAKHVFQPVALNREDTALLQYTGGTTGVAKGAVLSHGNICANMLQAKEWIKNQLREGKETVIAALPLYHIFALTVNLMIFANAGSKIILITNPRDMKGFIGELKKQRINVFIGVNTLFNAMVNRPDFAEVDFSELRLTLGGGMATQKAVAEKWKKITGTPIVEAYGLTEASPGVCCNPLNIESYSGSIGLPVSSTEVELRDANGKEVPVGQPGELWVKGPQVMQGYWNRPEETAKAIDARGFLETGDIAVMDEKGWLKLVDRKKDLIVVSGFNVYPNEIEEVIAHHGKVMEVACIGVPDEKTGEALKVFVVRKDPSLTKEELIAFCRTELTAYKVPKDIEFRDELPKSNVGKILRRELRQSTGK

SEQ ID NO: 66506 - protein, 286 aa, Bacillus subtilis
MRNICVIGSCSMDLVVTSDKRPKAGETVLGTSFQTVPGGKGANQAVAAARLGAQVFMVGKVGDDHYGTAILNNLKANGVRTDYMEPVTHTESGTAHIVLAEGDNSIVVVKGANDDITPAYALNALEQIEKVDMVLIQQEIPEETVDEVCKYCHSHDIPIILNPAPARPLKQETIDHATYLTPNEHEASILFPELTISEALALYPAKLFITEGKQGVRYSAGSKEVLIPSFPVEPVDTTGAGDTFNAAFAVALAEGKDIEAALRFANRAASLSVCSFGAQGGMPDKK

SEQ ID NO: 66507 - protein, 311 aa, Mannheimia succiniciproducens MBEL55E
MDYLQNARETLATEKDALTLLSRNLDQSFNNVIDLILNCGGRLVIGGIGKSGLIGRKMVATFASTGTPSFFLHPTEAFHGDLGMLKPIDIVMLISYSGESDDVNKLIPSLKNFGNTIIALTGNKHSTLAKHADYVLDISVEREACPNNLAPTTSALVTLALGDALAVALINARHFQPMDFAKFHPGGSLGRRLLCRVKDQMQTNLPVTALNTSFTDCLTIMNEGRMGVALVMENDDLKGIITDGDIRRALAANGADTLNKVARELMTSNPKVINQDTYIGQAEDYMKEHRIHSLIVVDNDNKVVGLVEFSS

SEQ ID NO: 66508 - protein, 144 aa, Glycine max
MASLATLAAVQPATINGLAGSSLSGTKLSFKPSRHSVKSKNFRSGAVVAKYGDKSVYFDLEDLGNTTGQWDLYGSDAPSPYNPLQSKFFETFAAPFTKRGLLLKFLILGGGSTLAYFRATASGDILPIKKGPQLPPKLGPRGKI

SEQ ID NO: 66509 - protein, 343 aa, Brassica napus
METSAASVTVSVAIVVVLWWVWRTLNWVWFKPKKLESYLRRQGLSGTPYTPLVGDVRRDYTMSMEARSKPIKITDDIVPRVVPFPSHMLKTYGRTFFTWRGPIPTITITDPEQIKEVFNKIYDFQKPHSFPLGRLIATGLFSYDGDKWAKHRRIINPAFHLEKIKNMVPAFHQSCSEVVGKWDKLVSDKGSSCEVDVWLGLVSMTADVISRTAFGSSYKEGQRIFELQAELALLLTQAFRRIFIPGYRYYPTKGNRRMKAAAREVQDILRGIVNKRLRARESGEAPSEDLLGTLLESNLGQTKGTGMSIADVIEECKLFYFAGQETTSVLLVWTMVMLSQHQD

SEQ ID NO: 66510 - protein, 268 aa, Brassica napus
  misc_feature (229)..(229): Xaa can be any naturally occurring amino acid
DGESEESDSDEEDRKKSTSIRKKRRYSDSDGSSDASEISASSSGDEQHTKSKIKRRKKLSGDGSDEGRRSKKKKRSRSGRKRPGHRRKSSDISASGEERSRSKSRRRKKLSGDGSDTDLKAKLEEKVKDTELDEEELKKFKEMVNESKKKSLAPEDDDEEAEVGPMPLPKAEGHISYGGALRPGEGDAIAQYVQQGKRIPRRGEVGLNADEIQRFEDLGYVMSGSRHQXRMNAIRIRKENQVYSAEDKRALAMFNYEEKAKREAKVMS

SEQ ID NO: 66511 - protein, 124 aa, Bacillus halodurans C-125
MKVVHTNQAPDAIGPYSQGIVVNNMFYSSGQIPLTAEGELVQGTVEEQTHQVFKNLQAVLKEAGASLDTVVKATVFIKDMNDFPRINEVYGEYFQTHKPARSCVEVARLPKDVLVEIEVIALVK

SEQ ID NO: 66512 - protein, 344 aa, Zea mays
MSPELTGKMAAKAAAAAAAVKPATRAYVTFLAGDGDYWKGVVGLAKGLRKVGSAYPLVVALLPDVPESHRRILVSQGCILREIEPVYPPENQTQFAMAYYVINYSKLRIWEFVEYERMVYLDADIQVFENIDELFELEKGYFYAVMDCFCEKTWSHTPQYRIGYCQQCPDKVAWPTTELGPPPPLYFNAGMFAHEPSMATAKALLDTLRVTPPTPFAEQDFLNMFFRDQYRPIPNVYNLVLAMLWRHPENVQLEKVKVVHYCAAGSKPWRFTGKEANMDREDIKTLVNKWWDIYNDEALDFKGLPLSPADADADDEVEAVAKKPLRAALAEAGTVKYVTAPSAA

SEQ ID NO: 66513 - protein, 130 aa, Alteromonadales bacterium TW-7
MNKAFISTEKAPAAIGTYSQAVKVGTAVYLSGQIPLVPETMEVISEDFSEQTHQVFKNITAVCEEAGGKIQDLVKVNIYLTDLSNFAVVNEVMSQYFKQPYPARAAVGVRALPKGVQVEIDGIMELPSTN

SEQ ID NO: 66514 - protein, 212 aa, Schizosaccharomyces pombe
KARHLIKLYEAEGIGRERVLIKIASTYEGIQAAKQLEEEGIHCNLTLLFSFVQAVACAEANVTLISPFVGRILDFYKAKNNRDYTAQEDPGVVSVSNIFNYYKKFGYKTIVMGASFRNVGEIKELAGVDFLTISPALLEQLNNSTDAVPKKLDASKASSLNLEKVSYLTDEPKFRFDFNNDEMAVVKLSTGIAAFAKDADTLRTILKAKLEA

SEQ ID NO: 66515 - protein, 233 aa, Arabidopsis thaliana
MASYQRLCITSCTIFFCLLSLSSSQKVTLSLYYEALCPFCAEFIVNRLPKIFETGLISSIDLQLVPWGNAAIRPDGTILCQHGEAECALNAIHACAINAYPDVMKHFGYIYCTEQLVLENKLEKWADCLEMVGLSRAAVDCYINGYGNQLEQRYAEETSELYPAHRFVPWVVVNNLPLQENYQNFVMYVCNAYGSNQVPEACRILNSSVETLSRSNSSVEKLSNSPQVCYSNH

SEQ ID NO: 66516 - protein, 302 aa, Cryptococcus neoformans var. neoformans JEC21
MPSPAVDLLKQKTASLPNAPISVVAANTFVPPTQPVTAGNQLPTSVPLPVLPAVEAAKRLAAYAAVDRHIAHEHKVIGIGSGSTVPYVVDRILAQGFEANKDRVFLPTGFQSKELIVKAGLTLGDVDQYARIDVTIDGADEVDNELNSIKGGGACQLREKVLAEAADTWIIVADYRKNSEVLGTSWTKGIPIEVVPFAYAKVLTNLAHMGSPHVLPNGQPGLSLRMGKMKAGPVVSDNGNFIIDAPFAEELMRQPEELLHKIKMLTGVVEVGLFCGMAKAAYFGNEDGSVTIRSDDGTISQL

SEQ ID NO: 66517 - protein, 553 aa, Oenococcus oeni PSU-1
MKSDIEIDHSIKALPITEIGKQIGLSDSQLIPYGHDKAKIDAYSIANMPRQGKLVLVTSINPTPAGEGKTTVTIGLVDAINRLGKSAIGALREPSMGPVFGLKGGATGGGYAQVIPMEDINLHFTGDIHAVSAAHNLLAAVIDNHLHQGNELKIDPENIYWRRVLDMNDRALRQITLGKGRVNGPERNSGFDITASSEIMAVLTLSKNLFDLKKRLSRIVVALDVQGKPVTVADLKVAGALTAILKDAINPNLVQSLEHSPFIIHGGPFANIAQGTNSVVATDAALKLADFAVTEAGFGSDLGGEKFMDVKVPVLGKEPDAVVIVATVKALKFHGGVALDHLSDKNVDAVRNGLDNLNRHLEAMTHYGKPVVVALNKFLDDDMEEIQLIKNFVEGEKKLQFEIVTSFVDGFEGSLDLAKKVIEATDNQRFFMPLYQADDSIENKIQTIVEKIYGGKDFELSDRAKKDLAEVKENGWGKLPVVIAKTPNSLTDDSKIHGAPTGFTIHIRRFIPKIGAGFIVAMAGKVLMMPGLGKNPAAEKIDVDENGKISGLS

SEQ ID NO: 66518 - protein, 1068 aa, Cryptococcus neoformans var. neoformans JEC21
MSSSAPSDPPLSASSLTVKHKKRSSKDKSGTPSPRPSKTARLDQEDGADDPMDVLEEGKDGRSRDPMEALEDGAMPKVEDEYEVQAEREVDAAKDFADVTAPGQEAKLKLVHQVRHQVAIPPDYPYIPINQHKRKDPPARTYKFELDPFQFVSTSCIERNESVLVSAHTSAGKTVVAEFAIATCLKEGRRVVYTSPIKALSNQKFREFTETFGDVGLMTGDVTINPEASCLVMTTEILRSMLYRGSEVMREVAWVIFDEVHYMRDKERGVVWEETIILLPHTVRYVFLSATIPNSMEFAEWICATHEQPCHVVYTDFRPTPLQHYLFPAGSEGIYLVVDEKSNFRDDNFQKAMAALAQGQGEDPANPSGGKGKKGKTKKGGALKGETSDIYKIVQLIMRRNLNPVIIFAFSKRECEDLAMQMQKFDFNTPDEAATVAQVFESAIGSLSEDDKKLSQIEGILPLLKRGIGIHHGGLLPILKEVIEILFQEGLIKALFATETFSIGLNMPAKTVVFTSVRKFDGKDFRNLSGGEYIQMSGRAGRRGLDARGIVIMMCDEKIEPEAAKGMVKGQADRLDSAFHLGYNMIINLMRVEGVSPEYMLEKCFFQFQNSMSVPVLEKQLKEAEAERDAIVIEREDEIEEYYELRQQLKERGQDFQAVITHPAYCLRFLQAGRLVEIRDGDKDFGWGVVVAFNKVVNQRGRPPIWTDQDPPQKQYIVDVLTRVETGASIPRDRSASEISPPSGADKGEVAIIACSLSTVQSISQYRVNLPKDLRGQQEKNTAFRAVNEIKKRMPDGPPLLDPIKSMGISDKSFVDLVKKIALLENRLQTLEITKSPELPRLYDLYDRKQKSIQSVKSLKRRINSVHDILQLEELKSRKRVLRRLGFTTADDVVEMKGRVACEISTGDELMLTEMMFGGTFGTLAPEQCAALLSCFVFQEKSEAKVRLKEELAVPLRTLQETAKRIAKVSNESGIAIVEDEYVQSFKVEMMDVVLQWCKGAKFSQICEMTDVFEGSIIRCFRRLQELIRQMGQAAHAIGNTELEEKFAKSMELLERPNTVVFNPSLYL

SEQ ID NO: 66519 - protein, 298 aa, Bacillus cereus ATCC 14579
MPNIAVVGSISMDLVAVSKKRPKAGETVIGEAFHTIPGGKGANQAVAAARLGANVAMVGAVGNDDYGTVVRKNLENERIFIDYVVPVTDRTTGIAHIVLAEEDNSIVVVQGANALVNKSVVDRSKDLLVKADMVVLQLEIPLETVKYVLAICEEHNIPVMLNPAPAQVLSEEILEKATYITPNEHECRIVLDDFTSPIEDLLAKYPNKLLMTEGSNGVRFHNGTEIVHVPSIAVDVVDTTGAGDTFNGALAVALSEGETLQKAIRFANIAGGLSVTKLGAQGGMPTRDRVREVQVIVG

SEQ ID NO: 66520 - protein, 162 aa, Solanum commersonii
MAAEVEYSCFVGGLAWATTDRTLSDAFSTYGEVVDSKIINDRETGRSRGFGFVTFKDEKSMKEAISGMNGSELDGRNITVNEAQARGSGGGGGGGGGFGGGRRREGGGGGYGGGGGYRGGGGGGYGGGRREGGGGGGYGGGRREGGGGGGYGGGGYGGGDRY

SEQ ID NO: 66521 - protein, 174 aa, Oryza sativa (japonica cultivar-group)
MVYHSSFVDDTGITKACGCPLLPLKTHIRGPAPAFDQDKADIVDEAITFFRANVFFKNFNVKSPADKLLIYLTFYINIALKRLEGCRTLAVGTKAIINLGLEKVPVPGEPGFPFPGLFTLPQSQEEAELLRNYLKQIREETSGRLLNCAYRANGTPNKWWLAFAKRKFMNIVIL

SEQ ID NO: 66522 - protein, 427 aa, Oenococcus oeni PSU-1
MQIKNNQLYIGGVSADQIAQQFGTPVYVYDVGQIRSIISDMKEAFDAEKLNYQISYASKAFSTVAIYDVLKHEIIHCDAVSGGEIATIAKAGFPMKNVSFNGNNKSADELMMAIDYKIGTIIVDNFHELDLLNEILSERKISQNVLMRISPGISAHTHKFISTGQQDSKFGFDLASGQAKKAFDKIQASEYLNLLGLHAHIGSQIFESSGYSKLVDLLIKTASKWHFQAEIIDVGGGFGIKYTDADDPIPNAEFIHLICQTAKASSRKYHAKLPEIWVEPGRSIVGPAGYSLYTIGGRKDIPGIRSYLSVDGGMGDNIRPALYQAEYKAVLVDQVDLPSEQVVRIAGKYCESGDVLIQKQELPKTYPGDLLAVLATGAYGYSMASNYNRNPRPAVVFAEKGKAKLVVKRETYEDITHLDLNYEVEND

SEQ ID NO: 66523 - protein, 219 aa, Burkholderia vietnamiensis G4
MQEIIDGFLKFQRDIMPARRELFRKLATSQTPRTLFISCSDSRMVPELVTQREPGDLFVIRNAGNIVPSFGPEPGGVSATVEYAVAALGVTDVVICGHSDCGAMTAVATCKCLDHMPAVANWLRYADSAKLVNQAREHAGERERVDSMVRENVIAQLDNLKTHPSVALGLAQGRLNLHGWVYEIESGSIDALDAATRQFVPLAAHPDVTATPAECVAAL

SEQ ID NO: 66524 - protein, 321 aa, Durio zibethinus
FIILCGATHFINLWTFTMHSKAVAVVMTIAKVSCAIVSCATALMLAHIIPDLMSVKTRELFLRNKAEELDREMGFILTQEETGRHVRMLTHEIRSTLDRHTILRTTLVELGRTLGLEECALWMPSRTGMNLLLSHTLNYQIKVGSTVPINLPIINEVFNSARAVHIPYTCPLASMIRPLVGRYVPPEVVAVRVPLLHLSNFQINDWPDLSAKSYAVMVLILPTDSARKWRDHELELVEVVADQVAVALSHAAILEESMRARNQLVEQNVALDLARREAEKAIHARNDFLAVMNHEMRTPMHAIIALCSLLLETDLTPERIP

SEQ ID NO: 66525 - protein, 526 aa, Pseudomonas putida GB-1
MTSARTRPSTRTRQPVNACSRRKPRARRTCVPSPGSGARSRPVSEHCPTIPAKELPMATPSKAFVIAHDPLVEADKAHYMHGYHVFDEHRAQGALNIVAGEGAYIRDAHGNRFLDAVGGMWCTNIGLGREEMALAIADQVRQLAYSNPFSDMANDVAIELCQKLAQLAPGDLNHVFLTTGGSTAVDTAYRLIQYYQNCRGKPHKKHIIARYNAYHGSTTLTMSIGNKAADRVPEFDYHHDLIHHVSNPNPYRAPDDMDEAEFLDYLVAEFEDKILSLGADNVAAFFAEPIMGSGGVIIPPEGYFLRMWQLCQTYDILFVADEVVTSFGRLGTFFASEELFGVTPDIITTAKGLTSAYLPLGACIFSERIWEVIAEPGKGRCFTHGFTYSGHPVCCTAALKNIEIIEREQLLDHVKDVGSYLEQRLQSLRELPLVGDVRCMKLMACVEFVADKASKALFPDEVNIGERIHSKAQAKGLLVRPIMHLNVMSPPLIITHAQVDEIVETLRQCIIETARELTALGLYQGR

SEQ ID NO: 66526 - protein, 594 aa, Salmonella enterica subsp. enterica serovar Typhi str. CT18
MSSKIFCKSWGAEYIAADVVRFRLWATGQQKVMLRLAGKDQEMQASGDGWFTLDVSGVTPGTEYNFVLSDGMVLPDPASRAQKTDVNGPSYVIDPGSYAWRNTGWKGSRWEQAVVYEMHTGTFTPEGTFHTAIAKLPYLAELGVTVIEVMPVAQFGGERGWGYDGVLLYAPHSAYGTPDDFKAFIDTAHGYGLSVILDIVLNHFGPEGNYLPLLAPAFFHKERMTPWGNGIAYDVDAVRRYIIEAPLYWLTEYHLDGLRFDAIDQIEDSSARHVLVEIAQRIREDITDRPIHLTTEDSRNIISLHPRDQDGNAPLFTAEWNDDFHNAVHVFATGETQAYYNDFADAPEKHLARALAEGFAYQGEISPQTGEPRGVKSTGQPPVAFVDFIQNHDQVGNRAQGDRLITLAGAERTKVLLATLLLSPHIPLLFMGEEYGESRPFLFFTDFHGDLARAVREGRAKEFADHAGENVPDPNAPETFQRSKLNWKQQHSEEGKAWLAFTRELLLLRQKHIVPLLSAARESSGTVLQTAPGFIAVSWRFPGGTLSLALNISATTVLLPDLPGKTLFAWPNESTGSLSQHSLIVRLAQGESAS

SEQ ID NO: 66527 - protein, 603 aa, Salmonella enterica subsp. enterica serovar Typhi str. CT18
MTTNRAFEIRSGYSHTLGANYDGEGVNFAIFSAHAERVELCLYDPSGEHEIARLELPEYTDEIWHGYVTKLQPGALYGYRVYGPYDPENGHRFNPNKLLIDPYARELVGDIQWNDAHFAYQLLHDDKDLTFDDQDSAPFTPKCRVIDPAEANWEDRQRPSIPWSNAIIYETHVKGFTQLNSAIPEPLRGTFEGMGHKASVDYIKSLGITSVELLPVHWFPDDQHLLDKGLKNFWGYNSLGFFAPATRYYGPKGIQGFRDMVRAFHDAGVEVILDVVYNHTAEGNELGPTLSFKGIDNFSYYRTMPDQHRYYINDTGTGNTVNTSHPRVLQMVMDSLRYWAESMHVDGFRFDLGTILGREPEGFDQRGGFFDAVTQDPVLAKLKLIGEPWDIGPGGYQVGGFPPGWGEWNDKYRDTVREYWKGDNVTNDFAARLLGSGDLYDLRGRRSWSSVNFITAHDGFTLNDLVSYNDKHNEANGEDNNDGHNDNRSCNYGAEGPTDDEGINAIRERQKRNFLTTLLFSHGTPMLLAGDEFGRSQMGNNNGYCQDSEISWVHWDNLPETANALREFTRHLIQLRATQPLLRRESWRDGLEIRWFNAGGGAQ

SEQ ID NO: 66528 - protein, 325 aa, Streptomyces avermitilis MA-4680
MAEKMAIAKAINESLRKALESDPKVLIMGEDVGKLGGVFRVTDGLQKDFGEERVIDTPLAESGIVGTAIGLALRGYRPVVEIQFDGFVFPAYDQIVTQLAKMHARALGKIKLPVVVRIPYGGGIGAVEHHSESPEALFAHVAGLKVVSPSNASDAYWMMQQAIQSDDPVIFFEPKRRYWDKGEVNVEAIPDPLHKARVVREGTDLTLAAYGPMVKVCQEAAAAAEEEGKSLEVVDLRSMSPIDFDAVQASVEKTRRLVVVHEAPVFLGTGAEIAARITERCFYHLEAPVLRVGGYHAPYPPARLEEEYLPGLDRVLDAVDRSLAY

SEQ ID NO: 66529 - protein, 310 aa, Populus tremula x Populus tremuloides
MAIPVIDFSKVNGTGEERAKTMAQIANGCEEWGFFQLMNHGIPEELLEKVKKVCSEYFKLEREEIFNNSTVANTLNALAEKNSGEKLENVDWEDVITLLDDNEWPSKTSGFKETMTEYRAELKKLAEKVMEVMDENLSLPKGYIKKAFNDGEGHSAFFGTKVSHYPPCPHPELVNGLRAHTDAGGVILLFQDDVVGGLQILKDGQWIDVQPMKNTIVINTGDQIEVLSNGRYKSTWHRVLASPDGNRRSIASFYNPSLKATIAPAPGLVEKDGEEIDQTYPKFLFGDYMSIYAKQKFLPKEPRFQAVRAL

SEQ ID NO: 66530 - protein, 462 aa, Streptomyces avermitilis MA-4680
MTEASVREFKMPDVGEGLTEAEILKWYVQPGDTVTDGQVVCEVETAKAAVELPIPYDGVVRELRFPEGTTVDVGQVIIAVDVAGDAPVAEIPVPAQEAPVQEEPKPEGRKPVLVGYGVAESSTKRRPRKSAPASEPAAEGTYFAATVLQGIQGELNGHGAVKQRPLAKPPVRKLAKDLGVDLATITPSGPDGVITREDVHAAVAPPPPAPQPVQTPAAPAPAPVAAYDTARETRVPVKGVRKATAAAMVGSAFTAPHVTEFVTVDVTRTMKLVEELKQDKEFTGLRVNPLLLIAKALLVAIKRNPDINASWDEANQEIVLKHYVNLGIAAATPRGLIVPNIKDAHAKTLPQLAESLGELVSTAREGKTSPTAMQGGTVTITNVGVFGVDTGTPILNPGESAILAVGAIKLQPWVHKGKVKPRQVTTLALSFDHRLVDGELGSKVLADVAAILEQPKRLITWA

SEQ ID NO: 66531 - protein, 435 aa, Saccharomyces cerevisiae
MTTNEEFIRTQIFGTVFEITNRYNDLNPVGMGAFGLVCSATDTLTSQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFAEMIEGKPLFPGKDHVHQFSIITDLLGSPPKDVINTICSENTLKFVTSLPHRDPIPFSERFKTVEPDAVDLLEKMLVFDPKKRITAADALAHPYSAPYHDPTDEPVADAKFDWHFNDADLPVDTWRVMMYSEILDFHKIGGSDGQIDISATFDDQVAAATAAAAQAQAQAQAQVQLNMAAHSHNGAGTTGNDHSDIAGGNKVSDHVAANDTITDYGNQAIQYANEFQQ

SEQ ID NO: 66532 - protein, 131 aa, Geobacter metallireducens GS-15
MIMPLINGLKITLKHMFMKPVTLQYPDERPTPSPNFRGLHALKVSHSKAKCVCCYLCPTVCPAKCITVEAGEDQEHNKYAERYEIDMLRCIFCGYCVEACPVDALKMTGEFELANYKREDFVFVKERLLEK

SEQ ID NO: 66533 - protein, 343 aa, Marinobacter sp. ELB17
MKALAFHGPGKRSWEDKPQPAIEKPTDAVVRITHTTICGTDLHILKGDVPAVEVGRILGHEGLGVVTEIGDGVSNIQIGDEVLISCVTSCGRCDYCKRGVYSHCRDGGWILGHLIDGTQAEYVRIPHADNSLYVLPEDMDRAAAVMLSDILPTGHEIGALNGEVKLGDTVAIVGAGPIGLAALMTSRFYSPARIIMIDPDENRLAMAKLLGATDTIARDPIEAIHKMTDGEGVDVAMEAVGVPETFDICQSIVRAGGHIANIGVHGKSVEFKLQDLWIKNITLRTGLVNTNTIPVLMRVVESGGVKPEELVTHRFKLDDIEKAYDIFSEAAKEQAIKMLLTVE

SEQ ID NO: 66534 - protein, 828 aa, Geobacter metallireducens GS-15
MVNLTIDGKQVTVPKDATIYDAAKSAGIRIPILCHDKKLHPFGGCRMCLVEVEQMKGRQIPACTTPVTEGMIVNTMTPEIIQARKLVLELLLLKHPIDCPVCDAAGDCDLQNLTYEYQVNSNRFKDEKFQHQIDYQNPLIERDMNRCVHCGKCARICDEIVSFGAYTFINRGLEAKIGTEFDGPLNCEFCGSCVSVCPVGALVSRPFKFKARWWSLNKVKTVCSYCGTGCQLTLGVKDNKVLTTVYDENQGFHNGQLCTRGRFGYQFVNSDKRLKTPLVKKNGKLEEASWDEALGLVHQRLADAKSVGASSVAGLVTPRLTNEELYLFKQLFNKGIGSDNIDHSAGYAHDALTAGAVESLGYPASPASISDIQTTNLLLVVKTDAYETHPVLGFEINLGVKRKGVNLRIVSDKKGKLSKLPNAITYVHKPASEVLLFNALAKVIVDEGLADSSASSLPGYDDFVKNLGACAPAIVAAQCGMSIEDITTLARDYAKAEKALIMLPIGLAYPGHGKALAQATINLALLTGKIGKEGCGVLIMGEKNNSQGAADLRIHPVAGGRDAMGILDGCASGAIKTLYVVGENPVISYPNRKKVEAALDAVEFLVVQDLFMTETASKADVVLPACSFAEKNGTFTSAGKAVQRVRKAIDTIGMARSDFDIFNSLYSTLGCDSFKGLSEVFAEIASVVPSYSGLTFDGLDENGSVYSVANRLRFVSTVADGQESAAGAMALVTGNALNHCGTLSLHGEGPMYVCPEGYVELNSGDAKKLGVENDQTLTVKSSVGEVKLKAKVSMRMPEGVVFAPYHFSDMSINSITNGAPVTWVTISK

SEQ ID NO: 66535 - protein, 476 aa, Saccharomyces cerevisiae
MSFRRINSRYFENRKGSSMEEKKAKVPPNVNLSLWRKNTVESDVHRFNSLPSKISGALTREQIYSYQVMFRIQEITIKLRTNDFVPPSRKNRSPSPPPVYDAQGKRTNTREQRYRKKLEDERIKLVEIALKTIPYFVPPDDYKRPTKFQDKYYIPVDQYPDVNFVGLLLGPRGRTLRKLQEDSNCKIAIRGRGSVKEGKNASDLPPGAMNFEDPLHCLIIADSEDKIQKGIKVCQNIVIKAVTSPEGQNDLKRGQLRELAELNGTLREDNRPCPICGLKDHKRYDCPNRKIPNIQGIVCKICGQTGHFSRDCNSSSQRMSRFDRNATVNNSAPIQSNDVHYNSNTHPIQAPKRSRYDNNSTEPPLKFPASSRYAPSPSPPASHISRQAQNVTPTPPPGLTSSSFSSGVPGIAPPPLQSPPESEQPKFSLPPPPGMTTVQSSIAPPPGLSGPPGFSNNMGNDINKPTPPGLQGPPGL

SEQ ID NO: 66536 - protein, 358 aa, Oryza sativa
MSAYCGKYKDELIKNAAYIGTPGKGILAADESTGTIGKRFASINVENVEENRRSLRELLFTTPGALQHLSGVILFEETLYQKTKDGKPFVDVLKEGGVLPGIKVDKGTVEVAGTNKETTTQGHDDLGKRCAKYYEAGARFAKWRAVLKIGPNEPSQLSIDLNAQGLARYAIICQENGLVPIVEPEILVDGSHDIERCAYVTEKVLAACYKALNEHHVLLEGSLLKPNMVTPGSESKKVSPQLIAEYTVRALQRTVPAAVPAIVFLSGGQSEEEATVNLNAMNKLSTKKPWALSFSFGRALQQSTLKAWGGKTENVVKAQKAFITRCKANSEATLGTYQGDAVLGEGASESLHVKDYKY

SEQ ID NO: 66537 - protein, 478 aa, Medicago truncatula
MGFRNNAIQAGSLDVGGKSKGKMKKDCDEKEIGCCVKFSCFGKCIPSRLKVDSSKSGTTSAHNVENASAYERSKKDRSAPPGSSTTSNAESIPSTPMFSEELKVSSDLRKFTFNELKMATRNFRPESLLGEGGFGCVFKGWIEENGTAPVKPGTGLTVAVKTLNHDGLQGHKEWLAELNILGDIVHPNLVKLIGFCIEDDQRLLVYQFMPRGSLENHLFRKGSLPLPWSIRMKIALGAAKGLNFLHEEAQRPIIYRDFKTSNILLDAEYNAKLSDFGLAKDGPQGENTHISTRVMGTYGYAAPEYVMTGHLTSKSDVYSFGVVLLEMLTGRRAVDKNRPNGEHNLVEWARPVLGERRLLFQIIDPRLEGHFSVKGAQKSAQLAAQCLNRDPKARPMMSEVVQALKPLQNLKDMAIASYHFQVVRVDRTMSMPNSKNGTQTQVASLSKKGQPMRILSSPNGQHGSPYRHYIKSPKPKNG

SEQ ID NO: 66538 - protein, 452 aa, Clostridium perfringens SM101
MEKQNLKNTEVNLIYGVDDDLDLPKKVLFGLQHIFAAFGGIIVVPLVIATSLGFDSKVTTALISASILGSGLATIIQAKGVGKVGARVACIMGTDFTFVSPAISVGSVLGLPGIIGATILGSLFEVILSFFIKPLMKFFPPLVTGTVVALIGLTLLPVSIDWAAGGAGSANYASLENLAVAMFVLIITLLLNNYGKGMISSASILIGIVVGYIVCIPLGLVDFTSVKEASWLSFPKILEFGVTFDAKAVMAFIPAYFVATIGTVGCLKAIGETSNIDIGDKRVAAGVLSDGVGSALGGLVGSCPNTSFSQNIGIISLTKVASRHVAVMAGILLVILGFLPKVAAIITGIPNPVLGGVGIMMFGTVAAAGIRTLSNIKLTERNLLIIAISMGLGLGVTFRPDVIHNLPEAIRMIFSSGISTGTIAALILNAVLKESPTSMEFENMYDEETKAS

SEQ ID NO: 66539 - protein, 292 aa, Oenococcus oeni PSU-1
MTNLLENTNLLTAIITPFDKNNRIDFQVYRRLIDSQISDGVKGFVISGTTGEAPTLSHDEKIELFKRTVDFVSGRAKVIVGTGSNNTKETIEFTKEAGRINGIDAALIVTPYYNKPDQAGMIAHFSTIADESPLPIVIYNIPGRSISALTVESLLKLADHPNIIAVKQCNSDYDMSELIEHAPKDFLVYTGEDGQSFLNYALGGAGTISVASHFYAKEFADMFSAIDNGDFKKAAGDFRFINPRVKALFSYPSPAPVKAVFKRSGIDVGIPRLPILPLDKAQTDGIMQVLKL

SEQ ID NO: 66540 - protein, 390 aa, Oenococcus oeni PSU-1
MPELKEGVINSVRSDVRNITTNKIRAVDMEFRKIDGLLRLTLGEPDFNAPELVKKAMIKSIEDNESHYSTARGSIEFLKAAADFLKRNYDLNYDPRTEILSTVGSTEAIFSSLSTILEEGDELLAPSPAYPLYEQLAHVNHTKMVYIPTNDTNFVLTPSKLQNAIEQHPRAKAIVLTYPNNPTGVDYSVEQLKELATVIAKTNLLVVSDEIYSTLNYVGKHVSIASLLPEQTIVLNGVSKSHAMTGDRIGFVAAPRDLISQIVKIHQFAITAVSNPAMAGAVAALNQGDALTEKMRQEYMKRRNYLIPEFKKIGFDVAAPDGAFYLFLKIPADQNQDDFAFARELAHKALVGLIPGSCFGPGGEGYLRLSYAASEETLHEALRRLQNYLA

SEQ ID NO: 66541 - protein, 350 aa, Bacillus cereus ATCC 14579
MKALLWHNQRDVRVEEVPEPTVKPGTVKIKVKWCGICGTDLHEYLAGPIFIPTEEHPLTHVKAPVILGHEFSGEVIEIGEGVTSHKVGDRVVVEPIYSCGKCEACKHGHYNVCEQLVFHGLGGEGGGFSEYTVVPEDMVHHIPDEMTYEQGALVEPAAVAVHAVRQSKLKEGEAVAVFGCGPIGLLVIQAAKAAGATPVIAVELSKERQELAKLAGADYVLNPATQDVLAEIRNLTNGLGVNVSFEVTGVEVVLRQAIESTSFEGQTVIVSVWEKDATITPNNLVLKEKEVIGILGYRHIFPAVIKLISSGQIQAEKLITKKITVDQVVEEGFEALVKDKTQVKILVSPK

SEQ ID NO: 66542 - protein, 665 aa, Oryza sativa
  misc_feature (558)..(558): Xaa can be any naturally occurring amino acid
MSNKLHNSSRHSFLLAWHSSNLAILHEAIRIIPRYIVAIVVEILRGLLVILLLGFVLHLAGRRPPPGRRGRSPCARGGTSGGWTVTKIYGSLPDRDACRAAGVVYPRTEEDLVAAVAVAVVAARKAKAATRYSNSFPRLACPGGVEGEGGVAISTRWLNRTVRVDAARRLMTVEGGMVLRDLIREAAAAGLALPHSPYWSGVTVGGALATGAHGSSLWGKGSAVHEYVVGMRIVTPAAASEGFAVVRELAADDPDLDAAKVSLGVLGIISQVTLALEPQFKRSVKFVKRDDADIAEKVAVWGRLHEFGDMVWLPGQRQVIYREDNRVNISTPGDGLNDYFGFRAQPTLSMVGARVIDECLEENPMYTDTARCLASRAVTKMFDLLAYGFTNDGATFTGYPVVGYQHRIQSSGSCMGSLEEKDDGLLLTTTCPWDRRTRGVFAYNVAFTVPLSRAPAFVADVSRLRDLDPAAFCQIDAKMGVLVRYVAASSAYLGQAGWTRWDFDVTYYRSRARGAPRAHADVFDELEQMALRGHGGVPRWGKNRNAAFDGAIARYPNXAGEFLRVKDRFDPEGVFSSEWSDRVLGVGGASPAIVGDGCAMEGLCVCSDDSHCAPELGYFCRPGKVFTEARVCSLLRDAADGYLRDRHGNVRVNATSTGKHSLLHE

SEQ ID NO: 66543 - protein, 470 aa, Pseudomonas putida GB-1
MREYARLYIDGAWQVPSGQGVAEVIDPASEQAIGRVPLGDEADVERAVMAARRAFDSWSRTPSNVRAGYIRALTTQLKNRAAEMAAVITDELGMPVRWCQAVQVEGPIAGLAQYAELAGLMDEVREVGNSLVYREAVGVCAFINPWNYPLHQMIGKLAPALAAGCTVVVKPSQETPLHAFLLAEMVDAIGLPAGVFNLVSGPGAKVGEALARHPQVDMVSFTGSTGAGVRVAQAAAPTVKRVCLELGGKSPLLITADADLHAAVRHGVQDVMINSGQTCTALTRMLLPASRYAEALDIAEAETRALVMGDPRDPASFLGPMCSAGQRRTVLDYIRAGQEEGARLVCGGDYGGFERGFYVAPTLFADVDNRMRIAQEEIFGPVLCLIPYANEAQALALANDSPFGLSSAVWAGNRERGLALARQIRAGQCFINGGGFNYQAPFGGYKQSGNGREWGEEGLAEFVEVKAVQC

SEQ ID NO: 66544 - protein, 183 aa, Oryza sativa (indica cultivar-group)
MPRLHLLLLLAVLAVAAAAAEAAAEKKPTAYEVLESYDFPVGILPKGVTSYTLEATTGDFTATLDTGDDDDSSSSTCEFAIEGSYSLRYQRAITGRIATGHLTDLRGVAVKVLFFWLNIVEVTRRGDRLEFSVGIASADFTVDNFLESPQCGCGFDCDDDGISSSSSLPPPLEPSLLRLRGAF

SEQ ID NO: 66545 - protein, 113 aa, Pseudomonas fluorescens PfO-1
MDIIETIKEQIANNTILLYMKGSPNAPQCGFSAKAAQAVMGCGEKFAYVDILQNPEIRANLPKYANWPTFPQLWVAGELVGGSDIMAEMFANGELQTLVKEASAKAAAAKSQA

SEQ ID NO: 66546 - protein, 297 aa, Zea mays
MFRRKHGSDFNSDDAEQREAKISELKAALGTLSARGEKYCSEACLRRYLEARNWNVAKSRKMLEESLKWRAAYKPEDIRWPDVSVEAETGKMYRASFRDREGRTVVVMKPTKQNTSSHEGQIRFLVYTLENAIFSLPEGQEKMVWLIDFTGWTVSHASPIKTCRETANILQNHFPERLAIGFLFNPPKVFEAFYKVIKIFLDPKSVEKVNFVYQKDEESMKVMYKYIDPEVLPVEFGGKSNVVYNHEEYSELMIQDDIKTASFWAVDAKTNHANPAINGTLVPEVAPQSSSLAAKAS

SEQ ID NO: 66547 - protein, 479 aa, Cryptococcus neoformans var. neoformans JEC21
MLSFAQVAKRSAAVSFRRQAVASRTLRTSAPSNVLSKFAMPAMSPTMTEGGVAQWKKKEGESFSAGDVLIEIETDKATIDVEAQDDGIMAKIIAQDGTKNIAVGTPIAIIGEEGDDLSQADALAAESQSESAPSQKEAAPKEEKTAPKEEKSESSTTPAVGVPGEQKSGAGDAQTSPAKAPEHPSKGDRPKFFASPLARKIALENGIPLAEIKGTGPNGRIVEADVKNYKPSAAAASTPAAGKSAAVPADYEDIPTSNMRRTIGKRLTESKQQLPHYYVTVEVNMDRVLKLREVFNKAGESKTKLSVNDFIVKAASLALADVPEANSAWLGETIRTYKKADICVAVATPNGLITPIIKDVGAKGLATISAETKALASRARDGKLKPEEYQGGSFTISNLGMFGVDEFTAIINPPQSCILAVGKTTTKLELAPEDPKGFKAVQVMKVTLSADHRTVDGAVGARWLKAFREYMEQPLTFML

SEQ ID NO: 66548 - protein, 468 aa, Pseudomonas putida GB-1
MTDTVEKIQLTRALKSRHIFMLSLGGVIGTGLFMGSGVTINQGGPVGAILAYLVAGLLMYLVMVCLGELSVQMPVSGSFQAHATKFIGPATGFMIGWVYWMSWATTVGLEFTAAGMLMTRWFPDVPIWYWSALFVVVLFGLNALATRAFGEAEYWFSGIKVATILGFIIIGLLVIFGAIPLTSGAPAPMLDNLVGESLFPHGLSAVFAVMMTVVYAFQGCEIMGVAAGETEHPEKSIPRAVRNVVFRVLIFYVLAIAVLSAIVPYEQAGLMESPFVQVFDMVGIPFAADVMNFVILTAILSVGNSGLYASTRILWAMSKSGMAPKSLSPLSKRGVPLRALSITLCFALISLMTSFIAADTLFMVLMAVSGMSGTVTWIVIALAQYRFRKAYLRDGGQLQDLKYRAPLYPLVPLLCITLCSSLFVFLALDETQRPSLYWGFGFIALCYAAYYFVNRRRQGAFEPSVPGV

SEQ ID NO: 66549 - protein, 164 aa, Mycobacterium avium subsp. paratuberculosis K-10
MSGSAPVVVMGVSGSGKSTVGVTLARRLRVPFVDADTLHPPANIAKMAAGTPLGDDDRRPWLDEVGEWLAAHRDGGVAACSALKRAYRDRLRAHCPDVAFLHLSGSAALLGPRLAARSGHFMPAALLQSQLDALEPLGPDEAGLTVDAGREVDSIVDVVLRARR

SEQ ID NO: 66550 - protein, 128 aa, Triticum aestivum
MDGTSRNFSPTTKHNPSQSHRREEKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 66551 - protein, 804 aa, Geobacillus kaustophilus HTA426
MLVSYRWLGEYVDLTGITAKELAERITKSGIEVERVEALDRGMKGVVIGHVLECEPHPNADKLRKCLVDLGEDEPVQIICGAPNVAKGQKVAVAKVGAVLPGNFKIKRAKLRGEESNGMICSLQELGVETKVVPKEYADGIFVFPSDAPIGADAIEWLGLHDEVLELSLTPNRADCLSMIGVAYEVAAILGRDVKLPEAAVKENSEHVHEYISVRVEAPEDNPLYAGRIVKNVRIGPSPLWMQARLMAAGIRPHNNVVDITNYILLEYGQPLHAFDYDRLGSKEIVVRRAKAGETIITLDDVERKLTEEHLVITNGREPVALAGVMGGANSEVRDDTTTVFIEAAYFTSPVIRQAVKDHGLRSEASTRFEKGIDPARTKEALERAAALMSEYAGGEVVGGIVEASVWRQDSVVVTVTLERINGVLGTAMSKEEVAAILSNLQFPFTEDNGTFTIHVPSRRRDIAIEEDIIEEVARLYGYDRLPATLPVAEAKPGGLTPYQAKRRRVRRYLEGAGLFQAITYSLTSPDKATRFALETAEPIRLALPMSEERSVLRQSLIPHLLEAASYNRARQVENVALYEIGSVYLSKGEHVQPAENERLAGVLTGLWHAHLWQGEKKAADFYVAKGILDGLFDLFGLAARIEYKPAKRADLHPGRTAEIALGGKVIGFVGQLHPAVQKEYDLKETYVFELALTDLLNAESEAIRYEPIPRFPSVVRDIALVVDENVEAGALKQAIEEAGKPLVKDVSLFDVYKGDRLPDGKKSLAFSLRYYDPERTLTDEEVAAVHERVLAAVEKQFGAVLRG

SEQ ID NO: 66552 - protein, 480 aa, Yarrowia lipolytica CLIB122
MAKATEKRVKRAKKEESGSESEDNDAIAQEILDTTKSDNEEEEPKKSSKNYTSVEVDESEEQTKTFKDLGVIDSICETCEELKFTKPTPIQAQSIPYALEGRDIIGLAQTGSGKTAAFAIPVLQSLYENPQPLYCVVLAPTRELAYQISETFEALGSAMGLRTAVVVGGMNMMTQAVALSKKPHVIVATPGRLVDHLENTKGFSLRTLKFLVMDEADRLLDMEFGPSLDKILKVIPRQRNTYLFSATMTSKVEKLQRASLVDPVRVAVSTKYQTADNLLQYMVFCPFKHKDTHLVYLVSENAGNSMIIFARTKSDTQRISLLLRNLGYGAIPLHGDLSQTARLGALNKFKSGSRNILIATDVASRGLDIPAVDLVINYDIPSDSKSYIHRVGRTARAGRAGKSVALVSQYDLELYLRIEGALGKKLDSYPLESEAVMLFSERVAEASRAAIQEMKGEDGTKKRSKFDKKRRRDEMDIGEQ

SEQ ID NO: 66553 - protein, 435 aa, Ostreococcus tauri
MSRPIVVVGAGNAAGYLVRALVAADPALGAKTLVLGAEDVAPYERPALTKAFLHEQTPPRLPGFHTCVGGGFDRQTPEWYAESGVELKLNSTVTSADFKAKTVTTAGGESFAYETLVVATGCGVIRLPESIGGGLRGVHYVRNNSDALALTEAMSKAKKCVVIGGGYIGLEVAASCATRGLNPEIIMMEPHCMARLWNGDIAKYYEALYEAKGARFHRESKVKRILADDATGAARGVELESGVVIDCDLVVVGIGATAPLPFAGLDAPEGRLGGVKVDSRFRASGADIAPGSVYAVGDIAAFPLKMTNEIVRMEHVKHARDSATLVGNLIAGKTDAEYDYTPFFYSRVFEHPGTERAVSWVFHGLQRGEIITVGDFNPKLAAFWVENSKCVGVMLESGAPEQNSALAAATRSGKSIDVDALRAAASADDAIALIL

SEQ ID NO: 66554 - protein, 341 aa, Salmonella enterica subsp. enterica serovar Typhi str. CT18
MKVKAVFINKPGEVETRWVDYPHKKENEVLIKVDAAGICGSDIGAFRGTNPLVTYPRIIGHEVTGIVLQEGTGMPDNIKKGDRVIVDPYIYCGHCYPCSVGRTNCCENLNVIGVHIDGAMQEVVTHPAHLIHKIPDNVPSEMAPLAEPLTIALHALHRANVKAGEYVAIIGAGAIGLMAALSARHYKATPILIDIVEERLRYAQKLGVPYVLNAADDQVIDAIKNITHGTMAQVVIEASGANSAIRNTLDLASFAGRISFTGWPKQETSLPTNLITYKELDLRGSRTSAGEFDEALRMLSTLEINPQDVVSKVVNLDEIPDAVKELDRYPERYLKINAVFH

SEQ ID NO: 66555 - protein, 1207 aa, Solanum peruvianum
MKAHKTVFNQHPLSLNKLFFVLLLIFFLPPASPAASVNGLYKDSQQLLSFKAALPPTPTLLQNWLSSTDPCSFTGVSCKNSRVSSIDLSNTFLSVDFSLVTSYLLPLSNLESLVLKNANLSGSLTSAAKSQCGVTLDSIDLAENTISGPISDISSFGVCSNLKSLNLSKNFLDPPGKEMLKGATFSLQVLDLSYNNISGFNLFPWVSSMGFVELEFFSIKGNKLAGSIPELDFKNLSYLDLSANNFSTVFPSFKDCSNLQHLDLSSNKFYGDIGSSLSSCGKLSFLNLTNNQFVGLVPKLPSESLQYLYLRGNDFQGVYPNQLADLCKTVVELDLSYNNFSGMVPESLGECSSLELVDISNNNFSGKLPVDTLLKLSNIKTMVLSFNKFVGGLPDSFSNLPKLETLDMSSNNLTGIIPSGICKDPMNNLKVLYLQNNLFKGPIPDSLSNCSQLVSLDLSFNYLTGSIPSSLGSLSKLKDLILWLNQLSGEIPQELMYLQALENLILDFNDLTGPIPASLSNCTKLNWISLSNNQLSGEIPASLGRLSNLAILKLGNNSISGNIPAELGNCQSLIWLDLNTNFLNGSIPPPLFKQSGNIAVALLTGKRYVYIKNDGSKECHGAGNLLEFGGIRQEQLDRISTRHPCNFTRVYRGITQPTFNHNGSMIFLDLSYNKLEGSIPKELGAMYYLSILNLGHNDLSGMIPQQLGGLKNVAILDLSYNRFNGTIPNSLTSLTLLGEIDLSNNNLSGMIPESAPFDTFPDYRFANNSLCGYPLPLPCSSGPKSDANQHQKSHRRQASLAGSVAMGLLFSLFCIFGLIIVAIETKKRRRKKEAALEAYMDGHSHSATANSAWKFTSAREALSINLAAFEKPLRKLTFADLLEATNGFHNDSLVGSGGFGDVYKAQLKDGSVVAIKKLIHVSGQGDREFTAEMETIGKIKHRNLVPLLGYCKVGEERLLVYEYMKYGSLEDVLHDRKKTGIKLNWPARRKIAIGAARGLAFLHHNCIPHIIHRDMKSSNVLLDENLEARVSDFGMARLMSAMDTHLSVSTLAGTPGYVPPEYYQSFRCSTKGDVYSYGVVLLELLTGKQPTDSADFGDNNLVGWVKLHAKGKITDVFDRELLKEDASIEIELLQHLKVACACLDDRHWKRPTMIQVMAMFKEIQAGSGMDSTSTIGADDVNFSGVEGGIEMGINGSIKEGNELSKHL

SEQ ID NO: 66556 - protein, 129 aa, Zea mays
SQGGWVAHFEYHKKAITSIEWSPHEASSLAVTSEDHQLTIWDLSLERDTEEEAEFRAKMKEQANAPDDLPPQLLFAHQGQRDLKEVHWHPQIPSMIISTAIDGFNVLMPSNIDTTIPGSTDTAMPPAEP

SEQ ID NO: 66557 - protein, 390 aa, Geobacter metallireducens GS-15
MASTEIMTVNMGPQHPSTHGVLRLVVELDGEIIQKITPHIGYLHRGVEKLSEHRTYHQTIPLTDRLDYLAPMHNNLGYVLAVEKLLGIEVPERAQTIRVILAELTRLKSHLVWVACHALDIGAMTVFIYAFREREMVMSLYEKISGARMTSSYFRVGGLSSDVYDGFEKDVREIVDTFPGHFDTYEGLLTKNTIWLNRTVGNGVISAEDAIDYGITGPALRGSGVDWDLRRDNPYSGYEKYQFKVPVGEKCDTFDRYKVRLVEMREAVNIIRQALDSLKPGPVLADAPQVTYPPKENVYNTIEGLIHHFKIASEGFPVPEGEVYQGVENPKGELGYYIVSDGGNKPYRMRIRPPSFVNLGAIEKMAKGSMIADLVAVIGTLDIVLGEIDR

SEQ ID NO: 66558 - protein, 162 aa, Geobacter metallireducens GS-15
MAETNRAVIKLREKFSASVLDVKEFRGEVTVTVKREDIVEICNFLKSSLAYNLCTDVTAVDYLGKQEPRFMVVYNLYSIPNKDRLRVKAGVPEAGCSIDTVSCVWSAANWLEREVYDLMGVVFNNHPDLRRILMTDDWVGHPLRKDYPLQGPGREPYKGRLS

SEQ ID NO: 66559 - protein, 514 aa, Robiginitalea biformata HTCC2501
MKILSKEQSYEADRRTLAAQGISSTELMERAAASIFNWLHNRLQGAPVRIHIFCGTGNNGGDGLAVARHLAEHGYHIQVYLVNYSEKRSGDFRINLERLRQRKIEPESLDADSGLPDISEADILLDAIFGIGLSRPPAPWVRNLIAHLNAADAFRLAVDLPSGLQMDAMPAHPEGVLAADFVLTIGSPKLVFFLPGSGEFAADFEVLDIGFDTTYLNEVAAQYEWVGADEARALHRTRGKFSHKGTFGHACIVGGSYGKIGAVALAASACLRAGAGLVSAWVPKCGYLPLQAGVPEVMVETCGREHYLDAFPEPGSGYRYGVGMGMGTEKDTAKAFFEWLGRVREPVVVDADGLNSLSAHPEALANLPAGSILTPHPGELARLIGEWTDDFDKLEKARAFAADHNCVLLIKGAYTVILGEGKGFINSSGNPGMATAGSGDVLAGILTGLLAQGYPPLEAAVFGVYLHGRAGDLVVSETGPEALVASDLFGALGRAFRELYAEATPPQSKEGEEG

SEQ ID NO: 66560 - protein, 427 aa, Geobacter metallireducens GS-15
MNTSHSKELFAKAQEIIPGGVNSPVRAFKSVGAEPVFIKKASGSTIIDADDNAYIDYVGSWGPMILGHCHPRIVASVQRATENGSSFGAPTELEITLAEMVVAAVPSIEMVRMVSSGTEATMSAIRLARGYTGRDKIIKFSGCYHGHADSLLVKAGSGAATFGVPDSPGVPRDFAQHTLTATFNDLESVEELICAHSREVACIIVEPIAGNMGTVPPRAGFLEGLREICTNEGIILIFDEVMTGFRVAYGGAQERYGITPDMTTLGKIIGGGLPVGAFGGKREIMQQLSPSGGVYQAGTLSGNPLAMTAGIETLKLLQEDGFYGRLEEKSRALAEGIADAARRAGYPIYSTRVGSMFCAFFTNGEVHDWTSAAMCDTKSFATFFRSMLEEGIYLAPSQFETAFVSIAHSSEDIEKTIAAAFSCFKKL

SEQ ID NO: 66561 - protein, 419 aa, Lactococcus lactis subsp. lactis Il1403
MAKKKIVIVGAGFAGVSATRLLAKNLKNDAEITVIDKHDFQTSMTQLHEVAASRVEADAVQYHLNRTIGKFNNVKVVKESLVELDKANKKVITDKNSYDYDYLVVSMGGEPNDFGVPGVNEYGFTLWSLEDALKIKAHLKEMVQAAAKEADSEKRKKLLTFSVAGSGFTGIEMAGELIDWRKKASKKYGIPESEFTINIVEMMPTIMNILDRSLADKALVYLQNKNINVLVNHGITAVAQDHITVNVGGRDEEKVVKEIPGNTLIWTTGVQGNTEAEACQLSETERGHRLQANEYMEAIGEENHGIYVAGDVSGYIVPENGRPTPQIVEAAEQTGSTAAKNIIADIKGGEKTKFVGNYRGTLVSIGSGYAVGTVGKTKLSGFSATFMKHMVYLVYTFEIRSGHYFFKYINDQLFHKGAI

SEQ ID NO: 66562 - protein, 667 aa, Lactococcus lactis subsp. lactis Il1403
MTKKQIVVIGGGVAGVHATRELSKKLKADADITLIDKHSYHTTMTQLHEVAAGRVPFTTVQYDFQKLLGKRKNVSLVTDSVVSLDKENKQVITKHGRYSYDYVIVALGGEPNDFGVPGVKEHGFTLWSLEDAMRIKRHLEKIVQYASTEVDDEKRRALLTISVAGSGFTGIEMAGELIDWRKKVSTDWKIPEEEITINVVEMMPTILNTLDRKQADKAHAYLEKKNVHVLTNHGIVEVAKDHIKVNVGGRDEEKVAKELPTHTLIWTTGVQGNTAAKTDLNETERGHRLQANEYMQAVGFEGKGIYVAGDVSGYIEPDTGRPTPQIVEAAEQTAHTAAANILADINGGSKHKHESKYQGTMVSIGSTWGVAKIGSMRLTGFWAMLMKNIVYFIYTLQIRSAHYFWRYALDEVFRVKDNRNFMRGHTSRQGNVLWAVPLRIFYGVVWFTEAIKKIVGDGQYFNPTTWFGKGSWFTNDLKFPFSWLQEAPKAADAAAGASTAASSSSSVADAAAGATGAATTAASSGGGEAAHKATEWGLSYAYGSDPMTVFDKVPHWMEPIFKFMIPNREVALFMQKFMSIVEIFLALALIFGLFTWIAAAATAALTVMFSLSGMFYWVNIWFIPVAIALMNGSGRSFGLDKWVQPWIQRWLTKIWYGQSRSIYKGRQ

SEQ ID NO: 66563 - protein, 607 aa, Oryza sativa
MEWALPLTVAGFSLLLTSHHDKLNPTKPSEARRRFKPSIHPAATLLLLGSSLPRLVPPLPSSFLPGVIKQTEFHQRWLVGDLNPPPPPCHLLPIQGQGQMQMQQRRKPPPAAAPVAAKQPSPRRTPGPLSFAGALLSLLVVATFLYINDHGNMMPPHASPDPDLRLLQEAAHQKVNSILLSRHAPAPPPRTNTNTSSSDQHLRLINIPMSSDLDLELGGNSTSSSGVEIQFEQQQQQEEKNLRGCELYKGRWVYDAAGREAPLYRESECGFLTEQVTCMRNGRRDDSYQRWRWQPEGCDLPSFDARALLERLRNKRMMFVGDSLNRNQWESMVCLVQSAIPYGQKTLTKFVNNGSLNVFRAHEYNATVEFYWAPFLVQSNSDDPQVHSVRDRVIAWRSIAKHAANWKGVHYLVFNTYIWWLNNFQIKVLKSRGAPFAGSGGWSSRYALVDRAIAYREVLKTWAKWVDRRIDPNKTHVFFMAMSPNHFMPEAWGGSAGAVKCAMETQPIVNRTSGGLDIGTDWRLHGVARGVLRSMRRVGVRFVDITALSELRKDAHTSVHTLRQGKLLTPEQQADPRTYADCIHWCLPGLPDTWNHFLYAHIVAHAA

SEQ ID NO: 66564 - protein, 242 aa, Brassica napus
MEVFYYVVFGVLGIVVATLELSKNNKDRINTSSAFTSFKNNYLVVYSLMMAGDWLQGPYVYYLYSTYGYSKGDIGQLFIAGFGSSMLFGTIVGSLADKQGRKRACVTYCITYILSCITKHSPQYKVLMVGRVLGGIATSLLFSSFESWLVAEHNKRGFEQQWLSITFSKAVFFGNGLVAIIAGLFGNLLVHSFSLGPVAPFDAAACFLAIGMAVILSSWSENYGDPSDNKDLITQFRGAAVA

SEQ ID NO: 66565 - protein, 165 aa, Aegilops speltoides
VMASSATTVTPFHGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNLRQVQCVSFIAFRPPGCE

SEQ ID NO: 66566 - protein, 616 aa, Arabidopsis thaliana
MAARINTSLHNALSFLKPFNTPLNTKPFSFRRNSFRFSKKLPYYSQFSSGKRALYCTSSSQESTVDEGETFVLTTPLYYVNAPPHMGSAYTTIAADSISRFQRLLGKKVIFITGTDEHGEKIATSAAANGRNPPEHCDLISQSYRTLWKDLDIAYDKFIRTTDPKHEAIVKEFYARVFANGDIYRADYEGLYCVNCEEYKDEKELLENNCCPVHQMPCVARKEDNYFFALSKYQKPLEDILAQNPRFVQPSYRLNEVQSWIKSGLRDFSISRALVDWGIPVPDDDKQTIYVWFDALLGYISALTEDNKQQNLETAVSFGWPASLHLIGKDILRFHAVYWPAMLMSAGLELPKMVFGHGFLTKDGMKMGKSLGNTLEPFELVQKFGPDAVRYFFLREVEFGNDGDYSEDRFIKIVNAHLANTIGNLLNRTLGLLKKNCESTLVVDSTVAAEGVPLKDTVEKLVEKARTNYENLSLSSACEAVLEIGNAGNTYMDQRAPWFLFKQGGVSAEEAAKDLVIILEVMRVIAVALSPVAPCLSLRIYSQLGYTEDQFNSITWSDTKWGGLKGGQVMEQASPVFARIELNPEKEEDEKKPKVGKKTGKAKVKVVEQTPTVAEA

SEQ ID NO: 66567 - protein, 1021 aa, Daucus carota
MGVLRVYVILILVGFCVQIVVVNSQNLTCNSNDLKALEGFMRGLESSIDGWKWNESSSFSSNCCDWVGISCKSSVSLGLDDVNESGRVVELELGRRKLSGKLSESVAKLDQLKVLNLTHNSLSGSIAASLLNLSNLEVLDLSSNDFSGLFPSLINLPSLRVLNVYENSFHGLIPASLCNNLPRIREIDLAMNYFDGSIPVGIGNCSSVEYLGLASNNLSGSIPQELFQLSNLSVLALQNNRLSGALSSKLGKLSNLGRLDISSNKFSGKIPDVFLELNKLWYFSAQSNLFNGEMPRSLSNSRSISLLSLRNNTLSGQIYLNCSAMTNLTSLDLASNSFSGSIPSNLPNCLRLKTINFAKIKFIAQIPESFKNFQSLTSLSFSNSSIQNISSALEILQHCQNLKTLVLTLNFQKEELPSVPSLQFKNLKVLIIASCQLRGTVPQWLSNSPSLQLLDLSWNQLSGTIPPWLGSLNSLFYLDLSNNTFIGEIPHSLTSLQSLVSKENAVEEPSPDFPFFKKKNTNAGGLQYNQPSSFPPMIDLSYNSLNGSIWPEFGDLRQLHVLNLKNNNLSGNIPANLSGMTSLEVLDLSHNNLSGNIPPSLVKLSFLSTFSVAYNKLSGPIPTGVQFQTFPNSSFEGNQGLCGEHASPCHITDQSPHGSAVKSKKNIRKIVAVAVGTGLGTVFLLTVTLLIILRTTSRGEVDPEKKADADEIELGSRSVVLFHNKDSNNELSLDDILKSTSSFNQANIIGCGGFGLVYKATLPDGTKVAIKRLSGDTGQMDREFQAEVETLSRAQHPNLVHLLGYCNYKNDKLLIYSYMDNGSLDYWLHEKVDGPPSLDWKTRLRIARGAAEGLAYLHQSCEPHILHRDIKSSNILLSDTFVAHLADFGLARLILPYDTHVTTDLVGTLGYIPPEYGQASVATYKGDVYSFGVVLLELLTGRRPMDVCKPRGSRDLISWVLQMKTEKRESEIFDPFIYDKDHAEEMLLVLEIACRCLGENPKTRPTTQQLVSWLENIDVSS

SEQ ID NO: 66568 - protein, 373 aa, Ostreococcus tauri
MGLSNADVSTGGADVIVFAERVAVRRRARTHRASRVSEARRASRERVHRARVVGGDARETREVDDDRSNDRLGTMAEVPIIIGLFHGFDGTGHWLNHVLIDRWILGTSKIGDAYDPSQYSLLRKFSVMWAFLTVFTYALYFTLCPLAYWWHFVRKDKDGKNNARWTGREGKDQVKNEIVLSTWSIAVMTFMIAPFELMVEAGWTKLYWDVDKYGKAYFFLTPLLFLVFSDTCIYWIHRGLHHRLVYAPVHKLHHKYKDTTPFSAYAFHPLDGWLQGCPYHLFIFLFPMHHMTYFISLAIVGLWTINIHDRVTMQLPHVNGAAHHTIHHTMFNYNYGQYFTFWDKIGGSYRNPMLYPPYAEKSPALTASAKKDK

SEQ ID NO: 66569 - protein, 514 aa, Zea mays
MGGSGKWVKSLIGLKKQPEKEDCKMSNVSVPAQDKLQLPSVHGGGLRGKGRRWKLWRTSSGDQGSMWRGSRGGSQRSAASEASDDASSVAAVPADPFTAAVATVARAPARDFMAVRQEWAAIRVQTAFRGFLARRALRALKGLVRLQAIVRGRQVRKQAAVTLRCMQALVRVQARIRARRVRMSTEGQAVQKLLEARRTQMDILREAEEGWCDSQGTLEQVRVKLQKRQEGAIKRERAIAYAYSQQADGAAKCNPPKLTSNGLVNHSGMLLKHQNLDKGNGNWSWLERWMAARPWENRLMEEHNSSSPDFRSSKNCEDSFGVLGDFSEPNSVKVRKNNVSKRVCAKPPGPTHAHGHHQRLKAQSISSLSTELHNDESSASSSSCFASTPISFTLVASEKTEDSVRTRPNYMSMTESIKAKQKACSAQRTVALKQCDDRKAMSAELKVAQWLGAAFLSCPPVAGCLIVQLLVVRLHLCSLIVAASLFSRCGFVSGRVSVKKDRIIYNVLLPKIAL

SEQ ID NO: 66570 - protein, 469 aa, Vibrio cholerae O1 biovar eltor str. N16961
MSVENVLSLIQENEVKFVDLRFTDTKGKEQHISIPAHQIDADFFEDGKMFDGSSVAGWKGINESDMVMMPDPSSAVLDPFTEDATLNIRCDILEPATMQGYDRDPRSIAKRAEEYMRSTGIADTVLVGPEPEFFLFDDVKFATNMSGSFFKIDDVEAAWNTGTEYEDGNKGHRPGVKGGYFPVAPVDSSQDIRSAMCLIMEEMGLVVEAHHHEVATAGQNEIATRFNTLTTKADEIQIYKYVVHNVAHAFGKTATFMPKPLVGDNGSGMHVHQSLAKDGVNLFAGDKYGGLSETALYYIGGIIKHARALNAITNPSTNSYKRLVPHYEAPVMLAYSARNRSASIRIPVVPSPKARRIEVRFPDPAANPYLAFAAMLMAGLDGIKNKIHPGEAMDKDLYDLPAEEAAEIPKVAESLQQALQYLDADREFLTAGGVFSDDFIDSYIALKTKDVERVNVAVHPLEFELYYSV

SEQ ID NO: 66571 - protein, 72 aa, Marinobacter sp. ELB17
MKSVGVVGDARRYEGVIALRAVETIDFMTARWAHLPYELLETVSNRIINEISGVSRVTYDVSSKPPATIEWE

SEQ ID NO: 66572 - protein, 525 aa, Marinobacter sp. ELB17
MAHDIHDHRILILDFGSQYTQLIARRVRDIGVYCEVRAFDITAEELDAFNPKGILLAGGPESVTELGGPRAPDGLFDREIPVLGICYGMQTMAEQLGGRVASSEKREFGYAQIKVRAKGPLLQDITDHLTATGESLLDVWMSHGDKVVAMPEGFELLASTESAPIAAMQDLSRNLYGLQFHPEVTHTLQGKRILEHFVMNICGCEALWTPAKIVDDAVQKIREQVGTDKVLLGLSGGVDSSVTAALLHKAIGDQLTCVFVDNGLLRLNEGDQVMDMFGSSMGVKVIRADAEERFLTNLKGVSDPEQKRKVIGNTFIDVFDEEATRIQNVNWLAQGTIYPDVIESAASKTGKSHVIKSHHNVGGLPETMKLKLVEPLRELFKDEVRRIGLELGLPYDMVYRHPFPGPGLGVRILGEVKKDYADILRRADAIFLEELHRADYYHKTSQAFAVFLPVKSVGVVGDARRYEWVIALRAVETIDFMTARWAHLPYELLETVSNRIINEISGVSRVTYDVSSKPPATIEWE

SEQ ID NO: 66573 - protein, 606 aa, Gluconobacter oxydans 621H
MELRNIAIIAHVDHGKTTLVDALLKQSGSFRDNQHVADRAMDSNDLERERGITILAKCTSVVWKDTRINIIDTPGHADFGGEVERILSMVDGAIILVDAAEGALPQTKFVLGKALARGIRPIVVVNKIDRSDARPDEVHEEIFDLFASLGADEFQLDFPMLYASGRQGWADLELDGPKKDLAPLFDLVLRHVPTPNVDKDAPFGMVSTILESDNFLGRILTGRIDQGRAKVNMPVRVLRPDGTVVETGRLTKLLSFRGLDRVPVEEAEAGDIVAVAGLSEATIPDTIADPSVEEPLPSRPVDPPTLSMTFRINDGPLGGREGKKVTSRQIRDRLFKETEGNVAIKVTESPESEAFEVAGRGELQLGVLIETMRREGFELTIGRPRVLFRENEETGEREEPFEEVLVDVDEPYSGVVVEKMSLRKGVMQDMRPSGGGKVRLTFLIPSRGLIGYHGEFLTDTRGTGLMNRLFHGYLPYVGPIEGRRNGSLISAEDGTTTQYALFSLQDRGTMFVDAGEKIYTGMILGEHSRENDLDVNAVREKKLTNMRASGKDEALLLTPPRRMSLEQAIAYIEDDELVEVTPSAIRIRKRYLDPHERKRASKSRES

SEQ ID NO: 66574 - protein, 165 aa, Aegilops speltoides
VMASSATTVTPFHGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFSAFRPPGCE

SEQ ID NO: 66575 - protein, 165 aa, Aegilops speltoides
VMASSATTVTPFHGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYSDAYVRVIGFDNLRQVQCVSFIAFRPPGCE

SEQ ID NO: 66576 - protein, 1028 aa, Mannheimia succiniciproducens MBEL55E
MFATHLLGVIMQVSRRKFFKICAGGMASSSAAMLGFMPTQALAAPREYKLIHAKVARNNCTYCAVGCGMLMYSLGDGAKNARGKLFHVEGDPDHPVSRGSLCPKGAGVLDFVNSPNRLKYPEYRAPGSDKWVRLSWEDAIHRIAKLMKEDRDAYFEEKNAQDTTVNRWLTTTMFCSSATSNETGILTHRWARSLGMVTINNQAATCHGPTVPALAATFGRGAMTNHWVDIKNANLVIVMGANTAEAHPVGFKWVIEAKKNGAKLMVVDPRFNRTAAVSDFFAQIRAGSDIAFLLGVIRYLLEHDAIQHEYVKHYTNAALIVADDFEFNDGLFSGFDESTAQYDRTSWAYATDESGQPLRDLTMQHPHCVLNLLKKHVERYTAETVENITGVKQATFNQFCETLAETASPNKTATFLYALGWTQHTVGAQNIRAMAMIQLLLGNIGMAGGGVNALRGHSNVQGASDMGLTPVGLPGYLQLPNEKDVSLEKYLERVTPKTLVQGQTNFLQNTPKFVVSLLKSFYGDNATAENEWGFHYLPKYDQVYDQLKMIEMMNEGQINGFLCQGFNPVSSLPNKNKVVSALSKLKYCVVFDPTETTTSNFWQNHGEYNDVNPAEIQTEVFRLPTVCFAEEDGSIANSGRWLQWHYKAAEPPAEAKPDVDILAEIREAILEMYEKEGGRGLEPLKATAWDYVNPLEPKAEELAKQNNGYALADLYDTAGNLIAKKGELLSNFGQLRDDGTTACSAWIYTGQWTEKGNQMDNRDNSDPSGLGNTLGWAFAWPANRRIVYNRASADLTGKPWDPKRQLVKWNGKNWNYIDIADFGTAPPNSEIMPFIMQNDGLGGLFCLNRLADGPFPEHYEPMETPIGTNPLHPNVISSPVARVMENDKPNFGTSNEFPYVGTTYSLTEHFHAWTAQVQLSMITQPEAFAEISEELAQEKGIKQGDVVKVHSKRGYIKMKAVVTKRIKPLTVNGQTVHTIGFPIHWGFSGVGKKTFVTNTLTPPVGEVNSLTPEYKAFLVNIEKTTEAL

SEQ ID NO: 66577 - protein, 165 aa, Aegilops speltoides
VMASSATTVTPFHGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNLRQVQCVSFIAFRPPGWE

SEQ ID NO: 66578 - protein, 463 aa, Bacillus cereus ATCC 14579
MQHTNKSGTLNRGLKERHITLMSLGSAIGVGLFLGSASAIKLAGPSILLGYMIAGLVIFFIMRALGEMAIEQPVAGSFSKYAYDYIGPLAGYITGWNYWFLWVVTCMAEITAAGIYMQYWFPDIPRWTWALLALLLMSAFNFLSVKVFGELEFWFALIKIVTIICMIVVGAGIILFGFGNGGIATGISNLWSHGGWFPNGFSGLLLSMQMVLFAYLGVELIGVTAGEAQNPKKTLAKAIDNVFWRILLFYVGALFVMMAIYPWNELGEKGSPFVLTFQQIGIAKAAGIINFVVLTAALSSCNGGLFSTGRMLYTLAQQKKAPERFGRLNKNGIPSQGIVATAIVLLIGVILNYLVPAKVFTWLTSISTFGAIWTWGIILVAQIKFRKSLPTQNKQKLSYKMPLYPLSSYFSLVFLVLVLGIMAYSEDTRIALIVGPIWLIGLAIVYYMKGFHKIDETPNSKIS

SEQ ID NO: 66579 - protein, 165 aa, Aegilops longissima
VMASSATTVAPFQGLKSTAGLPVSRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCE

SEQ ID NO: 66580 - protein, 1062 aa, Magnaporthe grisea 70-15
MRRCSRTTSLHPNSRSTSLARFSSLAAARHTLNLQSSSNDSSAIRLQTEPAAATAATHPGRYRLPSLTCSPDPRATLRGPQNPLALVSRHHLHHLPRTSSSSRGQFSQKRDFATSSSKPSSDMAAIKIDGTAIAKKIRERLHAEIDEKQAVNPHYKPCLNIIQVGDRSDSSTYVRMKLKAAEEAGIQCELLHYPETISEAELLNQLHRINNDPNIHGVLVQLPLPKHLDEYAVTSAVADEKDVDGFGATNIGELAKKGGRPYFIPCTPKGIMVLLEEAGVDLKGKNAVVLGRSDIVGSPVSYLLKNADATVTVCHSRTVGLQDHLKAADIVVAAIGKAGFVKGEWLKPGAVVIDVGTNYIPDASKKSGQRLVGDVDFESAAQVASHITPVPGGVGPMTVAMLLQNVVDSATMHTQRQKNRKTVPLPLKLLDPVPSDIAISRAQVPKQIVRVAEEVGIGASELEPYGAYKAKVDLSLLDRLKHRRNGRYVVVTGITPTPLGEGKSTTTMGIAQALGGHLGRPTFANVRQPSQGPTFGIKGGAAGGGYSQVIPMDEFNLHLTGDIHAITAANNLLAAAIDTRIFHENTSKDAGLFKRLVPVKNGKREFAPIMFRRLKKLGITKTDPAELTEEEISRFVRLDIDPETITWRRVLDVNDRHLRGITIGTAPTEKGQTRESGFDISVASECMAILALSTSLADMRERLGSMVVATSRSGDPVTCDDIGAGGALTALMRDAIKPNLMQTLEGTPVFVHAGPFANISIGNSSILADKIALKLVGTEPDEDHSANTGFVVTEAGFDFTMGGERFFNIKCRTSGLVPDVVVIVATVRAIKVHGGGPPITPGAPLSPVYKEENVETLRAGCTNLRKQIENAKQYGVPVVVAINKFSTDTDAEVAVVREESLAAGAVDAVLSNHWAEGGKGAIDLAQAVIAASDLPKPDFKLLYSLEGTVQERIEKIAKDMYGAAAVEFSELAQKKVETYTRQGFGNLPICIAKTQYSTSHDPELKGAPKGFTVPIRDVRMAAGAGYLYALAADIQTIPGLPTAPGYLNVDVDLETGEIDGLF

SEQ ID NO: 66581 - protein, 162 aa, Oenococcus oeni PSU-1
MKTDTIFFGYFLPITDIALLYQGIEYQCFRWEYKMKQNQVLEKLTQSQLRSDIPDFRPGDNVRVYARIVEGERERVQLFEGVVVKRKGFGISASYTVRKVSSGVGVERTFPLNSPRVDKIEVTRHGHVRRAKLYYLRALRGKAARIKESLNTKATNKKTQTK

SEQ ID NO: 66582 - protein, 342 aa, Geobacillus kaustophilus HTA426
MKAKVAINGFGRIGRMVFRRAINSPDLDIVAVNASYPPETLAHLVKYDSNHGKFDGEVIALEDGLLVNGKKVRLLNSRDPKQLPWKELDIDIVIEATGKFNDREKASLHLEAGAKRVILTAPGKNEDVTIVVGVNEHMLDIDRHFIISNASCTTNCLAPVVKVLDEAFGIENGLMTTVHAYTNDQKNIDNPHKDLRRARSCAQSIIPTTTGAAKALGLVLPHLKGKLHGMALRVPTPNVSLVDLVVDLKRDVTVDEVNEALIRAANGPLKGILDFTMEPLVSIDFNTNPHSAIIDGLSTMVMEGRKVKVLAWYDNEWGYSCRVVDLAHLVAAKMNERLSVNA

SEQ ID NO: 66583 - protein, 440 aa, Robiginitalea biformata HTCC2501
MDPKKTFDIPSLGPARFPSPLQLSNNSGDDLFNFVRESDRVLVDVSLSGFQQARESGSRPECLEKSGPRETIFFDPGKTTAAIVTCGGLCPGINNVIRSLVMALHYFYGVKRIIGVRYGYEGLSRDCPHEFMELTPDKVKDIHEFGGTILGSSRGAHPVSEMVDTLVENRIDILFTVGGDGTLKGAHAIGDEIAKRGLNIAVAGIPKTIDNDINLIDKSFGFETAFDVASPIVRDAHNEAIGAFNGISIVKLMGRDSGYIAASTALAMPVVNFVLVPEMPLKLEGEGGFLQALEDRLQRKHHAVIVVAEGAGQHLFDDDRRVTDASGNVKHKDIGILLKDRIQEHFGQSGTPVTIKYIDPSYIIRSAPANANDSLFSNRLAYQAVHGAMAGKTQFVAGRVHNRFVYLPISKVTDRRKKIDMEGEFWFAVLQSTGQPFKMG

SEQ ID NO: 66584 - protein, 468 aa, Burkholderia mallei ATCC 23344
MSTLETAIAGAPAADAAAGAATPGAIIARIERLPANAMQIRARVLIGTATFFDGFDVITIAATLPLLIHKWGLSPNQIGMLIASGAIGQLLGAFLFPALAQKHGRVRAIAWSSAVIGVTSIACGFASTFETFVLLRIVQGLGLGGELPVAATYINEITRAHGRGRFVLLYEIVFPIGLLASMAFGAWLVPRFGWEVMYFIGGMPLLLALVLTRLVPESPRWLASRGRLDEAGRALHAFEASVKEPLPPVAHAGEFDTLVLSHPKRRMVDLFGPAYLKRTLAVATLWATCGFIQYGLSTWLPTIYKNFYHAPLQLALNLAVIGSVMGVAGSLVSALAVDVVGRKPVIVWSFVLCALSLVFAGVYHASSVYVVAAFCSLALGLMASGFITSYVYTPEQYPTSIRAAGCGLGSAWLKIASFVAPMVVPRAIVGGDLSPAFYLLAAVPLIAALTVHSVGIETKGQVLEKLEA

SEQ ID NO: 66585 - protein, 152 aa, Triticum aestivum
MEFQGQHDNPANRVDEYGNPFPLAGGVGGAHAAPGTGGQFQARRGEHKTGGILHRSGSSSSSSSSEDDGMGGRRKKGMKEKIKEKLPGGNKDNQQHMATGTGTGGAYGPGTGTGGAYGQQGHAGMAGAGTGTGTGEKKGIMDKIKEKLPGQH

SEQ ID NO: 66586 - protein, 398 aa, Glycine max
FDESDKGEKKQMLKFFNWFVFFISLGTLTAVTVLVYIQDHIGRYWGYGISVCAMLVALLVLLSGTRRRYRYKRLVGSPLTQIAMVFVAAWRKRHLELPSDSSLLFNLDDVADESLRKNKQMLPHSKQFRFLDKAAIKDPKMDGEEITMQRNWYLSTLTDVEEVKMVQRILPVWATTIMFWTVYAQMTTFSVQQATTMDRRIGNSFQIPAASLTVFFVGSVLLTVPIYDRVITPIAKKISHNPQGLTPLQRIGVGLVFSIFAMVSAALIEIKRLRMAQFFFVGSGEAFTYIGQLDFFLRECPRGMKTMSTGLFLSTLSLGFFLSSLLVTLVHKATRHREPWLADNLNHGRLHHFYWLLALLSGVNLVAYLFCAKGYVYKDKRLAEAGIELEETDTACHA

SEQ ID NO: 66587 - protein, 300 aa, Saccharomyces cerevisiae
MVNNSQHPYIKDGWFREINDKSFPGQAFTMTVDSILYEARSEFQDILIFRNKVYGTVLVLDGIVQCTEFDEFAYQEMITHIAMFAHSNPKRVLIIGGGDGGVLREVAKHSCVEDITMVEIDSSVIELSRKFLPTLSNGAFDDERLDLKLCDGFKFLQDIGASDVHKKFDVIITDSSDPEGPAEAFFQERYFELLKDALNPNGVVIMQSSENFWLNLKYLHDLKNTAKKVFPNTEYCYTMVPTYTSGQLGLIVCSNNANIPLNIPQRKISEQEQGKLKYYNPQIHSSAFVLPTWADKVINE

SEQ ID NO: 66588 - protein, 554 aa, Saccharophagus degradans 2-40
MYVYDEHDHKIIQERVAQFRDQTNRYLAGELKDEEFLPLRLQNGLYIQRLAPMLRIAVPYGLLSATQVRKLAHISRVYDKGYCHMTTRQNVQFNWPNLEDVPDILAELAEVEMHAVQTSGNCIRNVTSDQFAGVATDEIVDPRPYCEIIRQWSTFHPEFAFLPRKFKIAVSGSVDDRAAIHFHDIGLQIVKSENGSVGFKVLVGGGLGRTPVIGSVIREFLAENDLLTYLEAILRVYNLHGRRDNKYKARIKILVKAMGPEEFAKRVEAEWEHIRDSQTLLTDKEIKRAKSFFTAPDYEAIDVQAAEAELANAASENKAFSNWLARNVTAHKVDGYKAVTLSLKPTGIAPGDVTDKQLEIIADLADKYSFGELRATHEQNIVLADVKVSELFNLWQEAKAAGFATANIGTLTDIICCPGGDFCSLANAKSIPIAEAIQREFDDLDYLYDLGDLDLNISGCMNACGHHHIGHIGILGVDKKGAEFYQVQLGGNAGNNAALAKVLGPAFSAEDMPTVVRKLVDVFVEKRVEGEQFFETYNRVGIEPFKERIYAKAS

SEQ ID NO: 66589 - protein, 207 aa, Zea mays
MAGDEEDHLADAPRVVGVLSALLERVVERNDAVADELAAGTESAAPPSAFRATARPDISVRSYMARIARFAGCSPACYVVAYVYLDRLLRRARSAPAVDSYTVHRLLITAVLAAVKFMDDVCYNNAYFARVGGISLSEMNYLEVDFLFAVGFDLNVSPETFGHYCTVLRAEMLYLELEGPPPPAASTSLHRCCLSEDDDGSSSTSSS

SEQ ID NO: 66590 - protein, 227 aa, Neisseria meningitidis FAM18
MELVFIRHGQSEWNAKNLFTGWRDVKLSEQGLAEAAAAGKKLKENGYEFDIAFTSVLTRAIKTCNIVLEESDQLFVPQIKTWRLNERHYGQLQGLDKKQTAEQYGDEQVRIWRRSYDTLPPLLDKDDEFSAHKDRRYAHLPADVVPDGENLKVTLERVLPFWEDQIAPAILSGKRVLVAAHGNSLRALAKHIEGISDKDIMGLEIPTGQPLVYKLDDNLKVLEKFYL

SEQ ID NO: 66591 - protein, 138 aa, Glycine max
MGVVSAVADAVVVLFSLTIAVGVPLIDAQAVLSHDAYPAQLRDLKRWYAAEFDDYLMAHPPPFFRGLLCLELAFLWPLSVATVYGVLARRRWAATTSLMVGVTTLTSLSAIFGEMLGSGKATTKLLQMYVPYAVFAVI

SEQ ID NO: 66592 - protein, 114 aa, Populus tremula x Populus tremuloides
MAEEGQVIACHTVDTWKEHFEKGKGSQKLIVVDFTASWCPPCKMIAPIFAELAKKFPNVTFLKVDVDELKAVAEEWNVEAMPTFIFLKDGKLVDKTVGADKDGLPTLVAKHATA

SEQ ID NO: 66593 - protein, 325 aa, Ensifer adhaerens
IGGWKAINESDMVLMPDPETAHMDPFFAQSTMVIICDILDPVSGEAYNRDPRGTAKKAEAYLKASGIGDTVFVGPEAEFFVFDDVKYKADPYNTGFKLDSSELPSNDDTDYETGNLGHRPRVKGGYFPVPPIDSCQDMRSEMLTVLSEMGVTVEKHHHEVAAAQHELGVKFDALVRNADKMQIYKYVVHQVANAYGKTATFMPKPIFGDNGSGMHVHLSIWKDGKPTFAGDEYAGLSESCLYFIGGIIKHAKSLNAFTNPSTNSYKRLVPGYEAPVLLAYSARNRSASCRIPFGTNPKAKRVEVRFPDPTANPYLAFAAMLMAGL

SEQ ID NO: 66594 - protein, 472 aa, Gluconobacter oxydans 621H
MSDTVLNPSPVPSAAVAKAPMVGRMMFAVALAAIAGLMFGLDVGVISGALGFIRDEFHASEFEQSWIVSSMMFGAAVGAVGAGRMSYAFGRRRSLIFSAFLFVAGGLVCALASSVSELIIGRTMLGLAIGIGSFVAPLYISEVSDISRRGSLVSMYQLMITLGILLAFVSNAILSYSGSWRWMLGIMAIPGTFFLIGSFFLPDSPRWLMLRGRHEEALSIMKELRHNPELAHQEIRDIQGQIHDRQRGLAMFLENRNFRRAVLLGIVLQVMQQLTGINVVMYYAPRIFQEVGFGSSGQMWGTAIVGVVNWLATFIAIAFADSWGRRPMLITGFAIMSAGLAVLATIMSGAVGNTDLSHYLAISVLLCFIAGFAFSAGPLVWVLCSEVMPLQGRDFGITCSTVTNWVTNMVVGATFLGLLTTLGASHTFWLYAGLNALFIFMVLFFVPETKGVSLESIETKLNQGVTLRNIGR

SEQ ID NO: 66595 - protein, 324 aa, Methanosarcina barkeri str. Fusaro
MNEYSHSSRIKPIKVLTFGEALFDIIRGSAHLGGAPLNLAAHLAKLGAKPAVITAVGRDELGKSLLSRAKAMGIDTSYILIDKKRPTGTVTVQLQAEGIPVFTINKGVAWDAITPDEKEFKALSGEEWDVFCFGTLAQRTEENRKTLERLFSEIKAKHFFYDVNLRTGNYKKEWILSSLEHTTILKLNEKEASTISCLLSGTSGTCKPLTSYKAFCRLVTEKYPEIFVICISRGPKGAAVCYKGVYEEVETTPIEVADTVGAGDAFSAGFLYTCLSGYGVSKAASIACILGTYVASKPGAVPDYSKELMEELKAQGLNLSFIKT

SEQ ID NO: 66596 - protein, 165 aa, Aegilops longissima
VMASSATTVAPFQGLKSTAGLPVSRRSSASLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCE

SEQ ID NO: 66597 - protein, 547 aa, Nocardia farcinica IFM 10152
MASADRVTAPVDTVTTGPIEGSVKHYREVDGLRIPVRRINLTNGETFDVYDTSGPYTDENATIDLEAGLPKLRDSWDKPTVAGPRTQLAWARAGIVTPEMRFIAAREGVEPELVRAEVAAGRAVIPANHNHPELEPTIIGKKFLVKINANIGNSAVSSSIAEEVEKMVWATRWGADTIMDLSTGKNIHETREWILRNSPVPVGTVPIYQALEKVNGDPAALTWEIYRDTVIEQAEQGVDYMTVHAGVLLRYVPLTAKRVTGIVSRGGSIMAAWCLAHHRESFLYTHFEELCEILARYDVTFSLGDGLRPGSVADANDEAQFAELRTLGELTKIAKSHGVQVMIEGPGHVPMHKIVENVRLEEELCEEAPFYTLGPLATDIAPAYDHITSAIGAAIIAQAGTAMLCYVTPKEHLGLPNRDDVKTGVITYKIAAHAADLAKGHPHAQQRDDALSKARFEFRWRDQFALSLDPDTAREYHDETMPAEPAKTAHFCSMCGPKFCSMRISADVREYAEANNLTDVAAIEAGMAAKSAEFAESGGKVYLPVVS

SEQ ID NO: 66598 - protein, 325 aa, Sinorhizobium terangae
ISGWKAINESDMVLMPDPETAHMDPFFAQSTMVILCDILDPVSGEAYNRDPRGTAKKAEAYLKASGIGDTVFVGPEAEFFVFDDVKYKADPYNTGFKLDSSELPSNDDTDYETGNLGHRPRIKGGYFPVPPIDSCQDMRSEMLTVLAEMGVTVEKHHHEVAAAQHELGVKFDALVRNADKMQIYKYVVHQVANAYGKTATFMPKPVFGDNGSGMHVHLSIWKDGKPTFAGDEYAGLSETCLYFIGGIIKHAKALNAFTNPSTNSYKRLVPGYEAPVLLAYSARNRSASCRIPFGSNPKAKRVEVRFPDPSANPYLAFAAMLMAGL

SEQ ID NO: 66599 - protein, 191 aa, Paracoccidioides brasiliensis
MAEIRRKLVIVGDGACGKTCLLIVFSKGTFPEVYVPTVFENYVADVEVDGKHVELALWDTAGQEDYDRLRPLSYPDSHVILICFAIDSPDSLDNVQEKWISEVLHFCQGHPIILVGCKKDLRDDPRTIEELRKTSQKPVTTEQGEEVRKKIGAYKYLECSARTNDGVREVFESATRAALLAKKEKKKCKIL

SEQ ID NO: 66600 - protein, 471 aa, Bacillus cereus ATCC 14579
MNQQIEQTDLKRTMKSRHLFMIALGGVIGTGLFMGSGQIVHNAGPGGAILAFLVGGFVMYLTMLCLGELSVAMPEAGSFQSYASKFISPGFGFVVGWMYWLNWAVTVGVELTTVSILMKRWFPDVSSWIWCVTFAAALFLVNALSAKAYAEAEFWFASVKVATIVIFIVLGGAVMFGLLDFNGKPAPMLHNFTENGGLFPNGALAVLLTMITVNYSFQGTELIGIASGESENPEKTIPKAIKNTIWRTLFFFVLAISVVVGLLPWQEANLVESPFVLVFDVAGVPYAADIMNFVIITAVLSVANSGLYANSRMLWAMAKQGMASPAFTKLTKKGVPLNALIFSLIFASLSLLTSVFAADTVFLVLTSIAAMAAVVVWMSIAASQFFFRRNFVKNGGNINDLKYRTPLYPLVPIVAFSLNFITFVSLAFIPDQRIALYCGIPFMIICYILYQVKYKKIVTLEQPRTVIREIN

SEQ ID NO: 66601 - protein, 165 aa, Aegilops searsii
VMASSATTVAPFQGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCE

SEQ ID NO: 66602 - protein, 136 aa, Triticum aestivum
  misc_feature (35)..(35): Xaa can be any naturally occurring amino acid
MASTTFRRFGVAAAAAAFIALAAFGSASASKTAFXVKSTVKAHDVVIFSKSYCPYCKRAKAVFKELELKKDPYVVELDQREDGGEIQDALSDMVGRRTVPQVFIRGKHLGGSDDTVDAYESGELAKLLNISVKDDL

SEQ ID NO: 66603 - protein, 441 aa, Pseudomonas fluorescens PfO-1
MARLQRTLSLGSVVLFGIAYMTPIIVLGTFGILAQSTAGMVPAAYLAALVAMFFTAMSYGRMAAAFPVAGSAYSYVRKAISPKLGFIAGWAVLLDYLFLPMAIWLIGAAYLASAFPSIPQWIWVLAFIGITSAINIIGLKLANGINALLMLVQFLVLIAFVGLCVHYVGGDASQPLWSIKPFFNGDMQMPLIMSGAAIACYSFLGFDAVSTLTEETRDPRRTIPRAIMLITLIGGLIFVGVSYFVQIAHPSFQFDSVDSAAYEIARNIGGDLFVSIFLIGLIVGQFASGLSAQASGSRLLFAMGRDGVLPKSFFGTLHERFGTPVNSILLCAVVALLALKLDVTTSTSFINFGAFLAFSLVNLSVIFHYWIGGEKKGLRELILFLIFPFIGLAADLWLMVSLDHLAVYLGLSWLAIGVVYLAVLTGGFRRQPPEMDFQEAA

SEQ ID NO: 66604 - protein, 325 aa, Shewanella oneidensis MR-1
MVDQSQLRQWGCKVIDIEKSALDNLYQYVDSAEFAQACELILNCSGKVIVMGMGKSGHIGNKISATLASTGTPAFFVHPGEASHGDLGVLSDNDIILAISNSGESSEILALMPVIQRKAIPVIAMTGKPESTMARLAKIHLCIEVPEEACPLGLAPTSSTTATLVMGDAMAIALLQAKGFTRDDFAMSHPGGALGRKLLLKVSNVMHCGDDLPLVKHDICITDALYEISKKGLGMTAIIDEQNKLVGIFTDGDLRRVIDAQVNLRTTPIADVMTRNCVTITENVLAAQALQVMDSRNINGLIVIDKENHPVGALNMLDMVKAGVI

SEQ ID NO: 66605 - protein, 372 aa, Geobacillus kaustophilus HTA426
MTVTRGLEGVVATTSSISSIIDDTLTYVGYDIDDLAENASFEEVVYLLWHRELPTKEQLEELKKQLAENAEIPNEIIEHFKLYPIDKVHPMAALRTAVSLLGLYDEEADVMTKEANYRKAIRLQAKIPTIVTAFARVRKGLEPVAPRKDLSFAANFLYMLTGKEPDDIATEAFNKALVLHADHELNASTFTARVCVATLSDIYSGITAAIGALKGPLHGGANEAVMKMLTEIGTVDNVEPYIRRKLANKEKIMGFGHRVYRKGDPRAKHLKKMSEKLTKLVGEPHWYEMSTKIEEIVTSEKALPPNVDFYSASVYHCLGIDHDLFTPIFAVSRTSGWLAHILEQYDNNRLIRPRAEYTGPGKRAYVPIDERG

SEQ ID NO: 66606 - protein, 415 aa, Burkholderia mallei ATCC 23344
MTEHAGADATAMPRTVVVIGGGQAAGWVVKTLRDEGFAGRIVMIADEAHLPYERPALSKAVLAGEADIATVRVMQPDAFGALDVDAWQPERAASIDRARRVVRTASGREIEYDRLVIATGGTPRRLPDAIVGTAHLHYLRTLDEALALGEKLRASRRVLVIGGGWIGLEVAATARKLGVDALVVEGAPRLCARSVPGAVSDFLLDLHRANGVDVRLNASLASLDAHPDDARRVRATLAGGGVVDADFAVAGIGLALNTSLATEAGLHVDDGIVVDEYGATSDPAIFACGDVANHPNAWLKRRVRLESWANAQHQAIAAAKAVLGVRAPYAEIPWFWSDQYDVNLQILGDLPADARCIVRGELAAKRATLFFVADGALRGVIAINAARELKLARKWMNQGRAIDVAALADTAKALA

SEQ ID NO: 66607 - protein, 319 aa, Geobacillus kaustophilus HTA426
MKRIGVLTSGGDSPGMNAAIRAVVRKAIYHGVEVYGIYHGYAGLIAGNIKKLEVGDVGDIIHRGGTILYTARCPEFKTEEGQKKGIEQLKKHGIEGLVVIGGDGSYQGAKKLTEHGFPCVGVPGTIDNDIPGTDFTIGFDTALNTVIDAIDKIRDTATSHERTYVVEVMGRHAGDIALWSGLAGGAETILIPEADYDMDDIIARLKRGHERGKKHSIIIVAEGVGSGVDFGRQIQEATGFETRVTVLGHVQRGGSPTAFDRVLASRLGARAVELLLEGKGGRCVGIQNNQIVDHDIAEALAKTHTVDQRMYTLSKELSI

SEQ ID NO: 66608 - protein, 86 aa, Triticum aestivum
MVLVLALGDLHVPHRAADLPPKFKSMLVPGKIQHIICTGNLCIKEIHDYLKTICPDLHIVRGEFDEDARYPETKTLTIGQFKLGLC

SEQ ID NO: 66609 - protein, 389 aa, Neisseria meningitidis FAM18
MSKKLHPQTLAIRGGKEQTEYREHNQALFLTSSFMWDNAQHAADLFSKKIKGFTYTRTANPTTAAFEKRIAALEGAERAVATSTGMSAIQAAFFTFLQAGDHVVSSRSLFGTTVGFINNIVTKFGIEVSHVSPTDINEWKAAVKANTKLLFLETPSNPLGEVANLEALAELAHGIGAILVVDNSLLSPIGSQPLKHGADISVSSATKAIDGHGRVMGGVLAGSEELMAQAAVYCNSCGLAMSPFNAWQLLSGVETLSLRMEKQFDNALKIAQWLQAQPQVQAVYYTGLPDHPQAALIRKQQNGGGIVIGFEVADQAAAWKVVDGVELFSRTANLGDVRSTITHPWTTTHGRMQPEEKLAANIRPGLVRLSVGLEYVGDLIDDLKQALAR

SEQ ID NO: 66610 - protein, 573 aa, Coccidioides immitis RS
MDGDDIRHAAVSSPEHLSSLPFAANGTPGKKRRKADLKPIITNDPPSAAAAANPSSTSINMTSSQSSNPLASAQYPVSTTYASPLSRSPSSSSSAEDLAETAADEEDSEDYCKGGYHPVQVGETYNNGRYVVIRKLGWGHFSTVWLSRDTTTGKHVALKVVRSAAHYTETAIDEIKLLKRIVDARPDHPGRKHVVSLLDSFEHRGPNGVHVCMVFEVLGENLLGLIKRWNHRGIPMPLVKQITKQVLLGLDYLHRECGIIHTDLKPENVLIEIGDVEHIVKTYVKEEEAQKEKDNHRNGRRRRRTLITGSQPLPSPLNTSFSAADPFKAHTPTLSSHSSLNQVLQEPTEAKREDNREVSGITLETGSTPEVDDPQVDLISVKIADLGNACWVGHHFTNDIQTRQYRSPEVILGAKWGASTDVWSMAAMVFELITGDYLFDPQSGTKYGKDDDHIAQIIELLGSFPKSMCLSGKWSQEIFNRKGELRHIHRLRHWALPDVLREKYHFPAEESKAISDFLLPMLELVPDRRANAGGMANHPYLKSTKGMDHIQLNVPVGSRGEGIAGWASEVKKR

SEQ ID NO: 66611 - protein, 325 aa, Bradyrhizobium elkanii
IAGWKAINESDMCLMPDPVTATIDPFFAETTMVITCDVLEPTTGEPYNRDPRGIAKKAEAMVKSMGVGDTVFVGPEAEFFVFDDVRYSAEPYNTGFRLDSSELPINSATEYEGGNLGHRIRTKAGYFPVPPQDSVQDMRSEMLGAMAKMGVKVEKHHHEVASAQHELGMKFDTLTLMADQMQVYKYCIHQVAHIYGKTATFMPKPVYGDNGSGMHVHQSIWKDGKPTFAGNKYADLSETCLHYIGGIIKHAKAINAFTNPSTNSYKRLVPGYEAPVLLAYSARNRSASCRIPYTANPKAKRVEVRFPDPMANPYLGFAAMLMAGL

SEQ ID NO: 66612 - protein, 165 aa, Triticum timopheevii subsp. armeniacum
VMASSATTVAPFQGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNLRQVQCVSFIAFRPPGCE

SEQ ID NO: 66613 - protein, 325 aa, Mesorhizobium loti
IAGWKAINESDMVLMPDPETVHMDPFFAQSTMVILCDILDPVSGESYNRDPRGTAKKAEAYMKAEGIGDTIFVGPEAEFFVFDDVKYKADPYNTGFKLDSTELPSNDDTDYETGNLGHRPRVKGGYFPVPPIDSAQDMRSEMLTVLAEMGVRVEKHHHEVAAAQHELGIKFDALVRNADKMLIYKYVVHQVANAYGKTATFMPKPIFGDNGSGMHVHMSIWKNGKPTFAGNEYAGLSESCLFYIGGIIKHAKAINAFTNPLTNSYKRLVPGYEAPVLLAYSARNRSASCRIPFGSSPKAKRVEIRFPDPGANPYLGFAALLMAGL

SEQ ID NO: 66614 - protein, 493 aa, Nicotiana tabacum
MANKVVCPKAFRDLRSFVRCLNTAPTVPPMNFTGAYDATTVTTPALIPTDQVITADKKVINFEDVKELFTGVSTLKLIRSTLTLQMAATEPMVDVGIWVMNSKLMHMPIVKEVILGFVKGTFYEHFCAGKDLIEVRRTVTKLSDVGLKGMLDYGVEHATENESCDQSMKVFLQTAESTKSLPSSSVSFVVVKITAICTPKLLKRMSDLLRWEHKNPSFNLPWKQKSLPLFSDSSPFYHTPQKPEPLTVEEEHDLQLAHERLMTICKKCLELDVDLLIDAEDTAIQPAIDYFAYSAAIKYHKDDDPMIFGTIQAYLKDSKERMVIAKKAAEKMGVPMGFKLVRGAYMSSERELASRLGVQSPIHDSIEQTHDCFNSCAEFMLDEISNGSGAVVLATHNIDSGKLAASKAIDLGIRKDSQKLQFAQLYGMAEGLSFGLRNAGFQVSKYLPFGPVEQVMPYLIRRAEENRGLLSTSAFDRQLMRKELTRRFKVATS

SEQ ID NO: 66615 - protein, 428 aa, Methanosarcina barkeri str. Fusaro
MSYIGLQQDSGEYKIQKIHAREILDSRGNPTVEVDVFTPKGFGRAGVPSGASTGTNEALELRDADPNRYGGKGVLTAVKNVNTIIQKELLGLDVRNQREIDELMIELDETDNKSNLGANAILGVSMAVARAAADSLNVPLYRYLGGSNAFTLPVPTMNVLNGGKHAGNDLAIQEFMIQPKGAETFYEALQIGAEIYHVLGKILEKKYGRSSTNVGYEGGYAPKMSESTEALDALAQAIEEAGYTDTEVTIGLDAAASEFYEDEAYAIDGKKLSAPELMDYYVELVNSYPILSIEDPFYEEAFEDFEALTNELWDTIIVGDDLFVTNIERLSKGVDMGAANALLLKVNQIGTISEAFDAANMASRNGYTVIVSHRSAETEDTTIADISVAIGAEMIKTGAPARGERTAKYNQLLRIEEDLGEVAHYVQL

SEQ ID NO: 66616 - protein, 473 aa, Pseudomonas fluorescens PfO-1
MPVGNHPPHGETAQGGPLKRELGERHIRLMALGACIGVGLFLGSAKAIEMAGPAIMLSYIIGGLAILVIMRALGEMAVHNPVAGSFSRYAQDYLGPLAGFLTGWNYWFLWLVTCVAEITAVAVYMGIWFPDVPRWIWALAALVSMGSINLIAVKAFGEFEFWFALIKIVTIIAMVLGGIGIIAFGFGNDGVALGISNLWAHGGFMPNGVTGVLMSLQMVMFAYLGVEMIGLTAGEAKNPQKTIPNAIGSVFWRILLFYVGALFVILSIYPWNEIGTQGSPFVMTFERLGIKTAAGIINFVVITAALSSCNGGIFSTGRMLYSLAQNGQAPAGFARTSSNGVPRRALLLSIFALLLGVLLNYLVPEKVFVWVTSIATFGAIWTWVMILLAQLKFRKGLSASERAGLKYKMWLFPVSSYLALAFLVLVVGLMAYFPDTRVALYVGPAFLVLLTVLFYVFKLQPKDSVQGAMRSAS

SEQ ID NO: 66617 - protein, 323 aa, Mesorhizobium mediterraneum
GWKAINESDMVLMPDTETVHMDPFFAQSTMVILCDILDPISGESYNRDPRGTAKKAEAYMKAEGIGDQIFVGPEAEFFVFDDVKYKADPYNTGFKLDSTELPSNDDTDYETGNLGHRPRIKGGYFPVPPIDSAQDMRSEMLTVLAEMGVRVEKHHHEVAAAQHELGIKFDTLVRNADKMLIYKYVVHQVANAYGKTATFMPKPVFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFPDPGANPYLAFAAMLMAGL

SEQ ID NO: 66618 - protein, 424 aa, Triticum aestivum
  misc_feature (18)..(19): Xaa can be any naturally occurring amino acid
  misc_feature (22)..(22): Xaa can be any naturally occurring amino acid
  misc_feature (353)..(353): Xaa can be any naturally occurring amino acid
  misc_feature (405)..(405): Xaa can be any naturally occurring amino acid
MCIHKKLKCHASFMPNGXXMNXPNIVKLKEVIRENDILYFIMEYMECNLYQLMKDRVKPFAESDVRNWCFQIFQALAYMHQRGYFHRDLKPENLLVSKDVLKLADFGLAREVSSAPPYTEYVSTRWYRAPEVLLQSSAYDSAVDMWAMGAIMAELLTLHPLFPGTSEADEILKICNVIGCPDEQTWPQGLSLAEAMKYQFPQIRGNQLSEVMKSASSEAVDLISSLCSWDPCKRPKAAEVLQHAFFKDCTYVPAAVRPKAAGPPKTPPGVGARGVSGHIARRYSTGALSTSKPAANISIKPSSLSKIGVQRKLQLDRQAPQKSTRPTESNTKQTTSRVPARNSPGNANPILRXHSRSLPETGRATVQKVSTITEKLAHMSVTSRTRTAVKPPVPLLKAGHLKSDXLGKSDEIPPAKRLTRKLVS

SEQ ID NO: 66619 - protein, 325 aa, Bradyrhizobium japonicum
IAGWKAINESDMCLMPDPVTATIDPFFAETTMVITCDVLEPTTGEPYNRDPRGIAKKAEAMVKSMGVGDSVFVGPEAEFFVFDDVRFSSSPYNTGFRLDSSELPTNTDTEYEGGNLGHRIRTKAGYFPVPPQDSVQDMRSEMLGAMAKMGVKVEKHHHEVASAQHELGMKFDTLTLMADHLQIYKYCIHQVAHIYGKTATFMPKPVYGDNGSGMHVHQSIWKDGKPVFAGNKYADLSETCLHYIGGIIKHAKAINAFTNPSTNSYKRLVPGYEAPVLLAYSARNRSASCRIPYTASPKAKRVEVRFPDPLANPYLGFAAMLMAGL

SEQ ID NO: 66620 - protein, 165 aa, Secale cereale
MMASSATTVAPFQGLKSTAGLPVSRRSSGSLGNVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCE

SEQ ID NO: 66621 - protein, 139 aa, Bacillus cereus ATCC 14579
MTRVRDLMSTHIVHCTPLDNVYEAAVKMKEESIGLIPVVENEQVVGLVTDRDLVVRGIAEKHPGSNKITNVMTTNIISVSPNDSIEKATELMAQHQIRRLPVVDSGQLIGMLALGDLAIRESADDQAGFALSEISERTE

SEQ ID NO: 66622 - protein, 496 aa, Burkholderia mallei ATCC 23344
MTAFDSSLVPSGDILIGGEWRRGRGATTPSFYPADGSLNTEIHMADAADAREAVQAADAAWRRADWAGLKPHQRADVLYRVADLIHAHREALAQLQRRDNGKPINETRALVASAASTFRYFAACAQTLDEALTPSRGDYLSMSVHEPLGVVAAITPWNSPIASDAQKLGPALAAGNAVVLKPAEVTPLASLALARLCEQAGVPRGVISVLPGKGSVIGDALVRDPLVKKVSFTGGTEVGRGIARLAAEKLMPLSLELGGKSPTIVFDDAELDHAVNGVLYGIFSSSGESCIAGSRLFVQRSIYGAFVARLVEAARKLRVGDPASERTQMGPLITARHRDTVERYVALGRDEGARVLCGGERPTGEGRDAGFFYLPTILDGLSNHARICREEIFGPVLVALPFDDEAALVADANDSVFGLAAGIWTRDYKRAWRVARVLDAGTVWINTYKQFSISTPFSGRKESGMGREKGSLGIREYMQQKSLYWGLNDSPLPWAN

SEQ ID NO: 66623 - protein, 209 aa, Glycine max
TSPITMGDSKHISVHRLLGEGLIADVVLWKNWRGAVAVLVSATALWYLFERAGYNFLSFVANVVLLLVVILFFWAKAANLLNRPLPPLPDLEISEETIARVADALQIWMNRALSVAHDIAIERNLLLCLQVVGVLWVISYIGSLFNFLTLIYFGVLLCLSLPVLYDKYQDQVDDRLCVIHGIIQTQYTKVHSTVLSKIPKLSNKEKKVQ

SEQ ID NO: 66624 - protein, 322 aa, Ostreococcus tauri
MPRGWTKTRAYDSHHFDADAWSVVTPRAGDVIIATAYKSGTTWMQQIVSQLVFEGAAPAALGELSPWVDLRVPPREVKRGMIEGLPSPRILKTHLPTTGLEYDENAKYIYVARDGRDAFMSLMNHYKNGNEAFYGALNGPGLKGAPLPTWEEACEGEGDEKLRALFDKWLNTPWGQHPWEEDGWPFWSLFYNMKTWWDARESKNIIFVHFSDLKKDLKGQMRRIAKFLNAPIDESKFDAQVTACTFESMKGNAASVAPLGGALWKGGAETFINKGTNGRWRNVLTKEQVKQYEQVAEKRLGKDCAKWLANGGDMNGRGCVIM

SEQ ID NO: 66625 - protein, 399 aa, Burkholderia mallei ATCC 23344
MSSNRGVVYQGPGKVEVRKIDYPKMVDPSGRAIGHGVILKVVSTNICGSDQHMVRGRTTAPVGLVLGHEITGEVIEVGRDAETLKIGDLVSVPFNVACGRCAMCKEQHTGVCLNVNPARAGGAYGYVDMGGWIGGQAEYVLVPYADFNLLKFPDRDRAMAKIRDLTCLSDILPTGYHGAVTAGVKPGSTVYVAGAGPVGMAAAASARLLGAACTIVGDMNAERLAHAKAMGFEVVDLSKDATLGEQIEQILGKPEIDCAVDCVGFEAHGHGSSGHAQEAPATVLNSLMEITRPAGAIGIPGLYVTDDPGAVDVAAKHGSLSIRFGLGWAKSHSFHTGQTPVLKYSRNLMQAILFDRLPIAEIVNVAVISLDDAPEGYKKFDGGAPRKFVIDPHGMLKAA

SEQ ID NO: 66626 - protein, 218 aa, Brassica napus
LESNLGQVKGNGMSNEDAREGCKLFYFAGQETTSVLLVWTMVLLSQHQDWQAKAREEVKQVFGHKIPDTDGLNQLKVMTMILYEVLRLYPPVTQVSRAIHKEMKLGDLTLPGGVQISLPILLVQRDTELWGDDAGEFKPERFREGLSKATKSQVSFFPFAWGPRICIGQNFALLEAKMAMALILQRFSFELSPSYVHAPYTVITIHPQFGAHLILHKL

SEQ ID NO: 66627 - protein, 509 aa, Geobacter metallireducens GS-15
MELPLCDFPFTLQLDLQKTTKESSEMMILKNSSLLKQQCYLDGHWCCADGGATIDVTNPATGEILGVVPKMGTQETRRAIEAANGALDGWKARTAKERSAILRRWFELIMENLEDLAVIMTAEQGKPLAESRGEIAYAASFIEWFAEEGKRIYGDTIPSYARDKRIVVIKEPIGVCAAITPWNFPAAMITRKAGPALAAGCTMVVKPATATPFSALALALIGEQAGIPAGVFSVITGSSKEIGDEMTGNPIVRKLTFTGSTEVGKQLTAQCAGTMKKVSMELGGNAPFIVFDDADLDAAVEGAIASKYRNTGQTCVCTNRILVQESVYEAFSAKLVAAVSKMTVGDGLKGEVQQGPLIDMTALEKVEEHIADAVAKGARVVLGGKRHALGGTFFEPTIITDVTPGMLVAREETFGPLAPLFKFSTDEEAIRMANDTEFGLASYFYSRDIRRVWKVSEALEYGMVGINTGLISSEVAPFGGVKESGVGREGSKYGIEEFVEVKYLCMGGI

SEQ ID NO: 66628 - protein, 230 aa, Saccharomyces cerevisiae
MKLFQNSYDFNYPWDQVTAANWKKYPNEISTHVIAVDVLRRELKDQGKVLVTERLITVKQGVPKWIMMMLGGTNMSHVREVSVVDLNKKSLTMRSCNLTMCNLLKVYETVTYSPHPDDSANKTLFQQEAQITAYGSIRKLCNKMEDWSVQRFCENAKKGKMGFDAVLQVFSENWEKHVDDLSNQLVSKVNETMEDVKISAGTLLKGTERSGRTILQQNIDLFRDAYNHEN

SEQ ID NO: 66629 - protein, 125 aa, Lactococcus lactis subsp. lactis Il1403
MLLNDGQEEKKMNLIESINAAQLRTDIPDFRPGDTVRVHAKVVEGTRERIQMFEGVVIARKNSGINETYTVRKISNGVGVERIFPVHTPRVEQIEVIRHGKVRRAKLYYLRALTGKKARIAERRR

SEQ ID NO: 66630 - protein, 165 aa, Hordeum vulgare subsp. vulgare
VMASSATTVAPFQGLKSTAGLPVSRRSSASLGSVSNGGRIRCMQVWPIEGIKKFETLSYLPPLTTEALLKQVDYLIRSKWVPCLEFSKVGFVFREHNSSPGYYDGRYWTMWKLPMFGCTDATQVLNEVEEVKKEYPDAYVRIIGFDNLRQVQCVSFIAFRPPGCE

SEQ ID NO: 66631 - protein, 165 aa, Avena sativa
VTASSATSVAPFQGLKSTAGLPVGRRSNAGLGNVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCE

SEQ ID NO: 66632 - protein, 992 aa, Sulfitobacter sp. EE-36
MLRKKTNGMARRPQRAGMLSDIAEKSVDRRAFLRGSGLAIGGLAAIASTAGSVTQASAATAVSGAVETIKSVCTHCSVGCTVIAEVSNGVWTGQEPGWDSPFNLGSHCAKGASVREHAHGERRLKYPMKKEGGQWVRISWEQAINEIGDKMNVIREESGPDSVYWLGSAKHNNEQAYLFRKFAAYWGTNNVDHQARICHSTTVAGVANTWGYGAMTNSYNDIHNSQAIFVIGGNPAEAHPVSLLHLLKAKEQNNAPMIVCDPRFTRTAAHADEYVRFRPGSDVALVWGILWHIFENGWEDKEFIRTRVWGMDQIRDEVAKWTPEEVERVTGAPASQLERVARTLANNRPGTVIWCMGGTQHSNGNNNTRAYCILQLALGNMGTAGGGTNIFRGHDNVQGATDLGVLADTLPGYYGLSAGAWAHWARVWEEDLEWLQSRFSKASFNDTSMMNLTGIPVSRWIDGVLEDKENIDQPDNTRAMVLWGHAPNSQTRQKEMVTAMEKLDLMVVVDPYPTVSAVMQDRQDGLYLLPATTQFETRGSVTASNRSLQWRDQVVEPLFESKPDHTIIKLFADKFGFSDRLFKNIALDGDEPNIEDLTREFNRGMWTIGYTAQSPERMKMHMANQHTFDRTTLRAKGGPADGDFYGLPWPAWGTPEMNHPGTANLYDMSLPVAEGGLTFRARFGVERDGDNLLAEGVYSAGSEIKDGYPEFTMAMLRELGWDKDLTDEEMAVINYVAGYPEGQPANAKPDEEVGETSQTGETPSDYIADTGGVNWKTDLSGGIQRVAIKHGCAPFGNAKARAVVWTFPDPVPIHREPLYTNRRDLVADYPTYDDKKFWRLPTMYKSIQENDFSKDYPIVLTSGRLVEYEGGGDETRSNPWLAELQQDMFIEINTRDANNLGVRDGADVWVEGPEGGKVKVMAMVTERVESGVAFMPFHFGGHMEGVDLRDRYPEGADPYVLGESTNTAQTYGYDSVTQMQETKATLCKIWTA

SEQ ID NO: 66633 - protein, 165 aa, Aegilops speltoides
VMASSATTVAPFQGLKSTAGLPVSRRSSASLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNLRQVQCVSFIAFRPPGCE

SEQ ID NO: 66634 - protein, 154 aa, Aegilops speltoides
VMASSATTVAPFQGLKSTAGLPVGRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNLRQVQCV

SEQ ID NO: 66635 - protein, 111 aa, Triticum aestivum
  misc_feature (80)..(80): Xaa can be any naturally occurring amino acid
  misc_feature (82)..(82): Xaa can be any naturally occurring amino acid
  misc_feature (89)..(89): Xaa can be any naturally occurring amino acid
MSAMETDINAPPPAPAGEGSSVVGPSSSSSRKPNKRFEIKKWNAVALWAWDIVVDNCAICRNHIMDLCIECQGEQASATXSXECTVAWXVRYHAFHSNCINKWLKDPNVPN

SEQ ID NO: 66636 - protein, 237 aa, Ostreococcus tauri
MRSFASATTLAVLLSATAAHASDVSSKHLLTDIPAANPDVEAVSVFPDYVDPAFPGGERVKVLLGLRNAGNEEVKVTHLAGSLNVPSNFNFYVANFTEASFTYEFSVDPQFAGHSLQLALTAFYEETDVAYATTYFNSTVPVLDPKVLFDRELAVIYLTLASVAFFIVAAIMKAAGLGHLVPFIGDEKPQGGQQKKSTVKKVAPKPAPSASASDSEQWLEGTAFARQSSKKEKKKNK

SEQ ID NO: 66637 - protein, 355 aa, Frankia sp. CcI3
MPATMQALAFLGIGKAGVIEKPIPKPGPTDAIVRTTSALICTSDVHTVRGAIPVPEGRALGHEAVGVVHDLGAAVTGFEAGERVAVGALTPCFHCGPCQRGFSTQCQGMLGGYKFTTQRDGNMAEYFLVNNAAANLARIPADLPDEKAVYATDMLSTGFGGAENAQLRLGESVAIFAQGPVGLSATIGCRLLGAGLIIAVEGRPERQELARRFGADVVVDPAAGDVVNQILDLTGGVGVDGAIEALGHPQTFEDCIRVTKPGGRISNIGYHGENPAPLQIPLEPFGLGMSDKKILTSLCPGGSDRLERIFTLMRSGRVDPTPMTTHEFGFDEIERAFSMMETKEDGVIKPLIRFA

SEQ ID NO: 66638 - protein, 334 aa, Ostreococcus tauri
MFSKHKPFDAASLTTPRSIVSAAGDWGCPEQGCPVDVLRTKRLITAIKTPYLTSGKVDLYAYDALVEAQIEGGVEGLIVGGTTGEGQLMSWDEHVMLIAHTAQKYGDRVLVIGNTGSNSTREAVHATSQGFAVGMDASLQINPYYGKTSRRGLIEHFGAVMDLGPAIVYNVPARTSQDIAPEVMFELAKHKNFAGVKECEGNVRIKGYTDKGVTCWTGNDDEVHEARYEAGAVGVISVTSNLVPELMRELLFDGPNPELRDRLLPLMGWLFREPNPIGVNTATAMLGVAKPVFRLPYVPYAADLRAEGAALLRDVGVANAQPLADDDFTLLREW

SEQ ID NO: 66639 - protein, 278 aa, Magnetospirillum magnetotacticum MS-1
MIVSGKARLAGVLGWPVSHSRSPRLHGFWLKQWGIDGAYLPLAVAPENLECVIRALPRMGFRGANVTVPHKEAVMRLVDHLDPLARRIGAVNTLVVRDDGSLEGRNTDAYGFFENLRQGCPAWTASSGPAAVIGAGGAARAVVAALADAGVPEIRLANRSRERAEALAADLGGPVKVVEWSERAGMLDGCALLVNTTTLGMTGQSDLDLDLAALPTTAVVNDIVYVPLETDLLVRARARGNATVDGLGMLLHQAVPGFEAWFGQKPQVSHELRAFVLS

SEQ ID NO: 66640 - protein, 625 aa, Streptomyces sp. JP95
MSAIAGWVDFERDLSPQAATVETMAAALAHRGPDGRGVWAEGHAALAHRRLALLDLTETGAQPAVHTTEGGAAVAVLTLDGALTNHTELRARLAAKGHRFTGRGDGETALHAYLEWGADFLTRLEGLFAIAVWDVRRQELLLARDRLGVKPLSYHPTPTGVLFGSEPKAILAHPDVDAVVDADGLRELFAHSRKPGTGVFRGMREVVPGHALIVRRPGSREQRYWSLPAREHTDSLDTTVATVRGLLADAVASHTRADAPVGAMLSGGIDSSALSALAHRDLTAAGSGPLRTFSVNFTGYTENFEPHPTMRSTPDAPFAALASRHIGSRHTEFLLDTAALTDPGVHTAALRSQDAPSPLGDMDVSLLRFFARLREEGFAAVLSGETADEVFNGYFWAYDPKHSNSQTFPWVSFERGHDAAAGGLGTSMIDRELRKRLDFLGYADQHYRDALTEVPHVDGDTAAERRAREVTYLALTRWAPTHLDRADRMSMAHGVQLRPPFCDRALVEYVYNVPAAMKRVDGVEKSLLRSAVADLLPDEVLHRRKSAYPTTQEAAYGDFVRQRFAELAADRDAAVAELLDTTATAEAVAADGSPQGAFAWVERAGMEMALQLDTWLTDYRVDLRL

SEQ ID NO: 66641 - protein, 238 aa, Haloarcula marismortui ATCC 43049
MRPRIALLNAAHDGDDNRRNFRRELDADLVEYDVTERELPDTFAFDGCLVTGSRASVYWDEPWIRDLESWVDAAIDRDIAFLGVCFGHQLLAHALGGTVEPMDEYEIGYRTVEHDGENELLAGVDESFTVFTTHSDRVAEVPPGATTFAENDYGIHGFRKENVFSVQFHPEYDPETAKTVTKGKDEQLADERIDAVLDGVTEENYRAACEAKRLFDNFTEFAARHAGGVTGATTAADD

SEQ ID NO: 66642 - protein, 364 aa, Arabidopsis thaliana
MTTISDLSDDLVGDILSRVPFTSLISVRSTCKKWNALSKNQIFGRKTAARNQFLEFMILDSRVCSLRLDLQGIRNEDKEDFVDPSMKLISIPSNDDQVEISQVYHCDGLLLCIAKENSNVFVWNPYLGQTKWIRPRNTFHRYDRFALGYDNNRNHKILRFLYDEESNESSRRTHIDVYDFSSDSWRVLDVNPDCDIPFYQTGVSLKGNTYFFERFGPCLPLLFYPPCPSFETVTLSWVRDEKLAVLYNHYVTAEIIEIRISTKIEPNAVSWSSFLTVDMSLVNGLPDHFSMYFEAKSFFIDEEKKVVVLFDSKEIKTCRYQMAYIVGDDGYFKSVNIGVSPNSQRKPGRLVCSSYVPSLVQLQD

SEQ ID NO: 66643 - protein, 578 aa, Aspergillus nidulans FGSC A4
MSLYYDAASILTTPSTAGGSFKSRLYNSRNLKASPAQVYALITEAAKWDILLKEVIDQAGILKLEPKVVPHHCPVLLTPLLALLLVHDHLLAKNGIAAPASHPLRQAVERHKIRLKGEFTKARVRRACATIPELKEAVRKEKLAALGAKGSSGAVYPRWVRVNNVRTTMEAQLKTTFAAFENVESLDGLVVGGDDKQKRMRLDPHIPDLVAVAPGVEFSSTPAYKNGEIILQDKASCFPAYLLLGDDWDGQGDLVDGCAAPGNKTTHMASLLRKAKSKKKAESSRIISMDASSIRAKTLKKMVSIAGADSFTSVLQGQDFLALDPQDPRFKDVTGLLLDPSCSGSGIIGRDDVPQLVLPAPGRPTPASGSKNQTQGKKRKRNDSSGSSSNQPSTPSSLTSAATPSTSENDTPISEITQDRLLKLSNLQFRIVTHALAFPAARKVTYSTCSIHLLENEAVVQRILESDIAKRRGWRVLRRDEQPEGLKKWIHRGVKREEPSADGAIEGGEVNLSDEELGGCLRCWPGDEEGTGGFFVAGFVREGDDDGSMVDAENESEDQDSIEQENEDEDEEWEGFSD

SEQ ID NO: 66644 - protein, 542 aa, Zea mays
MSAAQLLRHSRKLRSLQNPVGCENFSFVRHFSSGSGSFIARENGIGKRTRGTRFSQHNQPAKQLETFSAGVNGSCTWRIASNSLTPSAASWLSGSFSCGQVVSARPFSSSADLPPHQEIGMPSLSPTMTEGNIAKWLKKEGDKVSPGEVLCEVETDKATVEMECMEEGYLAKIIHGDGAKEIKVGEVIAITVEEEGDIEKLKDYKPSSSAEPVAPAEPKAEPEPSQPKAEEKKPTQAPEAKTPKIEEASQSGDRIFASPLARKLAEDNNVPLSSVKGTGPDGRILKADIEDYLASVAKGGLRESFADPGLGYVDIPNAQIRKVTANRLLASKQTIPHYYLTVDARVDKLVQLRGELNPLQDASGGKKISINDLVIKAAALALRKVPQCNSSWMNDFIRQYHNVNINVAVQTEHGLFVPVIRDADKKGLGAIAEEVKQLAQKARDNSLKPADYEGGTFTVSNLGGPFGIKQFCAIINPPQSAILAIGSAEKRVIPGSADGQFEFGSFMSATLSCDHRVIDGAIGAEFLKAFKGYIENPTSMLL

SEQ ID NO: 66645 - protein, 484 aa, Mycobacterium avium 104
MTVQAVLDDIRKRPGTGDVIAVIDPATEEKITEFTDCGAEAVDEAAARAKASFESGVWSQLPGRERAKILWRIGDLIDEHAEEFAQLDSLNTGMPLLQAQLQMSTCSEFFRYYAGWCSKINGTAYDVKTDGIATDTFVNMHAYTLKEPYSVVGLIFPWNGPIFNASAKLAPALAAGCSLLVKPAEETPLSALLLDRLVHEAGVPEGVVNLLTGYGHTAGAAITAHPDVEKVAFTGSTEVGKEIVRASAGNLKKVTLELGGKSPVLIFDDADLDKAILMASLGIFVHSGQGCVCGSRIFVQRGVYDRVVEGIAMMANTFKLGAPSEEGCVSGPLISQKQLNRVMGFIDEGKNDGVEVVTGGYRLDRKGYFVHPTVLTNVDPGMRLYQQEIFGPVVAILPFDDEDEAVAMANDTTYGLAATAWTENLGRAHRIVKRLQAGSVQVNCQLVFDHDVPFGGYKQSGWGHEFGKEGLEIYLKTKSVWAQL

SEQ ID NO: 66646 - protein, 253 aa, Glycine max
GKMKFKSKKGWKSIVPLHLKGKSATRFSLFRKVNSAAYGPGKTPVYLNVYDLTPMNGYVYWAGLGIYHSGVEVHGVEYAFGAHDYPTSGVFEVEPRQCPGFKFRKSIFIGTTSLDSTQVREFMERQSASYNGDTYHLIVKNCNHFCKDICYKLTGKSIPTWVNRLARLGSICNCILPEALRISAVGHDPNYQPHDSEKRRLRSGFNCLSSISMRQKHLSTSSLFLQSPIRGCLSSSWPSSELRKSINRSLKER

SEQ ID NO: 66647 - protein, 537 aa, Xanthomonas oryzae pv. oryzae KACC10331
MCSCESPIPTPQSRLSMTNIHTDKILILDFGAQYTQLIARRIREIGVYCEIWAWDHDPSEIAGFGAKGIILSGGPESTTLPGAPVAPQEVFDSGLPVFGICYGMQTLAAQLGGATEAADQREFGHAEVDVIAADALFAGLTDHAGAPRLNVWMSHGDHVSQVPPGFTITATTDRIPVAAMSNEDKRWYGVQFHPEVTHTLQGQTLLRRFVVDICGCQTLWTAANIIDDQIARVREQVGDDDVILGLSGGVDSSVVAALLHKAIGDKLTCVFVDTGLLRWQEGDQVMAMFAEHMGVKVIRVNAADRYFAKLEGVSDPEAKRKIIGNLFVEIFDEESNTLANAKWLAQGTIYPDVIESAGSKTGNAHVIKSHHNVGGLPQHMKLGLVEPLRELFKDEVRRLGVELGLPRTMVYRHPFPGPGLGVRILGEVKREYAELLAKADAIFIDELRKADLYDKISQAFAVFLPVKSVGVVGDARAYEWVIALRAVETIDFMTAHWAHLPYDFLGTVSNRIINELRGVSRVVYDISGKPPATIEWE

SEQ ID NO: 66648 - protein, 650 aa, Thermotoga maritima MSB8
MTVQQFIKKLVRLVELERNAEINAMLDEMKRLSGEEREKKGRAVLGLTGKFIGEELGYFLVRFGRRKKIDTEIGVGDLVLISKGNPLKSDYTGTVVEKGERFITVAVDRLPSWKLKNVRIDLFASDITFRRQIENLMTLSSEGKKALEFLLGKRKPEESFEEEFTPFDEGLNESQREAVSLALGSSDFFLIHGPFGTGKTRTLVEYIRQEVARGKKILVTAESNLAVDNLVERLWGKVSLVRIGHPSRVSSHLKESTLAHQIETSSEYEKVKKMKEELAKLIKKRDSFTKPSPQWRRGLSDKKILEYAEKNWSARGVSKEKIKEMAEWIKLNSQIQDIRDLIERKEEIIASRIVREAQVVLSTNSSAALEILSGIVFDVVVVDEASQATIPSILIPISKGKKFVLAGDHKQLPPTILSEDAKDLSRTLFEELITRYPEKSSLLDTQYRMNELLMEFPSEEFYDGKLKAAEKVRNITLFDLGVEIPNFGKFWDVVLSPKNVLVFIDTKNRSDRFERQRKDSPSRENPLEAQIVKEVVEKLLSMGVKEDWIGIITPYDDQVNLIRELIEAKVEVHSVDGFQGREKEVIIISFVRSNKNGEIGFLEDLRRLNVSLTRAKRKLIATGDSSTLSVHPTYRRFVEFVKKKGTYVIF

SEQ ID NO: 66649 - protein, 165 aa, Oryza sativa (indica cultivar-group)
MVHSPNQGFGTANHQAIFALQYPLVRATVNSSSHGSESSTPCPARQQEAPVNLESSSESSEDEVRRATRTNWTKENLRLISAWLSNSVDPIDGNDKKGEYYWKDVADEFNNKRPTNGHKRTVKQLKTHWGNVKKDIGKFCGVYAQVRRTCTSGHSDDMIMEKAHL

SEQ ID NO: 66650 - protein, 567 aa, Zea mays
MASAALICGTEQWKALQAHVGAIQKTHLRDLMADADRCKAMTAEYEGIFLDYSRQQATGETMEKLLKLADAAKLKEKIEKMFKGEKINSTENRSVLHVALRAPRDAVINSDGVNVVPEVWSVKDKIKQFSETFRSGSWVGATGKPLTNVVSVGIGGSFLGPLFVHTALQTDPEAAECAKGRQLRFLANVDPVDVARSIKDLDPETTLVVVVSKTFTTAETMLNARTLKEWIVSSLGPQAVAKHMIAVSTNLKLVKEFGIDPNNAFAFWDWVGGRYSVCSAVGVLPLSLQYGFPIVQKFLEGASSIDNHFYSSSFEKNIPVLLGLLSVWNVSFLGYPARAILPYSQALEKLAPHIQQLSMESNGKGVSIDGAQLSFETGEIDFGEPGTNGQHSFYQLIHQGRVIPCDFIGVVKSQQPVYLKGETVSNHDELMSNFFAQPDALAYGKTPEQLHSEKVPENLIPHKTFKGNRPSLSLLLPTLSAYEVGQLLSIYEHRIAVQGFIWGINSFDQWGVELGKSLASQVRKQLHGTRMEGKPVEGFNHSTSSLLARYLAVKPSTPYDTTVLPKV

SEQ ID NO: 66651 - protein, 462 aa, Oryza sativa (japonica cultivar-group)
MDPCPFVRVLVGNLSLKMPVAPRPAGAGAGVHPSTSPCYCKIRLNKLPYQTADAPLLLPPSPEASAAPAPAPATGALAAAFHLSKADLDRLTAKPSLFGSRTARLKIVVYAGRRGTTCGVGGGSGRLLGKVVIPLDLKGASAKPVVYHSSWICIGKRGRKPSSVSAANAQLNITVRAEPDPRFVFEFDGEPECSPQVLQVQGSMKQPMFTCKFSCRSNSDLRSRSMPADMGSGGRNWLTAFGSDRERAGKERKGWSVTVHDLSGSPVALASMVTPFVASPGTDRVSKSNPGAWLVLRPGDGTWKPWGRLECWRERGAGAAAGDSLGYRFELVLPDPTGMGVGVSVAESTIPASKGGRFAIDLTATQQFGRSGSPACSPCGSGDYGMWPFGSCRGFVMSAAVQGEGKCSRPAVEVGVQNVGCAEDAAAFVALAAAVDLSMDACRLFSHRLRRELSASRSDLLR

SEQ ID NO: 66652 - protein, 130 aa, Burkholderia vietnamiensis G4
MNLIAKLEQEEIERALAGKTIPEFAPGDTVIVNVNVVEGNRKRVQAYEGVVIAIRNRGLNSNFIVRKISSGEGVERTFQTYSPLLASIVVKRRGDVRRAKLYYLRERSGKSARIKEKLVSKDRTAAASQE

SEQ ID NO: 66653 - protein, 325 aa, Shewanella oneidensis MR-1
MQTLAQHLTSKAVNESLAQLILTLADTSKAISHAVRHGALAGVLGATEQENVQGETQKKLDIITNDMLKDALKADGTVRGLASEEEDHVVEVSANGQYLVCFDPLDGSSNIDINSLVGTIFSVLPAPQGELTEASFLQSGRNQLAAGYVLYGPSTMLALTTGQGVQLFTLHPETNEFLLTNATMSISPDTSEFAINMSNQRFWEAPMQTYIADLLLGKIGPREKSFNMRWIAAMVGDVHRVLSRGGIFTYPTDNKDPKKPYKLRLMYEANPMAFLVEQAGGKASTGYETILDIQPTQIHQRVAVILGSANEVDACLSYHGIDSRK

SEQ ID NO: 66654 - protein, 743 aa, Ostreococcus tauri
MASEDGPRTWDGSTPPVIVNNVPGTWAHDTVSRRLREDILARVFRDNASVIEGEAEINLRQLEDELRTASTSVIKHIADDGGPDCETWRELLEPWVGISWLDAPWLIVEFYFYRRILSAIGYFDESSPTFLHDPFAQMRSRNGRRGARTEPISLDELRLFVMVALWGNRMDLSIWPESDEGGNRASEAFTEALQAGEKYLLWDDSKVVASALAEGMRDVSIVVDNAGFELTCDLALADALVVSGVGRVILRVKAHPVFVSDAMDKDCRDTIDAMIDSADDETAAMGRRWASHLASGKWAIVPDFAWCQPQPFWALPKDTRDELKSSDLVVIKGDANYRRLLNDCLWELSTPFADVSSYFPAPLLALRSLKAELGCGIPMDRLAAVENEKDWMVTGKYGVVQYNARPARQYRVSSQIDGCKTFAGRDLPPVERLSLKKVLVALANASEELADALAVAPMRSSTLLGSVGGAKNASGDSQQKLDVVANDIFKQHLAECGGVRYYASEEEATPACLNESGKFVVCIDPLDGSRNIACNVPVGSIFGVYRVREDEDAVTNATQAGSEQVAAGYAHYSGATTLVLACGDDGPAIEYTLHEGNFEVANARMSCPPRGQVYSLNDARFDDWPEGLKEYVTDVRNGRGDTKKQYSARYICSLVGDFHRTLIYGGWAGNPRPHLRVVYEAAPLAFVARAAGAASSDGLVDVLTKKPAELHERSPLFLGSTEDIAELVRRGDVRQDDSKTYAV

SEQ ID NO: 66655 - protein, 166 aa, Zea mays
SSDLVGGSRYPDGMVAVKGPAATEDQKASEKTTKRVTSAEMARHCGEGDVWVAVQGKVYDVTAWLPHHPGGDLPLLSLAGQDVTDAFVAYHPASAWRVLDRYRVATLSDYAVSEVSRDYRRLVAEFAKAGLFDRKGHGCAASLCAMAALLAGAIWLVLATTNVAAH

SEQ ID NO: 66656 - protein, 298 aa, Zea mays
MAFASRIGNALRRTLAPTCSPLLQPVRCMSSSKLFVGGLSFATDETTLKDAFSEFGNVLEARIIIDRESGRSRGFGFITFTSTEEASAAMTSMDGKELQGRNIRVNHANERAGGIRGGGGFGSGGGYGGGGGYPTGGYGGGGDSSGGGYSSGGYAANGYGVGSGSGYGGTYSNASGGGYSGSDGYGNGAASGGYANNLSSGYNSNGRYNTIGSSDGNTGGYNSYPNPYGAGNYNTGGSSSSGGTLGEFGGGGFGGNNFAGNVTGGVSGGGASYGANKPQYNGDDDLLGEGFFDKEVAE

SEQ ID NO: 66657 - protein, 489 aa, Burkholderia mallei ATCC 23344
MSVYGLQRLYIAGAHADATSGKTFDTFDPATGELLARVQQASADDVDRAVASAREGQREWAAMTAMQRSRILRRAVELLRERNDALAELEMRDTGKPIAETRAVDIVTGADVIEYYAGLATAIEGLQVPLRPESFVYTRREPLGVCAGIGAWNYPIQIACWKSAPALAAGNAMIFKPSEVTPLSALKLAEIYTEAGVPAGVFNVVQGDGSVGALLSAHPGIAKVSFTGGVETGKKVMSLAGASSLKEVTMELGGKSPLIVFDDADLDRAADIAVTANFFSAGQVCTNGTRVFVQQAVKDAFVERVLARVARIRAGKPSDPDTNFGPLASAAQLDKVLGYIDSGKAEGAKLLAGGARLVNDHFASGQYVAPTVFGDCRDDMRIVREEIFGPVMSILSFETEDEAIARANATDYGLAAGVVTENLSRAHRAIHRLEAGICWINTWGESPAEMPVGGYKQSGVGRENGITTLEHYTRIKSVQVELGRYQPVF

SEQ ID NO: 66658 - protein, 329 aa, Oryza sativa (japonica cultivar-group)
MPSEFVAARKKPPPELLFAAGRKKQQPPPPGMAFVPSEFAAAGVGRKRQPAPPVEIRRVWAHNVEEEFRIIRNAIDHFPYVSMDTEFPGVIHRPTKHPALLTAGDRYDLLRRNVDALHLIQVGITLAASPTAAPALAFEINLSDFDQRVHRHAAESVQLLAEHGVDLAAHRRHGVRASALAPLLMSSGLVCSHGAVKWVTFHSAYDFAYLVKLLMGRKLPRSMAEFLNLVRVFFGDEVYDVKHMMRHCGGELYGGLERVAAALQVKRAAGRCHQAASDSLLTWDVFRRMRELYFLKHGVEAYQGVLFGLELDMDMPSNKTPSLPLVAAR

SEQ ID NO: 66659 - protein, 524 aa, Erysiphe necator
MYIADILSDLLTQQTTRYGWIFMVTSIAFSIILLAVGLNVLSQLLFRRPYEPPVVFHWFPIIGSTISYGIDPYKFYFDCRAKYGDIFTFILLGKKVTVYLGLQGNNFILNGKLKDVNAEEIYTNLTTPVFGRDVVFDCPNSKLMEQKKFMKTALTIEAFHSYVTIIQNEVEAYINNCVSFQGESGTVNISKVMAEITIYTASHALQGEEVRENFDSSFAALYHDLDMGFTPINFTFYWAPLPWNRARDHAQRTVARTYMNIIQARREEKRSGENKHDIMWELMRSTYKDGTPVPDREIAHMMIALLMAGQHSSSSTSSWIMLWLAARPDIMEELYEEQLRIFGSEKPFPPLQYEDLSKLQLHQNVLKEVLRLHAPIHSIMRKVKNPMIVPGTKYVIPTSHVLISSPGCTSQDATFFPDPLKWDPHRWDIGSGKVLGNDAVDEKYDYGYGLTSTGASSPYLPFGAGRHRCIGEQFATLQLVTIMATMVRFFRFRNIDGKQGVVKTDYSSLFSMPLAPALIGWEKR

SEQ ID NO: 66660 - protein, 338 aa, Vibrio sp. Ex25
MSGLRTLGEFIVEKQADFPHASGDLSSLLASIRLAAKIVNREINAAGLGDITGAVGTENVQGEDQQKLDVYANDKFKAALEARDQVCGVASEEEDEAVAFNKELNQNAKYVVLMDPLDGSSNIDVNVSVGTIFSIYRRVSPIGTPATEEDFLQPGHKQVAAGYVIYGSSTMLVYTTGNGVNGFTYDPSIGSFCLSHENMMIPEEGKIYSINEGNYIRFPQGVKKYIKYCQENVPEDGRPYTSRYIGSLVADFHRNLLKGGIYLYPSTQSHPQGKLRLLYECNPMAFLIEQAGGIASDGVNRIMDIKPTELHQRVPFFVGSKNMVRKVEEFLELHRDEE

SEQ ID NO: 66661 - protein, 499 aa, Candida albicans SC5314
MFKKALPLVSKLTTPKGITYNQPLGLFINNEYVHPKQQKTFEVISPSTEEKITDVYEALEEDIDTAVAAAQAAYHNGWAQGPPEQRSKVLFKLADLIEENAELLAQIETWDNGKSLQNARGDVALTAAYFRSCGGWADKILGSQINTGNTHFNYTQRVPLVCGQIIPWNFPLLMASWKLGPVLATGSTTVLKTAESTPLSALYLSQLLVEAGMPKGVINIVSGFGATAGAAIAKHPKIEKVAFTGSTATGKIIMKLAAESNLKKVTLELGGKSPNIVFNDADLDKTIQNLIVSIFYNSGEVCCAGSRLLIQSGVYDQVVEKFKEAAESVKVGNPFDEDTFMGAQVSDVQLSKILKYVESGKSQGATVVTGGARADGKGYFVKPTIFADVKKDMDIVREEIFGPVVTLIKFDTVDEAVELANDSDYGLAAGIHSADVNKCIDVANRVKAGTVWVNTYNDFHPMVPFGGFSASGIGREMGEEVLHEYTQVRAVRMKINPPN

SEQ ID NO: 66662 - protein, 502 aa, Xylella fastidiosa Dixon
MHNGFDALQLHANRLRGVTIPDLLAAELKRPEQYARQVGPLYFNFARQKYDCVALEALFALARNHNVTGAFQRMFCGEQVNVTEGRAVLHTALRGDLSGTSVAVAAYTAAAKVRERMYALIAGLDASEVTDIVSVGIGGSDLGPRLVVDALRPISQGRFRVHFVSNVDGAAMRRTLDMLDPSRTAGILISKTFGTQETLLNGRILYDWLGGSERLYAVSANPERAVHAFDIVPTQVLPIWDWVGGRYSLWSAVGFPIALAIGSQRFEELLAGAAEFDAYALRVPLEENVAVLHGLTAVWNRNFLGCATYAVMAYDQRLALLPAYLQQLVMESLGKRVKCDGTPVDRDTVPVWWGGVGTDVQHSFFQALHQGTNIVPADFIGTIRNDDLYTENHFALNANLLAQIEVLANGQLSDDPHRVYPGGNPSTLILLDALTPQALGGLIAMYEHSVYVQSVIWGINAFDQFGVELGKHLAVQLLPALKGESVEVVDPVTRAVLVRLRG

SEQ ID NO: 66663 - protein, 414 aa, Oryza sativa (japonica cultivar-group)
MGWKAPTRIQAEVIPFALQGRDVIGVGQTGSGKTAAFALPIIQALLEHEHRPCFFACVLAPTRELAIQIAKQFEALGSAISLQCSVLIGGIPRTSQTISLAKRPHVVVGTPGRLLDHLTNTKGFSFNKLKYLVLDEADDLLKVDFQKAVDDILNVIPKERRTFLFSATMTEKVKKLRRACLKNPVKVEVASKYSLVDTLRQDLYVVPAKYKDCYLIHVLNKMPGSMIMVFVRTCESTRLLALMLRNLRFKAISISGQMSQDKRLGALNRFRTRDCNILVCTDVASRGLDIQGVDVVINYDFPLNSKDYIHRVGRTARAGQSGYAVSLVNQFEGEFFKLTEQFLGGEEIPARKVDADEIMILHERIYDSKRIALKTMNESGYHKRMRRRMEDDEEEVEEAPVSSRSRSLKKSRRR

SEQ ID NO: 66664 - protein, 325 aa, Anabaena variabilis ATCC 29413
MSNPRVLCLGEVLFDCLADQLGLKLEEVKSWTAYPGGAPANVACALVKLGTPAGFIGAVGEDEPGNALVKLLQEVGVDTTGVQRHSTAPTRQVYVVRDLAGDRTFAGFGQYDTSEFADTHLQAKQLPESVFQEADFLILGTLELAYPDSEKAIHRALELAEQYDLKIVLDVNWRPVFWHDENIARQKIQEIFKRVDFLKLAKEEAEWLFDTSDPGAITYRLGSIEGVLVTDGENGCGYCLGENEGKIPAFAVSVVDTTGAGDSFLAGFIHQLSQHGIHNLNDAETAKRIITYASAVGALTTTKAGAIASQPTAVEVETFLASHKI

SEQ ID NO: 66665 - protein, 482 aa, Streptococcus pyogenes M49 591
MGTLFLKDIQGETEMTKTLPKDFIFGGATAAYQAEGATHTDGKGPVAWDKYLEDNYWYTAEPASDFYNRYPVDLKLSEEFGVNGIRISIAWSRIFPTGKGEVNPKGVEYYHNLFAECHKRGVEPFVTLHHFDTPEALHSDGDFLNRENIEHFVNYAEFCFKEFSEVNYWTTFNEIGPIGDGQYLVGKFPPGIQYDLAKVFQSHHNMMVSHARAVKLFKDSGYSGEIGVVHALPTKYPFDANNPDDVRAAELEDIIHNKFILDATYLGKYSDKTMEGVNHILEVNGGELDLCEEDFVALDAAKDLNDFLGINYYMSDWMQAFDGETEIIHNGKGEKGSSKYQIKGVGRRKAPVDVPKTDWDWIIFPQGLYDQIMRVKADYPNYKKIYITENGLGYKDEFVDNTVYDDGRIDYVKKHLEVISDAISDGVNVKGYFMWSLMDVFSWSNGYEKRYGLFYVDFETQERYPKKSAYWYKKVAETQVIE

SEQ ID NO: 66666 - protein, 287 aa, Oryza sativa (indica cultivar-group)
MDSSNQKFIDLLSQDSPNHAEKTSHNSPPQQFPNNFPQSQFTQSFNPHFLHNFYPFSSPSNYPPYGHSPPSFQGTPPSFQGIPHQGNWAQPNLATLQGFHLQENMVHSPNQGFGTANHQAIFALQYPLVRATVNSSSHGSESSTPCPARQQEAPVNLESSSESSEDEVRRATRTNWTEEENLRLISAWLSNSVDPIDGNDKKGEYYWKDVADEFNNNRPTNGHKRTVKQLKTHWGNVKKDIGKFCGVYAQVRRTCTSGHSDDMIMEKAHLWYKNQSNQKKPFTLEYM

SEQ ID NO: 66667 - protein, 427 aa, Oryza sativa (indica cultivar-group)
MKAERNLDNQKTTGSLQVPRVMIPDPELVREVFNKFDQFGKPKMIRVGKLLATGVVSYEGEKWAKHRRILNHAFHHEKIKRMLPVFANCCTEMVTRWENSISLEAASEIDVWPEFRNLTGDVISRTAFGSSYQEGRRIFQLQEELAQYLTEALQKLFIPGYWYLPTKNNRRMREIDREVHKILLEIIGNKERAITNGENSNDNMLGLLVESNTKQPELGMSTDDIIEECKLFYFAGMETTSVLLTWTLIVLSMHPEWQERAREEVLHHFGRTTTPDYDSLSRLKIVTMILYEVLRLYPPVVLLNRRTFKETNLGGIKFPADMNLILPILFIHHDPEIWGKDASEFNPGRFADGISNASKYHDASFFPFGWGLRICIGQSFALLEAKMALSMILQRFSLELSPSYIHAPYIVLTLRPQHGAQIKLKRI

SEQ ID NO: 66668 - protein, 468 aa, Xanthomonas oryzae pv. oryzae KACC10331
MSLPILNRIALAISSLSPRPDVLSMSADTTASAPSSATATGSLGDHHASVAVPKGGHWWFRLLAFLGPGYMVSVGYMDPGNWATDLAGGSQFGYLLLSVILLSNLMAIVLQGLSARLGIATGLDLAQACRARYPRGVNLALWGICELAIIACDLAEVIGTAIALKLMFGIPLTMGAIITAVDVVLVLLLMNRGFRALEAFVIALLLIIFVCFGLQMALAAPPIAAVLGGFIPRAQVVTDPQALYLAIGIIGATVMPHNLYLHSSIVQTRAYPRTDVGRKSALRWAVTDSTVALMFALFINASILILAAAVFHAQGRTDVQEIEQAHALLAPMLGVGLASTLFAVALLASGINSTVTATLAGQIVMEGFLQLRLPPWVRRLLTRGIAIVPVVIVTWLYGEAGTARLLVLSQVVLSMQLPFAVIPLVRFVSDRQLMGALVAPAWLVRIAWGIAAVIVCLNLKLLWDTALH

SEQ ID NO: 66669 - protein, 411 aa, Rickettsia montanensis
DSEFAELKIRGKIFELPILKASIGEDVIDISRVSAEADCFTYDPGFMSTASCQSTITYIDGDKGILRHRGYDIKDLAEKSDFLEVAYLLIYGELPSGEQYNNFTKQVAHHSLVNERLHYLFQTFCSSSHPMAIMLAAVGSLSAFYPDLLNFKEADYELTAIRMIAKIPTIAAMSYKYSIGQPFIYPDNSLDFTENFLHMMFATPCTKYKVNPIIKNALNKIFILHADHEQNASTSTVRIASSSGANPFACISTGIASLWGPAHGGANEAVINMLKEIGSSEYIPKYIAKAKDKNDPFRLMGFGHRVYKNYDPRAAVLKETCKEVLKELGQLDNNPLLQIAIELEAIALKDEYFIERKLYPNVDFYSGIIYKAMGIPSQMFTVLFAIARTVGWMAQWKEMHEDPEQKISRPR

SEQ ID NO: 66670 - protein, 885 aa, Frankia sp. CcI3
MTLTDHLPPTSGTGHDGERAAHPKDPHPKDPDSKNPDLTGPDDGPGGGPDPDALYDAFTRWVAEQGLELYPAQSEALIEIVSGSNVILATPTGSGKSLVAAGAHFAALAARRRTFYTAPIKALVSEKFFALCAMFGAAQVGMMTGDASVNDTAPIICCTAEVLANIALRDGVAADVGQVVMDEFHYYADPDRGWAWQVPLLELPHTQFILMSATLGDVSLFEADLTRRTGRETTVVRSAQRPVPLFYRFVTTPMHETIGELLETHQAPVYVVHFTQAQALERAQALMSVNVSTRAEKDAIARTIGNFRFTAGFGKVLSRLVRHGIGVHHAGMLPKYRRLVEQLAQAGLLKVICGTDTLGVGINVPIRTVVFTSLSKYDGSRVRLLSAREFHQIAGRAGRAGYDPVGNVVVQAPEHVIENERALAKAGDDPKKRRKVVRKKPPEGSVGYGLATFERLIAAEPEPLTSQFTVNHAMLLNVINRPGDAFASMRHLLTDNHSDRATQRRLIHRAIAIYRALLAAGVVERLDTPDELGRGVRVTVDLQLDFALNQPLSPFALAALELLDPASPSYALDVLSVLEATLDNPRQVLHAQLSKAKGEAVAAMKAEGVDYDRRMELLEEVSYPQPLAELLGAAFGLYRRGHPWVDDYELAPKSVARELYERAMTFAEYVAFYGLARSEGLLLRYLADAYKALRQTVPEDARTEEVVDLTEWLGELVRQTDSSLLDEWERLSNPAGDGAGATAGTTASGGGVDERPPAVTGNIRAFRVLVRNALFRRVELAALRRYDTLGELDGGYDGGFDADGWRAALEPYFAEHGEIGTGPDARGPGLLILDEKPGTPGTWTARQIFDDPAGDHDWGFSAEIDLTASDEAGVAVVRVTAVDRF

SEQ ID NO: 66671 - protein, 302 aa, Frankia sp. CcI3
MADQSKTLGEQVLLAFFIVVPLLALLAAVPLAWGWGLGWHDLVIGAVMYLITGFGVTVGYHRLFTHGSFRTGRPLRIILAVAGSLAIEMGVTDWVAAHRRHHKYSDQAADPHSPWRFGHHGRGLAKGFLHAHVGWLFHPERTAPETFCPDLLADRDIAAISARFPWLVAASVLLPPLVGGLWSMSWAGAATALFWGALVRIALLHHVTFSINSICHTIGTRPFAARDRSSNVWWLAIPSLGESWHNLHHADPTSARHGVLPGQIDPSAALIRLFEKLGWAHDVRWPTAKRIAARRVDAGAGR

SEQ ID NO: 66672 - protein, 356 aa, Clostridium difficile 630
MNCNIAVIKGDGVGPEIIDEGIKVLNKICCKFNHRFDCEYVLAGGCAIDETGEPLPNKTVEICRKNEAVLLGAVGGPKWDKCKGDKRPESGLLKLRESLGLFANLRPATMYESIKEASPLRTDIVEKGIDFVVVRELTGGIYFGERGRKIIDGIENAYDVEIYNENEIRRIGKRAFEIARNRNKKLISVDKANVLESSRLWRSIMEDLAKEFEDVELSHMYVDNAAMQVVKDPSQFDVIVTNNIFGDIISDEASMITGSIGMLPSASLREDSFGMYEPIHGSAPDIAGKDIVNPIATILSVSMMLRHSFNLEEEAKCIEDAVQSVLNKGYRTIDIYNGVGNVVGTRAMGELIVNEI

SEQ ID NO: 66673 - protein, 285 aa, Zea mays
MGGSHSREDLDLSDSDSDDAESRASDNSSDYGTPTPASASSKLASGAGAAATPASIDAIDRHLRQLHLKYNEPISPNPSPGLTLSANPAALNAVKLYLHIGGSSPSAKWIVSDSLAAASFVRTGDDEDDDAPAGGPWCLVVGSKIQARVGPELQLKTFPAQRRVDFVADGVWALKFRHADGFGDFCAKYHSCMFENSYGVAATDEGRAKVFGKDFAAWARPEDGDESIWEDATDGFFSPGPKGSPMPPRTPVLKPLLEDLREFEEPVEEGSGINSLALGALDNSF

SEQ ID NO: 66674 - protein, 146 aa, Zea mays
  misc_feature (56)..(56): Xaa can be any naturally occurring amino acid
  misc_feature (90)..(90): Xaa can be any naturally occurring amino acid
SARATPPYIFQLPLSVAAVDSTFIMIKPDGVQRGLIGEIIIRFEKKGFYLMALRLXNVPRSFAEKHYANLASKPFFQGLVDLLSSTGPLXEPVVMGSGTDAVYHILDPKIIGSTNPLASVPGNIRDNFAVDIGKHVIHGSDSIESA

SEQ ID NO: 66675 - protein, 531 aa, Zea mays
MGSADLVLKMACEGCGNTSDLYGTGCKHTTLCSDCGKSMARSRARCLVCSAPITRLIREYNVRANSVMDKTYSIGRFVTGLPPFSKKKNAENKWSLHKEGLQGRQIAENMREKYNKKPWILEDETGQYQYQGQMEGSQSATATYYLLMRHGKEFNAYPAGSWFNFSKIAQYKQLTLEEAEEKMNKRKTSATGYERWMMKAAANGPAAFGSDMKKLEATNGGEKESARPKKGKNNEEGNNSDKGEEDEEEEATRKNRLGLTKKGMDDDEEGGKDLDFDLDDEIEKGDDWEHEETFTDDDEAVDIDPEERADLAPEIPAPPEIKQDDEENEEEGGLSKSGKELKKLLGRAAGLNESDADEDEEDEDQEDDSSPVLAPKQKDQVKDEPVDSSPSKPAPSGHARGTPPASKSKQKRKSGVDDAKTSSGAASKKAKVELDAKASGLKEEASSLAKPASKTSAASKSGTSVSPVTEDEIRSVLLAVAPVTTQDLVSRFKSRLRGAEDKNAFAEILKKISKIQKTNGHNYVVLRDDKK

SEQ ID NO: 66676 - protein, 76 aa, Brassica napus
MEKSVPISKKLWNLVRFVMYMLHKGISKQKLLADFNATLKRGKNLMFNNRRRVPATASTVSSQPQKEYEFSCSDTP

SEQ ID NO: 66677 - protein, 478 aa, Burkholderia mallei ATCC 23344
MPAAPAVPSRAARASAAARLERLPFSGYHKLIFVIIAIAFFFDSVDLGTMTFVLGSIKREFGLSTATAGLVASASFFGMVLGAAVAGLLADRFGRRPVFQWSMVLWGAASYLCSTAQSVDALIVYRVLLGIGMGMEFPVAQTLLSEFVPAAKRGRLIALMDGFWPLGFITAGVVSYFVLPLFGWRTVFALLELPAVFVLVVRRLVPESPRWLEHRGRLAEAGRVLAHVEAKVMKSARVASLPAPSRLAEPACAQGRGAFGEIWSAAYRRRTTMVWLLWFFALLGFYGLTSWLGALLQQAGFAVTQSVFYTVLISLGGIPGFLCAAWLVERWGRKPTCIASLVGGGAMAYVYGQSALFGGSVTLLVGTGLAMQFFLFGMWAVLYTYTPELYGTGARATGSGFASAIGRVGSLIGPYAVGIVLPVFGQGGVFTLGALSFVVAALAVGVLGIETQGLALEALASTHAADDDARDPAGAAAN

SEQ ID NO: 66678 - protein, 453 aa, Candida albicans SC5314
MLRRLFPIRQLYTTTRAMASKSTDPTSLHNPYFYQKPGQKDIWSLINETAAQAQQESGEPIVNLGQGFFSYNPPEFAINAVEEALTKPQFNQYAHARGNPNLLKQVAEHYSRSYGRAVGVDEVQITTGANEGMFAIFFGFLTPGDEVIVFEPFFDQYIPNVEMTGAKIKYVEIKYPKKFDNEVVTGQDWEIDWEGLNNAITDKTKIIVINTPHNPIGKVFTEKELYKIGKLAVEHNLILVSDEVYENLYYTDKFPRPAALPQLPELAERTLTVGSAGKSFAATGWRVGYIQGPANLIKFVTAAHTRICFSTPAPLQQAVSQGFEQAEKSNYFENTRKEYEHKYKIFTKVFDDLGLPYTVAEGGYFVLVNLSKVKIPADYEFPGTISDRGTLDFKLAYWLIKEIGVVGIPPTEFLTESNRKGNGLENCVRFAVCKDDSVLEDAVERLKKLKDYL

SEQ ID NO: 66679 - protein, 723 aa, Burkholderia mallei ATCC 23344
MASGIGRFGKRASRLIDFGLWAAAALLLLTAGVGALGTARLSDNEADIHRASEVISGLERLLALARDMETSQRGYILTGKTDYLQPYKAALPEIRKQFDALATLVQGDAVQQQRLATLRMLLEKKQHELAATIELRKTEGFDAAQAIVSSDAGKIFMDRARVMVNEMEATVQQQLRTLRDRARATRDIAIGVGLASGLLTLAVCVSFGYVMRRLLLVEAAAAHDLFEQRELLHVTLASIGDGVIATDVGGRITFFNRVAEEMTALCADAVVGQPIERVLMFRHATTQRVIDNPARVAVERRRTASLPAHTRFVGRSGGELPVDGNAAPTFDANGKLVGAVLIVRDVSERERAEERFRLAVEAAPTAMIMVGRDGRIVLVNSQAEKLFGYARGDMIGHGIDMLVPERFRAGHWAHRDAFFGNPDARPMGEGRDLFGLRRDGSEFPVEIGLNPITTSEGAFVLCSIADITARKRAELELRRRSEELARSNQDLEQFAYVASHDLQEPLRAVAGPLQLLQRRYQGQLDARADEFIGHAVDGATRMQSLIDDLLSYSRVGRLEDARRPVDCEHVLDEALRNLSAAIRESGAQVTHDPLPTVHGIEAQLVLLFQNLIGNAIKFRGKDRVARIHLEAHTRDDAWLLRVRDNGIGIDPQYFERIFLIFQRLHTRREYPGTGLGLALCKRIVEHHGGRIFVESEPGQGTTFSFTLSRPGADETRWPRDPRE

SEQ ID NO: 66680 - protein, 680 aa, Ashbya gossypii ATCC 10895
MTQFSDVDRLAVSTIRLLSVDQVSKANSGHPGAPLGLAPAAHVVWKQMRLNPKSPKWINRDRFVLSNGHACALLYSLLHLFGYDLSIEDLKQFRQVGSKTPGHPEYELPGVEVTTGPLGQGISNAVGLAIAQANLAATYNKPGYELSDNYTYVFLGDGCLQEGVSSEASSLAGHLKLGNLIAFYDDNKITIDGHTEVSFDEDVLKRYEAYGWEVLNVANGDENLEDIASALEQAKKNKDKPTLIKLTTTIGFGSLNAGSHTVHGAPLKADDVKQLKTKLGFNPDESFIVPQEVYDLYHNSTIQPGAESEKEWNALLEKYAGEYPKEAAELKRRLAGKLPENWESKLPVYKPTDSAVASRKLSEIVLQSIFEDVPELIGGSADLTPSNLTRTTNAVDFQPPQSGLGDYSGRYIRFGVREHGMGAIINGLSAYGANYKVFGATFLNFVSYAAGAVRLAALSGHPVIWIATHDSIGLGEDGPTHQPIETLAHLRAIPNMMVWRPADGNEVSAAYKVALESQDTPSVIALSRQNLPQLDGSSIEKASKGGYILQDVENPDIAIVSTGSEVGIAVEAAKLLAEKNMKVRIVSLPDFHTFSRQPKEYQLSVLPDRVPILSVEVLSTSGWSEYAHQSFGLNRFGASGKGPEVYKFFEFTPEGIASRAEKTVAFYKGKEVLSPLNKAF

SEQ ID NO: 66681 - protein, 540 aa, Lactococcus lactis subsp. lactis Il1403
MRAHEILNNPFLNKGTAFTMKERQELGLIGLLPPTVQTIEEQAEQTYEQYLTKPSDLEKRHFLMEIFNTNRTLFYYLFNKHIVEFNPVVYDPTIADTIENYSHLFVDPQYAAYLDINHPENITETLKNAAGDREIRLIVVTDAEGILGIGDWGTQGVDISVGKLMIYTAAAGIDPASVLPVVIDAGTNRKELLEDHLYLGNHQERIYGDQYYSFVDQFVETAESIFPKLYLHWEDFGRSNAATILNNYKTKIPTFNDDIQGTGIVVLGGIFGSLDITGEKLTDQVYLCYGGGSAGAGIAGRVHAEMVSEGLSEEEAYKHFFMIDQQGLLFDDMEDLTPAQKPFAKKRADYKDAGDMTDLLNVVKTVKPTILVGTSTNPGAFTKEVVEAMCANTERPVIFPISNPTKKMETTAEQVIEWSDGKAFVATGVPSGTISYKGVDYQIGQANNSLIYPGLGLGMLASEAKLLTDEMIGAAAHSLSGLVDPGKPGAPVLPPFEFVADVSIKVAEAVAKKAQEQGLTESKETDMAKAVRDLKWYPEY

SEQ ID NO: 66682 - protein, 504 aa, Ashbya gossypii ATCC 10895
MSQRKLLQEVDKVLKKVKEGLVEFDLIYEKFQATESDNQSYREKLESDLKREIKKLQKHREQIKSWLSKDDVKEKNALLMENRRLIENGMERFKSVEKIMKTKKFSTEALSNPDLIKDPRELKKRDQFIFVEECLEELQKQLESYEAQELAEKVERHQFHISNLENILRMLQNNELEPDTVEEYQDDIRYYVDNNDDPDFIEYETIYEDMGCELQSEEGKDQPTPVKPKTKLERSPKKKATSPAPINIGTKSVVSTTGTATAPSAPGSQASSASPDSSAKQKKDSSPLPLDLPPPKDFSKEIEEIIEHDLTKLAFQNPLFKDELPYWLQAKRPLIQPYSTMSERMLKQLESSLLNCPDSLDADTPHLYQHPLSLPHPTSIFFPSEPIRFVAAGWNNDNTSTKDIYGKTSMVQIMTKFDLDTLFFIFYHYQGTYDQFLAARELIIRGWIFNRVNRCWFYKEVEKLPPGMDQKEEVSWRYFDYQKSWLARRCGPDFVFRSEEFERL

SEQ ID NO: 66683 - protein, 345 aa, Prunus persica
LDGKSFPVLFDVSKVEKKDLFTGTYMPSLELTGGYRILSYLDPSEPKHDKLKRVIFYLLKSSRDSVLPEFHSSYTELFETLESKLADKGKADFVEANDQAAFNFLARSLYRANPADTPLGLDGPKLVSKWVLFNLGPLLMLGLPKFIEDPLLHTFRLPPFLIKKDYQRLYDFFYQSSGHVLDEAERLGVSRDEACHNLLFATCFNSFGGMKILFPNMLKWIGRAGVKLHTQLAEEIRSVVRSNGGKITMGGMEQMPLMKSVVYEAFRIEPPVQLQYGKAKTDLLIESHDAAFKVKEGEMLFGFQSFATKDSKIFERAEEFVADRFVGEDGEKLLKHVLWSNGPET

SEQ ID NO: 66684 - protein, 344 aa, Streptococcus pyogenes M49 591
RAMIALDGTPNKGKLGANAILGVSIAVARAAADYLEVPLYTYLGGFNTKVLPTPMMNIINGGSHSDAPIAFQEFMIMPVGAPTFKEGLRWGAEVFHALKKILKERGLVTAVGDEGGFAPKFEGTEDGVETILKAIEAAGYEAGENGIMIGFDCASSEFYDKERKVYDYTKFEGEGAAVRTSAEQVDYLEELVNKYPIITIEDGMDENDWDGWKVLTERLGKRVQLVGDDFFVTNTEYLARGIKENAANSILIKVNQIGTLTETFEAIEMAKEAGYTAVVSHRSGETEDSTIADIAVATNAGQIKTGSLSRTDRIAKYNQLLRIEDQLGEVAQYKGIKSFYNLKK

SEQ ID NO: 66685 - protein, 309 aa, Burkholderia vietnamiensis G4
MSAITPPDAAAAAAAIAAGDPAACPPARMGRLRTADGLELASYRWPAADGSAPPRASVALVHGLAEHAGRYERLAARLNAAGISVLAIDLRGHGRSPGKRAWVERFDDYLNDADALVAEAARGNTPLFLMGHSMGGAIAALYAIERLPASGHTLAGLVLSSPALAPGRDVPRWMLAMSRFISRVWPSFPAIRIDAALLSRDPAIVAANRADPLVHHDAVPARTGAELLDAMARIERGRGSLRVPVLIYHGTSDKLTEPDGSRAFGAHVGSPDRTLTLYEGGFHETMNDLERERVIDALIAWIHAHAPAG

SEQ ID NO: 66686 - protein, 696 aa, Solibacter usitatus Ellin6076
MTSNLLENPQSAPPCTAALAGRCSPLGATVQANGVNFSVFSRSASAIELLLFDREDDALPARVIRIPAATNRTYHYWHTFVPGARPGQLYGYRVHGPFDPASGLRFDPRKLLLDPYGRGIVVPAGYSREAARLPGDSARTAMKSVVIDPAAYDWEGDTPLHRPSSRTIIYELHVRGFTRHPSSGLSENLRGTYAGLIEKIPYLHDLGITAVELMPVFQFDPQDAPVGHCNYWGYAPVSFFAPHQQYSSRRDPQGVLNEFRDMVKALHRAGIEVILDVVFNHTAEGDHRGPTLSFRGFDNTAYYLLEPDRSYSNYSGTGNTLNANHPIVRRMIVDSLRYWVEEMHIDGFRFDLASILSRDCCGRPMAQPPVLWDIECDAVLAGTKLIAEAWDAAGLYQVGSFIGDSWREWNGRFRDDIRAFVRGDDDTAARFADRWLGSQEIYGHENREAEQSINFVTCHDGFTLNDLVSYNDKHNQQNGESNRDGCNDNRSWNCGVEGPSNDPEIEALRNRQIKNFLTITLLSLGVPMIVMGDEVRRTQQGNNNAYSQDNETSWFDWTLVQRHADLHRFVKLLIARRLLRDIDSDRTTLNELLHGARKAWHGVTLFEPDWSPWSHSLALGAELFKERLEFHMIFNSWWQPLDFELPPVLSRSPWRRWIDTAQPSPRDIVDWQAASPIDGLHYHAAPRSVVVLIRDR

SEQ ID NO: 66687 - protein, 394 aa, Clostridium difficile 630
MMSKDYAKLALEMHEINKGKVSVESKVEIKTKDDLSTAYTPGVAEPCLKIHENQDDVYRYTSKGNLVAVVSDGSAVLGLGNIGAEASIPVMEGKAILFKQFADVDAFPICLKTNDVDEIVKSVELMEPVFGGINLEDISSPRCFEIEERLKKSLSIPVFHDDQHGTAIIVAAAIINSIKLIENKKIEDLEIVINGAGAAGIAIAKILLNMNVKNIILCDRSGALEASIENLNYVQKEMLKVTNIRNEKGPLKDIIKGKDVFIGVSGPGAVTKEMVESMSEKPIILAMANPTPEIMPEEAKLGGAFIMGTGRSDFPNQVNNVLAFPGIFRGALDVKAKEINEEMKIAAAYAIANTISDEEICPEYILPDVFNKNVVKNVAKAVKEAAIKTKVNRI

SEQ ID NO: 66688 - protein, 489 aa, Magnetospirillum magnetotacticum MS-1
MILKDSSLLKSRAFVNGAWTDADNGATFDVLNPATGEILASVPDMGAAEARRAIEAANAAWPAWKAKTGKERGAILRNWFNLIMAHQEDLAVLLTAEQGKPLAEARGEIAYGASFIEWFAEEAKRVYGDTIPGHAPDKRIVVVKEPIGVVAAITPWNFPNAMITRKCAPALAVGCPVVVKPAEDTPLSALALAELAVRAGIPAGIFNIVTARHGALVGGELSGNPLVRKLSFTGSTQVGKLLMSQCAATVKKVSLELGGNAPFIVFDDADLDAAVAGAMASKYRNAGQTCVCANRMLVQDGVYDEFARRLAKAVSQLKVGDGLASDANQGPLINAKAVEKVERMLADAVSKGATIVCGGKRHALGRTFFEPTIVTNVTSTMSMAREEIFGPVAPLFRFKTEAEAIAMANDTEFGLAAYFYAGNIARVWRVAEKLEYGMVGINDGIISTEVAPFGGVKESGIGREGSKYGIEDFLEIKYLCLGGIKEAAQ

SEQ ID NO: 66689 - protein, 154 aa, Burkholderia mallei ATCC 23344
MSLTVAQILRSKPDSGRTIHMVEKSDSVYNAIKLMAEKSIGALLVMDGANIAGIVTERDYARKVVLLDRSSKATRVEEIMTSKVRYVEPTQTSDECMALMTEHRMRHLPVLDDGKLVGLVSIGDLVKSVIADQQFTIDQLEHYIHGIPAAAHPQ

SEQ ID NO: 66690 - protein, 408 aa, Ustilago maydis 521
MPAPTSAGAAQQLQSAASTSTMAPLNAELLQVNLNPTPAAPDFENLVFGQKFSPHMLIVNWNHKTGWGAPQIKPYGPLSLSPAAPALHYASGLFEGMKAYRSTDGSGKIRLFRADKNMERMNRSAARAGLPTFDGDEFIKLIKTLVRIDRDYVPYGEGQTLYLRPTLIGTPDTLGMGVPTEAQLYCICSPVGNYYSSGTGSKPVSLLARTDVVRAWPGGTGCYKLAANYAGATRPAMDALLEGYHQVLWLFGPDRQLTEVGAMNLFVVFRDQAADGDATRYEIATAALDDGTILPGVTRDSILSLLRAYKAGNVQIEGLPKPENLTISERKVTMDEIIEKAEGNQICEVFGSGTAAVVCSVDKIGFEGVDIPIPIQPDGMGTFMRTMLREVTGRQWGTIPCPEWSSVC

SEQ ID NO: 66691 - protein, 287 aa, Vibrio sp. Ex25
FYIVSGGGKRLRPLLAILSARALGYQGNGHTMAAAFIEFIHTATLLHDDVVDESDMRRGKATANAAFGNAASVLVGDFIYTRSFQMMTELGSMKILKLMSNAVNVIAEGEVQQLMNCNDPDTTEESYMQVIYSKTARLFESATQIGAILNDAPEHVEIAMQNYGKYLGTAFQLIDDVMDYTSDGEDMGKNVGDDLAEGKPTLPLLHAMRNTTPDNALMIREAIEKANGMDRLEDILAVMKEAGSLEYTTQKALEEADKAIEELSVLPESEYKQALITLAHVAVQRTK

SEQ ID NO: 66692 - protein, 472 aa, Haloarcula marismortui ATCC 43049
MVVGDVTTGTELLVIGGGPGGYVAAIRGAQLGLDTTLVERDAYGGTCLNHGCIPSKALISASDVAHDARQAESMGVFADPAVDMAGMTEWKDGVVTRLTRGVESLCKNAGVNLVEGTAEFVDDGTVRVAHGGEGQGSESLSFEHAIVATGSRPMAVPGFEFDGEHILSSKDALALESVPEKLLVVGAGYIGMELSTVFAKLGAEVTVVEMLDDVLPGYEDDIATVVRDRAEELGIDFNFGEAADNWEETDEGIRVQTVDEDEVVTEYNAEKCLVAVGREPVTDTLALDNIDLQTDENGVIPTDDQCRTAFESVFAVGDVAGEPMLAHKAMAEGEVAARAAAGEPAAFDHQAIPAAVFTDPEIATVGMTESEAEAAGFEPVIGQMPVRANGRALTVNEKEGFVRVVADADEEFLLGAQIVGPEASELIAELGLGIEMGARLEDIAGTIHTHPTLSEAVHEAAAAARGEAVHTR

SEQ ID NO: 66693 - protein, 125 aa, Triticum aestivum
MAAHQQQQPQQAVGFEDYLPVMAERLGEEGLMEELAAGFRLLMDPASGLITFHSLRRNAPLLGLGAMSDDDLRGMLAEGDFDGDGALSQMEFCGLMVRLSPDLMDQPRRWLDDAVAQDSHFLFNS

SEQ ID NO: 66694 - protein, 332 aa, Haloarcula marismortui ATCC 43049
MSTQDANTQSLTLVQAVRDGLYGEMERDEDVVVMGEDVGKNGGVFRATQGLHEEFGDDRVIDTPLAEAGIVGTAIGMAAYGLRPVPEMQFSGFMYPAFDQIVSHAARLRNRSRGRYNCPLTVRAPYGGGIRAPEHHSESKEAFYVHEAGLKVVVPSTPKETKGLLTAAIRDPDPVIFLEPKLIYRSFREEVPDDPYTVELGEAKVRREGADVSVFTWGAMTRPTVEAAEELAEEGIDAEVIDLRTLSPMDTDTIVESFKKTGRATVVHEAPKTGGLAGEIIATIQEEVLLYQEAPVTRVTGFDVPYPLYALEDYYLPEPARIKDGIREAVEF

SEQ ID NO: 66695 - protein, 164 aa, Debaryomyces hansenii CBS767
MSQPKVIIISSDDEKFPVDVKIAEKSILIKKMIEDLNPDGLEEDFEIPTPNVRSTVLSKVLEWCTHHKNSVFPDDDDEDARKSAPVDEWDKNFLKVDQEMLYEIILAANYLNIRPLLDSGCKIVAEMIRGKSPEELRRTFNIVNDFSPEEEAAIKRENEWAEDR

SEQ ID NO: 66696 - protein, 270 aa, Triticum aestivum
GGGASVSRVRLERDARGGRGVGRREAPGRASPRAWAQAPSPRRAAASGRREAGPDTQRGNGPATRRRAGRGPSRCATAPLARHRRTARCGAGSPGTHHRSGTTDPRDSKEGRRGGPPCSAAPPDSRPTARSGLRRPLRGWGSVAHDPRVARTEGEEDKMGEGLSMSQKLTLAYPALVGAGGVMGYMKSGSQKSLAAGGISALVLFFVHTQLPVRPVFASAIGLGISAALLSVMGSRFKKSGKIFPAGVVSLLSLVMVGGYAHGIMRSSHA

SEQ ID NO: 66697 - protein, 266 aa, Methanosarcina barkeri str. Fusaro
MLTFIGLGLFDEYDISLKGLEAIREADMVYAEFYTSCLMGTNLEKMEKLYGKKVFLLSREDVEQHPDWLSKAKNRNLCFLTGGDTMVSTTHVDLRLRAEKLGIDTRLIHGASIASAVSGLTGLQNYRFGKSASIPHPYESRRGTRIISETPYDTIKQNLELGLHTLVFLDIDKEKGYMTVNTALELLLEVEEKRGEGIMRGAAAVGIARAGSEKPVIRADYAENLKDFNFGKPLHILVIPGKLHFLEAEALVKLAGGPVGFMKEVE

SEQ ID NO: 66698 - protein, 568 aa, Streptococcus pyogenes MGAS315
MDSNDLEKERGITILAKNTAVAYNDVRINIMDTPGHADFGGEVERIMKMVDGVVLVVDAYEGTMPQTRFVLKKALEQNLIPIVVVNKIDKPSARPAEVVDEVLELFIELGADDEQLEFPVVYASAINGTSSLSDDPADQEHTMAPIFDTIIDHIPAPVDNSDEPLQFQVSLLDYNDFVGRIGIGRVFRGTVKVGDQVTLSKLDGTTKNFRVTKLFGFFGLERREIQEAKAGDLIAVSGMEDIFVGETITPTDCVEALPILRIDEPTLQMTFLVNNSPFAGREGKWITSRKVEERLLAELQTDVSLRVDPTDSPDKWTVSGRGELHLSILIETMRREGYELQVSRPEVIIKEIDGVKCEPFERVQIDTPEEYQGAIIQSLSERKGDMLDMQMVGNGQTRLIFLIPARGLIGYSTEFLSMTRGYGIMNHTFDQYLPVVQGEIGGRHRGALVSIENGKATTYSIMRIEERGTIFVNPGTEVYEGMIVGENSRDNDLGVNITTAKQMTNVRSATKDQTAVIKTPRILTLEESLEFLNDDEYMEVTPESIRLRKQILNKAARDKANKKKKSAE

SEQ ID NO: 66699 - protein, 299 aa, Methanosarcina barkeri str. Fusaro
MDRVISIVGHTALDYIVDVERIAGKNESSPVIDYEEYPGGGAANIAVAIAKLGGKSQLISPVGTDFVSSGYEKLLTEANVDLSRLYRIEDQKISKAFIFTDKEDNQTTYFYWGASSKFKKLEPEPVDFVHLATADSVYNAKLAQIAGFVSFDPGQDLVTYSKENLELILAHTDILFANRHEIRRVSEMTGKSFSELKAMIDIIVVTYDSKGSKIYTDKNEFLIPVISVQAADPTGAGDAYRAGFLLALTRGYPLPTCGKIGSTVASFAVQARGCQTDLPTWEEMKARYEANFGRLEKEC

SEQ ID NO: 66700 - protein, 306 aa, Mycobacterium smegmatis str. MC2 155
MSRALVIGEALIDIVEREGQVVGEHVGGSPLNVAVGLGRLGRDVDFLTHIADDPRGRRIVDYLKASGVQLVPGSTSAKKTPTAQVRLDAAGSATYEFDIDWQLAGTAEVAPPIVAHSGSIATVLEPGCRAAAALLDAYHLSATITFDPNVRPALISDGETARRRIERLVERADVVKISDEDLRWLDSRRSPEQIAKTWLSMGPSIVAVTAGGEGSFAVCGAGMVRVPARTVEVIDTVGAGDAFMTGLLDALWSLDLLGADRRRNLAHISTDALEHVLSTAALTSALTVAKAGADLPDRDALRAAQQ

SEQ ID NO: 66701 - protein, 428 aa, Ustilago maydis 521
MLSTGVCRSLRCAGRIALGRLGEASSIAPRFLPQQCRLSTAISTLVKRGSHSGRIVPLLAAAPSSGDSRRHFTSGRPRASQKPFQFLTAYAFQGKPRSSEDVPQEGDASSSASTSEHDGAPPTPKKAQIGVPSDSEIGRWRDELLRGGEAGEDSLMCTSMGAADDVAIGVADGVGGWTENGIDPSLFSQALMFYASRSAAHTSADPQTGCAPDRILSEAFEHVLKEPLVVAGSATACILTMDASNGTLRSANLGDSGFVILRQGTGKQGVFHVSSPQQLGFNTPLQLAKLPKEWIQEGSISNTPKDAASWECTLQHGDLIIVGTDGLFDNVDAKIEIPQFAKFIKEKHHASYAARHAAAASEAKEDTLEEDREFVQVLATNLVEYAKICQSSTTKQSPFEREAARYGIHFPGGKIDDVALVCCLVVER

SEQ ID NO: 66702 - protein, 584 aa, Haloarcula marismortui ATCC 43049
MPVVDVDPDELRYLTGHSEKDDDELKSDLFNLGLEFEGWTEDDEFQLEFAPDRLDRLSVEGVARSLRYHYGDDRGVEIPNTNSADWTIEVEDQPDERPYVTGAIVRGLDMDEAALESLIQLQEKLHATMGRKRAKGAIGVHDLTMLKGDSVTDETGKSITYTSADPDEATFVPLDADAEMTPSEVMASHETGQTYGDLVADFDRVPAIYDAIGLFSFPPVINGRRTEVSVDSRDLFIEMTGTNQWTIDHMCNIVCYALAARGGQVEKVDVSYADDAPGEYAGKTLERPDFSVRTKTVTHDRIESILGVSLDSREVVDYAERAGLDATETESDDGVAYDVEVPPYRVDVIHPLDIIDDIGRALGFNSLEPTYPDVSTVGGRHERSRLEDAARDALVGLGFEDLLNFHMTNEVENFERMNLSTPEAEDGNDADTVGLADPVTIQEPYSEDYTILRTWALPSIMMVLENNTHRSYPQDLAEIGLAAGLDDSENTGVAEHRTVAAALARTDASYEDAKARLQALADAFDKDLETPPTTHPSFIGGRAAEVVLDGESVGVIGEIHPKVLVEHDLELPVAAFEFRLDALA

SEQ ID NO: 66703 - protein, 221 aa, Brassica napus
  misc_feature (61)..(61): Xaa can be any naturally occurring amino acid
  misc_feature (113)..(113): Xaa can be any naturally occurring amino acid
MKHENLVRLTGFCCSKGRGECFLIYEFVPNGNLLQYLDLKDESGDVLEWTTRVTIINGIAXRGIVYLHGENGNKPAIVHQNLSAEKILIDHWYNPSLADSGLHKLFTDDIVFXKLKASAAMGYLAPEYITTGRFTDKSDVYAFGMILLQILSGKSKISHLMILQAVESGRLNEDFIDPNLRKKFPETEAAQLARLGLLCTHESSNQRPSMADVVKELNKLS

SEQ ID NO: 66704 - protein, 993 aa, Anabaena variabilis ATCC 29413
MVLQVQTSTYEAKTQEIARQLLGATQENRSFFASLRDQMRWDDKLLAWAMSNPGLRVQLFRFIDTLPALHSKAEIAAHLQEYLGDESVELPAALKGMLNFANPDSVPGQVAATTVSTAVETLAHKYISGENIKQVIKTVERLRKEKMAFTIDLLGEAVITETEAQSYLERYLELISQLTEASKNWGTVGAIDEADGEQLAKVQVSVKLTAFYSQFDPLDAKGSEEKVSDRIRILLRRAKELGAAIHFDMEQYAYKNLTLNILQKILLEDEFRQRTDIGITIQAYLRDSEQDARNAIAWLKQRGYPLTIRLVKGAYWDQETIKAAQKHWPQPVFNDKAATDANFEAITQLLLENNQYVYSAIGSHNVRSQALAIAIAETLQVPRRRFEMQVLYGMGDKLAKALVDRGYRVRVYCPYGDLLPGMAYLIRRLLENTANSSFLRQNLENRPVEELLAAPDINLAHAKAQRSKEEKGSFGATDTDFAVEEERKEAARAFAEVRGALGRSYLPLINGEYVQTAEVIDSVNPSNFGEVIGKVGLISVEQAEQAMQAAKAAFPGWRRTPVKERAAILRRAGDLLEERRAELSAWIVLEVGKPVKEADAEVSEAIDFCRYYADEMERLYQGINYDVAGETNRYIYQPRGIVVVISPWNFPLAIACGMTVAALVTGNCTLLKPAETSSVITAKLTEILLEAGIPKGVFQYVPGKGSQVGAYLVSHPDTHLIAFTGSQEVGCRIYAEAATLKPQQRHMKRVIAEMGGKNAIIVDESADLDQAVIGVVQSAFGYSGQKCSACSRVIVVEAIYDAFIHRLVEATKSLNIGEAELPSTQVGPVIDANARDRIREYIEKGKAESQVALELSAPNHGYFVGPVIFGEVPPHGTIAQQEIFGPVLAVIKAKDFAQALAIANDTDYALTGGLYSRTPSHIQQAQEEFEVGNLYINRNITGAIVARQPFGGFKLSGVGSKAGGPDYLLQFLEPRTITENIQRQGFAPIEGAE

SEQ ID NO: 66705 - protein, 561 aa, Oryza sativa (japonica cultivar-group)
MAIPPLAVSGVAVATLAVLGLAVFACRRWRRGASPAPPPPASSQDDDINMPLISDNLDDYSVSSNSSTVDESGIRIDRIITSPKTHGIVGKGATYPTESHVIEGETHVIDVTNSKTEELYLGNTLKRPAVANGPTPDVKHIRRDSGESNHNGTIPDIIVGSNLALEVIAGPSHGINHYMQSGNKSMLPVTLGRVPPSHLVLKDSEVSGKHAQIDWNANKLKWEIVDMGSLNGTFLNSRSVNHPDVGSRRWGEPAELADGDIITLGSSSKVSVQIELQNQQPVGVGIASDPMTARRTGKKLHMEDVSCCQYPLIGVEKFGLFGIFDGHGGDGAAIAASRILPQNIANILSQQETKERVLSCHSASDVLRHAFALTEAALHHQYEGCTATILLIWFDQNEDCFAQCANLGDSACIMSVNGEIITMTEDHRVVSTTERARMANSGQPLKDGESRICGLNLGRMLGDKFLKEQDSRFSSEPYVSQAVRMTKACLASALIASDGLWDVISANRAAQLVLEGKQKYSEQKTSADKVAHHVLSEARKLRTKDNTSVIFVDLDTLRSDP

SEQ ID NO: 66706 - protein, 215 aa, Oryza sativa (japonica cultivar-group)
MIAAVGRGPEGWGEDEMSVLPRHTKVVVTGNNRTKSVLVGLHGVVKKAVGLGGWHWLVLTNGIEVKLQRNALSVIEPPTGNEDDDKFDCENMQWNSSDLASDDAQSPKPQRSRSRQHRGFQTKSFSRSMSCDSHSKASFSSSSRAHTKVDLSKLEMTALWRYWRHFNLDASPNPSREQLVDAVQRHFVSQQLDELQVIVGFVQAAKRLKTNVKVA

SEQ ID NO: 66707 - protein, 426 aa, Gluconobacter oxydans 621H
MSRNALSAPHLTAADQPNLWLPYTQMQTAPFPVEAVSTSGSRITLADGRELVDGVAAWWTACHGYSHPHIHEALVRQAERMPHVMFGGMVHEPAIRLAARLAAMLPGDLERVFFTDSGSVAMEVAIKMAVQYHINRGTSGRTKILSFRGGYHGDTLGMMSICDPEEGMHSLFAGVLPEQALADLPVDGDSLARLEALLAERGDSIAAMVTEPLVQGAGGMLFHDPEVLRHLRELCDRHGILLILDEIFTGFGRTGTMFACEQAGIVPDIVALSKALTGGTMALAATVARRGVFEAFLSDSAGHALMHGPTFMANPLACAVANASLDLFETEPRLEQVATISAQLARELEPCRTLPGVKDVRVLGAIGVVELETLDDPDALRRAFVERGVWIRPFRNIVYLTPAFTIMPEELTRLTTAIVDVLREGA

SEQ ID NO: 66708 - protein, 439 aa, Glycine max
MKFTPSSKFLGFSNHFHSLLAPSFSPTPKFSSSFSATMSTLSTQNDTVTHKTQQPLQIAKRLEKFQTTIFTQMSLLAIKHGAINLGQGFPNFDGPEFVKEAAIQAIRDGKNQYARGYGVPDLNIAIAERFKKDTGLVVDPEKEITVTSGCTEAIAATMIGLINPGDEVIMFAPFYDSYEATLSMAGAKVKGITLRPPDFAVPLEELKSTISKNTRAILINTPHNPTGKMFTREELNCIASLCIENDVLVFTDEVYDKLAFDMEHISMASLPGMFERTVTLNSLGKTFSLTGWKIGWAIAPPHLSWGVRQAHAFLTFATAHPFQCAAAAALRAPDSYYVELKRDYMAKRAILIEGLKAVGFKVFPSSGTYFVVVDHTPFGLENDVAFCEYLVKEVGVVAIPTSVFYLNPEEGKNLVRFTFCKDEETIRSAVERMKAKLRK

SEQ ID NO: 66709 - protein, 506 aa, Alkalilimnicola ehrlichei MLHE-1
MIYANPGERDAKVQFKPRYGNFINGEWVEPASGQYFENITPVTGEVFCEVARSNADDVERALDAAHAAKDAWGKASVTERANVLLKIADRMEANLERLAVAETWDNGKPVRETLNADLPLAIDHFRYFAGAIRAQEGGISEIDHDTIAYHFHEPLGVVGQIIPWNFPLLMATWKIAPALACGNCIVLKPAEQTPASILVLMECIQDVLPPGVLNVVNGFGVEAGKPLATSNRIAKVAFTGETTTGRLIMQYAAENIIPVTLELGGKSPNIFMADVMDQDDDFLDKAIEGMTLACLNQGEVCTCPSRALIQEDIYDDFIAKVIDRFSMVKQGNPLDTETMIGAQASSEQMEKILSYMDIGRQEGAECLIGGDRAEIGGDFQNGYYVQPTLFRGHNKMRIFQEEIFGPVVSVTTFKDEAEALELANDTLYGLGAGLWSRSAHTTYRMGRAIQAGRVWTNCYHLYPAHAAFGGYKQSGIGRENHQMMLEHYQQTKNLLVSYSPKAMGFF

SEQ ID NO: 66710 - protein, 456 aa, Arabidopsis thaliana
MESTVMPGFDRISELPESLISQILLHLPTKASVKTSVLSTRWKNLWLNVPGLDLNCRDFPFQNNNEKLLIDFIDRFLQFNNESRLQKFKVDYSRDKIIKFSDRIGDAISRGIRVLDVESNTYYRDADDCIDYPCIEFMPLNLYSCKTLVSLKLSYSGLEDPGFVYLPCLKFMHLREVRWDSSGTMNLEKLVSGCPVLEELIYLHDDKLVVTRVRSRSLKRFSIPFRHKLSLFRRVTQTFEIDAPGLEYMSLKADHFDRIVVKNLTSLFMIDLDIKFIVGFGWMFDPEDLPKRNEIRDFLTGISSVRHMVISHNTVKALDLYSKVGLIPKFNNLSRVEAAFPSSLLQFLPAFLESFPNLKHLILETECPVEVMEKFELVNVPRCFVSTLEHVEIKGLFDWGEQDMKIASYFLENSAVLKKLILSFMGCPQHYSESDIYEELNKLTKRSPRCQIIIRC

SEQ ID NO: 66711 - protein, 143 aa, Zea mays
MAGLQRSATTFRRSGSSGLVWDERFLTEAEAKAKGGGGAAAEDPQPELRHSRSVGSIGMLLRGGDSDDGNKKAKEVEKARGGHQQRVFRTKDVAPDMDPPSPRVSGCILCAILGGSSGGGKARRRPKPKPKPKPRKDVATTTA

SEQ ID NO: 66712 - protein, 488 aa, Legionella pneumophila str. Lens
MEIYEMYIDGKFTLAKSGATRDIIDPANGELIAKVPESAKEDAILAIKAARKAFDEGEWRISLALDRGKLLFKLADLIRANAKMLAELETRNCGKPLPEAEFDVTDAANCFEFYGGLATKIHGETMSVPANSFSYVVREPIGVCGQIIPWNFPLLMAAWKLAPALAAGNTVVLKPSELTPITALELFKLIDQCGFPAGVVNLITGPGIGVGEELASNAMVDKVAFTGGSATGRKIMQAATGNLKKISLELGGKNPNIVFADCDLEMAIDGALFGAFANQGEVCSAGSRLLVERSIHKKIVEGMLKKIPNIKLGHGLDAGVKMGPLVSSAHREKVESYVKLGMEEGAKLLCGGKRPTGSEFAKGHFFEPTIFDEVKSTMRIAREEIFGPVLVVIPFDTEEEAIRIANDTDYGLSGAVWTKNVTRAHRVTSQIRAGILWVNHYHPTYNEMPWGGYKQSGAGRELGLYGIESYLEVKQVNINLDETPIGWY

SEQ ID NO: 66713 - protein, 450 aa, Legionella pneumophila str. Lens
MKHQLVGTKLMKKIHIKTPIPGPKSQQLMELRRQHVARGPFHATPIFVKQAKGSFVEDVDGNVFLDFSSGFGVVNTGHCPDSVVNAIKLQAEKFIHTGFNIIPYESYIKVCEKLNDHTPGHFEKKSLLLNSGAEAVENAIKIARAYTGKQAVICFDHAFHGRTYMAMTLTSKNKPYKHGFGPFPSEIHRAPFPYEYRWKGVNCVEECFNEFTDLANFRVGVENIAAVIIEPVLGEGGFIQSPALFLQKLREFCTTNDIVFIADEIQSGFGRTGNLFAMNTLGVPPDLTISAKGLGGGVVLAGVTGKAEIMDAAMEGGLGGTFGGNPLSCAAALEVFHIFEEGSLLQNVTHLAKALQSRLSGFKEKYKVVGDVRGLGVMQAIELVKDKNTKEPNKEATVQLAQFCLEHGLIILTCGTYGNVIRLHMPLSTGVKDLEIGLSIIEEGLKKLSV

SEQ ID NO: 66714 - protein, 310 aa, Legionella pneumophila str. Lens
MSSKLLTIQLLEELVHAAELNQEGKTADYIPELANVNQELTAIAVQTLGEKTLAYSNNPLHPVTLQSTGKMIPLIGLLEEFGADQLFEWVKVEPSGDDFASITRLEQFGPKPSNPMLNAGAIALCSRIPGVGEQQFRWLEHWVQKLFNQRLSINPLVFASEKRTGNRNRALAYLLKSRNNLGADVHETLDLYFALCSYEAMLDQMLYLPTLLANSGKDSDTGEQILSMETCKITLAIMATCGLYDETGTHMVKTGMPAKSGVSGYTIAVVPGKAGIVVLSPRVNAKGNSIRGEIMLEGLSKAMNWHFALP

SEQ ID NO: 66715 - protein, 209 aa, Brassica napus
  misc_feature (32)..(32): Xaa can be any naturally occurring amino acid
RTSGEYLTHNGVSTFACSETVKFGSGYFNEKXEQYVEIPSDSGISFNVKPKMKALEIAEKARDAILSGKFDQVRVNLPNSDMVGHTGDIDATVVACEAADVAVKMILDAIEQVKGIYVVTADHGNAEDMVKRDKAGKPALDKEGKLQILTSHTLKPVPIAIGGPGLSEGVRFRKDLEIPGLANVAATVMNLHGFVAPADYEPTLIEVVE

SEQ ID NO: 66716 - protein, 521 aa, Methanosarcina acetivorans C2A
MWNSLHMTQARRPLMLMILDGWGYREASEGNAILAAETPNLNSLLNEFPWCFLECSGEAVGLPEGQMGNSEVGHLNIGAGRVVYQDLTRINLSVRNGDFFENPVLLDAISNVKLNDSSLHLMGLVSYGGVHSYMTHLYALIKLARDKGLKKVYIHAFLDGRDVPPKAALADIRELDAFCKENGSARIATVQGRYYAMDRDKRWERSKLAYDALTLGVAPYTTSDAETAVSDAYARGETDEFVKPTVVTGSDGKPEAVVQDNDSIIFFNFRPDRARQLTWAFENDDFDGFPREKRPKVHYVCMAQYDETLDLPIAFPPEELENVLGEVLSKQGLVQLRIAETEKYAHVTFFLNGGQEKCYDGEDRCLIPSPKVATYDLKPEMSAYEVTDEVIRRIQSGKYDVIVLNFANMDMVGHTGIFEAAVQAVEAVDTCVGRIIEALKKAGGVALITADHGNAEQMENQHTGEPHTAHTSNPVRCIYAGKGEVKALENGKLSDLAPTLLDLLGVPKPEEMKGKSLILNE

SEQ ID NO: 66717 - protein, 449 aa, Burkholderia mallei ATCC 23344
MSYNDSRFWHPMLHPNDMKRREPIRIVRGDGCHVYDERGRQLVDGVAGLWNVNVGHNRAEVKEAIVRQLDELEYFQLFDGITHPRAEELSSKLIDMMEPEGMRRVLYSSGGSDSVETALKIARQYWKVRGQADRTKFISLKQGYHGTHFGGASVNGNTVFRRNYEPNLPGCFHVETPWLYRNPFTQDPEALGRICAELLEREILFQSPDTVAAFIAEPIQGAGGVIVPPANYWPLVREVCDRYGVLLIADEVVTGFGRSGSLFGSRGWGVKPDIMCLAKGISSGYVPLGATAVNARIEDAFASNADFGGAIMHGYTYSGHPVACAAALASLDIVLREDLPANAAKQGAHLIEALRPFVERFDALGEVRGKGLMVALDLVADKATRAPIDPMSGYANAVAEVARENGVLVRPVGTKIILSPPLVIQREQIDRIVAGLEAGFAATPFPGGR

SEQ ID NO: 66718 - protein, 177 aa, Ceratodon purpureus
MAPPTVGTQAQAAPAMVPARVYSKDDEVLVKKSWDILKKDAQRNGINFFRKVFEIAPGAKSMYSFLRDSTIPFEENPKVKNHARYVFMMTGDAAVQLGEKGAYQVLDSKLQKLAATHINAGVTDDQFEIVKEAILYAIEMGVPELWSPELKSAWGDAYDMLAAAVKAEMHAQRAAAQ

SEQ ID NO: 66719 - protein, 500 aa, Burkholderia mallei ATCC 23344
MTQTDLVAVADTVRAFTEREFGVFIDGAMRAAHSPRRLDVFDPATGARLSRVPDADAHDVDAAVASAQRAFDARAWSGLRPAERERILLKLADVLEAHAEELAQLETLNQGKSILVSRGVEVGATIEYVRYMAGWATKITGQTLDVSIPFPPGARYTAYTRKEPVGVVAAIVPWNFPLMIAVWKLVPALAAGCTVVLKPSPETPLTALRLAELALEAGVPAGVFNVVTGARACGAALASHPAVRKISFTGSTATGKLVGAAAVQNMTRFSLELGGKNPIVMLEDVDVDAALGGVAAGAFFNQGQVCAAASRIYVHRSRFRRLAEGLAGVASAMRLGPGLDPAAQINPLVSAHHRDTVARHIDAARREGLTFFAGGTRADDLPGYFVRPAVIADAAHDSAIVRDEVFGPVVVVLPFDDPAEAVRLANASPYGLAASLWSNDLKAVMDLVPQIEAGTVWVNCHIPLDPSMPFGGYKQSGIGREFGQYAIEGFTETKSVCIAH

SEQ ID NO: 66720 - protein, 293 aa, Ashbya gossypii ATCC 10895
MSDEITHPTIKDGWFREISDTMWPGQAMTLRVEKVLHHEKSKYQDVLVFKSTNHGNVLVLDNVVQCSERDEFAYQEMITHLAMNLHANPKKVLVIGGGDGGVLREVLKHESVEEAWLCDIDEAVIRVSKQYLPEMSRSYEHPKVKTHIGDGFQFLRDYPNTFDVIITDSSDPEGPAEALFEQPYFSLLNQALTENGVITTHPESLFIHMEIIKQLKGTCSQLFPNVGYAYASVPTYPSGQIGFMVCSKNADIELSKPLRTISDEQERELYKYYSKKMHEACFVLPTFAAKELN

SEQ ID NO: 66721 - protein, 862 aa, Solanum lycopersicum
MILNKIVDSITGKDDGEKVKGTVVLMKKNVLDFTDVTASIVDGALEFLGRRVSFQLISNSVHDANGLEGKLSNPAYLENWITNITPVVAGESTFSVTFDWDDDEFGVPGAFIIKNLHFSEFFLKSLTLEHVPNHGKVHFVCNSWVYPASKYKSDRIFFANQAYLPSETPELLRKYRENELVALRGDGTGKLEEWDRVYDYAYYNDLGDPDKGQEYARPVLGGSSQYPYPRRGRTGRKPTKTDPNTESRIPLLMSLDIYVPRDERFGHVKMSDFLTFALKSISQLLLPEFKALFDSTPNEFDSFADVLKIYEGGIKLPQGPLFKAIVDAIPLEILKQLLSTDGEGLLKYPTPQVIQEDKSAWRTDEEFGREMLAGINPVIISRLQEFPPKSKLDPKIYGNQTSTITREQIEDKLDGLTVDEAVKTNRLFILNHHDILMPYVRRINTTTNTKMYATRTLLFLQDDGTLKPLAIELSLPHPDGDQFGAVSEVFTPSDQGVEGSIWQLAKAYAAVNDSGVHQLVSHWLNTHTVIEPFVIATNRQLSVLHPIHKLLLPHFRDTMNINALARQILINGGGLLELTVFPAKYSMELSSVIYKDWIFPEQALPADLIKRGVAVEDSNSPHGVRLLIQDYPYAVDGLEIWSAIKSWVTEYCNYYYKSDDAVQKDAELQAWWKELREEGHGDKKDEPWWPKMQSVQELIDSCTITIWIASALHAAVNFGQYPYAGYLPNRPTLSRKFMPEPGSAEYEELKRNPDNVFLKTITPQLQTLVGISLIELLSRHASDTLYLGQRDSPEWTKDQEPLSAFERFGKKLGEIEDRIIQMNGDNQKWKNRSGPVKVPYTLLFPTSEEGLTGKGIPNSVSI

SEQ ID NO: 66722 - protein, 450 aa, Methanosarcina acetivorans C2A
MEKEYDIIILGTGTAGRTLAGRAKSSGLKFAIIDSREYGGTCPLRGCDPKKVLAGASEATDWNNRLIGKGAGTEKPLEINWSSLIEFKRTFTRDYPRETEKMFADMGIDMYHGRANFENENTILVGKDKLKGKYIFLATGSKPRKLNIPGEEYLITSEEFMETEKFPEKIIFVGGGYVSFEFAHIALRAGAEVLILHRSEKPLRDFDSEMADLLVRASEAAGMRILTDRPVVAVEREGDRFLVRAEYKTETGSETQTFNADMVVNGAGRTPDIEDLRLENAGITAEKKGIIVDKHMQTSNPRVYAGGDCTAEGMQLTPVATLQGEIAAANIFDENRAEIDYTGIPSAVFTIPVLASVGITEAKVNDKHRVIFRDRSKWSTTRRAGLEFAASKIIVDETNDHIVGAHILGPNAEEAINIFATAMQLGLRASSIKKMAFTYPTTCSDIRYML

SEQ ID NO: 66723 - protein, 290 aa, Candidatus Kuenenia stuttgartiensis
MQQINSILKIPPRKPDSHKGDFGRVLVIAGSYGMTGAACLCSEAALRSGAGLVTLGIPESLHGIVATKLTCVMTHPLPETHLKTLSDMGRQDILDFSQRFDVVAIGPGLSQCVETKRLVLWLLQNIERPIVLDADGINALAEDTATLDKIKQHVILTPHPQEMARLLKVYTTKEIQSKRKEIAEKFINSRDKVTLVLKGNNTIVMNNEKYYVNTTGNPGMATAGSGDILTGMIAALLGQNFPPFEAAQLGVYLHGTAGDYAKQAVGEISMTATDILDNLPKAFLNHIQNK

SEQ ID NO: 66724 - protein, 239 aa, Anabaena variabilis ATCC 29413
MKLFIPATVIGLCLSSSQVLAQTLTLSPNLIGFNSNEGEKLLLTSGSREDFFPLSMQFVTQVNQAYCGVASIIMVLNSLGIDAPETAQYSPYRVFTQDNFFSNEKTKAVIAPEVVASQGMTLDELGGLIASYGVEVKVHHASNTNIEEFRKQVAENLKQDGNFVIVNYLRKEIGQERGGHISPLAAYNEQTDRFLIMDVSRYKYPPVWVKTTDLWKAMNTVDSVSQKTRGFVLVSKIQD

SEQ ID NO: 66725 - protein, 175 aa, Triticum aestivum
MAAVEGEKKMITLKSSDGQEFEVEEAVAMESQTIRHMIEDDCADNGIPLPNVDSKILSKIIEYCKKHVQASPKPADSGAAADANSSTSTAAPASAEDLKSFDAEFVKVDQATLFDLILAANYLNIKGLLDLTCQTVADMIKDKTPEEIRKIFNIKNDFTPEEEAEIRRENQWAFE

SEQ ID NO: 66726 - protein, 121 aa, Mycoplasma hyopneumoniae 232
MQAKLIEILESSQIRLYPQFQPGDNVRVYFKIQEGNKTRIQIFEGLVIKFKKNGLSSNFVVRKISHNVGVERTFLLHSPLVEKVEVIRSNKVRRAKLYYMKKRSGKSARLKEIKRKELKNL

SEQ ID NO: 66727 - protein, 545 aa, Myxococcus xanthus
MRVVVDLTRCQGYAQCAFLAPSVFRMQSGDALLYDSNPDDALREQIKRAAAACPVQAIHIGGMGTLAAMRKEPAQRRKPRGPVRLTDAEAAFKRGGRIVIVGASLAGLTAALMFRTQGFAGSLTLIGDEACDPYDRPPLSKQVLTGWVKADHTLLPYSDELDADWHLGVRAMGLDLAGKQVLLADGNRVQFDRLLIATGARARPWPNDAEASLEGVEVVRTRDDAAQLQRRLAARPGRVLVIGGGFTGSEVASACRELGLPVTVTERGATPLVGALGGVVGAVAAALQRDHGVDLRCGVTVTRLEGDANGRLRRAHFSDGSTLNVDVAVVALGAIRNVECVRDSGLAVTRWGVACDAACHAFDINGLVTRNIFVAGDVARVPHPIYDYQFLSLEHWGNAVTQAKIAAHNMLSPEADRWPHLTIPTFWSTQFGVNIKSVGVPTFSDALVITQGSLAERRFVAVYGYKGRVTAAVAFDQPKWLEFYQGLIDAAAPFPPAFRTVHQPAEMRPVPPEFPKRAVSEHEATVMVTGREPYERRVRWVYRHL

SEQ ID NO: 66728 - protein, 384 aa, Legionella pneumophila str. Lens
MMFGFLNMTLWGYLLTGFVLTHITTTAVTIYLHRYQTHRALTLHPLVSHFFRFWLWLTTGMTTAEWVAIHRKHHANTDMEGDPHSPQVFNIRKVFWQVPELYREASKDKDMIKKYSYGTPNDWIERKLYSPHANKGIFLMLALNLFLFGIPGLTLWAIQMMWIPLVAGVVNGIGHYWGYRNHESSDSSTNVFPWGLLIAGEELHNNHHTFASSAKFSIKWWEFDLGWFYIRCLSFLKLAKVKKLPPKLIIDKNKSHIDVDSVKAILGNRFQVISDYYKLVIFPTLRDMQYRIKNRDLKNARHLLKKPNEQLSHADQLRLKTLLKQHDNLQAVHNYRELLQQIWLKTSLSNKDLLNLIQKWCSQAEESGLLVLRQFASQLKSYSL

SEQ ID NO: 66729 - protein, 443 aa, Pyrococcus sp.
MNEIKGIERAVQVEVPRPRFLLLAFTDINGSLKGMEIPMERYEEAVEDGVSFDGSSIPGFEGIEDSDLIFKADPSTYAEIPWEGIGRVYGYIYKGDEPYQADPRGILKRVLERLEKEGLKAHIGPEPEFYIFKKNGTWELHIPDSGGYFDLVGLDKAREIRREIALYMPYLGLKPEVLHHEVGKAQHEIDFRYDEALRTADNIVSFKHVVKAVAELHGYYATFMPKPIYGFPGNGMHLHISLWKDGENVFIGEDGLSDTALHFIGGILKHAKALAALTNPTVNSYKRLVPGYEAPVYISWGYRNRSALIRVPAFKGSGARIEYRCPDPSANPYLALAGILMVGLDGIKKKVEPDSYVETNVYEMDDAERERLGIDTLPGSLGEALEELKKDKTVREALGGANKNFIDYKEREWEEYIEYLSSRDIPIDTKKVTEWELERYFYV

SEQ ID NO: 66730 - protein, 379 aa, Zea mays
MATAGKVIKCRAAVAWEAGKPLSIEEVEVAPPQAMEVRVKILYTALCHTDVYFWEAKGQTPVFPRILGHEAGGIVESVGEGVTELAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQAKKFGCTEFVNPKDHDKPVQEVLIELTNGGVDRSVECTGNVNAMISAFECVHDGWGVAVLVGVPHKDDQFKTHPMNFLSEKTLKGTFFGNYKPRTDLPNVVEMYMKKELELEKFITHSVPFSEINTAFDLMLKGESLRCIMRMED

SEQ ID NO: 66731 - protein, 427 aa, Leptospira interrogans serovar Copenhageni str. Fiocruz L1-130
MRTQSPDYIVIGAGFTGLLYSTLAVLEGRSVFLYEKQNRSGGLVGSIQTPFGLVETAANGILNSYQLEELASALGLKILTTEKKSKKRFIWKNGSPRRFPLSFLDTLRVLYGILGISAEIRAGESVYQWGVRVLGKGAVKNVLEPGLGGIYAGNLKDMSAELALGGWISSKGSLLKNIREIKKIKTKNPKQKKGTVSFRGGLGELLNAMEAKIKSSPNSKIYYSQESPTLSSIRKKYPNSKIILSCGLESSLKLLSSGFPVFKRYEKLCKTLGVVTVTRFGNQPLLGKKSGFGILFPSDSGFRTLGVLLNSSIFSGRVSKGHYSETFIFGGALDQEIVKFKEKEIINVLEEDRKKITVQNDEPLNHYVTIWKSALPIYDLALLEFNKELDRSLPEGIFVEGNFRYGIGLSSILERAWNVMRNQKGRT

SEQ ID NO: 66732 - protein, 587 aa, Haloarcula marismortui ATCC 43049
MPTKVENWKDEVYGNEIREHLMEFAEQGWDAIPEDEHDAWFERFKWWGLYHQRSGQESYFMMRIGTPNGVIKPGQLEVIGEVAKEYATGPVDNPEFGEAYCDWTTRQSIQLHWIKLEDIPEIFEKLEAVGLGTQQACGDSWRNIVGCPVAGKDKHEHVDAWPVAEDLHETFKGNDDYSNLPRKWKVAIAGCDEGCGQGDINDLAFEPAEKDGELGFNVRIGGGLSRKEPRLARDIDVWVPPEQAADVAHGMSSLFRDYGDREDRFNARIKFLMDEWGPEKMRSVLQEEYVDFELPTAGEDMRDQYSYNTGSQDGHNDHVGIHEQNDGNYYIGLNVLVGRMGADDVLELAELADEYGSGEVRLTQRQNIIVTDVPEENLDAFTSEPLLENYSPDPSPFMRGSIACTGTEYCSLSIVETKNRQVRYARWLKDNVELPEDHKDFHIHLSGCTASCAQPQIADVSLRGMKTRKDGEPVEALDIGLGGGLGDDPRFADWVEMRVPADEVPGAIKNLVNNFEDAREGGETFRDFVADRDEETLADMVEPEETDYHDPYMHNTKMTWYPYAEDDDMQSSPAPTDGSGEPLPSDD

SEQ ID NO: 66733 - protein, 187 aa, Datura stramonium
TEGCLVASTNRGCKAIYASGGATSILLRDGMTRAPCVRFGTAKRAAELKFFVEDPIKFETLANVFNQSSRFARLQRIQCAIAGKNLYMRFVCSTGDAMGMNMVSKGVQNVLDYLQNEYPDMDVIGISGNFCSDKKPAAINWIEGRGKSVVCEAIITEEVVKKVLKTEVAALVELNMLKNLTGSAMAG

SEQ ID NO: 66734 - protein, 384 aa, Oryza sativa (japonica cultivar-group)
MSSVCKLMPEQESDHGEDGSAPKAAAVRGGSPRGGVRWWLSVAADMFMVLCGQTVATLLGRLYYNSGGNSKWMATLTQSAGSPLLAILLLFTPAPAADEPRPAAAKMAPIYVGLGIIIGFDNLMYSYALQYLPVSTFSLVAATQLGFNSVTSRLINAQRFTVLIANSVVVLTFSAALLGIGASSDETASSVPRGKYPAGFALTLAASAVFALILSLFEATFEKVVRTRTLRWVLRAQLWTNVVASTVSAVGLLASGDWRTIPAEMAAFKDGRARYVATLVGTAVSWQVMAVGSLRLIVRVSSLFANVTGTLSLPLVPVFAVALFGDRMTGIKAVSMLMAVWGFLSYAYQQYIDGRRAAGAGKGRAAAECRVCAARAGSDPDSPA

SEQ ID NO: 66735 - protein, 363 aa, Candida albicans SC5314
MFSGFGSSIYGSGFGSSGFPSNKFEEYFRCYPIAMMPDLIRKDDANYGGKIFLPPSALNKLTMLHIRYPMLFEIKNEQNEKLTHSGVLEFIAEEGRTYLPQWMMNTLELTPGSLIKITNCDLNLGKFVKIEPQSVDFLDISDPKAVLENVLRKFSTLTVNDIIEVNYNDAIYGIRVLEVKPDSTSKGICVVETDLETDFAPLVGYVEPEYKPKTVEPSSKPIDPSKVNKSAGAATMAKSINYAKLVAEAGKTTKFSGSGQKLSGKSIDMDKNQSTKNYRIDDLDPDAPPVPLSLPENQLFFGFPVVLPTQEEIDEESKEELKKQQAFSGSGQSLRQSKKRKDKNTNYPSLKNHTRSPDAIEID

SEQ ID NO: 66736 - protein, 251 aa, Leptospira interrogans serovar Copenhageni str. Fiocruz L1-130
MSSMKNVIITGASSGIGKELARLYAQTGANVALTARRKDVLKKIVEELKSSGTKGKILFASLDVSDADQNFKVIPKLIKELGGLDLIVLNAGISTTSSFGGRSFEADRAVIETNLIGAMAGVEAVLPIFQKQKSGQIVAISSVASFRGLPGSASYSSSKAGLSVYMEALRGEVKRYGISVSVIHPGFIDTPINNRMKSRPFVISVERGAQKIFKRIENNVLSATVPWFPWVFLGYLMKRIPEFLWSKISLK

SEQ ID NO: 66737 - protein, 262 aa, Oryza sativa
  misc_feature (21)..(21): Xaa can be any naturally occurring amino acid
  misc_feature (47)..(47): Xaa can be any naturally occurring amino acid
MSPAEASREENVYMAKLAEQXAERYEEMVEFMEKVAKTTDVGELTAXSERNLLSVAYKNVIGARRASWRIISSIEQKEESRGNEAYVASIKEYRSRIETELSKICDGILKLLDSHLVPSATAAESKVFYLKMKGDYHRYLAEFKSGAERKEAAENTLVAYKSAQDIALADLPTTHPIRLGLALNFSVFYYEILNSPDRACNLAKQAFDDAIAELDTLGEESYKDSTLIMQLLRDNLTLWTSDNAEDGGDEIKEAAKPEGEGH

SEQ ID NO: 66738 - protein, 453 aa, Mycobacterium smegmatis str. MC2 155
MKVLVIGGGFGGLFCARRLGRLDVDVTLVDRAAGHLFQPLLYQCATGTLSIGHISRPLREELARYSNVKPLLGEAIRLDPDQRQVTFLRPDETSFVLDYDVLVVAAGMRQSYMGNERFSEWAPGMKTLDDALSIRQRVFTAFEIAETLPPGPERDAWLTFAVAGGGPTGVELAGQIREMATRTLANEFHSIEPEEARVLLFDGGDRVLKSFAPDLAERAAESLSALGVELRMGVHVTDVRRDGVTVTPKNGGPAEEYATRTVLWTAGVEAVPFARHVAEVLGAKTDRAGRIEVEPDLTVPGHPEVFVVGDLVGRDKLPGVAENAMQGGLHVARCVRRDLAGKPRRPYRYHDLGSAAYIRRGDALLQVHRVRVSGFAGWLAWGFIHIAFLTGMRNRVSTVITWMATIARASRYHRAFMLGDPTKIEQERYTWSRWDQESPPPETWPPPAVEQGP

SEQ ID NO: 66739 - protein, 452 aa, Salmonella enterica subsp. enterica serovar Paratyphi A str.
MLSIFKPAPHKARLPAAEIDPTYRRLRWQIFLGIFFGYAAYYLVRKNFALAMPYLVEQGFSRGDLGFALSGISIAYGFSKFIMGSVSDRSNPRVFLPAGLILAAAVMLFMGFVPWATSSIAVMFVLLFLCGWFQGMGWPPCGRTMVHWWSQKERGGIVSVWNCAHNVGGGIPSLLFLLGMAWFNDWKAALYMPAFGAIVVALFAFAMMRDTPQSCGLPPIEEYKNDYPDDYNEKAEEELTAKQIFMQYVLPNKLLWYIAIANVFVYLLRYGILDWSPTYLKEVKHFALDKSSWAYFLYEYAGIPGTLLCGWMSDKVFRGNRGATGVFFMTLVTIATIVYWMNPAGNPNVDMACMIIIGFLIYGPVMLIGLHALELAPKKAAGTAAGFTGLFGYLGGSVAASAIVGYTVDFFGWDGGFMVMIGGSILAVILLVVVMIGEKRHHDELQLKRNGG

SEQ ID NO: 66740 - protein, 419 aa, Methanosarcina barkeri str. Fusaro
MKEVTVGSRSKLLEGVKQHLCTCAAGLKLTPDMEAFLEMPMRELYVSLPVHMDDGSIKVFKGFRVQYNEALGPTKGGVRFHPEDTMETTRALAALMTWKCALHKLPLGGAKGGVICNPKELSHREIERLSRAYIRGIYQIIGPDRDIPAPDIYTNPQVMAWMMDEYSKLAGRNVFGSITGKPTSLGGSAGRYDATARGGLYTIREAAERIGISLKASRVAVHGFGNVGYHAAYLANKLYGCKVVAVSDSKGAIFSPYGLDPEDVSGHKHSTGSVLDYPEAENLTNKELLELDVEILIPASLENIITEENAGNIKARILAEMANGPTTVEGEAILNSKGIHIIPDILCNGGGVIVSYFEMVQNQSSTQWEEEEVQNRLERKMKEAYFSVYDFASKNNVEMRQAAYTLAVGRVVEAMQLRG

SEQ ID NO: 66741 - protein, 197 aa, Medicago sativa
MSGSRFIKCVTVGDGAVGKTCLLISYTSNTFPTDYVPTVFDNFSANVVVDGSTINLGLWDTAGQEDYNRLRPLSYRGADVFLLAFSLISKASYENIAKKWIPELRHYAPGVPIILVGTKLDLRDDSQFFQDHPGAAPITTAQGEELRKLIGAPVYIECSSKTQKNVKAVFDSAIKVVLQPPKQKKTKRKGQKACSIM

SEQ ID NO: 66742 - protein, 730 aa, Solibacter usitatus Ellin6076
MAKVPGSQDERTSRYGPHLNYTPPGGWKGESGKGGENLVKTHCCFCGQQCGIQLKVRDNRVMGFEPWEEFPFNRGMLCPKGVKRYMQGSHPDRLLDPLMRTPEGFRPAKWDEALDFTARRLRELQEKYGKDSVAVYGGASLTTEKSYLMGKFARVGLGTRHIDYNGRLCMVSAGTAYKTALGVDRAPNPWNDISEAEVLFVIGANIGECAPITTDYIWRARDKGAKLIVADPRFTPIARNADLYLPVRPGTDLALLMGMLHVIIRDGLTDPAFIEAHTTGFEKTAESVEAWNPRRAAEVSGVAPEAIEKAAHLIGESRRAMLMHARGLEHQSKGVENCEAVVAIALATGNIGREGAGPIMVTGQGNGQGGREHGQKCDQLPGQRSLTDPAARAHVAGVWGISPDDLPQPGYTAVEIMNAIHSGEIKGLLSICFNPLVSLPDANFTREALEKLEFFAVIDFFLSETAAHADVVLAGSLQEEEEGVTANVEARVIHIKKAVDPPGNARADSSIICDLAHRLGRGQFFPFKEPREIFEELRRASQGGLADYYGITYEKIDQQMGVFWPCPTLDHPGTPRLFEDGRFFHPDGKARFMSLVWRDSGDPVDAEFSIYLTTGRVVSQYLSGTQTRRIGALVDQYPEPKLELHPRLAEQHKINSGDWVTVTSRRTAITLQAMVVRTIRPDTVFIPYHWPGGRSANRLTHRTLDPRSKIPEYKVSACRIEKAVAPGGQS

SEQ ID NO: 66743 - protein, 174 aa, Candidatus Pelagibacter ubique HTCC1002
MKTIEEINQLNVKKILSEKKIPDFFPGDVIKVGVRITEGKKDRIQYFEGVCIARKNRDINSSFTVRKISFGEGVERTFPLYGTVIDTITVIRHGKVRRAKLYYLRDRTGKSARIAEKIRKKIGIEVDVKPEMVTEETLAPVAAEPVKQAEVQAEPVKQAEVQAEPKIEKSEEKK

SEQ ID NO: 66744 - protein, 379 aa, Euglena gracilis
MNPFRLLLQRAGGDLMRLKLQSTFKVHTPEGMPEFTGPNDFTEVTVDQIKRFHTDMVRIRRMETKASQMYTQKKIRGFCHLYIGQEAVCVGMESSLTFKDAIITAYRDHAWHLTRGGTITEVIAEMQGKAAGCSKGKGGSMHMYKAANNFYGGNGIVGAQCPVGAGIAFGLAYEDPKAPKGVCLSLYGDGAANQGQLFEAMNMASLWKLPVIFVCENNQFAMGTSVKRGSAQQVFYKRSDYIPGLWVDGMDVLACREGMRYAKEWCMAGNGPVCMEMQTYRYMGHSMSDPGTSYRTRDEVQKVKEERDCISKLSSRLIAEGISTEAELKTVEKETNKEVDKEIAAVEALPPTPFEEIGRDIFDVPITVRACDHTIVYGQ

SEQ ID NO: 66745 - protein, 523 aa, Datisca glomerata
MPAVGGIVVGGSKKEYPGNLTPYVTITCIVAAMGGLIFGYDIGISGGVTSMDSFLKKFFPAVYRKKELDSTTNQYCQYDSQTLTMFTSSLYLAALLASIVASTITRKFGRRLSMLFGGILFCAGAIINGFAQAVWMLILGRMFLGFGIGFSNQSVPLYLSEMAPYKYRGALNIGFQLSITIGILVANVLNYFFAKIRGGWGWRLSLGGAMVPALIITVGSLLLPDTPNSLIERGNRDEARSKLQRVRGVDDVDEEFNDLVAASEESKQVEHPWTNLLRRKYRPHLAMAILIPFFQQLTGINVIMFYAPVLFNTIGFGSDASLMSAVITGCVNVAGTLVSIYGVDKWGRRFLFLEGGFQMLICQAVVAAAIGAKFGVNGNPGELPKWYAIVVVLFICIYVAGFSWSWGPLGWLVPSESFPLEIRSAAQSINVSVNMIFTFAIAQIFLTMLCHLKFGLFIFFAFFVVVMSIFVYFFLPETKGIPIEEMGRVWKSHWYWSRFVTDADYTIGSGVEMGKGAQELKNI

SEQ ID NO: 66746 - protein, 432 aa, Alkalilimnicola ehrlichei MLHE-1
MSEKTVTLTDNSTGKSVELPVYQGTHGPEVIDIKNVYGELGYFTYDAGFTSTASCKSDVTFIDGDNGVLLYRGYPIEHLAEKSSFLEVSYLLLHGELPNKAELDQFVSSVTNHTMLNESLKDFFDGFHYNAHPMAMLTGVVGSLSAFYHGELDINDPKNRELTAHRVIAKMPTIAAAAYKHLVGEPFVYPQNHLSYAGNLLNMLFSRPTEKYEVNPVAERALDQLLILHADHEQNASTSTVRLAGSTGTNPFAAIAAGCAALWGPAHGGANEAVLNMLNEIGDVSNVPKFIEKAKDKNDPFRLMGFGHRVYKNFDPRATIIRKTCHEVLEELGVGKDPQLELAMELEDIALQDEYFVERKLYPNVDFYSGIIYRALGIPTEFFTVLFALGRTPGWLAQWMEMVNDPEQRIGRPRQLYTGAAKRDYVPVDQRS

SEQ ID NO: 66747 - protein, 233 aa, Oceanobacter sp. RED65
MKQVLRVGIGGPVGSGKTALLEQLCQTMRDHYNIAVVTNDIYTKEDAQFLMRKNALEEDRIMGVETGGCPHTAIREDASMNLAAVKDLQDRHDGLEMVLVESGGDNLSATFSPELSDFTIYVIDVCAGDKIPRKGGPGITKSDLLIINKVDIADHVGASLAVMDRDTRKMRGDRPFVLANVETQKGIAEIVRIIIEEGMLPQRPEIEEKLSTMPKAHDVSAEAARPSTRSTID

SEQ ID NO: 66748 - protein, 463 aa, Lupinus luteus
MKMGNSSFVAIALLMSVVVLCNGGKTSSYVRKLIQNPVDMPLDSDAFAIPPGYNAPQQVHITQGDHVGQAMIISWVTVDEPGSNEVIYWSNSSLQNFTAEGEVFTYTYYNYTSGFIHHTNITNLEFNTTYFYVVGIGNTTRQFWFITPPEVGINVPYTFGIIGDLGQTFDSNTTLTHYQNSKGNTLLYVGDLSYADNYPNHDNVRWDTWGRFIERSAAYQPWIWTAGNHEIDFDPQIGETQPFKPFSNRYHTPYVASQSTEPYYYSIKRGPAHIIVLASYSAYGTSSLQYKWLTSELPKVDRTKTSWLIVLMHAPWYNSYYSHYMEGEPMRVVFESLFVKYKGDVVFAGHVHAYERPERVSNDKYNITNGICTPVKDISAPVYITNGDGGNQEGLSINMTQPQPSYSAYREASFGHGTLEIKNRTHAHYSWNRNQDGYAVEADKLWLFNRYWNPRDDSTIHIP

SEQ ID NO: 66749 - protein, 422 aa, Leptospira interrogans serovar Copenhageni str. Fiocruz L1-130
MGESNQKKVVVIGAGFGGLQAVKKLSQNNNLDITVIDKKNHHLFQPLLYQVATAVLSPADIAIPTRSLVGESKNVTVVLGEATKIDLKTKTVYYQNTSTNYDYLILSAGARSSYFGNDHWEKYTIGLKNLKDALKIRHKLLISFEKAELSGDPEVVKSLLNYVIIGGGPTGVELAGSIAELSHQIIRDEFHTIDPALSKITLIEASPRLLMTFDPSLGEFTKKRLERRGVEVLTGTRVIDINERGVQLEGKMIPTQTVIWAAGVQANSIAATLDVTLDRGGRVIVDEFCNIEGHSEVFVIGDIASYSKGLERPLPGVSPVAMQQGRYVASLIQNDLKNKKRKPFHYIDKGSMATIGRTDAVAQVGILKMKGLFGWLAWLFVHLFYQVGFKNKITILITWVWSYIAFRAEARVIQDEISADND

SEQ ID NO: 66750 - protein, 317 aa, Yarrowia lipolytica CLIB122
MAVILDKQKKQPPKQISTLGGFVAGAIAACGAVTVTNPIELVKTRMQLQGELAARGEAKKVYTSPLQALVKIYKSEGIKGLQSGLFSAYVYQIGLNGCRLGLYEPTRKVIANVCNIDLNKENPVGLNVASGAISGIMGAVAGSPFYLIKTRQQSYSPAFKVGAQTYYKSIGDGFRQIYGAEGFKGLYRGVDAAILRTGAGSSVQLPIYNWAKELLLKHHITDPGASTHLVASAMSGLGVAVVMNPWDVLMTRMYNQKGNMYKNPFDCLMKTVSIEGPFALYKGFGAHLLRIAPHTILTLMFMEQTMKWVKWFEGVPF

SEQ ID NO: 66751 - protein, 432 aa, Oryza sativa
  misc_feature (371)..(371): Xaa can be any naturally occurring amino acid
MDDDAGDASPPPAAAGVGATAAQSRDMAASPTSSRSVTETVNGSHRFVIQGYSLAKGMGVGKHIASETFSVGGYQWAVYFYPDGKNPEDNSAYVSVFIALASEGTDVRALFELTLLDQSGKGKHKVHSHFDRSLESGPYTLKYRGSMWGYKRFFRRTALETSDFLKDDCLKINCTVGVVVSTIDYSRPHSILVPDSDIGYHFGTLLDNHEGVDVVLSVGGERFHAHKLVLAARSSFFRSELFEHESDEEKNEVDTSNEIQEIVLDDMEPKVFNAVLHFIYRDTLVDDNELGGSSSEGSIFDTLAAKLLAAADKYDLARLRLLCESYLCKAISVATVASTLALADRHHAMELKAVCLKFAAENLSDTLMSLXAVIRTEGFDYLKDNCPSLQSEILRTLAGCEEECSSGGKSQSVWGQLSDGGDTSGRRVRPRT

SEQ ID NO: 66752 - protein, 221 aa, Oryza sativa
  misc_feature (199)..(199): Xaa can be any naturally occurring amino acid
MASSALICDTEQWKGLQAHVGAIQKTHLRDLMDDAERCKAMTAEYEGIFLDYSRQRATGETMEKLFKLAEAAKLKEKIEKMFSGDKINSTENRSVLHVALRAPRDEVINSNGVNVVPEVWGVKDKIKQFSETFRSGSWVGATGKALTNVVSVGIRGSFLGPLFVHAALQTDPEAAESAKGRQLRFLCNVDPVDVARSIXDLGSGTNLVVAVSKTFPTVEPG

SEQ ID NO: 66753 - protein, 326 aa, Yarrowia lipolytica CLIB122
MSVKTVDISTINQTTADELLECASRDGFLFVEGSGFTQKEVDDMFNMSKGFFALPLEEKNKFPIGAENRGYNAINVETLDPATQKKGDPKEGFNFGKYINEKPIQPMPEFFQKPENADIIANMQTKLYNLSQRILKLLAMGLKIDESSGGSNWFADRHRRDYPSGSIFRLLYYPGQKKADPEDEIRAGAHTDYGSLTLLFQREGEEGLEILSPVSKKWEPVPYVGPKEPGMAPPVVVNIGDLLSYWTAGILKSTIHRVKFPAKLQAEGTDRYSCVFFCHPEEEVRLEPVPSAKIASVTGRGANEGKVITAEEHLQSRLSATYGWKK

SEQ ID NO: 66754 - protein, 511 aa, Bruguiera gymnorhiza
MAMASFARRKAYLLTRNLSNNSCSDALSCSFCLSSFSRGFASAGSDDNDVVVIGGGPGGYVAAIKAAQLGLKTTCIEKRGALGGTCLNVGCIPSKALLHSSHMFHEAKHSFASHGVKFSSVEIDLPAMMAQKEKAVSTLTKGIEGLFKKNKVTYVKGYGKFVSPSEVSVDTLEGGNIVVKGKNIIIATGSDVKSLPGITIDEKKIVSSTGALALSEIPRKLVVIGAGYIGLEMGSVWGRLGSEVTVVEFAPDIVPSMDGEIRKQFQRTLEKQKMKFILKTKVVGVDTSGDGVKLTLEPASGGNQTTLEADVVLASAGRIPFTAGLGLDKIGVETDKVGRVLVNDRFQTNASGVYAIGDVIPGPMLAHKAEEDGVACVEFIAGTHGHVDYDKVPGVVYTHPEVASVGKTEEQVKSLGIDYRVGKFPFLANSRAKAIDDAEGIVKILAEKETDKVLGVHIMSPNAGELIHEAVLALTYDASSEDIARVCHAHPTMSEALKEAAMATYDKPIHI

SEQ ID NO: 66755 - protein, 222 aa, Brassica napus
  misc_feature (207)..(207): Xaa can be any naturally occurring amino acid
MEKTSSPESAPVSVKSPATTVGEMECSLFDESSIHDIDYFVKTIAQIKAKGVRPDLIGSIITHYASKWLPDLSDIFTTSPDGPNQQSQPQQLQSESFSVTAFVMKKRFYVETLIGIIPPEKDSVSCDFLLRLLRTANLVGADDSYRAELEGRVSGQLDQASLKELMIPSFSHTCGTLLDVELVTRAVKKFAGLDSEGVKSGASLVKXPKLVDSYLAEVAVDG

SEQ ID NO: 66756 - protein, 375 aa, Xanthomonas oryzae pv. oryzae KACC10331
MTPILFVDRDGTLITEPADYQIDAYEKLRFVDHVIPAMLKLRDAGYQFVIVSNQDGLGSESFPRASFDGPNNLMLQIFASQGIEFREVLIDCSWPSDNAPTRKPGVGLMVPYLQDRTIDWARSAMVGDRITDIQFAQNLNIRGFQLRTDEFGGEWDWPGIAHELADAPRRAVVQRNTKETRIRVELDLDRVAEPKTATGLPFFDHMLEQIGKHGGFALDIRAEGDLHIDEHHTIEDTGLALGQALREALGDKRGIGRYGFDPESSPWQVAGDTAQHGFTLPMDETIASAALDFSGRPYFVFDGQFKRDRLGDMPTELVPHFFRSICDASGVNLHLTVRGENDHHKVEACFKALARALRQAIRREGSALPTTKGAL

SEQ ID NO: 66757 - protein, 434 aa, Euglena gracilis
MLPRRLLVPLFQAARTRGYAEKILMPALSPTMEAGTIATWKKKVGDKLRPGDVLCSVETDKATLDFEWAGDEGIVAQLALEPGHEPVPVGTPIAVLADDESDLPAAKAMDLSQGTSKAAKSSPAAPAAAAPPSEAPAVKAPSSSPKSEGVKPEPYTSAKVRASPAAMAVFAKHIQGTGPNGRIVEADVEAFLKDAGSGKVAGAAATPAPSAAGTLPAQYEDTPASLMRKSIASRLTASKVEIPHFYLTVDVAVEKMKEMVAALNAGAKDKEYKITVNDFLVKACALACKKVPAANSQWHGDKIRRFHSVDISVAVATPTGLITPVVYNADLKGLKEISNDIRTLAALAREGKLTPEQYIGGTFTISNLGSYGVKHFTAIINPPQACILAVGAAQENGLMSVTLSCDHRVVDGAVGATWLQAFKGYVETPSSLLL

SEQ ID NO: 66758 - protein, 450 aa, Escherichia coli O157:H7 EDL933
  misc_feature (393)..(393): Xaa can be any naturally occurring amino acid
MTKHYDYIAIGGGSGGIASINRAAMYGQKCALIEAKELGGTCVNVGCVPKKVMWHAAQIREAIHMYGPDYGFDTTINKFNWETLIASRTAYIDRIHTSYENVLGKNNVDVIKGFARFVDAKTLEVNGETITADHILIATGGRPSHPDIPGVEYGIDSDGFFALPALPERVAVVGAGYIAVELAGVINGLGAKTHLFVRKHAPLRSFDPMISETLVEVMNAEGPQLHTNAIPKAVVKNADGSLTLELEDGRSETVDCLIWAIGREPANDNINLEAAGVKTNEKGYIVVDKYQNTNVEGIYAVGDNTGAVELTPVAVAAGRRLSERLFNNKPDEHLDYSNIPTVVFSHPPIGTVGLTEPQAREQYGDDQVKVYKSSFTAMYTAVTTHRQPCRMKXVCVGPEEKIVGIHGIGFGMDEMLQGFAVALKMGATKKDFDNTVAIHPTAAEEFVTMR

SEQ ID NO: 66759 - protein, 542 aa, Candidatus Pelagibacter ubique HTCC1002
MSHYDTNLDKNEANYVPLSPLTFLERTKDIYPNYEALVYESRSYTWEEVYKRCVKFASALDKLGVKTGDTVSIMAFNTPEIFEAHYSIPMVGAVINAINTRLDPNTISYILQHSDAKVLIVDRQFHDVIEKALKNVKNKITIIDIDDQDIDTSSFKRIGELEYESFLNTGNENYEWKKPKDEWEAISLGYTSGTTGNPKGVVYHHRGSYLMATGSVTAWNMPNKLNFLCVVPMFHCNGWCYPWTLAMLHARVICLRNIDVKKMFELIDKYEVTHFGGAPIVLNMIVNAPKEDQKALKRKVNVLTAGAPPPSIIFEKMENLGFEVMHVYGLTETYGHMLQCAWNDDWNSLEKDKKNEIKARQGVRYPNTEGAIVMDPETMKPAPKDGKTMGEIMIRGNIVMKGYYKDKEATDKSMAGGWFHSGDLAVTHPDGYIKIQDRSKDIIISGGENISSIEIENAIAKHPSVSLAAVVAKPDEKWGETPCAFVELIEDKPATEKEIIDFCRETLAGFKLPKSVIFCDLPKTSTGKIQKFELRKKVKELS

SEQ ID NO: 66760 - protein, 474 aa, Euglena gracilis
MFRQSFIQLAKHDLIVIGGGPGGYVAAIKAAQLGLNVACVEKRGTLGGTCLNVGCIPSKALLNASHHYHDAKHKFAGYGIDIPSVSMDIPKMQGTKAKSVTRLTGGIELLFKKNKVTYYKGFASLEGDKKVKVVGETTEVHEADKILIATGSEPIELPFLKFDEKVVCSSTGALDFQEVPAHLVVIGAGVIGLELGSVWSRLGSKVTVVEFMDRICPFMDADVGKEFHRILKKQGLQIKTSTKVVAGKVEGGQVILELESVDGAKKETLQANAVLVSVGRRPFTDGLGLDKVGVELNAKKFIVVDDHFKTNKDGIYAVGDVIHRGPMLAHKAEDEGICVAEMFAGKAGHINYDTIPNVIYTHPEVAWVGKTEEDLKKEGRKLKTSKFPFQANSRAVTNVDTEGFVKVVTDADTDRLLSMSIINSNAGEAIAEAVLAMEYSGSAEDIGRTCHAHPTLSEAIKEACMAAYDKPIHV

SEQ ID NO: 66761 - protein, 206 aa, Xanthomonas oryzae pv. oryzae KACC10331
MGSNDVATGDALVTLDWSKGDGLLPVIVQDADNLRVLMLGYMNAEALAATQQRGEVTFFSRSKQRLWTKGESSGNVLRVVSIETDCDADTLLVQARPHGPTCHLGRTSCFPSAPGQFLGSLDALVAERERERPHGSYTSKLFEQGIRRIAQKVGEEGVETALAGVVQGNDALLGESADLLYHLIVLLRARGLGLGDAVALLESRHT

SEQ ID NO: 66762 - protein, 397 aa, Solibacter usitatus Ellin6076
MHPCRKDTLIRNRVLTPDEVEAFRASIKSEVDQAAAEADSHPQPATSNLLAHIYSERTAPAIVRPTYLAEKPVTMIDAINHGLREEMERNPKIVMWGEDIADPKGGVFGVTRGLSSALPGRVFNAPLAEASIAGVAAGMAIAGYKPIIEIQFADYTWPAFMQLRNEIATVRWRSQGTWNCPVVVRIAAGAYIKGGPWHSACVEGVFAHIPGWRVLFPSCAEDAKGLIKMAARLEDPVIFLEHKGLYRKVQAQTNEPDSDFVIPFGKGRIARAGTDLTIVAWGYTVHLAQEAARQLEAQGKSVEVIDLRSISPLDEDLISRSVRKTNRVIVAHEDSLTMGFGAEVAARIAENCFEYLDAPVRRIAAADSFVPTAPNLEALTLPSVADLRVAAEELLGW

SEQ ID NO: 66763 - protein, 101 aa, Triticum aestivum
ISNMVGNVPSLKGGGAFWFTDLTTPDALCIFPMITSLFIMLTSELKYNASKKCKKCSRTMHKEAREALRVMSLLSMWLTATLPQAISCSLVTWEFSVLQKG

SEQ ID NO: 66764 - protein, 199 aa, Helicobacter pylori
MVKIGVCGPVGSGKTALIEALTRHMSKDYDMAVITNDIYTKEDAEFMCKNSVMPRERIIGVETGGCPHTAIREDASMNLEAVEEMHGRFPNLELLLIESGGSNLSATFNPELADFTIFVIDVAEGDKIPRKGGPGITRSDLLVINKIDLAPYVGADLKVMERDSKKIAAKSPLFLPNIRAKEGLDDVIAWIKRNALLED

SEQ ID NO: 66765 - protein, 512 aa, Medicago truncatula
MAGGVLPVDSTPVAVTAINIGGKLTLSIIITCIVAASGGLLYGYDLGVSGGVTTMVPFLQKFFPDILRKAASAEVNMYCVYDSQILTLFTSSLYLAGLVSSIAASKVTAAYGRRNVIIIGGALFIAGGAINGGSENIPMLILGRVLLGFGVGFTNQAAPLYLSETAPPKWRGTFNTGFQFFLGIGVVAAGCINYATAKHTWGWRLSLGLAVVPAAVMTIGSFLITDTPNGLVERGKIEQAKQALRKIRGSSVDIEPELEELIKWTEIAKSVQQEPFKTILKREYRPHLVMAFAIPFFQQLTGINIVAFYSPNLFHSVGFGHDGALLSAIILGSVSLLSNLISAGIVDRIGRRFLFISGGIMMLVCLIAVSIVLAVVTGVDGTKDISKGNAIVVLVLLCFYSAGFGWSWGPLTWLIPSEIFPVKIRTTGQSIAVAVQFIIIFVLSQTFLTMLCHMKFGAFVFYAFWVIVMTLFVIFFLPETKGIPLESMYTIWGRHWFWSRYVKGQEVLENLP

SEQ ID NO: 66766 - protein, 395 aa, Ehrlichia ruminantium str. Gardel
MLESHDFTFANMKKIQDFSCRGKTILLRVDLNVPVDDNKVVLDDTRIVRLTTTVKYLLSNNAKIVMISHYGRPKSYDREFSLKFLVEYLNKIFATNVLFVDGVIGSYVEQAVQSVPLGSVLLLENLRFYVEEEKNDLNFAKQLALLADVYVNDAFSCMHRKHASIDAVARLLPSFIGFNFQEELKYLSYVVSSSDKPVGVIVGGAKISTKIHMLRNLTQKVNFLILGGAIANNFLLSQGLKIGNSLCEKLDEDPFVDVINFAKKYGCEIIVPEDYLVTKDLVSNEAVVKNNQELAPDDIILDIGPHTINIITSIIGKCRTVLWNGPMGMFEKEPFSHGTFSIARLLAEFTKAGKLKSIVGGGDSICAIKLSGLLSEDFTYISTGGGALLHFLSLA

SEQ ID NO: 66767 - protein, 203 aa, Escherichia coli CFT073
MLTEQQRRELDWEKTDGLMPVIVQHAVSGEVLMLGYMNPEALDRTIESGKVTFFSRTKQRLWTKGETSGNFLNVVSIAPDCDNDTLLVLANPIGPTCHKGTSSCFGDTAHQWLFLYQLEQLLAERKSADPETSYTAKLYASGSKRIAQKVGEEGVETALAATVHDRFELTNEASDLMYHLLVLLQDQDLDLTTVIENLRKRHQ

SEQ ID NO: 66768 - protein, 364 aa, Candida albicans SC5314
MNFFRKKTEEDRDSSSSSLPRDDTASVSSKATSTSTNTTSKVELVKCYIPFEQPVNPIKAPDFELDKEQIEKYEKLVAYFEDYISKEIPVNDQHNATTHPLIEDELAWLTKECFLRYLRATKWKVDAAIKRIEDTIIWRRTFGVANIPNHTDPKKLITADLVSDENETGKQLIVGYDNDNRPCLYLRNGYQNTAPSLKQVQHLVFMLERVIHFMPPGQDSLALLIDFKAAPAELNLSSKFPSLSTSKQCLHILQSHYPERLGRGLFTNIPWIGYTFLKVVGPFIDPHTRSKTIYDQPFENFVPKEQLDKEFNGILDFEYIHDTYWPKMNEIADRKRANYMENFRRLGSKIGLSEYDLRLEQAAL

SEQ ID NO: 66769 - protein, 517 aa, Aspergillus oryzae
MEAPSLAVPQSRSPSTSSVDEIETTAEEEDSEDYCKGGYHPVTVGETYNNGRYVVVRKLGWGHFSTVWLSRDTTTGKHVALKVVRSAAHYTETAIDEIKLLNRIVQAKPSHPGRKHVVSLLDSFEHKGPNGVHVCMVFEVLGENLLGLIKRWNHRGIPMPLVKQITKQVLLGLDYLHRECGIIHTDLKPENVLIEIGDVEQIVKTYVKEEQKKDHKEDNRNGRRRRRTLITGSQPLPSPLNTTFDFKHSSHHSQSSLSQMINEESETAPSEKASMKEILGIKEEDEKQKQREKTADLLEREVSGISLNKSSKEAKDELECDIISVKIADLGNACWVGHHFTNDIQTRQYRSPEVILGSKWGASTDVWSMACMVFELITGDYLFDPQSGTKYGKDDDHIAQIIELLGPFPKSLCLSGKWSQEIFNRKGELRNIHRLRHWALPDVLREKYHFSAEESMRISEFLLPMLEIPPERRANAGGMASHAWMKDTAGMDAVDLGISPGSRGEGIEGWASEVKRR

SEQ ID NO: 66770 - protein, 335 aa, Fusobacterium nucleatum subsp. nucleatum ATCC 25586
MAVKVAINGFGRIGRLALRVMSKNKDFDVVAINDLTDAKTLAHLFKYDSAQGRFDGTIEVTDDGFVVNGDSIKVFAKANPEELPWKDLGVDVVLECTGFFTSKEKAEAHIKAGAKKVVISAPATGDLKTVVYNVNDNILDGSETVISGASCTTNCLAPMAKVLNDKFGIVEGLMTTIHAYTNDQNTLDAPHKKGDLRRARAAAENIVPNTTGAAKAIGLVIPELKGKLDGAAQRVPVITGSITELVTVLGKEVTVEEINAAMKAASNESFGYTEEPLVSSDIIGISFGSLFDATQTKVLTVDGKQLVKTVAWYDNEMSYTSQLIRTLKKFVEISK

SEQ ID NO: 66771 - protein, 362 aa, Anabaena variabilis ATCC 29413
MTQNYRITLLPGDGIGPEIMAVAVDVLKVVGQQFDIQFDFQEALIGGAAIDATGEPLPSATLDTCRQSDAVLLAAIGGYKWDSLPPHQRPEGGLLGLRAGLELFANLRPAQILPQLIDASTLKREVVEGVDIMVVRELTGGIYFGKPRGIFTTETGEKRGVNTMVYTESEIDRIGRIAFETARKRRGKLCSVDKANVLDVSQLWRDRITKLSQEYPDVELSHLYVDNAAMQLVRAPKQFDTIVTGNLFGDILSDAAAMLTGSIGMLPSASLGASGPGVFEPVHGSAPDIAGLDKANPLAQVLSAAMMLRYALNQPQAADKIEQAVLQVLEQGDRTGDIMSVGMNLLGCRAMGDSLIKALEKS

SEQ ID NO: 66772 - protein, 398 aa, Fusobacterium nucleatum subsp. nucleatum ATCC 25586
MKKIITDLDLNNKKVLMRVDFNVPMKDGKITDENRIVQALPTIKYVLEHNAKLILFSHLGKVKIEEDKATKSLKAVAEKLSELLGKNVTFIPETRGEKLESAINNLKSGEVLMFENTRFEDLDGKKESKNDSELGKYWASLGDVFVNDAFGTAHRAHASNVGIAENIGNGNSAVGFLVEKELKFIGEAVNNPKRPLIAILGGAKVSDKIGVIENLLTKADKILIGGAMMFTFLKAEGKNIGTSLVEDDKLDLAKDLLAKSNGKIVLPVDTVIASEFKNDIEFSTVDVDNIPNNKMGLDIGEKTVTLFDSYIKTAKTVVWNGPMGVFEMSNFAKGTIGVCESIANLTDAVTIIGGGDSAAAAISLGYADKFTHISTGGGASLEFLEGKVLPGVEAISNK

SEQ ID NO: 66773 - protein, 474 aa, Zea mays
HWAARRGGSTFSSRFAAFYLSHLPSTALSLPLLSRGNWAIAATPTQVFVGRFASRQVFVGPSPGLRPSILRRRAPTRGWELQRGTGSMAGGAGNGSNEAVQAKGSGGDSSAAKPLPPCCVKARAAAPESEAKCHATVVSGWFTEPRSHCGKASKVQYYNNPMWPGEAHSLKVENILYQGKSPYQEVLVFESSTYGKVLVLDGIVQLTDKDECAYQEMITHLPLCSIPSPKKVLVIGGGDGGVLREISRHSSVESIDICEIDQLVIDICKEFFPHLSVGFEDPRVQLHVGDAVEFLRNAPEGTYDAIIVDSSDPIGPAQELVEKPFFETIARALRPGGVLCNQAESMWLHTHLIQDMLSICRETFKGSVRYAWASVPTYPSGVIGFLLCAKDGPPVNFLTPVNPIEEVEGATKAGREIRFYNSEMHMAAFVLPTFAKRELEAYCASTETEQAEEVAATAPQKLTAAPKRGITTAS

SEQ ID NO: 66774 - protein, 199 aa, Brassica napus
MSSVSSQQQFRYTQTPSKVLHLRNLPWECTEEELIELGKPFGTVVNTKCNVGANKNQAFIEFEDLNQAIQMISFYASSSEPAQVRGKTVYLQYSNRQEIVNNKTAADVVGNVLLVTVEGEDARMVSIDVLHLVFSAFGFVHKITTFEKTAGYQALVQFSDAETATSARTSLDGRSIPSYLLPEEVSQCSLKITYSAHTD

SEQ ID NO: 66775 - protein, 184 aa, Triticum aestivum
QAIYLHSTAMAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 66776 - protein, 381 aa, Brassica napus
MSREGRDKKNKSEASTRSHTQARSSSDIFKTILLVVIVGSLAWFYKAIQPPPTGTVGSTGGASVTSPRIKLRDGRQLAYKEFGFPRDEAKFKIIYIHGFDSCMLDSPFPQFLSQALVEELRIYTVSFDRPGYGESDPDPNRSPRSIALDIEELADGLGLGPNFYVVGLSMGGEITWTCLKYIPHRLAGAALLGPVINYWWRNLPRDITREAFSLTSPADQWALRVAHHAPWLTYWWNTQKWFPFSNVIAGNPVIFSRQDMEVVSKLGGFRPNLAYIRQQGEYESIHRDLKVGFSSWEFDPLDLEDPFPNNNGSVHLWHGDEDRFVPVKLQRYIASKLPWIHYHELSGSGHLLPYVEGLTDKITKSLLVGEEEVPESREASA

SEQ ID NO: 66777 - protein, 232 aa, Munzothamnus blairii
GGRYSVCSAVGVLPLSLQYGFPVVEKFLKGARSIDQHFLSAPFEKNIPVLLGLLSVWNVSFLGYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVASHLVPHKTFTGNRPSLSLLLPSLDAYRIGQLLSMYEHRIAVEGFIWG

SEQ ID NO: 66778 - protein, 425 aa, Candidatus Pelagibacter ubique HTCC1002
MSEKILVPVLGESITEATVAKWLKKEGDTVVADEAIVELETDKVNLEVPSPIDGVLSEINSKDGETVEVGALLGMISQNGAQPSEKKIITKIEPKKTENNVVNLEIKKEAPKVLKEPEEEEPLVLTNEVKEEKTNSSNNNNEILSPAVRKIVVENKIDLKKVSGSGKEGRVLKGDLISMMGENPQPSERKIKYGQEERIKMSRLRQTIAKRLKQAQENAALLTTFNEVDMTGIMEMRKENQEDFQSRYGIKLGFMSFFVKACVAALKMYPSVNAEIDGDEIIYKNYYNMSFAVGTEKGLVVPVLRDTDQLSFADIEKNIKTISEKARDGKITIEDLQGGTFTISNGGVYGSMLSTPILNLPQSGVLGMHNIVERPMVVDGEIKIRPIMYLALSYDHRIIDGKESVSFLKMVKENLEDPRRLFLNI

SEQ ID NO: 66779 - protein, 283 aa, Zea mays
MGGWNRSRHVRWQRDRPRRPPLPPPDYGPEHCSVPLWEREFCSYVGNISWQRFCENKRYASVDNTLEHWDDSGALENFQNSKARFWAHYHGQPSDIPLPDPDMYIDKVDHRCRVDPELVADLDKVRVPFETDYSSGLATGSTDAGADNKRAQNQCGNWDIYVEKPSEVNRWEWEASSKPDLSWGAKNETSGVWGNGNSGWGDALEKPNWRGSSNDHYSSNNRNSGFFGGSSNRHQQEDPTHASGRKRNSGEYSQQWNSKHRRQDGRYQISSCRGRNDEWRPWH

SEQ ID NO: 66780 - protein, 466 aa, Candidatus Pelagibacter ubique HTCC1002
MSDKFQAVVIGGGPGGYVCAIRLAQLGLKTACIESRGSLGGTCLNVGCIPSKNLLNISENYHKAQNFSKLGIEVGEVKLNLQKMMQNKDKAITILTKGVEFLFKKNKVTYFKGTGSFKSANKISILDDQKKETIIETDKTVISTGSVPVALPGIEFDEKIIVSSTGALTLETVPKKMVVVGGGYIGLEMGSVWSRLGAEVHVVEFLEHITPGMDREISTEFMKILKKQGINFHMQTKVEGIKKNANGAIVSTSDKDGKKADFDCDVVLISVGRKPNTTNLNLEAIGVELDEKKRIKTDKTFQTNVENVYAIGDVIDGPMLAHKAEDEGIAVAENIAGQSGHVNYDIIPGVVYTTPEVASIGKTEEQLKEANTKYKIGKFSFMANSRAKAIDEAEGFVKILADEKTDRVLGAHIIGPHAGELIGEIGVAMEFGASAEDIARTCHAHPTFSEAVKEAALSVDKRAIHS

SEQ ID NO: 66781 - protein, 232 aa, Rafinesquia californica
GGRYSVCSAVGVLPLSLQYGFPVVEKFLKGARSIDQNFLSAPFEKNIPVLLGLLSVWNVSFLEYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVASHLVPHKTFTGNRPSLSLLLPSLDAYRIGQLLAIYEHRIAVEGFIWG

SEQ ID NO: 66782 - protein, 232 aa, Stephanomeria cichoriacea
GGRYSVCSAVGVLPLSLQYGFPVVEKFLKGARSIDQQFLSAPFEKNIPVLLGLLSVWNVSFLEYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVASHLVPHKTFTGNRPSLSLLLPSLDAYRIGQLLAIYEHRIAVEGFIWG

SEQ ID NO: 66783 - protein, 552 aa, Desulfitobacterium hafniense Y51
MRIIEGVGIMNDPVWYNCYEEGVPKRIEIENISLYEMFERSAKNFGQRPAIVFGGKTWTYTDMERDVDRLAKALSRLGVKPKDRISINMPNSATWMISFFAIMKVGAIVVQTNPLYVEGELKALMNDSGAIGMITVAPLYPRVQGIRQETSLKWVLVEGLKAMGLDEGEGTCDFHGCLNDDSEVEWSKPVIDPQTDIAVLQYTGGTTGTSKGAMLSHGNLYANAYQIWEWIKGSPGQEKSLCVIPLFHIYALSVCMNTSILGGSAVIPVPKFDADLILKLINDEKPTLYPGTPTMYVALINHPKLKEHDVSSIRACVSGSAPLPVEVALRFGELTGGKLVEGYGLSEASPVTHINPFPSARVGSIGTPVSNTQAKIVDIELGDKELPVGEVGELAVKGPQVMLGYWQRENETRAVLRDGWLYTGDLARMDEDGYFYVVDRKKDMIITGGYNVYPREIEEALYAHPAVREAICAGVPDSYWGEKVKAYVVLREEQQVTEEELLSFLKKELASYKVPKQIEIRDNLPKTAVGKVLRRFLVEEEKQKLEEHAQEA

SEQ ID NO: 66784 - protein, 577 aa, Solibacter usitatus Ellin6076
MRQSVIPIFVPVTKPRPLECRSYQTKCRGVAVLNSPMLNKGTAFTSKERKELGLTGLLPPEISTLGTQVKLAYIQYDRLPDTLAKNTYLTTLHAHNEVLFYRLFSEHLREMIPVLDDATLSLAAQRNHHECGQSRGVYLSIDHIDAMEEAFANLGADAGDIDLILTTDGEQVRGVGDAGMSGIERSLGKLAVYTAAGGINPNRAISVVLDVGTDRQDLLDDPTYIGNRHPRIRGKRYDAFLESYVTTTTRLFPHAMLHWENFAPGNGRRLLEKYGGQVCTFNDDMQGTGAITLAAAISAVRICGTPLRNQRVVILGAGTAGVGIADQICDAMAREGLSRQEAVRQFWFVDRQGLLTSNMTGQLRDHQVTFARPDVESRGWKQLHGGGIGLAEVVRQVKPTMLIGASSSSGSFTEPIIRQMAAHTARPIIFVLSTPPVRAEANPADLIAWTAGRALIATGSLFAPVTYRGLTYVVAQLNNAMVYPGLSLGAVVARARRISEGMFEAAAGAVSSLVTVRHPGASLLPHIDDLSSVSMTVAAAVAEAAVSEGLSRAPIDDIVQQVRDAMWQPEYHEIQAS

SEQ ID NO: 66785 - protein, 394 aa, Legionella pneumophila str. Lens
MHLKRTLSLTLLAFYGLGTILGAGIYALVGEVAKEAAQFTPLSFLIASIIAFFTAISYAELSSRLPLSAGSALYVRRAFQQRWLSGLIGWIVVLTGVISAATLSHGFVKYFQLFLPLPPSLIITILVVILAGVAVWGIRESATLILFMTLMEVGGLLMIIYYGRYSLASIDIQSFSFPHSFDGVLIGAFIAFYAFIGFEDMVNTAEETINPEKTLPKAIFLALISATILYVVVAWVIVSTIPSHTLVKTDMPLIEIIKLQGQSPLLFSIIALISITNGILVQIIMASRLIYGMANQQNAPQIFSFVYSKTQTPANSTLLVSLIILLFAYALPITTLAKLTSSIILCIFIIIHASLIKIKLTEKKSPEAISFPIVFPMISILLTLTFLGIQFFLK

SEQ ID NO: 66786 - protein, 355 aa, Vitis labrusca x Vitis vinifera
MVTSVAPRVESLSSSGIQSIPKEYIRPQEELTSIGNVFEEEKKDEGPQVPTIDLKDIESEDEVVRERCREELKKAAMEWGVMHLVNHGISDDLINRVKVAGETFFNLPMEEKEKYANDQASGKIAGYGSKLANNASGQLEWEDYFFHLIFPEDKRDMTIWPKTPSDYVPATCEYSVKLRSLATKILSVLSLGLGLEEGRLEKEVGGMEELLLQKKINYYPKCPQPELALGVEAHTDVSALTFILHNMVPGLQLFYEGKWVTAKCVPNSIIMHIGDTIEILSNGKYKSILHRGLVNKEKVRISWAVFCEPPKEKIILKPLPETVSETEPPLFPPRTFSQHIQHKLFRKTQEALLSK

SEQ ID NO: 66787 - protein, 511 aa, Oryza sativa (japonica cultivar-group)
MAAMDLRVAAPASVAAAARCGTSLARPWPARAVGGGGGGGGRGRRLSVRTSVATTEAAAAAVGASEDAALEARDSKTVVAVILGGGAGTRLFPLTKRRAKPAVPIGGAYRLIDVPMSNCINSGINKVYILTQFNSASLNRHLSRAYNFSNGVAFGDGFVEVLAATQTPGSEGKRWFQGTADAVRQFDWLFDDAKAKDIDDVLILSGDHLYRMDYMDFVQSHRQRGADISICCLPIDDSRASDFGLMKIDDTGRVIAFSEKPKGDDLKAMQVDTTVLGLPQDEAKEKPYIASMGVYIFKKEILLNLLRWRFPTANDFGSEIIPASAKEINVKAYLFNDYWEDIGTIKSFFEANLSLAEQPPRFSFYDANKPMYTSRRNLPPSMINNSKITDSIISHGCFLDSCRIEHSVVGIRSRIGSNVHLKDTVMLGADFYETDLERGELLAEGKVPIGIGENTKIQNCIIDKNARIGKNVTISNSEGVQEADRTSEGFYIRSGITIVLKNSIIADGLVI

SEQ ID NO: 66788 - protein, 206 aa, Thiobacillus denitrificans ATCC 25259
MTAKPVLNRAHFFTSVAQFRDLPPSRAEVAFAGRSNAGKSSAINLLTRKNRLAFTSKTPGRTQLINFFELTADTYLVDLPGYGYAKVPPEVKAKWEGLLSRYLQEREALAGMVLIMDARHPLTPLDRQMLEWFAPTGKPVHILLSKADKLSNSEKALTLRKVKQELADRETVSVQLFSSLSRVGAEEAAVRIEGWLAPEAAVHAPG

SEQ ID NO: 66789 - protein, 334 aa, Bacillus clausii KSM-K16
MSTVRNIALITSGGDAPGLNGAIAAIAQTPDVNLYFYHGGFDGIIEQDPIAISPTTAREAVQQGELLCFSGRSTHMLHEAGQKRVLEKLKQDCIDALIVCGGNGSAQGARSLSAGLPVAVVPMTIDNDIGGSEYTIGHDTAVNAIAESLHRLRQTAANLPGRIFMVETFGGRCGQLPLAAAVAASADIVLLPEYELNIDKFITEVNARSARGKSVIIVVSEGIYLNKRFSAGDQGVSFALARALEESTGKRVRLSILGYTQRAGDPTSYDCLMAKQMGQCAVDALLNGEKAMLVALKEGRVKAIPLTAIEQAPTLAKELLQLAFKENQLIQLEG

SEQ ID NO: 66790 - protein, 442 aa, Acinetobacter sp. ADP1
MLYSIFIAHQESWMVDQFDLEHIWHPYTSMINPLPTFKVKRASGVMIELDDGRQLIDGMSSWWCAIHGYNHPALNQAVKDQLEQMSHIMFGGFTHDPAIELAKILLKITPPSLDKIFYADSGSVAVEVALKMAVQYWTAQGQHQKTNFITTRSGYHGDTWNAMSVCDPVTGMHQIFGASLPNRVFVSAPKSRFDGEWDSSEMDEVEQLIQQHTQLAAFIIEPIVQGAGGMRFYHPEYLRQLKQLCEKYQLLLIFDEIATGFGRTGKLFAWEHAQVEPDIMCIGKGLTGGYMTLSATLTSQHVAEVISRGEAGVFMHGPTFMGNPLACAVALKSTQLLVEQDWQSNIRRIENRLQPLYQLAALAHVADIRTLGAIGVVELKHNVDMKTLQQQFVELGIWIRPFGKLVYVMPPYIISNDELDELIQKMMNVVRQLSCEAQHGIA

SEQ ID NO: 66791 - protein, 227 aa, Yarrowia lipolytica CLIB122
MSRRRAPVKSDRIEELGDEEVITRVETNVSYSTTIPTKKTASSNTTDNGFSLFDIIRSLGFLLFLGATLSYYITGTWAWGYETQLTNPAYLRHSFKHNILGAPYLNLTDDQLSVYDGTRAGEPIYVGVGGKVYDVSANPLTYGPGGPYHFFAGRDAARAFSTGCFQTDLTWDVRGLDPDTVAKDIRGWQRFFEKNKKYFYVGQVVHPEPSGEPPKFCQGQKMPGGRH

SEQ ID NO: 66792 - protein, 206 aa, Triticum aestivum
NKFVQKSRLVPVPNSRDIVDPRVRGRVRDWSTRTLTWTEGVENYSPFRTLFRRRRFEPPPNQQQSTGGAAMARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 66793 - protein, 558 aa, Triticum aestivum
  misc_feature (349)..(349): Xaa can be any naturally occurring amino acid
  misc_feature (445)..(445): Xaa can be any naturally occurring amino acid
MATTNWTLPDHPTLPKGKTVAVVVLDGWGEASPDQYNCIHVAQTPVTDSLKNGAPEKWRLVKAHGTAVGLPSDDDMGNSEVGHNALGAGRIFAQGAKLVDAALASGKIWEDEGFNYIKESFDKGTLHLIGLLSDGGVHSRLDQVQLIVKGASERGAKRIRLHILTDGRDVLDGSSVGFVETIEKDLAQLREQGVDARIASGGGRMYVTMDRYENDWSVVKRGWDAQVLGEAPYKFPNALEAVKTLRAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGXRTFACSETVKFGHVTFFWNGNRSGYFDETREEYVEIPSDSGITFNEQPKMKALEIAEKTRDAILSGKFDQVRINLPNGDMVGHTGDIEATVVACKXAADEAVKMVLDAVEQVGGIYLVTADHGNAEDMVKRNKAGEPMLDKSGSIQILTSHTLQPVPVAIGGPGLHPGVRFRSDIQTPGLANVAATVMNLHGFQAPADYETTLIEVVDK

SEQ ID NO: 66794 - protein, 135 aa, Triticum aestivum
  misc_feature (7)..(7): Xaa can be any naturally occurring amino acid
MGSLMAXGWDSPVLGDGTKARVTRNRSLTKEEVEAFWRQRGKPAPEDGGDVTSPLGSPGRPMEKSPLGSSQRSRSPASSPVSGVHEETIGAADAGKSRDWWTRSNWAFLNEPPQEERPGTAHTYTPQFHVAAGNA

SEQ ID NO: 66795 - protein, 232 aa, Stephanomeria guadalupensis
GGRYSVCSAVGVLPLSLQYGFPVVEKFLKGARSIDLQFLSAPFEKNIPVLLGLLSVWNVSFLEYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVASHLVPHKTFTGNRPSLSLLLPSLDAYRIGQLLAIYEHRIAVEGFIWG

SEQ ID NO: 66796 - protein, 287 aa, Zea mays
AGTAASLLAYFPYTRAQPQAVDRRMAPGGSGERWSLAGATALVTGGSKGIGQAVVEELARLGARVHTCARSAADLEECRRRWAEKGLRVTVSVCDVAVRADRERLVLDTVSAAFDGKLDILVNNAALLLLKPAAEWAAEDYARIMATNLESCLHISQLAHPLLLNASVAGGASIVNVSSIASVLGFPQEVMYSVTKGGLNQMTRSLAVEWACDRIRVNCVAPGVIMTDMGKELPAALVEQERSRIPLRRTGEPEEVASLVSFLCMPAASYVTGQVIFVDGGRTISGA

SEQ ID NO: 66797 - protein, 232 aa, Stephanomeria lactucina
GGRYSVCSAVGVLPLSLQYGFPVVEKFLKGARSIDQHFLSAPFEKNIPVLLGLLSVWNVSFLEYPARAILPYTQALEKLAPHIQQVSMESNGKGVSIDGVRLPFEAGEIDFGEPGTNGQHSFYQLIHQGRVIPCDFIGIVKSQQPVYLIDEVVNNHDELMSNFFAQPDALAYGKTPEQLQSENVASHLVPHKTFTGNRPSLSLLLPSLDAYRIGQLLAIYEHRIAVEGFIWG

SEQ ID NO: 66798 - protein, 257 aa, Legionella pneumophila str. Lens
MNFLNNKIVMITGASSGIGQACARLFAAQGARLILAARRVERLHELSSELKHHHNQEHYILPLDVCKKDLVRQQIESLPSQWNSIDVLINNAGLALDTLPLHQGILEHWDTMIDTNIKGLLYISRLLLPGMLERNSGHVINIGSIAGHECYPNGNVYSATKHAVHAISKSMRLDMLGSAVRVTEIAPGAVETEFSEVRWKDKQRAIDFYKDFQPLMAEDVADAALYCATRPLHVDIEQMIIMPTVQASANHLSRKGR

SEQ ID NO: 66799 - protein, 146 aa, Streptomyces kanamyceticus
MADYVRDVMTTGVVVVRPDASLVEAAQLMRAQDIGDVLVAVGGRILGVLTDRDITLRAVADGADPLTVSAQAICTPNPVVVTPDDAVSAAVDLMRDHAVRRLPVVEDGRPVGMVSLGDLALARDPSSALADISGADPDTWPDIARP

SEQ ID NO: 66800 - protein, 49 aa, Glycine max
KKSKSIVDLGDEEYKQMLCVDGAAVKKSITLRPGEEWTGRLELSVLPCS

SEQ ID NO: 66801 - protein, 794 aa, Oryza sativa
MSVSAAARHLESLLPRLASLRHYLQFHARLLTSGHLGAHPGLRARFLDRLALSPHPAALPHALLLLRSLPTPATNDLNAALRGLAASPHPARSLLLLAGRLLPALLPRPDALSLSFALKASARCSDAHTTVQLHALVLRLGVAADVRLLTTLLDSYAKCGDLASARKVFDEMTVRDVATWNSLLAGLAQGTEPNLALALFHRLANSFQELPSREEPNEVTIVAALSACAQIGLLKDGMYVHEFAKRFGLDRNVRVCNSLIDMYSKCGSLSRALDVFHSIKPEDQTLVSYNAAIQAHSMHGHGGDALRLFDEMPTRIEPDGVTYLAVLCGCNHSGLVDDGLRVFNSMRVAPNMKHYGTIVDLLGRAGRLTEAYDTVISMPFPADIVLWQTLLGAAKMHGVVELAELAANKLAELGSNVDGDYVLLSNVYASKARWMDVGRVRDTMRSNDVRKVPGFSYTEIDGVMHKFINGDKEHPRWQEIYRALEDIVSRISELGYEPETSNVLHDIGEEEKQYALCYHSEKLAIAFGLIATPPGETLRVIKNLRICGDCHVVAKLISKAYGRVIVIRDRARFHRFEDGQCSCRDYCGVWAIWFCVKLLGFQKHFIERCHVASSQGFVTFATVEGHDADFVFYTRQEIQDVDGEKDAGRAGETGMISYKIAAHAADLAKCHPYAQAWDDTLSKARFEFRWLDQFALYLDPVTTMSFHDETLPSERPKVAHFCSMCGPKSCSMKITEDIRKYADEHGYRIVEEAVIPGMNAMSAEFLAARKTISGEQHGEAGGEIYVPESYTARK

SEQ ID NO: 66802 - protein, 313 aa, Zea mays
  misc_feature (84)..(84): Xaa can be any naturally occurring amino acid
MATPLDVPLDDLIKSRAGRGTGRGRGQGGGRGRGDGQRLARGSWRGRGTGNFRERGLGVSSRRPLGVNTWSSSFAIAKASTQLXTSFNKAKDFVWRHDLFEDSMVAAGLSGIESGTKLYISNLHYGVTSEDLQELFSEMGHLKHCAVHYDSYRHPTGSAEVIFTRRSEALAALKRYNNMRLDGKAMKIEVIGAELGLSAAAVPQISVVPGASRRGQREVVMMPGGSGFGQGASGPSSSLPGWKRGGFVRRGQGRVSFPQRGRGQVRSRGRGRGRSSFVQSRGRGYVRRGNAEKSAKQLDKELDNYNSGAMNVD

SEQ ID NO: 66803 - protein, 470 aa, Ehrlichia ruminantium str. Gardel
MFLSAEDTLNYIKKNTINFVDLRFTDSTSRWHHITRNAETIDTYVLSSGVNFDSSSIPGWQSVEKSDMILLPDVSTAFVDPFTAQPTLVIICNVINPYDKSEYPKDPRYTAHKASQYMLSTGIADKCYFGPEVEFFVFDNATFYNGMYHSYFKIESSEHISQFQKREHINNSHCPKIKGGYMPTPPVDSLHDLRSEILTMLKEVGITPLIHHHEVAASQCEVGFQHDELIRSADNVQKCKYIIHGVASSYGKTATFMPKPVIGDNGSGMHCHQSLWKDNINIFVNSDGSMSEICLYYIGGIIKYGKAINAFTNPSTNSYKRLVPNFEAPTWLTYSYENRSSAIRIPYVPNTDLNAKRIEVRFPDPLANPYLCFSAQLMAGLYGIKNKIHPGPSIDKNLYTLDKKELQSFISVANSLEESLYALDNNREFLLEGDVFTNDQIDTYIKLKSSEARDLHLHPHPIEFINYYSS

SEQ ID NO: 66804 - protein, 466 aa, Escherichia coli O157:H7 EDL933
MDQKLLTDFRSELLDSRFGAKAISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKEGEDPGYTLYDLSERLRLRGWQVPAFTLGGEATDIVVMRIMCRRGFEMDFAELLLEDYKASLKYLSDHPKLQGIAQQNSFKHT

SEQ ID NO: 66805 - protein, 946 aa, Magnaporthe grisea 70-15
MDDDDKSKVQLVDKEGRAEPEVNGNGIVKMETQNSATDSAQRSRSPSSMLRDGETQTVDDGDKISPRNASPDAKSTRKNPQQLPMRTSKLFSHLADVTEEASRGFAILSDCVYASKALGNSGQETLDCDCEEDWRDGLNHACAEDSDCINRVTKIECVSGNCGDGCQNQRFQRKQYANVSVIKTENKGYGLRADANLEPNDFVFEYIGEVIGEELFRSRLMKYDTQRLEHFYFMSLTRTEYVDATKKGNLGRFCNHSCNPNCYVDKWVVGDKLRMGIFAMRAIKAGEELCFNYNVDRYGANPQRCYCGESNCSGILGGKTQTERTTKLPLAMIEALGIDDGDHWESSVRKPRKKKAGESEEEYVGSIQPRKLEDGEVGVVMSTLRSCKEKWVATKLLHRILAVDEERVLNRVVKFHGYEYLKTTLNTFKDDNEVVFQVLSILYKLPRVTRNKIDDSNIEPLITELSNSKHEEIAAESKKLLEVWKTLQVGYRIPRAKADRSARDNAGSFFDDRRQQAREAASAPLPRAPSPVRNAPTGPRSSMPQRNPHYVPPRRKYPQQPPRDAPALPSGWRSAIDQRTGRQYYWETANPDKKSWVRPTSEMAKANAALQAQKIQDIINQCAQPTPKPSSATHTPQPVGTPVAEPKRETWRSWPADKQRRLYENTIFPHIKYVADKYYKRLPKEDLKKFVKDVNKTLAASDYKHGRVNDPSKVEEKQQSKIRKYTRDFLDKAVKKHELRQAEKASANNKSLEDGAAEPSGSTLSGAAEGSKKSPPGTDARVQSTNDSAPRSADSPDSSATDLKRKRGESHDVENVEGAAADLTPGYTPLAKRVKETDVEEPSPPPPPPTPPPLDELDDAVMIEEATEGRRLREHEDELRLENEEAHRLQQDAVEQKRLREHEEALERENQETLLALQTDQRGPEPDGDTPMANNVNGTKMGTVMV

SEQ ID NO: 66806 - protein, 232 aa, Stephanomeria tenuifolia
GGRYSVCSAVGVLPLSLQYGFPVVEKFLKGARSIDQHFLSAPFEKNIPVLLGLLSIWNVSFLEYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVASHLVPHKTFTGNRPSLSLLLPSLDAYRIGQLLAIYEHRIAVEGFIWG

SEQ ID NO: 66807 - protein, 370 aa, Cryptococcus neoformans var. neoformans B-3501A
MANILKRSALKLGMIPADGIGKEVLPAAQRVIEALGSSIPKTTFVPLVAGWEEFNKNGKALPDDTVSALRECDGAMFGAVSSPSHKVAGYSSPIVALRKHLDLYANVRPVSSVPIPGQPSAKAVDLVIVRENTECLYIKQEEISGEGEDRVALATRKISAKASSRIGRMAFEIALRRGQEREAARAAGKDVWWKGEPKVTIVHKSNVLSVTDGLFRETVRAVKEGKGGEKYAGVKLEEQIVDSMVYRMFREPEFFDVCVAPNLYGDIISDGAAALVGSLGLVPSINAGDNFIMGEPVHGSAPDIEGKNIANPIASIRSAALLLSSLGYIEPAAKINAAVNAVLVEGQYLTPDLGGKSSTTEVTEAVLKRL

SEQ ID NO: 66808 - protein, 411 aa, Streptomyces hygroscopicus
MTDHTGALRLDNSMKLLARGRLVDATLSEKDYVIERDRLVEGAYPVYGERARGARVWDADGNEYLDYILAYGTIILGHADPAVTKAAQQEIEEGFSITLRKRTHIELAERLVRIIPGAERVFLLKTGSDATSAAVRLARAYTGRDRVVRWGYNGWHDWAAQRPGGIPDTVRTQVDTFRYNDLDDLREVFRRHAGQVACLLLMPFELDSPEPGFLQGAIDLAHEHGALVVFDEMRSGFRVALGGAQELYGVRADLATFSKAMANGWAVSALTGRAEVMAMVGQTHISSTFYSNTVSMAAAVATIDQLADGTVLDRVRRLGVRLQSGLTELVGRHGVPARVRGVPQMPFLAFTHPDPGRSRAMQDAFFAETTRRGVLLHPTHHWFVCAATTDADLEHTLAACDAAFEVAAKVA

SEQ ID NO: 66809 - protein, 232 aa, Stephanomeria tenuifolia
  misc_feature (54)..(59): Xaa can be any naturally occurring amino acid
GGRYSVCSAVGVLPLSLQYGFPVVEKFLKGARSIDQHFLSAPFEKNIPVLLGLXXXXXXSLLEYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVASHLVPHKTFTGNRPSLSLLLPSLDAYRIGQLLAIYEHRIAVEGFIWG

SEQ ID NO: 66810 - protein, 195 aa, Saccharum officinarum
IGSTGYGLGGSSMALFGRVGGGIYTKAADVGADLVGKVERNIPEDDPRNPAVIADSVGDNVGDIAGMGSDLFGSYAESSRAALVVASISSFGIDHEFTPMLYPLLISSVGIIACLITTLFATDFFEIKAVDEIEPALKKQLIISTAVMTVGIALVSWLGLPYTFTIYNFGVQKTVYNWQLFLCVAVGLWAGLGSY

SEQ ID NO: 66811 - protein, 291 aa, Desulfitobacterium hafniense Y51
MALNRIMTAMVTPFNDKMEVNYPEAEKLANYLIEHGNDGIVVCGTTGESPTVSAEEKIELFRTVKKAVGSKATVIAGIGSNTTDGSINLARQAEKTGVDGLMAVVPYYNKPSQEGLYQHFRAIAEAISLPLMVYNIPGRTSINLLPETVLRLSEIPNITSIKEAAGSMDQVSEMRRILPEDFLIYSGDDSLTLPMLALGCDGIISVAAHLVGDEIKQLVDAWFNGEPQTALQWHLKLMPMFKGVFVTTNPVPVKYLLKKAGINAGGVKLPLVCAAPEEEAFLDDLYQKIKG

SEQ ID NO: 66812 - protein, 462 aa, Cryptococcus neoformans var. neoformans B-3501A
MPRVIKPSKPRHDPLHLELEGDESIRKFGRVTKPGKRKAKKEEADDDEPKAEDARMSKKILDLARDQQEEVARELGQDDDWEDEDEAEAEPSRRPRDIAQLPSDDEEEEEFSDGEISGGEEYAELHIDPEDHATLDALNRGNGTVPMGQDQGEEDGEPKTLADMIFSKMQGGAVSRGVVDEHEGPPDPRKGLNPKVVEVYSKVGFLLSRYKSGPLPKALKILPSLPHWAQLLALTKPTEWTPHATFACTKIFVSNLKPTEVRVFLEGVLLDKCREDMRMNNGKLNVHLYEALKKGLYKPAAFFKGILFPLCETGCSLKEAAIFASVLSKVSVPVLHSAAALLRLASMDYSGPNSLFIRILLDKKYALPYKVVDALVFHFIRLANSPRSKDGEDKLPVLWHQSLLVFVQRYASDLTPDQKDALLDVIRARPHPTISSEVRREIVNSVERGAPRPEDGEDVKMQ

SEQ ID NO: 66813 - protein, 322 aa, Thermoanaerobacter tengcongensis MB4
MDKFWNDNLEVKEELVEVVKIMKKRVKSSNKLISDILLDMVNNSGKMLRPAFVIISAKFGNYDRKKILPLAAAIEMLHMATLVHDDIIDNALIRRSKPTIQAEYGKDYAVFIGDFLFSQSFLLLSDNINVANLKKVSKVVSRICKGEIDQFESRYDINITINDYLKRIAAKTAALFALSFYVGAYESNCGEELAKILGSIGYNIGIAFQIIDDILDYTGEESVVGKPLCNDIRQGVFTLPLIYSLERNRDEKIISLIKKRNYCEDDIKRIVAFVQQNGGITQSKMLAEKYTKKAFDKIAMLKDSPPKQILIDVTTKLLYRNY

SEQ ID NO: 66814 - protein, 769 aa, Arabidopsis thaliana
MFAASCLASCCAACACDACRTVVSGISRRSARIAYCGLFALSLIVSWILREVAAPLMEKLPWINHFHKTPDREWFETDAVLRVSLGNFLFFSILSVMMIGVKNQKDPRDGIHHGGWMMKIICWCILVIFMFFLPNEIISFYESMSKFGAGFFLLVQVVLLLDFVHGWNDTWVGYDEQFWYAALLVVSLVCYLATFVFSGFLFHWFTPSGHDCGLNTFFIIMTLIFVFVFAIVVLHPTVGGSILPASVISLYCMYLCYSGLASEPRDYECNGLHNHSKAVSTGTMTIGLLTTVLSVVYSAVRAGSSTTLLSPPDSPRAEKPLLPIDGKAEEKEEKENKKPVSYSYAFFHIIFSLASMYSAMLLTGWSTSVGESGKLVDVGWPSVWVRVVTSWATAGLFIWSLVAPILFPDLSFVDMKLTVKTLKGSHFEIRVLPTDTIMAVKKNIEDSQSKDNYPCGQQLLIHNGKVLKDETTLVENKVTEEGFLVVMLSKSKTASSAGPSSTQLAAPSTTQSIAVPASNSTPVQEQPTAQSDTYGQAASTLVSGSSIEQMVQQIMEMGGGSWDKETVTRALRAAYNNPERAVDYLYSGIPETVTIPATNLSGVGSGRELTAPPPSGGPNSSPLDLFPQEAVSDAAGGDLGTLEFLRGNDQFQQLRSMVNSNPQILQPMLQELGKQNPQLLRLIQENQAEFLQLLNEPYEGSDGDVDIFDQPDQEMPHSVNVTPEEQESIERLEAMGFDRAIVIEAFLSCDRNEELAANYLLEHSADFED

SEQ ID NO: 66815 - protein, 175 aa, Brassica napus
SLKYMLLCKIMVSQADDVAGIISSKAGLQYVGPDLDAMKAVADAHSKRSLKLFENALRDYKAQLEDDPIVHRHLSSLYDTLLEQNLCRLIEHAWARVEIGHIAELIGLPVDHVEKKLSQMILDKKFAGTLDQGAGCLIIFEDPKADAIYSATLDTIANMGKVVDSLYVRSAKIMS

SEQ ID NO: 66816 - protein, 406 aa, Ehrlichia ruminantium str. Gardel
MFVEVLMPALSPTMTSGIIRKWYKSEGEEVKSGDIIADIETDKAVMEFEYTDEDGIMGKIIVAEGTKNVLVNQLIALIVTDKLDLKEIDTYVSSSTASKTEKASVVLQGEEEIKNDVVTISEPKRIKISPLAKKIASDFAIDINSIQGTGPYGRIVKADVLDAASKKENNVEIIPTSNGENTFIEVSSMRKVIAERLVYSKQMIPHFYVSVDCKVDDLLKVRLEINAENFGTKITINDFIIKAVSMSIKKFPEINVSWDDNDKIIAFANIDISVAVSIDDGLITPIIRNADKKSLLEISNEVKMLASKAKTGKLKPEEFQGGGFTISNLGMFGIKEFNAIINPPQSCIMAVGCSDKRAIIVDDQICISNVMTVTLSVDHRVIDGVLAAKFLNCFKSYIEKPYLMLI

SEQ ID NO: 66817 - protein, 306 aa, Ashbya gossypii ATCC 10895
MTAVNYTKEKKVGEGTYAVVYLGHRQTDGRQIAIKEIKTSQFKDGLDMSAIREVKYLQEIRHANVIELVDLFMAQENLNLVLEFLPADLEMLIKDSSLLFTQADIKSWLLMTLRGVHHCHRSFILHRDLKPNNLLLAPDGQLKIADFGLARTLAAPHEFMTSNVVTRWYRAPELLFGARHYTAAVDLWSVGVIFAELMLRIPYLPGRDDVDQIDVTFRALGTPTDKDWPEVSSFSAYNKIQVYPPPSRSELRSRFIAATENALDLMCGMLTMDPHKRWDTTRCLLSQYFVELPEATPPTELPKLNK

SEQ ID NO: 66818 - protein, 534 aa, Aspergillus oryzae
MSIKSGKDDTIMYQARSDLDEEDPGSQAGSIDPLAAPLKRRLKSRHLQMIAIGGIIGPGLLVGSGNALNKGGPAGCLISFSLVGLIVFFVMQSLGELATAIPVSGSFTEYAQRFVDDALAFGLGWAYWYLWVTILASEYNAISLVIGFWTDAVPQWGWILIFWVLFLGLSNLGVLAYGEMEFWLSLIKVLALLAFFILAICISTGGVGPGPIGFKYYHDPGAFADSINGVARTFVVAGTLYAGTEMVGVTAGESANPQKAVPTAIKQVFWRILIFYIGTFFFLGILLPYNHPKLLSSTSTAASSPLTIALTDAGILPAAHLINALIVISVISAGNGSLYVASRTMLFMARNGKAPRFIDRTNSRGVPWVALIFSNIFTCIVFLTLSSSAGRIYSALITLAGVATFVVWAVICIAHIRFRKAMVVQGDDPSRLPFRAALYPYGTYFALGATIFLVFFQGYTAFLNPFSVDDFIINYILLPVFVMLVVGYKIWNKTKIVKLEEMDIWTGRRVAVIDETETGKEHGWLAKLKDIIIG

SEQ ID NO: 66819 - protein, 533 aa, Triticum aestivum
MVHPLHGIHELLLQARSPQAALVVSLLLFCPLLVLLVARRFRTPSTATATARAREDQLSKLPSPPSRLPIIGHLHLVGPLPHVSLRDLASQHGRDGLMLLRLGAVPTLIVSSPSAAQAVLRTHDHVFASRAYSPVTDILFYGSTDVAFCPYGEHWRQVKKIATTHLLTNKKVRSYRHARENEVRLVVAKIREAATTGAAMDLSDLLNAFTNDIVCHAVAGKSFRKQGHNKLFRELVEANSSLIGGFNLEDYFPVLVKLDFIKRMVCAKAQKVNKMWDELLNSLIDEHASRPTSEQGGDDSDFIDVLLSIQQEYNLTRDHIKAQLEIMFEAGTDTSFIVLEYAMVRLMQKPHLMNKLKNEVRSTISKGKDMIAEDDLSSLAYLKAVIKETLRLHMPAPLLVPHLSMADCKINGYTIPSGTRAIVNSWALARDPSSWESAEEFMPERFMEGGSAATMDYKGIDFPYLPFGTGRRICPGINFAIVTIEIMLANLMYHFDWKLPSESMEAGISMTESFGVTVHRKEKLLLVPVVPEG

SEQ ID NO: 66820 - protein, 511 aa, Prochlorococcus marinus subsp. pastoris str. CCMP1986
MSFVITTPLYYVNDKPHLGSIYTTLICDSIARYKRLTGADVIFITGVDEHGLKIQRTAKNKGVEPQFHCDEISDIFKQNWKNWDITHNKFVRTSSQKHEYIVKEFYNRVKKSDDIYMGVQKGWYCVGCEEFKDNPDNSPTHKCPIHQKTLEWKNEENLFFKLSKYQSQIEELIKEPAFIQPKERRNEIINFVSKGLKDFSISRTNVSWGISVPDIDNHTFYVWFDALLGYVSAISLDMKEPSLDESIDNGWPADIHLIGKDILRFHAVYWPAMLISAGMKVPKKVYGHGFLTREGQKMGKSLGNVLDPDILLSKYGKEAVRWYLLKDITLGQDGDFQNKRFVDIINNDLANTIGNLLNRTSSMSRKWFDNRVPSNEMLSKDNSLELYAKKTVENYFRHFNSYELDLAANVILSLAINTNLYLNEKQPWTLIKDEKNIPLVSNIIYNVLESTRIVGLLLLPILPNLSSKIDQQLGLLYNEKGSWKKQLDWGKLIHESILPAPNPVIEKLEYE

SEQ ID NO: 66821 - protein, 188 aa, Zea mays
MAAASVSTPQGVAERRGIPAAAFVEDVEAYLRQVGLDVNSALAFLQERLQQYKIVEMKLLAQQRDLQAKIPDIEKCLDIVATLQAKKDLGEALIADFELSEGIYSRAKIEDTDSVCLWLGANVMLEYSCDEANALLKKNLENAKASLEVLVADLHFLRDQQTITQVTISRVFNWDVHHRRSKQAVKET

SEQ ID NO: 66822 - protein, 357 aa, Kluyveromyces lactis NRRL Y-1140
MSEWKVDPDNRRRLLQLQKVGGNKKCLDCGAHNPQWASPKFGVFICLECAGIHRGLGVHISFVRSITMDQFKSDELVRMENGGNDKFTEYLEDHGIDSSLPQKLKYDNVIASDYKDKLTAICESKEWEEPDRSDFDPTQLTATNSRSGTPQLNGSLSEKLGSEEAVNQKEKNESYFATLGEKNLQKPEHIPPSQGGKYQGFGNTPIIQHKKGNQAEPGSTTLTLENFQKDPLGTFTKGWGLFSSAVSKSMEEVQESIIKPNVEQFSQKDLSEEAVRAAKQFGQKFQESSSYGLQALNSFTKGLQQQLQETQDGPATSSQYTKLFDGADATSTTHTQAPAQNKTSEKKISGEDGWEEF

SEQ ID NO: 66823 - protein, 245 aa, Brassica napus
MAEVVVHIYDVTNTGSDKTNNTILQINRIFKDGIGLGGIFHSAIQVYGNDEWSYGYCEQGTGVFRCPSSKNPMYTYREKIVLGRTDCTIFMVNQIFRELTREWPGHTYDLLSRNCNHFCDVLCDRLGVPKLPGWVNRFAQAGDTALEVAETTAMRLKQAKTELLSASKVAYRFLSNVTSSVTNSTNGSPQQPGTVNNSDNGNLRMQGTWLKGMLNTSKPSTSTEIENTDEDANHDSEVLQFQHQP

SEQ ID NO: 66824 - protein, 943 aa, Bacillus cereus G9241
MVIAAALSLPFAVYSTPALAAVAIETNKTGQGLEDGTYDAVIKAYKDKTNEESMAAVYIKNPKLTIENGKKIVTATLSDSDFFQYLKTEDIHTPGVFHDVKVISEDKKKNGTKVIQFEVGELGKRYNMQMHIYIPTMAYDNKYQVQFEVNTLNLENNVPEEQKENKEDKVDQQDENGNVILDKQLQRYINKYNLDRDNIDAPITKKDLLQIKTLSIYSGKGINEIAGLEYMTNLEKLTLRESNVTDISAISKLRGLKYVDLTSNSIESIHPIGQLENINMLFLRDNKISDLTPLSKIKKIKTLDLIGNNIKDIQPLFTLSTMKQLYLANNQISDLTGIDRLNNVKLLWIGNNKINNVESISKMSNLIELEISDSEIKDISPLSQLGNLQMLNLEENYISDISPLSTLTNLHEVNLGANEISDVRPVEELGKRISIDIQRQKIFLNEASVDEEIKIPVYNLKGEPLQNINLQSEGATLNNGFIKWNSPGEKIYEFKLDTNSTESKIRFNGTVIQNIVEKQKESQNVILDKTLQQHINKENLGRENVNAPITKEDLLQIKKLEIFKEKGNEIKDITGLEYMTNLEKLTLEGVGLKNIEFISNLKQLNNVNVSHNQIEDITPLSSLENLQWLNLTGNRIKDVSVLGSMLDLLSLKLAENEIRDVRPLIQLGQWGTIDVRRQKVILDDAEINKEVIIPVYDLEGEPIEKITLKSEGGTLTDEGIIWSTLGEKIYEFDLDADHYETGILYSGIVMQNIVEKLIPKEEVDEPTKEVEEEKEEVDEPTKEVGEEKEEVKEPTKEVEEEKEEVKEPTKEVEEGKEEVKEPTKEVKEEKEEVKEPTKEVEESKEEVDEPTTGVEGSKAKVKETGKEIEGSKDAVNQSAVVQEQNVNNQVVKENKPAVNKQEESKKSLGATGGQENTSTLLSGIALVLSAMSMFVFRKRLFKK

SEQ ID NO: 66825 - protein, 250 aa, Leptospira interrogans serovar Copenhageni str. Fiocruz L1-130
MDMSFRDHFSSHSSFYSEFRPGYPKDLFYYLKNLSPHGKTVWDCGTGTGQAAVPLGELFEKVIASDPSENQIVNAEPHQNVEYRVCKAENSTLGNHEVDLITVAQAFHWFDFNPFYKEVIRVGKKKGILAIWGYGLHSISSEIDGLVDKLYGEIVGPYWPSERKYVEEKYKTIPFPFEEIVPPHFSMKEEWNVDQLLGYLRTWSSVQKYIQKNESDPVLLVEEYIRNSWGPTQTKIVEWPLFFKIGRLPD

SEQ ID NO: 66826 - protein, 313 aa, Oryza sativa (japonica cultivar-group)
MAAKAVMLALLVLVSTAQVSMGARRRMELYKPDPADMLSYHSGAVLQGNIPVSIYWYGKFTPAQKSILFDFLLSLSVAPYAAAPSVAQWWSSIDELYLSKAVQTNSNGQSKKTQVLVASQVSDINCSMGKSLTLAQVAALAAQAKPKKGGIALVFTAQDVTVEGFGMSRCGLHGSDAKSGTAYIWVGNPATQCPGECAWPFHQPMYGPQGAPLVAPNGDIGADGMVMNLASMLAGTVTNPFGDGYYQGSRDAPLEAATACPGVFGSGAYPGFAGELKVDQATGASYNANGANGRKYLLPALYNPSTGTCNTLV

SEQ ID NO: 66827 - protein, 128 aa, Glycine max
  misc_feature (93)..(93): Xaa can be any naturally occurring amino acid
MAPMLKRIAEDEPKKAAYVTFLAGSGDYWKGVVGLAKGLRAVKSAYPLVVAVLPDVPEDHRQKLLAQGCVVREIVPVYPLESQTQFAMAYYVXNYSKLRIWEFVEYERMVYLDADIQVYDNIDHLFDL

SEQ ID NO: 66828 - protein, 521 aa, Magnaporthe grisea 70-15
MPPPPNRFPTGPTTISPYQHQFPPHGQGHAGGHPPPLGNPAYINPNAQLNPFAANGALSLAAGLNAASGFGAHDASGLGSHAARLGFSQGATLQQHHQQQQQQHHPQQSHGVMVDHPTRNQTKGRIREVWKHNLHEEMAVLRDLIERYSYISMDTTFPGVVCRPMGSFRSKRDYHYQCLRANVDMLNVIQIGITLFNEDGENPPARPNSTDVAELLGAAGRRSAQQGPLPYTWQFNFQFSLKDDMYSQSQIESLLQAGIDFVALERDGINPKEFASLMISSGMVCDESISWISFHSAYDFGYLLKLLWCNMLPEDQDEFKQLLRLFFPNVYDVKYFMKHQMKPLNAIGFQGIDGAIVDALQKFDHKSTLETLAEVLKVKRTGPAHQAGSDSLLTGRAFFQMREKVFGGKLPEDILGQVWGLEDSEPGPSMSLASANAAAAANQGESGANGTQGHHLQHHQQQQQQNGPSTPNTVSASLVTTPGAVSHSHNTNGMGAAGMGPMTPGGGGGAFGHFAFSSHQR

SEQ ID NO: 66829 - protein, 596 aa, Thermoanaerobacter tengcongensis MB4
MGNNKKIVIIGAGYGGLHAAKLLNKKLKNNPDIEVTLIDKKPYHTLLTDLHEVAGSRIEPDSVRIYLHKVFAGKRVNIILDEIEKIDHEKQQVIGKKGAYQYDYLILGIGSEPCDFGIPGVFEYGFNVGSLEAAIRTREHIEEMFRKASVEKDPDEKKKMLTFVIAGAGFTGIETAGELMEWTKSLCDKYNLDRSEIKIMVVEALNTILPNLNAKLAIKAQRFLNKKGVEVLTNSPIVEVARDYVVLKDGRKIETKTLIWTCGVQGNKCVENFGLELNRRCRVQTNEYMQAVGKENIYVIGDLAYYEIDGKPIPQVVETALQSAETAVHNIVADIKGEEKKPFKPKYHGFMVSIGSRYAVAELMGVSLTGFLAMAIKHLVNMHYLFGVAGIDAVLSYIYHEFFEVKNNRSILGGHIAAHVPTFWLVLLRIYVGALWLIEGINKIQQGWLDPSKIFIITASDVSGATANATSGATAVQTLQPLLKEPPAFYKWFMDTFVVPHAFLFQVMVVLAEVAIGLALIAGLFTFLASAGSIFLALNFILSAMADKSILWYIFAAIALMGGAGRSFGLDYYVIPWIKNWWKKTTFARKTYLYIS

SEQ ID NO: 66830 - protein, 249 aa, Thermoanaerobacter tengcongensis MB4
MYKVVLLRHGESIWNMENRFTGWTDVDLSPKGIEEAKQAGKILKEKGFTFDAAFTSVLKRAIRTLWIVLDELDLMWIPVYKSWRLNERHYGALQGLNKAETAKKYGEEQVKLWRRSAEVRPPALTKDDPRYPGNDPRYADLSEDEIPLTENLIDTINRVIPYWESTIAPTIKSGKRVIIAAHGNSLRGLVKYLDNLSNEEIMELNIPTGIPLVYELDENLKPIRHYYLADEEELKKKQQEVAEQGKARA

SEQ ID NO: 66831 - protein, 232 aa, Stephanomeria exigua subsp. coronaria
GGRYSVCSAVGVLPLSLQYGFPVVEKFLKGARSIDQQFLSAPFEKNIPVLLGLLSVWNVSFLEYPARAILPYTQALEKLAPHIQQVSMESNGKGVSIDGVRLPFEAGEIDFGEPGTKGQHSFYQLIHQGRVIPCDFIGIVKSQQPVYLKDEVVNNHDELMSNFFAQPDALAYGKTPEQLQSENVASHLIPHKTFTGNRPSLSLLLPSLDAYRIGQLLAIYEHRIAVEGFIWG

SEQ ID NO: 66832 - protein, 351 aa, Myxococcus xanthus DK 1622
MRANVFQAVNRFGIEEVERPRAGAGEAVIRMTMTTVCGTDLHIVRGEYPVRPGLVIGHEPVGVIEELGPGVTDYRPGQRVLVGAITPCGQCRACLSSHLSQCGHGAGYEALGGWRMGNTQDGAQAEYIRIPAAQANLAPIPDGLTDEQVILLSDIASTGFSGAEAGSVRIGDAVVVFAQGPIGLCASIGARLMGASLVVGVDGDEARMKMAQRMGVDVVLDHRQQDVVAEVKRLTGGGADVAIEALGTQQTFESALRCLRPAGTLSSLGVYSGKLQLPYDAFSAGLGDYRIVTTLCPGGKERMRRLMDLVHHKRVDLSPLITHRFKLADIQEAYALFGERRDGVFKVAIQP

SEQ ID NO: 66833 - protein, 515 aa, Salmonella typhimurium LT2
MMDHNMKKNPVSIPHSIWPADDIKRLERDAADAFGLTLYELMLRAGDAAFRVARDSYPDTRHWLVLCGHGNNGGDGYVVARLAQAAGISVTLLAQESDKPLPEEAAQARDAWLNAGGIIHAADIIWPEATDLIIDALLGTGIAQAPRDPVAGLIEQANAHPAPVVAVDIPSGLLAQTGATPGAVISAAHTVTFIALKPGLLTGKARDVTGILHYDALGLEGWLASQTPPLRRFDATQLGQWLTPRRPTSHKGDHGRLAIIGGDQGTAGAIRMAGEAALRTGAGLVRVLTRGENIAPLLTARPELMVHELTPQSLEESLTWADVVVIGPGLGQQEWGKKALQKVENVRKPMLWDADALNLLAINPDKRHNRVITPHPGEAARLLGCSVAEIESDRLLSAQRLVKRYGGVVVLKGAGTIIAAEHHPLAIIDAGNAGMASGGMGDVLSGIIGALLGQKFTPYDAACVGCVAHGAAADLLAARYGARGMLATDLFTTLRRIVNPDVIDVNHDESSNSAT

SEQ ID NO: 66834 - protein, 528 aa, Ehrlichia ruminantium str. Gardel
MSKVAIIDFGSQFTQLLARRIRDLNIYSEIFLPNVAFDLIKGVDAFILSGGPRSVPNSDGIPKIVHDILQFNEKTSIPVLGICYGLQILSNYFESDVVSNCNKEFGKTILNIIKNSKIIENIWESGDQAYVWMSHADSVYNIPRGFEVIAYSVLNNSIAMVANEQRRIYGMQFHPEVYHTPDGINLLANFLDIAGCQKDWTVTSFIDDQQDAIKKQIGNKKVIAALSGGVDSSVAAALTYKAIGDQLHCVFIDNGLLRYNEVEKVKQLFINELKIPVTIVDKSAVFLNRLKSITDPERKRKIIGETFIEIFEEEANKLEGVEFLMQGTIYPDVVESGGSGSIAKESVVIKSHHNVGGLPKTMKFKLVEPLKYLFKDEVRILGRNLGISTEILMRHPFPGPGLAVRIIGEITEEKVKMLQAADDIYINLIKKYELYDVMWQAFVVLLPVKTVGVMGDRRTYGHACVLRAVNSHDGMTAESFPFCMDEETQWKFFKCIQEASNAIINSVNGINRVAYDITSKPPATIEWE

SEQ ID NO: 66835 - protein, 479 aa, Methanosarcina acetivorans C2A
MVAMKMQINGKAVEACGGEVFGIKNPATGELIEQVPRGTEEDVAVAVEAASSAFTGWASASPQQRGEVLYRAAEIVRQRKDELASLLTQEQGKPIVEARNEIEGFAHVLEYYCGLSGSQRGDFIPVPGNGYAFTVKKPLGVCAAIIPWNMPALIMGWKIAPVLISGNTLVLKPASNTPLTNLTLASIFVEAGLPAGVLNVVTGPGETVGESLVRSPEVRKISFTGEARTGKRVAELAACGMKRITLELGGSDPMLVCDDADLESAAAGALRGRFYNCGQTCTAVKRLYVFESVAEEFIKKLETGIKSLRLGNGMDKNISMGPLNNRTQWEYIKELAAEIEEKDAGRIITGGKVPEFKDSEKGYFFEPTLVSDVPGDSRLLKEEVFGPLLPVVTVKNLDEAIVGANSTCYGLGASIWTKNIDRARKGCEQLNAGIIWINQHLKVAPEVPFGGVKESGFGRENGPESLSEYLETKTIMLKI

SEQ ID NO: 66836 - protein, 636 aa, Clostridium acetobutylicum ATCC 824
MNHSFVKISSACPKTNVADVDFNVKNIKLCIDKALADNSKVVVFPELSITSYTCGDLFGQSTLINNSLKGIKELCDFLIDKDIVVVVGAPLLYNYCLYNCAYVLFNGSILGIVPKSYIPNYVEFYEKRWFTEGLNLKGQFAQFPFQQDVPFGCDLIFRCGDLKLGIEICEDLWAPIPPSSYLSLMGANVILNISASNEVVSKADYRRSLISNQSGRCMCSYIYSSAGVFESSTDVVFSGHLLICENGRILSENDRFERDNLVLTSMIDLEKLQSERLKNSTFKDSVRLCDFKPNYIDFNLSNWDIGDFDRFIDSHPFVPSNERQREERCKEIFNIQTAGLAKRFTHTGLKRAVIGISGGLDSTLALVVTVKTFDMLGIDRKNIITVTMPGFGTTDKTYNNAVDLCKHLGCDFREIDIVPACLLHFKDINHPEEKHDVTYENVQARERTQILMDIANKEGGLLIGTGDLSELALGWCTYNGDHMSMYAVNCSIPKTLVRYLVDYVAEKELTGEVSKTLIDILNTPVSPELLPKDAKGNISQKTEDIIGPYELHDFFLYYFIKQGSEPEKIIFMAEKAFKNTYSRETIEKWFNLFIKRFFNQQFKRSAIPDGPKVGTISLSPRGDLRMPSDASYNGWK

SEQ ID NO: 66837 - protein, 205 aa, Oryza sativa (japonica cultivar-group)
MQRAIQAIGSHGSLLKSAVLRHISAPKPSILPAVYSRSMSVSSAQIEESGFETATVADILKSKGKSADGSWLWCTTDDSVYDAVKSMTQHNVGALVVVKPGQDKSIAGIVTERDYLRKIIVQGRSSKSTKVGDIMTEENQLITVKPDTRVLQAMQLMTEKRIRHIPVIDGTGMVGMVSIGDIVRAVVSEHREELNRLNAYIQGGY

SEQ ID NO: 66838 - protein, 563 aa, Oryza sativa
MWDPSVIHTKKNIFVGPIDMWGPHIILYLQPFFLLPSSHMSCVLGRPSAPSLDHPQQPNPPPVAPEKPPAVAKKAAEEEEEKKPPKQARRERHAWSSRSAAAEAVGLGLGGSFANRARGEQVAAGWPAWLSAVVGEAIDGWTLRRADSFEKIDKVRTPALALAIVGGGGRELSSSVLSVAQIGQGTYINVYKARDTVTGKIVALKKMGQVCFLLCKPSYRGDTAAGGRGGRRRQQQQTAALAEEESGMAGGGGGGNRLDLPVVDLASSDPRAAAESIRKACVESGFFYVVNHGVEEGLLKRLFAESSKFFELPMEEKIALRRNSNHRGYTPPYAEKLDPSSKFEGDLKESFYIGPIGDEGLQNDANQWPSEERLPSRRETIKMYHASALSTGKRILSLIALSLNLDAEFFENIGAFSCPSAFLRLLHYPGEVDDSDDGNYGASAHSDYGMITLLATDGTPGLQICREKNRNPQLWEDVHHIDGALIVNIGDLLERWTNCIYRSTVHRVVAVGKERYSAAFFLDPNPDLVVQCLESCCSESCPPRFSPIKSGDYLKERLSATYK

SEQ ID NO: 66839 - protein, 304 aa, Prochlorococcus marinus subsp. pastoris str. CCMP1986
MQEFLPYAWFEGKCIPFKDAKVSIATHALHYGTAAFGGMRAIPNPSNKDEFLLFRTDKHVKRLSQSARLLLTEISEEYIFNALKTILKKNKPSKPIYIRPFVYTSDLGIAPRLHNIETDFFIYCIELGDYLSPDGVSCRMSSWTRQEDRSLPLRGKISGAYITSSLAKTEASLSGFDEALLLNSSGKVSEASGMNLFIVRNGELITPGVDQDILEGITRASVIELAKSFGINVIERPVDKTELLIADEVFLTGTAAKITPVKQIESTNINNYRPIMTKLKNKLIEITEGRSQDYDDWITRIDIS

SEQ ID NO: 66840 - protein, 272 aa, Pseudomonas putida KT2440
MSDRYAVIGRPINHTKSPLIHGLFAQASNQQLEYGAIEGSLDDFEAQVLQFRSEGGKGMNITAPFKLRAFELADRRSERAQLARAANALKFEDGRIVAENFDGIGLLRDIEENLGEPLRNRRVLLLGAGGAVRGALLPFLQAGPSELVIANRDMAKALALRNELDHSRLRISRYEALEGQSFDIVVNATSASLTADLPPLPADVLGEAALAYELAYGKGLTPFLRLAREQGQARLADGVGMLVEQAAEAFAWWRGVRPDTRAVINQLTIPLE

SEQ ID NO: 66841 - protein, 63 aa, Aureococcus anophagefferens
MRGILVDWLVEVHLKFKMLQPTIYLTVQIIDRYLSAKQIDRNQLQLLGVAALFIASKYEEIYP

SEQ ID NO: 66842 - protein, 190 aa, Oryza sativa (indica cultivar-group)
MAAQGIAEAVQAYTGLSPAAAVTILALMLATYLLVSSLFVAPDAAPPKPPPQRKEEEQQQQQQEEAGAFVPYPDPVQVGEITLEQLAAYDGKDPAKPILIAIRGQVYDVTRGRLFYGPQGPYSLFAGRDATRALALMSFDPIDLTGDLDGLGPDELEVLQDWEDKFKERYPTVGHLASENAADGNHGGAA

SEQ ID NO: 66843 - protein, 63 aa, Alexandrium tamarense
MRGILADWLVEVAEEYKLCADTLYLSVNYIDRFLSIHPVQRSNLQLVGIACMWIASKYEEIYP

SEQ ID NO: 66844 - protein, 195 aa, Oryza sativa (indica cultivar-group)
MASVIVAAACIFLSCSASVAHGRRFVRSSSYDEPCKEMRLYLHDILYDYSNSTSNSTSAAATKPTALATAVPSTGGTFFGQVVVFNDPMTEGRALPPSLEETAVRAQGVYLYNSKEAFNAWFAFSIVFNSTGRRGTLNLMGADIIAEKTRDISVVGGTGDFFMSRGVATLRTDAFEGFTYFRLQMDIKLYECYVV

SEQ ID NO: 66845 - protein, 64 aa, Isochrysis galbana
MRGILADWLIEVHHKFKLHIETLYGSVDLIDRYLSKCAPITRSKLQLVGVAAMFIASKYEEIYP

SEQ ID NO: 66846 - protein, 130 aa, Oryza sativa (indica cultivar-group)
MHGDEDILYDFSNSTSNSTSAAATKPTPLSTAVSSPGYFFGRVVGLYLLDKKDDFSAWFAFSVVFNSTAHRGTLNLMGANPNAATRDISVVGGTGDFFMSRGVATLRTDAIEGFKYFRVQMDIKLYECYF

SEQ ID NO: 66847 - protein, 208 aa, Glycine max
  misc_feature (61)..(61): Xaa can be any naturally occurring amino acid
MSSDPEKRVTSEVVEDDELSPIEEVRLTGTNTDHPTRPVWTLRMWFLRLLSCSLLSFLNQXFAYRTVPLIITQITVHVATLPIGHFMAAFLPTTTFSIPGFGSKSFSFNPGPFNMKEHVLITIFANAGSAFGSGSPYAVGIVNIIKAFYGRSISFAASWLLIITTQVLGYGWAGLLRKYVVEPAHMWWPSTLVQVSLFRALHEKDDHR

SEQ ID NO: 66848 - protein, 232 aa, Stephanomeria exigua subsp. coronaria
GGRYSVCSAVGVLPLSLQYGFPVVEKFLKGARSIDQQFLSAPFEKNIPVLLGLLSVWNVSFLEYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVASHLVPHKTFTGNRPSLSLLLPALDAYRIGQLLAIYEHRIAVEGFIWG

SEQ ID NO: 66849 - protein, 202 aa, Oryza sativa (indica cultivar-group)
MATWSKPSLIAAVIFLLVSLLSSASVANGGRSGGRRLVRSYDEPCKEMRLYLHDILYDYSNSTSNSTSAAATKPTALSAAVSNPGFFFGRMVVFNDPVTEGRALPPSLEETVVRAQGLYLYDGKVVFDAWFAFTVVFNSTAHQGTLNLMGADPNTEMRDISVVGGTGDFFMSRGVATLRTDAFEGFTYFRLQMDIKLYECYV

SEQ ID NO: 66850 - protein, 63 aa, Prorocentrum minimum
MRGILTDWLVEVAEEYKLCADTLYLSVNYIDRFLSIHPVQRSNLQLVGIACMWIASKYEEIYP

SEQ ID NO: 66851 - protein, 429 aa, Oryza sativa (indica cultivar-group)
MRMGKYEMGRALGEGHFGKVKLARHADTGAAFAIKILDRQRILAMKIDEQIKREIATLKLLKHPNVVRLHEVSASKTKIYMVLEYVNGGELFDKIALKGKLSEKEGRKLFQQLMDAVSYCHEKGVYHRDLKPENVLVDAKGNIKVSDFGLSALPQNQRKDGLLHTTCGSPNYIAPEFSAYGGCSSDRGNLPFDDQNTVVLYQKILKGDARIPKWLSPGAQDILRKILDPNPITRLDITGIRAHEWFRQDYTPAMPFDDDDDNNISDGNLHMTENQDIETSPAISQINAFQLIGMSSCLDLSGFFEKEDVSERKIRFVSNYSPTSLFEKIESTVTEKGFQVQKNSGKLKVIQVCKEPANPRGHGNLLISAEVFEINESLYVVELKRSSGDCSLYRQLCASLSEDLGICKRQQLLKKDSMRQDLCRYNSSF

SEQ ID NO: 66852 - protein, 464 aa, Agrobacterium tumefaciens str. C58
MAKKSPPLDLSSTRGVSSWREAAQWLRVRGIEDIECITPDLAGVARGKMMPTAKFTGDTSLALPSALYRHTISGEYPDETANFRYEPRDSDLKLVPDLSTLSVVPWESDPTAQVICDVVDAEGNFVPYTPRNVLKNVLSLYTEKGWKPVVAPEIEFYLVAMNDDPDYPLHPPKGRSGRSIVGGQSYSIAGINEFDELIDDIYHFSEKQGLEIDTLIHEEGPAQLEINLRHGDPIELADQVFLFKRTIREAALKHGIYATFMAKPMQGQPGSAMHIHQSVVEIDGGRNIFSNADGSPSKVFFSFVGGMQRYVPNALVMLAPYVNSYRRLTPDMACPVNNAWGYDNRTTAFRVPISSPQARRVENRLPSSDANPYLALAASLGCGWLGIVNNIEPTEPTADTANEGSIELPRGLLEAVALLEGEEQFDRVFGHEFVGLYAGLKRGEFETFMQVISPWEREFLLLNV

SEQ ID NO: 66853 - protein, 63 aa, Prorocentrum minimum
MRGILVDWLVEVAEEYKLCADTLYLSVNYIDRFLSIHPVQRSNLQLVGIACMWIASKYEEIYP

SEQ ID NO: 66854 - protein, 377 aa, Oryza sativa
MAVSQRIQQSSFAGSKAGLKKAAVRAAPVRAVGSSIRAEKKIKVAINGFGRIGRNFMRCLETRTDSLLDVVAINDSGGVKQASHLLKYDSTLGKFDAEVKVVDDGHISVNGKVIRVVSSRDPTKLPWGDLDIDLVIEGTGVFIDTPGASKHIQAGAKKVLITAPAKGSDIPTYVVGVNAHDYKHSDAIISNASCTTNCLAPFVKVLDEKFGIVKGTMTTTHSYTGDQRLLDASHRDLRRARAAALNIVPTTTGAAKAVALVLPKLKGKLNGIALRVPTPNVSVVDLVVQVEKKTFAEEVNNAFKEAANGALNGVLAVGDEPLVSVDFRCTDVSSTIDSSLTMVMGDDMVKVVAWYDNEWGYSQRVVDLAELTAQKWE

SEQ ID NO: 66855 - protein, 567 aa, Arabidopsis thaliana
MGRGRKHTDAAAEQRELAIKASLKFFRRFRSIGKAAWEWDESQVLSGRCAETDGTWLGISIRGRVAFLVEAGPVNRDRIIGAECRTLDFLKSNLSPEDFADSLALDSGRNTGIAYHLIVADIVSNSMFYIYKPSLSEDGMVYTEPVGPGVHTLSSAGLDSEVGHRDLRLKRYFSERINRELPEPISGLAEEVMYDTVEAINGDPLSSIFVVDTLIENEHYGTRCTTALVVRRTMQVRFFERYRARFNDDWNVHDFRKKVFKVIVNFLGGSCSGLLLLFIDGLFLANPLTKRFRPLNHSGSKLLSPIFGRNSQITSRDDGIEDYKARKERRMRVGFVVSPTKGFKIVCILEMETVYGFEISDGDSWRLSETTITTSSKSLLTTWMKPVYLDGTLHWLRNDGSIIAFDPETEQARFVPSVFHRGGPGTKLIFTEDSKKNRLTLISGTKETISVYTLVNNSKWDLTRQIANVYVNEIDLLCWQLIVCDGKCLVVVENTHSGYGVVHVYDLEANSWKVSGSNEFMGMSIGDFYKFTPSLVFVEGDEQEIIASTEKRIISALTAVMGLTDRT

SEQ ID NO: 66856 - protein, 427 aa, Ralstonia solanacearum GMI1000 [sequence omitted]

SEQ ID NO: 66857 - protein, 266 aa, Arabidopsis thaliana
MGRGRKHTDAAAEQRELAIKANIVDEPFSVSAIDRSIRKAEWVKTETDQILSGRCPETDGTWLGISTRGRVAFLVEAGTINRDRFNGAESRTLEFLESNESPEDFAKSSAADYIRNKNTAAFHLIVADIASNSMLYISKPRFSDYGIVYTEPVGPGVHTLSSAGLDSDVGYRDLRMRHSFCEMINRERLPPIRDIAEIMYDPVKAYESVLLSSIFFVDMKIGYEHYGTRITTALVVKRTKEVLFFERYREIFNDDWDDHDFAFTII

SEQ ID NO: 66858 - protein, 426 aa, Mycobacterium tuberculosis
MTPRSYCVVGGGISGLTSAYRLRQAVGDDATITLFEPADRLGGVLRTEHIGGQPMDLGAEAFVLRRPEMPALLAELGLSDRQLASTGARPLIYSQQRLHPLPPQTVVGIPSSAGSMAGLVDDATLARIDAEAARPFTWQVGSDPAVADLVADRFGDQVVARSVDPLLSGVYAGSAATIGLRAAAPSVAAALDRGATSVTDAVRQALPPGSGGPVFGALDGGYQVLLDGLVRRSRVHWVRARVVQLERGWVLRDETGGRWQADAVILAVPAPRLARLVDGIAPRTHAAARQIVSASSAVVALAVPGGTAFPHCSGVLVAGDESPHAKAITLSSRKWGQRGDVALLRLSFGRFGDEPALTASDDQLLAWAADDLVTVFGVAVDPVDVRVRRWIEAMPQYGPGHADVVAELRAGLPPTLAVAGSYLDGI

SEQ ID NO: 66859 - protein, 307 aa, Burkholderia xenovorans LB400
MRDKPMKNFTDRVAAITGAGSGMGRSLAIQLAREGCHLALADRNAASLAETAQLAQAAAPQIVGSPLRITTRVLDVADRAAMFDWAAETAAQHQRVNLVFNNAGVALSSTIEGMDYADLEWIVGINFWGVVHGTKAFLPYLKASGAGHIVNTSSVFGLFSQPGMSGYNATKFAVRGFTEALRQELDLMKCGVSATCVHPGGIRTGIAQSSRIASNMVGFMLETEQQGKDDFEKFFITTADEAARVILDGVRRNKRRVLIGRDARAADWLARTLPAAYQALVVMQTRRMKRIAEKRARRAAQVDGRRA

SEQ ID NO: 66860 - protein, 206 aa, Oryza sativa (japonica cultivar-group)
MRVPAAVTGGCGCGVDGGGGCCRGGGKLADWEEGKDDEMKSVVVKGWTRMAQVVPLHDNASAEDDDDDEEDDDEDDDDDDDEDDEEEAAPPYVMAVDDSSVDRAVITALLRRSKYRDSGKRALEILGSEPNVSMIITDYWMPEMTGYDLLKKIKESSELKQIPVVIMSSENVPTRISRCLEEGAEDFLLKPVRPADISRITSRMLQ

SEQ ID NO: 66861 - protein, 531 aa, Burkholderia xenovorans LB400
MNARMPHDTAAPGTSAPVETDIAIIGSGFAGLGMAIRLRQAGIGDFIVAEKADSVGGTWRDNHYPGCACDVQSHVYSFSFAPNPRWTRMFARQPEIRAYLEDCTQRFGVQRHLRFGHELASAIYDETRHRWQLSFTNGQQWSARVLISGMGGLSRAAMPTIPGIENFKGKAFHSQHWDHGYSLQGKRVAVIGTGASAIQFVPQIAPRVAHLDLFQRTPPWIMPKADRRVKPLEQWLFTHLPVTQKIMRSALYCMLESRAFGFAIHPSLMKTAQKVAERHLRRQVRDPLLRAKLTPNYTMGCKRILISNDYFPALSRPNVSVTTTAIARIEEDAVITTDGARHPADCLIFGTGFQVADPFPRGVVRGRGGVDIVDTWRDGAHAYLGTTLPGYPNFFMIVGPNTGLGHNSMVFMIESQVEYILRALKTMNAERADAIEVRPQVERAYNEQIQQKLGRAIWSTGGCKSWYLDPKTGRNTTLWPGFAYKFRQATSTFSMGDYLAYSPAPQPASAPMVPPQPVHAHGSATASAEAT

SEQ ID NO: 66862 - protein, 147 aa, Glycine max
LVYICLQSSEEEGEDGEKRKKKKKEKKGLKEKIEEKIEGDHHHHKDEDTSVPVEKVEVVETAHAEEKKGFLDKIKEKLPGHKKTEEATATTPPPPPPVASLEHGEGAHHEGEAKEKKGILEKIKEKLPGYHSKTEEEKEKEKESGAH

SEQ ID NO: 66863 - protein, 337 aa, Oceanobacter sp. RED65
MTIKIGINGFGRMGRLTMRAAFDWDDIEIIQINDPAGDATTLAHLLTFDSVHGRWHHDATADDNTMLIADKRIPCTQNKTIEETDWSQCDIVIEASGKMKSKAVLQDYLAQGVKRVVVTAPVKEDGVLNVVMGVNDHLYDPQKHSIVTAASCTTNCLAPVVKVIHENLGIEHGSMTTIHDITNTQSILDQPHKDLRRARACGMSLIPTTTGSATAITHIFPELKGKLNGHAVRIPLANASLTDCVFEVKKHTTEEEVNQLLKAAADNELKNILGYEERPLVSIDYKTDPRSSIIDALSTMVVNGTQVKLYAWYDNEWGYANRTAELARKVGEIDSLG

SEQ ID NO: 66864 - protein, 444 aa, Rhizobium leguminosarum bv. viciae 3841
MDQISKTNAPVLENFWMPFTANRQFKATPRLLAAAEGMYYTDVDGHQVLDGTAGLWCCNAGHGRKKIAHAVERQLATLDYAPTFQMGHPIAFDFASKLAANAPGGPEAKLDRIFFTGSGSESVDTALKIAIAYQRAIGQGTRTRIIGREKGYHGVGFGGISVGGLVNNRRVFPQIPADHMRHTLDIERNAFSKGLPAHGVELADDLERLVQLHGAETIAAVIVEPMSGSAGVVLPAKGYLEKLRATADKHGILLIFDEVITGFGRLGTPFAADYFGVVPDLITTAKGITNGSIPMGAVFASRKVYDGLMVGPDNAIELFHGYTYSGHPVACAAGLATLEIYEEEGLLTRAADLAEYWQEALHSLKGLPHVVDIRNLGLVGAVELASRDGAPGTRAYDIFVDCFNKGLLIRVTGDIIALSPPLIIEKSQIDTIVSILGDALKRAA

SEQ ID NO: 66865 - protein, 299 aa, Synechococcus elongatus PCC 6301
MPQPYPFGRVITAMITPFNAEGQVAYDIAQSLAVHLVEQGSDGLVICGTTGESPTLTWEEELQLFRAVKEAVGDRAAVIAGTGSNCTREAIAATQSAATLGLNGSLQVVPYYNKPPQEGLYAHFRAIAEACPDLPLMLYNIPGRTGQSLQPETVARLASLPNVVAIKAASGNVEEVSALRQLLPDSFAIYSGDDSLTLPMLAVGAQGVVSVASHLVGPQLQALIQAFEAGNVARAQQLHHQLYPLFKALFLTTNPIPVRAAMELLGWSIGLPRLPLVPASAEIRQALASCLTELGLYTA

SEQ ID NO: 66866 - protein, 320 aa, Ustilago maydis 521
MPQSHSFKYDPEFLQAAGPVLATFAQRPKPSLHDVETHRVNLDTALRAAGEAGPKYPVETTTHAITTRDGATINRRDNGPAVIHAHGGGMMSGTADAWVASGILPGLAAASGVDIFSVEYRPAPEHQLDGLVNDCYDALEWLSSNSASLGIDSNRIGVFGESAGGGIVAGVALQARDKALSPPLRKQILIYPMLDDRNLTPDERLSPTAIWSYENNLTGWSALLGKDIAGTDKVNELVKYAVPARVQDLSGLPDTYIDIGQLDIFIEETLEYVNRLHKAGVQVDLNVYKGFPHAWELVGAQNTSVGKRIMSERILALQSF

SEQ ID NO: 66867 - protein, 414 aa, Thiobacillus denitrificans ATCC 25259
MNAPHRIDGRLHLEGVALDTLAERCGTPLYVYSRAALEAAYRAYEEAFAATPHLICYAVKANSSLALLNLFARMGAGFDIVSGGELARVLSAQGDPRKVVFSGVGKRVDEMRAALEAGILCFNVESTSELHRLNRVAGELGKVAPVSFRVNPDVDPKTHPYISTGLKENKFGVPIAEAPALYRTAAALPHIRVTGIDCHIGSQLLDLSPLADAADRVFALVDALAAEGIALEHIDLGGGVGISYRGETAPDLAGYGRVLAERFAGRRETLIVEPGRSLVGNAGLLLARVEYLKLGADKNFAIVDAAMNDLMRPALYEAYHEIVEVIARPLPKRRYDVVGPICETGDFLGSARELSLDEGDLVALLSSGAYGMSMSSNYNSRPRAAEILVDKKEIHLIRERETQEGLMAGERLLD

SEQ ID NO: 66868 - protein, 400 aa, Oryza sativa (indica cultivar-group)
MATRKNAEQRRGEAASVTSRHRVFAEDLLLPREAEGEDHFDRVPDSLVLLIFNRLADARSLGRCSAVSKRFNSLVPLVDDACLRIDRVITDAADADDALGLAGPRPAGRGVLSHLLKAMLLAVLKPFGHCDAGVRGGGGGERAGKHGGGGGGCGAQQHHSPAQVLKNFSSIRNLRMELPVSDVGTDDGVLLRWKAVFGSTLQSCVILGGTRVDRAAAPPAAAATATAAGDSEASQGDDTGSIPESFYTNGGLKLRVVWTISSLIAAATRHYLLREIVKEHPTLERVALTDAHGQGTLSMGRDQIREFRDKPLAAAAAANRTQVPACNMKLRYAPMLELSDGTRIQGATLVVIKPVGEAGGIGGGRKELDEFVADAFDGPYREAVRALSKRRTYLLEMNGF

SEQ ID NO: 66869 - protein, 116 aa, Arabidopsis thaliana
MTKLWTSLSALHSLAGPVVMLLYPLYASVIAIESPSKVDDEQWLAYWILYSFLTLSELILQSLLEWIPIWYTAKLVFVAWLVLPQFRGAAFIYNKVVREQFKKYGILKPKVEHQAE

SEQ ID NO: 66870 - protein, 140 aa, Brassica napus
  misc_feature (135)..(135): Xaa can be any naturally occurring amino acid
MALAYDPLFITSDKSAMDVPSTPPPMMLTQDELKRIAAHKAVDFVESGMVLGLGTGSTAKHAVARIGELLRQGKLENIVGIPTSKKTQEQALSLGIPLSDLDAHPVIDLSIDGADEVDPHLNLVKGRGGSLLREXMIEGA

SEQ ID NO: 66871 - protein, 300 aa, Yarrowia lipolytica CLIB122
MTVKQLEHASIKNSWFTEVSDSFPGQGLMLKVEEILHVSQSEFQDVLVFRSTEYGNVLVLDGVVQVSERDEFAYQEMICHVAMMSHECPKRVLVIGGGDGGVLREIVKHESVEAAHLCEIDESVIELSKKYLPNMAVGFDNTKVTVHIRDGFEFIREVARSDEKYDVIITDSSDPDGPAEKFFQREYFQLLHTALNDDGIVITQSSENVWLNFKFVKQLRDICKGVFASVEYCAALLPTYTSGQLGLMVCSKKPTNLKIPKRQWTQEEESSLVRYYNKEIHEASFVLPNWAKHFLEGTSL

SEQ ID NO: 66872 - protein, 999 aa, Yarrowia lipolytica CLIB122
MLQAAIGKIVGFAVNRPIHTVVLTSIVASTAYLAILDIAIPGFEGTQPISYYHPAAKSYDNPADWTHIAEADIPSDAYRLAFAQIRVSDVQGGEAPTIPGAVAVSDLDHRIVMDYKQWAPWTASNEQIASENHIWKHSFKDHVAFSWIKWFRWAYLRLSTLIQGADNFDIAVVALGYLAMHYTFFSLFRSMRKVGSHFWLASMALVSSTFAFLLAVVASSSLGYRPSMITMSEGLPFLVVAIGFDRKVNLASEVLTSKSSQLAPMVQVITKIASKALFEYSLEVAALFAGAYTGVPRLSQFCFLSAWILIFDYMFLLTFYSAVLAIKFEINHIKRNRMIQDALKEDGVSAAVAEKVADSSPDAKLDRKSDVSLFGASGAIAVFKIFMVLGFLGLNLINLTAIPHLGKAAAAAQSVTPITLSPELLHAIPASVPVVVTFVPSVVYEHSQLILQLEDALTTFLAACSKTIGDPVISKYIFLCLMVSTALNVYLFGATREVVRTQSVKVVEKHVPIVIEKPSEKEEDTSSEDSIELTVGKQPKPVTETRSLDDLEAIMKAGKTKLLEDHEVVKLSLEGKLPLYALEKQLGDNTRAVGIRRSIISQQSNTKTLETSKLPYLHYDYDRVFGACCENVIGYMPLPVGVAGPMNIDGKNYHIPMATTEGCLVASTMRGCKAINAGGGVTTVLTQDGMTRGPCVSFPSLKRAGAAKIWLDSEEGLKSMRKAFNSTSRFARLQSLHSTLAGNLLFIRFRTTTGDAMGMNMISKGVEHSLAVMVKEYGFPDMDIVSVSGNYCTDKKPAAINWIEGRGKSVVAEATIPAHIVKSVLKSEVDALVELNISKNLIGSAMAGSVGGFNAHAANLVTAIYLATGQDPAQNVESSNCITLMSNVDGNLLISVSMPSIEVGTIGGGTILEPQGAMLEMLGVRGPHIETPGANAQQLARIIASGVLAAELSLCSALAAGHLVQSHMTHNRSQAPTPAKQSQADLQRLQNGSNICIRS

SEQ ID NO: 66873 - protein, 58 aa, Skeletonema costatum
MRGILADWLVEVHLKFKLVPETLYLVVNLIDRYLAKKEVTRSKLQLVGVTALFIATKY

SEQ ID NO: 66874 - protein, 313 aa, Schizosaccharomyces pombe
MPGYDDKRYFTSTAVLLNELIKLVVCFSVGYHQGRKNVGKEAKLRAFLPQIFGGDSWKLAIPAFLYTCQNNLQYVAAGNLTAASFQVTYQLKILTTAIFSILLLHRRLGPMKWFSLFLLTGGIASFSCKSLLRRPNVGRPMNPVTGFSAVLVGCLISGLAGVYFEKVLKDTNPSLWVRNVQLSFFSLFPCLFTILMKDYHNIAENGFFFGYNSIVWLAILLQAGGGIIVALCVAFADNIMKNFSTSISIIISSLASVYLMDFKISLTFLIGVMLVIAATFLYTKPESKPSPSRGTYIPMTTQDAAAKDVDHKH

SEQ ID NO: 66875 - protein, 399 aa, Bacillus cereus G9241
MLENQINERSLLLHKELVGKIEITSKVEVNSADDLSLTYTPGVAESCKAIAADEETVYDYTARGNMVAVVSDGTAVLGLGNIGPKAAMPVMEGKSILFKKFANVDAFPLCLGTTDVDEIVTLVKNLEPTFAGINLEDIAAPRCFEIEKRLKEETSIPVFHDDQHGTAIVVLAAVINALKVVSKQMDHVKIVINGAGSAGIAIGKLLLKAGAKHITLVSLEGIVCEGEAWMNEAQIEVSKKTNREHVRGTLKEAIHQADIFIGVSAPNVLTKELVKTMNEKAIVFAMANPIPEIFPEDALEAGAAVVGTGRSDYANQVNNVLAFPGIFRGALDVRATDITEEMKLAAAYGIANIITDEERNANYVIPNPLDKRVVPSVAEAVAKAAIDSGVAQITKIPSY

SEQ ID NO: 66876 - protein, 200 aa, Oryza sativa (indica cultivar-group)
MAAWSMASLMIVAAIFLLSLTSASVVHGRSSRRRFVRSYDEPCMEMRLYLHDILYDYSNSTTNSTSAAATKPTALSTAVSKSGYFFGRVVVFNDPMTEGRALPPSLEETAVRAQGLYLLDKKDDFSAWFAFSIVFNSTARRGTLNLMGADPNAATRDISVVGGTGDFFMSRGVATLRTDAIEGFKYFRVQMDIKLYECYV

SEQ ID NO: 66877 - protein, 129 aa, Ralstonia solanacearum GMI1000
MIVVFDAQCLLCSGFARFLLKHDRRGVLRFASMQGETGRALLRAADVDPEDVDTVLFVRDGRAWRESAAALRILHALGWPWRLAWLGWAVPLPIRDALYRCVARNRYRWFGCSDTCILPPPGAAQRFLD

SEQ ID NO: 66878 - protein, 297 aa, Aspergillus nidulans FGSC A4
MVADMSPRDLTAKPCGEAVSAMASELRSLVGDLTNAVNRKQFDTANTLLARAKRTLLLQNALIPASSTNPELLVLARETLELGALSAIRQTDAPAFTRYYQQLQPFYDLEREGSSTLDTRTSQRSKITGLYLLLLLSSGDGSSFHTVLEGLVEEASLKGGNVEDDPFIKYPVNLERNLMEGSYDKVWRETNSERVPSEDFALFSNVLVGTIRSEIADCSEKAYPSLPISNAKNLLFLESEGAVMEFAQQRGWTLRDGRIYFPVEPEAATRSEKDILVASSTIIENAIGYARELETIV

SEQ ID NO: 66879 - protein, 309 aa, Oryza sativa (japonica cultivar-group)
MAEAKQQQQQPQAATAAAASGVWKTVKPFANGGASGMLATCVIQPIDMVKVRIQLGEGSAASVTKKMLANEGISAFYKGLSAGLLRQATYTTARLGSFRVLTNKAVEANDGKPLPLVQKAGIGLTAGAIGACVGSPADLALIRMQADSTLPAAQSRNYKNAFHALYRIAADEGVLALWKGAGPTVVRAMSLNMGMLASYDQSVELFRDTLGAGEVTTVLGASAVSGLCASACSLPFDYVKTQIQKMQPDASGKYPYTGSLDCAMKTLKSGGPFKFYTGFPVYCVRIAPHAMMTWIFLNEIQKLEKRLGL

SEQ ID NO: 66880 - protein, 367 aa, Arabidopsis thaliana
MHLPEDLVLEILSKVPAVSLARFRSTCRRWNALVVDGSFAKKHYAYGPRQYPIVIMLIEFRVYLVSIDLHGINNNNGAPSAKLTGQFSLKDPLSNSSEEVDIRNAFHCDGLLLCCTKDRRLVVWNPCSGETKWIQPRNSYKESDLYALGYDNRSSSYKILRMHPVGNPFHIESEVYDFASHSWRSVGVTTDFHIQTNESYGMNVKGTTYWFALSKDWWSSDDRRFLLSFDFSRERFQCLPLPADVKNLHLTVVLSVTREEQQLCMFATLGAGNVYKLDVFVATKTEETTGELTWTKFRRFHSKICINVSADHEKKVLVPHHILLPYYNILHIVGEDIYIRQVNKDGDIGCPILLTYVPSLVQIQQGI

SEQ ID NO: 66881 - protein, 210 aa, Sporobolus stapfianus
MSYAYLFKYIIIGDTGVGKSCLLLQFTDKRFQPVHDLTIGVEFGARMITIDNKPIKLQIWDTAGQESFRSITRSYYRGAAGALLVYDITRRETFNHLASWLEDARQHANANMTVMLIGNKCDLSHRRAVSYEEGEQFAKEHGLVFMEASAKTAQNVEEAFIKTAGTIYKKIQDGIFDVSNESNGIKVGYVVPNSSGGAAGSSSQGGGCCS

SEQ ID NO: 66882 - protein, 243 aa, Oryza sativa (japonica cultivar-group)
MASDGTDVVALYGGANGLSHKSGSFSVKVGLAQMLRGGVIMDVVTPEQARIAEEAGACAVMALERVPADIRAQGGVARHARIGHLVEAQILEAIGVDYVDESEVLTLADDAHHINKNNFRVPFVMDDDEVFSYAKRIAAPYDLVMQTKQLGRLPVVQFAAPGVATPADAALMMQLGCDGVFVGSGIFKSGDPALRARAIVQAVTHYSDPKILAEVSSGLGEAMVGINLSDPKIHVERFAARSD

SEQ ID NO: 66883 - protein, 199 aa, Brassica napus
PNSITAQQVGSGYQGLGVGAFTLDWAGISAYHGSPWVAPGSSILNVGVGFIMFIYIIVPVCYWRFDTFDARKFPIFSNQLFTSAGQKYDTTKILTPRFDLDINAYNNYGKLYLSPLFALSIGSGFARFTATLTHVALFNGRDIWRQTWSAVKTVKLDIHGKLMQRYKQVPEWWFYVLLVGSVALSLLMSFVWKESVQLP

SEQ ID NO: 66884 - protein, 147 aa, Bordetella parapertussis 12822
MFKGLRLTGKYFFKRKVTLRYPMEKTPTSARFRGLHALRRYPNGEERCIACKLCEAVCPALAITIESEQRDDGTRRTTRYDIDLTKCIFCGFCEESCPVDSIVETHIHEYHGEKRGDLYFTKDMLLAVGDRYEAEIARRRAEDAPYR

SEQ ID NO: 66885 - protein, 418 aa, Bordetella parapertussis 12822
MAEIKNYTLNFGPQHPAAHGVLRLVLELDGEVIQRADPHIGLLHRATEKLAEHKTFIQALPYMDRLDYVSMMCNEHAYVMAIEKLLGIEAPLRAQYIRVMFDEITRVLNHLMSLGSHALDVGAMAVFLYAFREREDLMDCYEAVSGARMHAAYYRPGGVYRDLPDTMPQYGDSSKYRGEKEVRAMNDARSGSLLDFIEDFTNRFPGCVDEYETLLTDNRIWKQRLVGIGVVDPDRAKALGFTGPMLRGSGVAWDLRKTQPYEVYDLMDFDVPVGVNGDCYDRYLVRVAEMRESNRIIRQCVEWLRNNPGPVMIENHKIAPPSRTAMKSNMEELIHHFKLFSEGFHVPPGEAYAAVEHPKGEFGIYLVADGANKPYRLKIRAPGFAHLQSLDEMARGHMIADAVTIIGTQDIVFGEIDR

SEQ ID NO: 66886 - protein, 316 aa, Vigna unguiculata
MMMSRSGGNRVANAVMLVAKGLSGEVGGARAFYGGGVRSESTLVLPEKEKMEKKVGDGGNKEQKGIVSYWGVEPSKITKLDGTEWKWNCFRPWETYKADVSIDLNKHHAPTTFLDKMALWTVKTLRYPTDLFFQRRYGCRAMMLETVAAVPGMVAGMLLHLKSLRRFEHSGGWIKALLEEAENERMHLMTFMEVAKPKWYERALVITVQGVFFNAYFLGYMISPKFAHRMVGYLEEEAIHSYTEFLKELDKGNIENVPAPAIAIDYWQLPPDSTLKDVVTVVRADEAHHRDVNHFASDIHYQGRELREAAAPIGYH

SEQ ID NO: 66887 - protein, 565 aa, Oryza sativa (indica cultivar-group)
MAIGEDDTCENKDCRVGAERKAMAIEEDDTCENKDFRVGARRKATTVGENGACENKDCRVGAGRKASAVEEDNACENKENRRKMMVAKATSPSSLDCPKLGILIEPFFIPLSSSSWMWSSLGSWSLLPWMAKTCSTSMLVGWLARPHSRTITASTARRPPLAPLSEWILLVGNSFRGSGKYCEHAVCSLLDGSQVFDKIIKKEIPSTVVFEDEKVLAFRDINPQAPTHIVIIPKVKDGLTGLSKAEERHVEILGYLLYVAKVVAKQEGLEDGYRIVINDGPSGSGDSLGEEVLRMFLAERQAHGDFVTKISDMVWRRNGGDLGVLEAAAEQENSADVAPPQPEEASNTENHPVVQDVMGEGMLRIAATRDWVSGESSLPVSKRLSAKDRQDERERRKELNLLRYEALKDELLLLTTGIGAACSLYCLLVFSLEAAVSYAFGVAFSCLYLQLLYRHTDNLSKKDVPEIFMKKKVKRIGIRSEDLKNTIEKVLGGISVALSSPRLVIPAIFFGLSTLSDHFQNSILNFELVPGMMGFFAYKAAALVQVYRDNEDLRLILPEEDADSS

SEQ ID NO: 66888 - protein, 110 aa, Glycine max
  misc_feature (44)..(44): Xaa can be any naturally occurring amino acid
ILNQRAIEASEKQRPTPDIRTGDIVEIKLEVPENKRRLSIYKGXIVISKQNAGIHTTIRIRRIIAGTGVEIVFPVYSPNIKEIRVVSHRKVRRARLYYLRDKLPRFSTFK

SEQ ID NO: 66889 - protein, 475 aa, Arabidopsis thaliana
MDRISSLSNDIISNIVSFLSAKDAAVASVLSKRWQNIYTIVPNLEFDNTLENQGSLTDFLNGLLALPASTRIKNVSIKRRGRDGPNRDADLNRFLCNVLKRGVLKLKLDIWVTLDGRYSLPVEVFTCKTLVELELGSILQIDLVPENALLPALKTLIIDAVQFSDQSGCAFQKLLSSCPVLVELRMLNVQWEHWQWSRRVSSPTLEKLTMNHRYHFGNTYYDMEGITFDTPSLTSLKYYDLPPKSYPTVNLDSLVEATISLTLPLHHAWTGKHARRGDTVPSVTNLIKGLRNVETLNLSSTDTVAAFYFSNEAIPVFENLHRLSIATEREFCWRTLPYLLKKSPNLESLVIGGPLHYNYQLGDGYESEEIYSEDDDEEESESDDDEPICECLSDYSFLESCLVKTVEISEYSGTKIELKHMKHFLEKLSCLELVKVFSHERDEEEHVQLRTNLLNLPRSSKCKTQFEFIPPRSSV

SEQ ID NO: 66890 - protein, 978 aa, Bacillus cereus G9241
MAEQTVRVTVDGKEFSASGEKTILQLFNESNLEHPQICHVPEVDPIQTCDTCIVEVDGKLMRACSTQIENGMHIERQSQRAKEAQTEAMDRILENHLLYCTVCDNNNGNCKVHNTVHMMGIEEQKYPYEPKVSACEVDMSHPFYRYDPNQCIACGQCVEVCQNLQVNETISIDWSLDRPRVIWDHGVSINDSSCVSCGQCVTVCPCNALMEKSMLGEAGFMTGLKPDVLDPMIDFVKDVEPGYSSILAVSEVEAAMRKTKVNKTKTVCTFCGVGCSFEVWTKDRHILKVQPVSDAPVNGISTCVKGKFGWDFVNSEDRITKPLIRQGDMFVEATWEEALEVVASNMQHIKSEYGSDAFGFISSSKVTNEENYLMQKLARQIYGTNNVDNCSRYCQSPATDGLFKTVGMGGDAGTVKDIAEAGLVIIVGANPTEGHPVLATRVKRAHKLHEQKLIVADLRKHEMAERADLFIHPRQGTDYVWLAGITKYIIDQDWHDKKFIAENVKNFDEYSTMLEKYTLDYTEEITGISKENLKEMARMVYEADGTCVLWGMGVTQNTGGSTTSAAISNLLLVTGNYRRPGAGAYPLRGHNNVQGACDMATLPNWLPGYQAVSDDTLRAKFEKAYGTTIPKAPGLNNIAMLLAADEGKLRGMYVMGEEMALVDSNANHVQHILANLDFLVVQDMFLSKTARFADVILPAAPSLEKEGTFTNTERRIQRLYEVLKPLGDSKPDWWILQKVARALGGDWNYESPSEIMDEIASLAPLYSQATYDRLEGWNSLCWGSHDGSDTPLLYVDGFNFPDKLARLSLDEWVPPVVAPDEYDLLLNNGRMLEHFHEGNMTNKSAGILSKVSEVFVEISPELAIERNVKDGGLVELASPFGKIKVQALITDRVTGKELYLPMHATINEEAINILTGTATDLYTCTPAYKQTMVKMRVLREKGNRPLPSSNPRDKKRNPQNGVEIEQKWQRKQYVSLVD

SEQ ID NO: 66891 - protein, 294 aa, Ralstonia solanacearum GMI1000
MTQISGSLVAIVTPMHEDGSLDFPSLRSLIDWHIAEGTDGIVIVGTSGESPTVSVDEHRELIRVTVEQVNKRIPVIAGTGGNSTTEAVELTAYAKSVGADASLQVVPYYNKPTQEGMYLHFRKVAESVDLPVILYNVPGRTVADMSVDTMLRLAQVPGVMGVKEATGNIDRAAQLIKAAPASFKIYSGDDPTAVALMLLGGHGNISVTANVAPRAMHDLCAAAMRGDVETARRIHMQLLSVHKNLFVESNPIPVKWALQAMGKMAGGIRLPLTPLAAQYQEVVRASLQDAGLLS

SEQ ID NO: 66892 - protein, 66 aa, Zea mays
  misc_feature (25)..(27): Xaa can be any naturally occurring amino acid
KRPTRLASSMFFSADAITSPAQATXXXPFTGLKSSAAFPDTPKRNNYITSIASNAGRVSCMKERPP

SEQ ID NO: 66893 - protein, 822 aa, Arabidopsis thaliana
MGLIKNTVHYCCVSRDNQILYSYNGGDQTNESLAALCLEKSPPFHTWYFETIGKRRFGFLIGDGFVYFAIVDEVLKRSSVLKFLEHLRDEFKKAARENSRGSFTAMIGSINVEDQLVPVVTRLIASLERVAESSSNNELKSSNLGEQSEGSNSTKAPLLGRLSKQEKKKGKDHVIELEEHRKSNDRGNITDDSAGAGTSLEKECVSSSGRSVTQSFEWKWRRPINRLRETNLPKEKNQQNQNKATVSLSLSLSLTSSPPFSPLKPDQKPSFIRALLGQQMFTSGNVTARVFERQIRTPPPGASVNRARHFYENLVPSYTLYDVESPDHCFRKFTEDGLFLISFSRNHQELIVYRPSWLTYSTTDDSTTTLPPLPRRASKFDSFFTQLYSVNLASSNELICKDFFLYHQTRRFGLFATSTAQIHDSSSPSNDAVPGVPSIDKITFVLLRLDDGVVLDERVFLHDFVNLAHNMGVFLYDDLLAILSLRYQRIHLLQIRDSGHLVDARAIGYFCREDDELFLNSSSQAMMSQDKSKQQSLSGSKEDDTGENGLRHSLSQPSGSNSFLSGVKQRLLSFIFREIWNEESDNVMRVQSLKKKFYFHFQDYVDLIIWKVQFLDRQHLLIKFGSVDGGVTRSADHHPAFFAVYNMETTDIVAFYQNSAEDLYQLFEQFSDHFTVSSSTPFMNFVTSHSNNVYALEQLKYTKNKSNSFSQFVKKMLLSLPFSCQSQSPSPYFDQSLFRFDEKLISAADRHRQSSDNPIKFISRRQPQTLKFKIKPGPECGTADGRSKKICSFLFHPHLPLAISIQQTLFMPPSVVNIHFRR

SEQ ID NO: 66894 - protein, 350 aa, Mycobacterium sp. KMS
MIPAALRCVPAGQVDVTAPVTIDGLSYIAPDDPAMPMYRVIANNRQPVALRDLMIQPVRSGYIGDGHQPDPALVPPTGAQAVPDVDVDQVYLPVRDGVARCQLYRPRAAPADEQLPVIVYYHGGGFTVGVSEDCDFLARKLAFTNSALVVSANYRSAPEFMFPTPLDDAFDVYRWVTVNAELVGGDATRVAVAGDSAGSNFAAALALRARDEHARVPDAVVMLGAMPDFHFERWDSFRAQAPRGIVYDMAFAGFIRGAYVGPTPWDHPWVSPIEGDLTGYPLTVITAGTHDPIVDSARAFGERIRAAGGQTVEYFPAGMPHGYYFFPGVHAEEDVAYEIVAEVLAKPFRR

SEQ ID NO: 66895 - protein, 495 aa, Roseovarius nubinhibens ISM
MTDWQARVAKLYDGGFRPMVIGGKWCAAQSGEVMEARNPADGGLLATVPKGGAEDIDAAVAAARAAFEGPWAKFTPFERQALLLRIAERFEAEWETLCLSDTLDMGMPIQRTLANSRRVLGMLRYYAGQAVAIHGETIPNSFPGEIYSSTVREPVGVVGAIIPWNAPIAGSIWKIGPALATGCTVVLKPSEEASLTVLLIAKLMQEAGLPDGVLNIVTGHGSDAGAALAAHPGVDKIVFTGSTATGQAIARAATGNLKRVALELGGKSPVIVCRDADIDKAVPVAAMSVFANSGQICIAGSRLFVAREIHDEFVRRVAEYAAGLRLGHGIHEETEIGPIISARQAERIGGYLEAGRREGAEVMTGGAAPEGAAFENGHFYKPTVFAGVTDEMTIAREEIFGPVISALPFDTLDEVVERANATPYGLAAGVFSTHLGTAHQLAHRIKAGSVWVNMYHAIDPAVPFGGVKMSGYGREGGREHVEEYLDTKAIWINAE

SEQ ID NO: 66896 - protein, 436 aa, Clostridium perfringens str. 13
MNYTTQMDAAKKGIITKEMQVVSEKEGINIETLMNLMAEGKIVIPANKNHKSISAEGVGQGLRTKINVNLGISKDCANIELELEKVKKAIDMNAESIMDLSNYGKTYDFRKRLVEVSTAMIGTVPMYDVVGFYDKELKDITVDEFFEVVEKHAKDGVDFVTIHAGLNRETIETFRRNKRLTNIVSRGGSLLFAWMELNNRENPFYEYFDRLLDICEKYDLTLSLGDACRPGSIADATDAVQIKELITLGELTKRAWERNVQVIIEGPGHMAMNEIEANVLLEKKLCHGAPFYVLGPIVTDIAPGYDHITSAIGGAMAASYGADFLCYVTPAEHLRLPNLEDVREGIVATKIAAHAADIAKGISGARDIDNKMSDARKRLDWDEMFSLAIDSEKAIRYRKESTPEHKDSCTMCGKMCSIRNMNKILEGKDINLLRED

SEQ ID NO: 66897 - protein, 474 aa, Clostridium acetobutylicum ATCC 824
MLSEFPKNFLWGASSAAYQVEGAWKEDGKGESVWDNFSKIPGKTFEGTNGDVAVDHYHRFKEDVALMAEMGLKAYRFSVSWSRIYPKGRGKVNLKGLEFYKNLVDELLKYNIEPVLTLYHWDLPQALQDLYGGFESRNVISDFENYCITLFKNFKDKVKYWITFNEQNVFTNLGYRCAVHPPGIKDIKKYYLANHIVNLANASAIKAFRKYVPNGKIGPSFGMGPVYSFDCKPENVLAGDEAEEYFNHWWLDVYCFGKYPTITLNRLEKLKVMPEITKEDLQLLREAKPDFIGLNYYHGGTVMANDNVIRENLDKKDPYLVENSEEDKGFKYISNPFLKKTEWNWEIDPQGLRIALRRLTNRYNLPILITENGIGAVDRLEEDERINDDYRIEYLKAHVLACKEAIDDGVQLIGYLPWSFTDLLSWLNGYKKRYGFVYINRDEHSQKDLRRIKKKSFYWYKDVIEKNSDNIYGR

SEQ ID NO: 66898 - protein, 230 aa, Burkholderia xenovorans LB400
MQPPFTLLFDLDGTLVNTDEFHFAAYQTLLADFGRSITPEIYRTRIMGAPNDAIMRELFPNEPENRHRQLADRKEELFRSAVKHLEPTRGAIDVFDWAARNDVGVAIVTNAPRQNAELMLNGLGLTECVDLLVIGDELARGKPDPLPYLTGLERLGGTARQAVAFEDSLSGIRSATGAGIYTLGISTGLPPGALRGAGAADVIDDFTAGAVWDILDRVAREGTAFGGKYE

SEQ ID NO: 66899 - protein, 192 aa, Penicillium marneffei
MVVATIKCVVVGDGAVGKTCLLISYTTNKFPSEYVPTVFDNYAVTVMIGDEPYTLGLFDTAGQEDYDRLRPLSYPQTDVFLVCFSVTSPASFENVREKWFPEVHHHCPGVPCLIVGTQTDLRDDPAVREKLAKQKMQPVRKEDGDRMAKELGAVKYVECSALTQYKLKDVFDEAIVAALEPAPKKRPKCVVL

SEQ ID NO: 66900 - protein, 154 aa, Synechococcus elongatus PCC 6301
MTATVADFMTRDPISVKPQTPLTEAIRILADKHISGLPVVDEAGQLVGVLSETDLMWRESGVPTPPPYIQVLDSFIYLENPARYEQELHKALGETVAEVMTAQPLTIAADRPLPEAARLFNDRKVHRLFVLSGDHQVVGVITRGDIIRAMAQGA

SEQ ID NO: 66901 - protein, 461 aa, Oryza sativa (indica cultivar-group)
MKITDVEVEILLGILNLYSLVGSFAAGRTSDWIGRRLTIILAAVIFFVGAIMMGLSVNYPMLMAGRFVAGIGVGYAFMIAPVYTAEVSPASSRGFLTSFPEVFINFGILLGYVSNYAFSRLRLQLGWRLMLGVGAAPSVALALMVLAMPESPRWLVMKGRLADAKVVLGETSDTAEEAATRLAEIKEAVAIPADLDGDVVAVPKRAGGERRVWKELILSPTPAVRRVLLSALGIHFFQQSSGIDAVVLYSPRVFQSAGITDKNKLLGTTCAVGVTKTLFILRRRHDRTLVTLGLGLTVIGEDATGGGWAIAVSIASILAFVAFFSIGLGPITWVYSSEIFPLHLRALGCALGVGLNRVTSGVISMTFLSLSKAITIGGSFFLYAGIASLAWLFFFTYLPETRGRTLEQMGELFGIHNMAGDDDSAATRPPSPEEEEKITNYVEMAAPSSSSSTATSSHHAK

SEQ ID NO: 66902 - protein, 506 aa, Rhodospirillum rubrum ATCC 11170
MASAYAVAVHDLLVHLGVPESAFTGGDITVHSPIDGGTIGAVHATPLAEVAPLIERAHRAHLAWRQIPGPRRGELVRLFGEELRAHKADLGRLVTLENGKILSEGLGEVQEMIDICDFAVGLSRQLHGLTIASERPGHAMRETWHPLGVVGVISAFNFPVAVWAWNSALALVCGDAVVWKPSEITPLTALACGALLAKAAQRFGDDYPTDLSVLLIGASALGEALVDHPQVPLISATGSTRMGRLVAPKVAARLGRTILELGGNNAGIVCPSADLDLAVRAIAFAAIGTAGQRCTTLRRVIVHESIAADLIGRLAAAYASIRVGNPLEAGTLVGPLIHGAAQEAMETALARAKADGGIVHGGERVMLPGSEGGCYVRPALVEMPAQTAVVAEETFAPILYAVTYRSLEEAIALQNAVPQGLSSSIFTNDLREAETFLSAAGSDCGIANVNIGPSGAEIGGAFGGEKDTGGGRESGSDAWKGYMRRATNTVNYSGALPLAQGVSFEL

SEQ ID NO: 66903 - protein, 232 aa, Stephanomeria virgata subsp. virgata
GGRYSVCSAVGVLPLSLQYGFPVVEKFLKGARSIDQQFLSAPFEKNIPVLLGLLSVWNVSFLEYPARAILPYTQALEKLAPHIQQVSMESNGKGVSIDGIRLPFEAGEIDFGEPGTNGQHSFYQLIHQGRVIPCDFIGIVKSQQPVYLKDEVVNNHDELMSNFFAQPDALAYGKTPEQLQSENVASHLVPHKTFTGNRPSLSLLLPSLDAYRIGQLLAIYEHRIAVEGFIWG

SEQ ID NO: 66904 - protein, 355 aa, Heliobacillus mobilis
MLELKIELAPQRKEKPPADKLGFGKIFTDHMFVMDYSVEQGWHNAKIKPYEPLELDPSVMVFHYGQAIFEGMKAFRTQDNRVVLFRPEKYISRMTNSARKLCIPEFDEAFVVKAIKTLIDTERDWVYGEEGTALYIRPFIIATDPYLGVRPSHTYKFMVILSPVGAYYAEGFNPVKIFITDEFTRAAKNGLGDVKTPANYAASLYAGEKAKQMGFTQVLWLDPVEKKYIEEVGTMNVFFRIGDEVVTPVLHGSILPGVTRDSVIQVLRNWGIPVVERTISVDELFEAHAAGNLKESFGTGTAAVISPVGLLRHGDREAVINEGKTGELASRLFDSITGMQYGKSEDLFGWIADVR

SEQ ID NO: 66905 - protein, 734 aa, Arabidopsis thaliana
MKGATLVALAATIGNFLQGWDNATIAGAMVYINKDLNLPTSVQGLVVAMSLIGATVITTCSGPISDWLGRRPMLILSSVMYFVCGLIMLWSPNVYVLCFARLLNGFGAGLAVTLVPVYISETAPPEIRGQLNTLPQFLGSGGMFLSYCMVFTMSLSDSPSWRAMLGVLSIPSLLYLFLTVFYLPESPRWLVSKGRMDEAKRVLQQLCGREDVTDEMALLVEGLDIGGEKTMEDLLVTLEDHEGDDTLETVDEDGQMRLYGTHENQSYLARPVPEQNSSLGLRSRHGSLANQSMILKDPLVNLFGSLHEKMPEAGGNTRSGIFPHFGSMFSTTADAPHGKPAHWEKDIESHYNKDNDDYATDDGAGDDDDSDNDLRSPLMSRQTTSMDKDMIPHPTSGSTLSMRRHSTLMQGNGESSMGIGGGWHMGYRYENDEYKRYYLKEDGAESRRGSIISIPGGPDGGGSYIHASALVSRSVLGPKSVHGSAMVPPEKIAASGPLWSALLEPGVKRALVVGVGIQILQQFSGINGVLYYTPQILERAGVDILLSSLGLSSISASFLISGLTTLLMLPAIVVAMRLMDVSGRRSLLLWTIPVLIVSLVVLVISELIHISKVVNAALSTGCVVLYFCFFVMGYGPIPNILCSEIFPTRVRGLCIAICAMVFWIGDIIVTYSLPVLLSSIGLVGVFSIYAAVCVISWIFVYMKVPETKGMPLEVITDYFAFGAQAQASAPSKDI

SEQ ID NO: 66906 - protein, 500 aa, Ralstonia eutropha JMP134
MLRSRHLLSGSFFNGRTTMLKLQDPSLLRQQCYIDGRWTDGERRIDVTNPATGELVAQVPQFGVAETRHAIEAANRALPAWRARLAKERSALLRKWFELILANQDDLARIMTAEQGKPFAEAKGEIAYAASFIEWFAEEGKRVYGETIPAPVSSQRIVVTKEPIGVCAAITPWNFPAAMITRKAGPALAAGCTMVVKPASQTPLTALALAVLAERAGIPAGVLSVVTGSAGAIGGELSSNPLVRKLTFTGSTEVGRVLMAQTASTIKKVSMELGGNAPFIVFDDADLDAAVEGAIISKYRNAGQTCVCANRIYVQDKVYDAFAQKLVAAVAQLKVGNGMEDGVRIGPLIDEKAVAKVEEHIADALGKGARVLEGGHRHGLGHTFFQPTVLADVAPNMLVAREETFGPLAPLFRFKTEDDVVAMANDTEFGLASYFYARDLGRVWRVSERLEYGMVGVNTGLISNEVAPFGGVKQSGVGREGSHYGIEDYLVIKYTCMAGI

SEQ ID NO: 66907 - protein, 338 aa, Agrobacterium tumefaciens str. C58
MGVVIPLEESKNKLASVKPLVDLTRPDMERVNQLILSRAGSDVQMIPEVANHLISSGGKRLRPMLTLASASMFGYEGDNHIKLATSVEFMHTATLLHDDVVDESDLRRGKSTARTIWGNQASVLVGDFLLGQAFRMMVDVGSLDALDVLSTAASVIAEGEVLQLSVAKNMETTEDDYLQVIRAKTAALFAAAAEVGPIVAKTDKASRSALKSYGMNLGLAFQLVDDVLDYGGKSADLGKNTGDDFREGKITLPVILSYRRGTQDERAFWRNAIEKGESSDENLEKALGLITKYNGLGDTIGRATHYGTIARDALAPLPQSPWKNALLEVIDFCIERLN

SEQ ID NO: 66908 - protein, 46 aa, Arabidopsis thaliana
ETTIMLPDLADFKTVDEIYPKYFPAPSPAPSTYQVAALPLNAQIED

SEQ ID NO: 66909 - protein, 746 aa, Roseovarius nubinhibens ISM
MTSEPSSPLATDQFAAKLEPLTVDTPCWTLTTDETDLRAVPVAELARMLEQLFLIRHFEERLLELSKEGLLHGPAHASIGQEGAAVGLMSALTSGDKINGTHRMHHQFLAKTLNHALVAEYDPLDQGFPQAAQEVVFKTYSEILGLKSGYCGGRGGSMHLREPEAGVLGSNAIVGGNIPHAVGYALADKMRGERAISVAFFGDGAMQIGTAYEAMNLAALYTTPTVFVVENNQYAVSTHVSEQTRETRLSLRGLGLGIPSITFDGMDVIAARRAMETARKIIETSGGPVLLEARTYRHLHQSGPLKGSAFGYRDKAEEDAWLARDPATTLPQQILRAGLLTEAQIDTLRSRATAAVDDTLDRLIEGSGKDRRLKPDLWPDPATVEYGIRGDLSELADKRHLEERDLTAETGVEAKFHDVISEVMLRNMEKFDGLFVLGEDVHRLRGGTAGATRGIAERFPDRLLGTPICENGFTGMALGAALNGARPVVEIMYPDFSLVAADQLFNQIAKVRHMFGGDFPVPVVVRSRVTQGTGYGSQHSMDASGLFTLYPGWRVVAPSTPHDYIGLMNAAIACDDPVLVVEYNELFQNKGQVPTGDWDYIIPFGKARIARPGTQATILTYGPMVESCTKLCDSTGLDAEVIDLRTLDPLGLDWETITASVAKTNALLMVEQTTRGTSIGSRVVNDAQRRLFNHLDYEILHVTGTESSAVVSKVLEEAAFARPADVEAALRQVISDRHPALQGASA

SEQ ID NO: 66910 - protein, 537 aa, Vitis pseudoreticulata
MAARRISSLLSRSLSVSSAFSLSLGKNFNRGKSIHRFSTAAAAVEELITPTVQINYTQLLINGQFVDAASGKTFPTFDPRTGEVIANVAEGDAEDINRAVSAARKAFDEGPWPRMSPYERSRILLRFADLAEKHNDELAALETWNNGKPYEQAAKAELPLFVRLFRYYAGWADKIHGLTVQADGPHHVQILHEPIGVAGQIIPWNFPLMMFAWKVGPALACGNTIVLKTAEQTPLTALFAAKLFHEAGLPPGVLNIVSGYGPTAGAALASHMDVDKIAFTGSTDTGKIVQELAAKSNLKPVTLELGGKSPFIVCEDADIDQAVELAHFALFFNQGQCCCAGSRTFVHESVYDEFIEKAKARALSRTVGDPFKKGIEQGPQIDPEQFAKVLRYIKSGVESNATLECGGGRIGSKGYFVQPTVFSNVQDDMLIAKDEIFGPVQSILKYKDLDEVIRRANSTRYGLAAGVFTKNINTANTLTRALRVGTVWVNCFDVFDAAIPFGGYKMSGVGREKGIYNLNNYLQVKAVITPLRNPAWL

SEQ ID NO: 66911 - protein, 284 aa, Glycine max
MGVFSENPNPDPVVIRQVWASNLESEFQLIRELIDHYPFISMDTEFPGVVFRPHLDPTKPYNHRNNNRNRHSDHYRLLKSNVDALNLIQVGLTLTDAAGNLPDLAGNRSIWEFNFRDFDVARDAYALDSIDLLRRQGIDFARNATDGVESTRFAELMMSSGLVCNDSVSWVTFHSAYDFGYLVKILTRRNLPTRLEEFLKTVKVFFGDNVYDVKHMMRFCDTLYGGLDRVARSLNVERAVGKCHQAGSDSLLTWHAFQKIVDIYFVKDEHRKHAGVLYGLEVFC

SEQ ID NO: 66912 - protein, 297 aa, Myxococcus xanthus DK 1622
MATFQLNSFLAAQQARVEALLNERVARLGPSGTPPQLAEAMRYSLLAGGKRLRPVLCLAFADLVARGSAVSAVAGDAACALEYVHTYSLVHDDLPAMDNDDYRRGRLTNHKVYGEAMAILAGDALLTEAFTLVASGPESMRAALCRELAVASGAAGMVGGQVLDTAEDRPSALDYLIRMHRMKTGALIRAACRMGVLASGGDADALARADTYGDAVGLAFQIADDVLDVTATAAELGKPAGADAAAGRFTFPAVVGLEASRTLADQKVAEAIAAVRPLEGEDGPLAALARYTVERKS

SEQ ID NO: 66913 - protein, 411 aa, Synechococcus elongatus PCC 6301
MSESLESLARLAHWRHELRTPINAILGYSQLLLEDWAGTAIATDLERIESAGQELLRLVNEILDPHSSDRGLSLDTYQARLRYALRTPVNTVCGYVELLLEEDSPELAESRVDLERISAAGERLLEQLEAMAAWDQPASQASAVALSEMEVEVAESVLRYRQAAVSASAVTGGRLLVAEDNEINRDVLERRLRRLGHDVVCVASGQEALNQLAQQPFDLLFLDLMMPGLTGFEVLQQLKADPTLAELPVLMISALDDLESVIRCLRLGATDYLTKPFEPTLLQTRLETCLQHKRLRDRELDYLRNVAIVTDAAVAVEAGDYDRDRLQTVAERSDALGQLARMFRQMTRSVEQRETQLKQTIRRLELQIDTATVKSQVKEITESDYFRDLESRARQIRRDRSYRSSPPDRHA

SEQ ID NO: 66914 - protein, 562 aa, Vibrio vulnificus CMCP6
MNNDKRPLYIPFAGPALLSTPLLNKGSAFSAEERISFNLEGLLPETTETIQEQVERAYMQYKAFESDMDKHIYLRNIQDTNETLFYRLVQNHITEMMPIIYTPTVGAACENFSNIYRRGRGLFVSYANRDRIDDILNNASNHNVKVIVVTDGERILGLGDQGIGGMGIPIGKLSLYTACGGISPAYTLPIVLDVGTNNPQRLADPMYMGWRHPRITGADYDAFVEEFIQAVQRRWPDALIQFEDFAQKNAMPLLERYKNRICCFNDDIQGTAAVTVGSLMAACQAAGSKLSEQRITFLGAGSAGCGIAEAIIAQMVSEGISDKKARSQVFMVDRWGLLQEGMPNLLDFQQRLVQKHSVTAKWETEANGFSLLDVVKNAKPTVLIGVSGAPGLFTQEVIQEMHKHCPRPIVFPLSNPTSRVEAVPADIIRWTNGDALVATGSPFDPVIHEGKTYPIVQCNNSYIFPGIGLGVLAVNAKRVTDEMLMESSRALATCSPLAINGKGALLPPLEEIHTVSKRIAYAVAKKAIEQGVALEIADDALQVAIEQHFWQPVYRRYKRTAF

SEQ ID NO: 66915 - protein, 162 aa, Oryza sativa
  misc_feature (22)..(22): Xaa can be any naturally occurring amino acid
  misc_feature (134)..(134): Xaa can be any naturally occurring amino acid
HHETKEKVLSYYDASSVLTYAXTMTYAAVGQEYEGCTASVMLIWFDHKNDCFAQCANLGDSACVMRVNGDMMGMTIDHGVASVTGRARIARAVQAVQAVKVRINGVHLARMFGDKFLKEQDARFSGAPYVSSSXLTPKACSVLAVITMGGLWDVIRPRPGAR

SEQ ID NO: 66916 - protein, 473 aa, Prochlorococcus marinus subsp. pastoris str. CCMP1986
MAKSPQDVLSQIKDEGIELIDLKFTDIHGKWQHLTLTSDMIEEESFTEGLAFDGSSIRGWKAINASDMSMVPDSSTAWIDPFYKHKTLSMICSIQEPRSGEPYNRCPRSLAQKALKYLDSTGIADTAFFGPEPEFFLFDDVRYDSKEGSCFYSVDTIEAPWNTGRTEEGGNLGYKIQYKEGYFPVAPNDTAQDIRSEMLLQMAELGIPTEKHHHEVAGAGQHELGIKFDSLISSADSVMTYKYVVRNVAKKYGKTATFMPKPVFNDNGTGMHVHQSLWESGQPLFYGEGSYANLSQTARWYIGGILKHAPSFLAFTNPTTNSYKRLIPGFEAPVNLVYSEGNRSAAVRIPLTGPNPKAKRLEFRSGDALANPYLAFSVMMLAGIDGIKNQIDPGDGVDVDLFELPAEELSKIDTVPSSLNDSLNALKADKDYLLAGGVFTEDFIDNFIDMKYEEVQQLRQRPHPHEFFMYYDA

SEQ ID NO: 66917 - protein, 114 aa, Zea mays
  misc_feature (7)..(7): Xaa can be any naturally occurring amino acid
  misc_feature (88)..(88): Xaa can be any naturally occurring amino acid
TPLHNHXRVKNIYWWDKHNINLSKIYVLTQFNSASLNRHLSISYINNIAFYKNDPFIELLPPQHIPYNPNCFQRTPNTIHQYIWLFHXHNIIQFLILALYHLNPMYYQKFIQPH

SEQ ID NO: 66918 - protein, 223 aa, Zea mays
MAALLARQAAQALRARQSAQLGPTTSAMQGHLRTYMNAGIPKRFKEEEEKEQLAKDIAKDWNAVFERSINTLFLTEVVRGLMLTLKYFFERNVTINYPFEKGPLSPRFRGEHALRRYESGEERCIACKLCEAICPAQAITIEAEEREDGSRRTTRYDIDMTKCIYCGFCQEACPVDAIVEGPNFEFATETHEELLYDKEKLLENGDRWETEIAENLRSESLYR

SEQ ID NO: 66919 - protein, 341 aa, Magnaporthe grisea 70-15
MASHHDEDTMPEETQGYKLSQPKQSLAEYSQMVNKARVRFGGGPRKLHPTISIRPEEHSLEMFSTRPPPPSLDSASPETQPLRSSLRLATSRPNDYAPPGSGTQQPLQACSYEPSLDLGAITLSNFILPSLKSRPIPSVMSPLNVMLRIDWANRHRDQNVHQRRNHDLTNATTTDAGDESLQRYKQSLGLGQGKDLSDPNDPRVCIIYSLTMESPGRDPVKIDLRTPGSEKTLKDHPFKIKEGAKFTMVADFKVQHEILSGLHYVQVVKRKGIKVSKDSEMIGSYAPNTDKQPIYTKKFQEEEAPTGMLARGHYNAISSFVDDDKKKHLEFEWSFDIAKDW

SEQ ID NO: 66920 - protein, 499 aa, Rhodospirillum rubrum ATCC 11170
MTQAAPPIDWTARARALRLPNHALIDGAPASAGDGATFDCVSPIDGRVLTRVAACGAADVDRAVAAGRAAFEDRRWCGLSPAARKKILLAFAERIEAHRDELALLETLDMGKPIADSLAVDVPATARCLRWYAEALDKVYGEVAPTGDDVLATITREPLGVVGVVVPWNFPMIMAAWKIAPALAAGNSVVLKPAEQSPLTAIRLGELALEAGLPAGVLNVVPGLGPVTGRAIGLHPDIDGAFFTGSTAVGKLFLSYSSQSNMKRLGLECGGKSAHIVLASCKNTTAAAQAAASAIFFNQGEMCTAGSRLIVERAIADEVIEKVVAEAAFWRPGPPLDPATRMGALVDAEQTERVLGYIALGQDEGARLATGGSRAMAESGGCYVEPTIFTGVAPTMRIAREEIFGPVLSVITVESADEAVRVANDSDYGLAAAVWSDDVTTLHRVAKRLRAGMVYANCYDADDITVPFGGFKQSGIGRDKSLHAIDKYTELKTTWLRLG

SEQ ID NO: 66921 - protein, 232 aa, Stephanomeria virgata subsp. virgata
GGRYSVCSAVGVLPLSLQYGFPVVEKFLKGARSIDQQFLSAPFEKNIPVLLGLLSVWNVSFLEYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVASHLVPHKTFTGNRPSLSVLLPSLDAYRIGQLLAIYEHRIAVEGFIWG

SEQ ID NO: 66922 - protein, 890 aa, Arabidopsis thaliana
MKSLHWFLHLLIIAFTVLRSVEAQNQAGFISLDCGLVPKETTYTEKSTNITYKSDVDYIDSGLVGKINDAYKTQFQQQVWAVRSFPVGQRNCYNVNLTANNKYLIRGTFVYGNYDGLNQFPSFDLHIGPNKWSSVKILGVTNTSMHEIIHVVPQDSLEVCLVKTGPTTPFISSLEVRPLNNESYLTQSGSLMLFARVYFPSSSSSFIRYDEDIHDRVWNSFTDDETVWISTDLPIDTSNSYDMPQSVMKTAAVPKNASEPWLLWWTLDENTAQSYVYMHFAEVQNLTANETREFNITYNGGLRWFSYLRPPNLSISTIFNPRAVSSSNGIFNFTFAMTGNSTLPPLLNALEIYTVVDILQLETNKDEVSAMMNIKETYGLSKKISWQGDPCAPQLYRWEGLNCSYPDSEGSRIISLNLNGSELTGSITSDISKLTLLTVLDLSNNDLSGDIPTFFAEMKSLKLINLSGNPNLNLTAIPDSLQQRVNSKSLTLILGENLTLTPKKESKKVPMVAIAASVAGVFALLVILAIFFVIKRKNVKAHKSPGPPPLVTPGIVKSETRSSNPSIITRERKITYPEVLKMTNNFERVLGKGGFGTVYHGNLDGAEVAVKMLSHSSAQGYKEFKAEVELLLRVHHRHLVGLVGYCDDGDNLALIYEYMANGDLRENMSGKRGGNVLTWENRMQIAVEAAQGLEYLHNGCRPPMVHRDVKTTNILLNERCGAKLADFGLSRSFPIDGECHVSTVVAGTPGYLDPEYYRTNWLSEKSDVYSFGVVLLEIVTNQPVIDKTRERPHINDWVGFMLTKGDIKSIVDPKLMGDYDTNGAWKIVELALACVNPSSNRRPTMAHVVMELNDCVALENARRQGSEEMYSMGSVDYSLSSTSDFAPGAR

SEQ ID NO: 66923 - protein, 475 aa, Thermoanaerobacter tengcongensis MB4
MVLLMTELQKRISFIGLVALGAAGVIGTSWIYTNSKFFAAYGAGGEIFGFVVATVIASLIALAYAELSTVFPRAGGEVVYTYVAFGKTTSFIAGWALVGAYLASLAFYVTASSLLLAWIFPQLEQGPYYVIAGTKIHLPELIVGIAITLLVFLVNYYGAHLASGIQIVMFGTMIVLGLLLVIVGFTHGQASNFWPAWSKDMNPFLSTMRFVLPAMTYLTGFELVAVLAEEANMPVRKIGISVILSVVLAGLFYTIVLLSSAWVIPWQETAKLKLGTIDAFKVAGFPALGWAAYFISVLGLVTSFVGLFAATPRLILSLSRAGVLPQTFTKTHPKYGTPVNALYLTLGFALGLGWLGKGAMVWFLDMGGFAIAIAWVLATLSLIKIRKKYPNLRGAYRTSATLLPLIGGIVAIIIAIATLIPGTPLSLAWPYEYIVLGVWAIVGVILYAKAPKGNEEEALKNLLGEYYEAIKKASD

SEQ ID NO: 66924 - protein, 112 aa, Fusobacterium nucleatum subsp. vincentii ATCC 49256
MATLFTKIINKEIPANIVYEDDDVIAFKDIAPVAPVHVLVVPKKEIPTINDITDEDALLIGKVYRVIGKLAKEFGIDKDGYRVVSNCNEHGGQTVFHIHFHLIGGEKLGTMV

SEQ ID NO: 66925 - protein, 430 aa, Oryza sativa (japonica cultivar-group)
MEDEGAGGGGIGGDASPVHVGSATEVGVGRDIVPSPTSSRSVMQTVNGSHMFVIQGYSLAKGMGIGKYIASETFTVGGCQWAIYFYPDGKNPEDNSAYISVFIALISDGIDVRVLFELKLLDQSGKAKHKGHSQFDRSLESSPYTLKNRGSMWGYKRFFRRTALETSDFLKDDCLKINCTVGVVVSTMDYSKPHSIHVPESDIGYHFGTLLDNQEGVDVICNVAGEKFHAHQLVLAARSSFFRSELFEHESDEEKNEVDTSNEIKEIVIDDMEPKVFKAVLHFMYRDNLVGDDELSASSSDCSIFDTLAGKLLAAADRYELPRLRLLCESYLCKHISVNSVATTLALADRHHAMELKSVCLKFAAENLSAVIRTDGFDYLKDNCPALQSEILRTVAGCEEECSSGGKSQSVWGQLSDGGDTSGRRVRPRV

SEQ ID NO: 66926 - protein, 1166 aa, Oryza sativa (japonica cultivar-group)
MGVPEAVALEIPAAAEAEEEVEEEEGSPSPPVVARVPPRIRRRLLLRHRGGAPATAEEIEAKLRDADLRRQQFHEALSCKARCTVRYPSCPSQEEDPKKRLEAKLVAAEQKRLSLLAKEQSRLAKLDELRQAAKNDAELRFKKEREELGMKVESRVRQAEEKRTQLMHARSQRRAALEERTTKYLVQRVAWENKYRERVHSAILQKRTAAEKRRTGLLEGEKRRAQGRFSQVQLAARTLSCQREADRSKLKEQLEDKLQRAKRQRAEYLKQRGSTHSFTYTASVKHGDFLSRNLARCWRRFITSRKTTVVLARAFDMLRINEESVKPMPFEKLALCIESPTVLQTTRAFLDRLESRFTLSQSSSPSSPENIDHLLKHLGSPKRTLSKSGGRTRVTPTKAARNSDVSKLPRYSPRIVLCAYMILGHPSVVFNERGEREKLLVESAENFVKEFELLIKTILDGSSGACILKQPILDDLSPGSSNYQESSAVVADRKKFRSQLASFDKAWCAYLYHFVVWKAKDAKSLEEDLVRAACKLELSMMQTCKFTAEGQPENLNDNLKAIQKEVMVDQTLLREKVRHLGGEAGIERMEVALSEARTKFFEAKGNRSPLATTIKNVAATCSSGESPISDMKENSNINDKRPSQAVQSMFRVPSSPSESNTAGITMSNPMTVSSTLSEKRPTENEQMVNEILHGFLADSSSNIGTVEGGFKEKVRETMEKAFWDVVVDSLRGDMPDYSYLVQLVKEVRDTLYEMVPKGWKEEIINNIDLEILLQVLESGTQDMQYLGQILQYSLGMLRKLSSPAKEDEMKRSHDKLLGELTEHSECNNSGSNSFVIAVIKGLRFTMEELKALKTEVSRARIQLLEPIIKGSGGVEYLQKAFADRYGFPSNASVALRSTAQWISTSKDTVEVEWNEHAQPFVATLRSGHGVPDQRQSTIPVSDDTGLPECTGQRLDQLIRIGLLQLISGIEGVQMQSVTETFKLNWLRLRSVQSQFQQVIVIATSMLVQRQVLATDDPNITPTELESATSQLFNTLAELLDNFPDVSTAKIMEVMLRSSSSSSSGSTTGSPSDERTESRKQILARVFLKSLQTDDPVFKKVSRSVYCAFRAITLGGSGARGRKLADAALRRIGATKLTDRVVRSAEILIRAASISQQVHGPWYNHLV

SEQ ID NO: 66927 - protein, 436 aa, Saccharomyces cerevisiae
AVSKVYARSVYDSRGNPTVEVELTTEKGVFRSIVPSGASTGVHEALEMRDGDKSKWMGKGVLHAVKNVNDVIAPAFVKANIDVKDQKAVDDFLISLDGTANKSKLGANAILGVSLAASRAAAAEKNVPLYKHLADLSKSKTSPYVLPVPFLNVLNGGSHAGGALALQEFMIAPTGAKTFAEALRIGSEVYHNLKSLTKKRYGASAGNVGDEGGVAPNIQTAEEALDLIVDAIKAAGHDGKVKIGLDCASSEFFKDGKYDLDFKNPNSDKSKWLTGPQLADLYHSLMKRYPIVSIEDPFAEDDWEAWSHFFKTAGIQIVADDLTVTNPKRIATAIEKKAADALLLKVNQIGTLSESIKAAQDSFAAGWGVMVSHRSGETEDTFIADLVVGLRTGQIKTGAPARSERLAKLNQLLRIEEELGDNAVFAGENFHHGDKL

SEQ ID NO: 66928 - protein, 271 aa, Clostridium perfringens str. 13
MKLFGLIGEKLGHSLSPEIHNKVFKDNNIDGLYNLFSVKKDFENNIVESLKCLGVKGANVTIPYKEKVMDQLDIISHEAKVIGAVNTILIKDGKSYGYNTDYYGFGKMLERAKVNIEGNSFFVLGAGGAARSILKYLEDSKAKKIVLVSRDKEKAFKKFKDFNINFMSYGELEEINEEFALINTTPCGMYPNTNSVAVSEKVIKKFKVAVDIVYNPLETKFLKMAKDNGLKTVDGLFMLVGQGVKAEEIWNGIKVDKSTEEEIYEELKCRF

SEQ ID NO: 66929 - protein, 450 aa, Kluyveromyces lactis NRRL Y-1140
MEFLSRISQHLGIVEDVDRDGTVFILGKEYAPLNNKSRTDVETDDSALESLINIVSLNPGLLSDVHSRVFFTYRTQFTPIRRNENGPSPINFTLFFRDNPINTLENALTDPDSFYSDIGWGCMIRTGQALLANAIQRVKLAREFRINASRIDDNELNLIRWFQDDVKYPLSLHNFVKAEEKISGMKPGQWFGPSATARSIKTLIEGFPLCGIKNCIISTQSADIYEDEVTRIFHKDRDANLLLLFAVRLGVDKINSLYWKDIFKILSSPYSVGIAGGKPSSSLYFFGYQNENLFYLDPHNTQQSSLMMDDLEFYRSCHGHKFNKLHISETDPSMLLGMLISGKNEWDQFHTYFRDSQIIQFLTTRPENDLYQSANMSVGSDSIHSLESDIQDTGEYVDVGTLVSGKQMSSPQPKDEEFEDVKCKSQRIIVCEDPADPEVEQVLVEDSSSC

SEQ ID NO: 66930 - protein, 378 aa, Arabidopsis thaliana
  misc_feature (62)..(62): Xaa can be any naturally occurring amino acid
MADGEDIQPLVCDNGTGMVKAGFAGDDAPRAVFPSIVGRPRHTGVMVGMGQKDAYVGDEAQXSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYMFTTTAEREIVRDIKEKLAYVALDYEQELETAKSSSSVEKNYELPDGQVITIGAERFRCPEVLFQPSLIGMEAPGIHETTYNSIMKCDVDIRKDLYGNIVLSGGSTMFPGIADRMSKEITALAPSSMKIKVVAPPERKYSVWIGGSILASLSTFQQMWISKSEYDESGPSIVHRKCF

SEQ ID NO: 66931 - protein, 327 aa, Prochlorococcus marinus subsp. pastoris str. CCMP1986
MASTLLFTALKEAIDEEMANDVNVCIMGEDVGQYGGSYKVTKDLYEKYGELRVLDTPIAENSFTGMAVGAAMTGLRPIVEGMNMGFLLLAFNQISNNMGMLRYTSGGNYKIPAVVRGPGGVGRQLGAEHSQRLEAYFHAVPGIKIVACSTPTNAKGLMKAAIRDNNPVLFFEHVLLYNLSEELPEGDYICSLDQADLVKEGKDITILTYSRMRHHCLKAVEELDKKNIDVELIDLISLKPFDMKTISKSIKKTNNVIIVEECMKTGGIGAELIALITEECFDDLDTRPIRLSSQDIPTPYNGNLENLTIIQPHQIVEKVEEVINGSI

SEQ ID NO: 66932 - protein, 225 aa, Zea mays
PYPIHCPLTFSPSCTAELPDHRAITLKEQVSSTKIPVRLKSGSPLCSACENFTGKAVSYISEKQTQDKVMGFLHDACSQSFSFEQKCDELMDSYATLLFAKITEIKPEAFCKQYGLCRGTALFSGVTSDSTCVFCHHLLDEVMSKLKDPDAEFEIIQILIKECNKIEGHVQQCKRLVLQYIPLILVNGEKFLEKNDVCALVQACPATHKKTFSSALKEALLLSNA

SEQ ID NO: 66933 - protein, 198 aa, Oryza sativa (indica cultivar-group)
MASLTIVVAAIFLLSLTSASVVHGRSSRRRFVRSYDEPCMEMRLYLHDILYDYSNSTSNSTSAAATKPTALATAVPSTGGTFFGQVVVFNDPMTEGRALPPSLEETAVRAQGVYLYNSKEAFNAWFAFSIVFNSTGRRGTLNLMGADIIAEKTRDISVVGGTGDFFMSRGVATLRTDAFEGFTYFRLQMDIKLYECYV

SEQ ID NO: 66934 - protein, 206 aa, Oryza sativa (indica cultivar-group)
MATWYSKASLIAAAIFLVISLLSSATFANGGRSGRRLVRSYDEPCKKMTLYFHDILYDYSNSTTNSTSAAAAKPTALATAVSPNGTFFGEVVVFDDPMTEGTRALPPPSLRETAAARAQGVYLYDSKEVYDAWFAFSVVFNSTGRRGTLNLMGADLMSEKTRDISVVGGTGDFFMSRGVATLRTDAVEGLVYFRLQMDIKLYECYI

SEQ ID NO: 66935 - protein, 157 aa, Capsicum annuum
HQHHKVVQLYKSRNIRRMRLYDPNQAALQALRGSNIEVMLGVPNSDLQNIAANPSNANSWVQRNVRNFWPAVKFRYIAVGNEVSPVTGTSSLTRFLLPAMRNIRNAISSAGLGNNIKVSTSIDMTLIGNSFPPSQGSFRNDVRSFIDPIIVFLRGDK

SEQ ID NO: 66936 - protein, 468 aa, Brassica napus
MNVMRRLKSIASGRTSISSDPGVDSSLKRPKLDQDNDNLSSRGDDPMQVDQSTDMVVVSQDTVAGTSNVPPPPDQLPEVMNDMRLREDEPHANRGEEDKDMEPPIVNGCGTETGQVITTTVGGRDGKPKQTISYMAQRVVGTGSFGVVFQAKCLETGEQVAIKKVLQDKRYKNRELQIMRLQDHPNVVRLRHSFFSTTDKDELYLNLVLEFVPETVYRALKHYTKMNQHMPIILVQLYTYQICRALNYLHRVVGVCHRDIKPQNLLVNTHTHQLKICDFGSAKMLVPGEPNISYICSRYYRAPELIFGATEYTNAIDMWSGGCVMAELLLGQPLFPGESGIDQLVEIIKILGTPTREEIRCMNPNYTEFKFPQIKAHPWHKIFHKRMPPEAVDLVSRLLQYSPNLRCTALEACAHPFFDDLRAPNVSLPNGRALPPLFNFTAQELAGASTELRQRLIPAHCQGTGNSS

SEQ ID NO: 66937 - protein, 424 aa, Oryza sativa
MASALFGSGPVRSKNLVEFKAGRMNLKGKMVHPDKRKGLVYVYQSEDSLMHFCWKDRSNGIVEDDLMIFPDDVEIKRVAQCTTGRVFLMRFKSSNKKFFFWMQETETEKDEKLWKKVNDLLNNPPAPGSASSSVTSASGAGERGAASSASGAGVAGVPGGLPGVLGADFGNLEGPELHNLIGSMSDQQLQMFLGGFMPVNSPSSNRSSNLSSNQASRVQSTTPASRTEPTSAAAAAASSQPSSAVPTSATTETKPSAATAGSQDGTSSQQSSTTEKQETTNGGAPKMQFSDFQNILGNLAASGGGRSDLDLSDVLTLDVMAPILSNKDVQARLIEHLPESPDILAKNEHELRQTITTPQFKKALSSSCMALQSGQLGPVFKQFDLPDEVSNAAAQGNLEAFAKAMEAHAKKAKKANDDDAMDTK

SEQ ID NO: 66938 - protein, 332 aa, Salmonella typhimurium LT2
MKTLGEFIVEKQHEFSQATGELTALLSAIKLGAKIIHRDINKAGLVDILGASGAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLVYTTGCGVHAFTYDPSLGVFCLCQERMRFPEKGKTYSINEGNYIKFPNGVKKYIKFCQEEDSSTSRPYTSRYIGSLVADFHRNLLKGGIYLYPSTASHPQGKLRLLYECNPMAFLAEQAGGKASDGKERILDIIPESLHQRRSFFVGNRHMVDDVERFIREYPDA

SEQ ID NO: 66939 - protein, 111 aa, Saccharomyces cerevisiae
MHHHHHHMVTQLKSASEYDSALASGDKLVVVDFFATWCGPCKMIAPMIEKFAEQYSDAAFYKLDVDEVSDVAQKAEVSSMPTLIFYKGGKEVTRVVGANPAAIKQAIASNV

SEQ ID NO: 66940 - protein, 477 aa, Salmonella typhimurium LT2
MSTSDSCYNTGYILRICAIAALGGILFGYDTAVISGAIGSLTSYFHLSPAETGWAVSCVVVGCVIGSFSAGYLSKRFGRKKSLMVSALLFTISAVGTSLSYTFTHFVIYRIIGGLAVGLAATVSPMYMSEVSPKNMRGRALSMQQFAIVFGQILIFYVNYKIASIAADTWLIELGWRYMFAAGIIPCILFCILVFLIPESPRWMMMIGREEETLKILTKISNEEHARHLLADIKTSLQNDQLNAHQKLNYRDGNVRFILILGCMIAMLQQVTGVNVMMYYAPIVLKDVTGSAQEALFQTIWIGVIQLIGSIIGAMIMDKMGRLSLMRKGTIGSIIGLLLTSWALYSQATGYFALFGMLFFMIFYALSWGVGAWVLISEIFPNRMRSQGMSISVGFMWMANFLVSQFFPMINENPYLLSHFHGAFPMWIFAICCIFSYFFICRYLPETKGISLEKMESVVLAKRRKKLQPIQTERYSD

SEQ ID NO: 66941 - protein, 500 aa, Oryza sativa (japonica cultivar-group)
MDVNQLWLLWATLAVSLLYYISNRRRRVGGRRRCPPGPMPLPLVGNLLNLRGHLPPALARLARTYGPVMMLKMGLTTTVVISSGDAAREAFTKHDRHLAARTVLDVTRSLDFADRSMIWLPSSDTVWKTLRGVTAASIFSPRGLAALRGVRESKVRDLVGYFRGRAGEVVDVRHAVYGCMLSLVSSAFFSVDVVDLSAESENEFRQSMTFLMEVVSKTNVSDFFPFLRPLDLQGWRRLTERYLGRVTCFLDDVIDRRFAADASANRHGDFLDSLLDLVSTGKIVRENVTTILLDVFIAGSDTITATVEWAMAELLRNPSEMAKVRAEMDGALGGKKTVDEPDIARLPYLQAVVKEAMRLHPAAPLLLPHRAVEDGVEVGGYCVPKGSMVIFNVWAIMRDPAAWERPEEFMPERFIRRGDDDEVDFWGKTFEFIPFGSGRRVCAGLPMAERVVPFMLASLLRAFEWRLPDGVSAEELDMRHRFTIANFRAIPLKAVPVVVS

SEQ ID NO: 66942 - protein, 380 aa, Clostridium perfringens str. 13
MKVIIFYTKTGGGHLSACKSLEESLNSMNIPVVTLDSLEFAGHLVSKEICSAYNYIVKSVPELFGALYNAGEKISDHNKKSIIYKLNSFYADNILTVLEEEQPDIIISTHIFATQSLSYLKQKNKVKALTASIVTDYTCAPFWEETDLDYYFLPHKDLIKEFKDKGLDSSKLIAFGLPIDSKFKVKTPKEKAKFNLALKKDKPHILIMGGSMGAGSVKDTTLYISKHLKECNITTICGNNKELFKEISEIKKSNPKIHVLQFTHEMNELMDSADILITKPGGLTSTEAMNKSLPIIMINPIPGVESANCNFFMKHNLGIKSNSLHETLKVCEKLISDKNFYEKIVSSQKLNSNINAAEDICKFLITKYHEIQYNSDNNSL

SEQ ID NO: 66943 - protein, 743 aa, Ralstonia eutropha JMP134
MNIALQVPDRLLPGKPYPLGAQWDGLGVNFAVFSANASRIDLCLFSANGRKELARMPLPECTDEIWHGYLPNAALGTLYGFRAFGPYDPARGHRFNPHKLLLDPYARRLSGPVRWSDALFGYRLQSARADLTPDRRDSAPTMPKAVVVDESFHWGDDRPPGVPWQDTVIYEAHLRGVSMLRDDVLPHQRGTFAALCDPRFLDHLLRMGITAVELLPIHAILQDRFLLERGLRNYWGYNTLSYFAPEPSYLATDQLHELKVAVRRLHAAGIEVILDVVYNHTCEGNELGPTVSWRGLDNASYYQLVPGDERHYLNDTGCGNMLNLPHPRVLQMVLDSLRYWVQCFHVDGFRFDLGATLGRDHNGFDPGASFFDAILQDPVLSRVKLISEPWDLGPGGYQLGNHPPGFAEWNDKFRDTVRRFWRGDSGQRGELAARLSGSADLFDRRHRRPWASVNFITAHDGFTLADLVSYNGKHNDDNGEENRDGTDNNYSANWSPDGSVEGPTDDPAILALRARVAQAMLSTLLLAQGTPMLTAGDEWGRSQQGNNNAYCQDNAMSWLDWKQAQTPRGQVLLQMVRRLLALRLRLPSLGANHFSHGNQEPAPGIGDIAWFDTEGQPPSPEAWAAPEIRTLALRRAAAPPRSERLELAHRATREGQPGPVNVTLLLLNAGDTDVVFRLPEPALAWQLVLDSSQPQAEAGRPSNAITEQAVPAHSLVLLAAQAAPQRFDHPAEPARAAPQEAAS

SEQ ID NO: 66944 - protein, 710 aa, Xanthomonas campestris pv. vesicatoria str. 85-10
MRRPASAAYANPSRIRQGRPFPRGAVFDGKGTNFALFSAHATRVELCLFDEQGNETRVDLPEYTNEIWHGYLPDAKPGQRYGYRVHGPYAPTEGHRFNHNKLLLDPYARELDGDLIWSDELYGYTVGHPDGDLSFDERDSAPFMPKCVVVEDTYDWGDDTRLLKPWNETVIYETHVRGYTMRNPQVPEAVRGTFAGLAQPQVLQYIKDLGITAVELLPVLAYLDDQHLLDKGLRNYWGYNTIGFFALKSRYLSSGHRDEFRDMVKAMHKQGLEVILDVVYNHTAEGSELGPTLSFKGIDNASYYRLADDKRYYINDTGTGNTLNLSNSRVIQFVNDSLRYWAGEMHVDGFRFDLATILGREPSGFDQRGGFLDACNQDPLLSEVKLIAEPWDCGPGGYQVGHFPPGWSEWNDKFRDNAREFWKGEDGKLAEFATRFTGSADLFDRRGRRPWASVNFITAHDGFTLRDLVSYNEKHNIDNGEDNRDGSSNDGSCNYGEEGDTDNAEVLQIRERQMKNLLATLLLSQGTPMMLSGDERAQTQGGNNNTYCQDNEITWLDWENDPTDGRLTEFVKSLTRLRKRYPILSRGRFLNGQYNEEAGLRDLTWLNPGGIEMDDAHWTDPAARSVGLLLEGKAQTSGVKELANDDTLLIVINAYHEGVTFTLPSSDEPVHWKLVLSTDEALEVDMMPAGASEFLAPPRSVSVFECKSDQ

SEQ ID NO: 66945 - protein, 550 aa, Oryza sativa
  misc_feature (177)..(177): Xaa can be any naturally occurring amino acid
  misc_feature (219)..(219): Xaa can be any naturally occurring amino acid
  misc_feature (246)..(246): Xaa can be any naturally occurring amino acid
  misc_feature (312)..(312): Xaa can be any naturally occurring amino acid
MGSFARKEHQFLAELGLAPRNPGSFACGAWGGSGPVVTSTNPTNNQARLPPHDPLGSRRSIWFGPPWHFWGVIAEVVEASAREYEEGMRACYDAAKTWMAIPAPKRGEIVRQIGDALRAKLHHLGRLVSLEMGKILPEGIGEVQEIIDMCDYAVGLSRQLNGSIIPSERPNHMMMEXWNPLGVVGVITAFNFPCAVLGWNACIALVCGNCVVWKGAPTXTPLITIAMTKIVASVLERNNLPGSIFXSAFVVGADIGQAISLDTRIPLVSFTGSTKVGLMVQQQVNARFGKCLLELSGNNAIIVMDDADIQLXAVRSVLFAAVGTAGQRCTTCRRLLLHESIYRTFLDQLVEVYKQVRIGDPLENGTLLGPLHTPASRDAFLKGIQTIRSQGGKILYGGSAIESEGNFVQPTIVEISPSAPVVREELFGPVLYVMKVQNLKEAVEINNSVPQGLSSSIFTKRPDIIFKWIGPHGSDCGIVNVNIPTNGAEIGGAFGGEKATGGGREAGSDSWKQYMRRATWSSNLFSCVTPVPKQDGLKTLYQKIIHNFFM

SEQ ID NO: 66946 - protein, 560 aa, Arabidopsis thaliana
MGSSGDVNWKLADHPKLPKGKTIGLIVLDGWGESDPDQYNCIHKAPTPAMDSLKDGKPDTWRLIKAHGTAVGLPSEDDMGNSEVGHNALGAGRIYAQGAKLVDLALASGKIYEDEGFKYISQSFEKGTVHLIGLLSDGGVHSRLDQVQLLLKGFAERGAKRIRVHILTDGRDVLDGSSVGFVETLEADLAALRAKGVDAQVASGGGRMYVTMDRYENDWSVVKRGWDAQVLGEAPHKFKSALEAVKTLRAEPGANDQYLPSFVIVDDNGKAVGPIVDGDAVVTFNFRADRMVMHAKALEYKDFDKFDRVRVPDIRYAGMLQYDGELKLPSRYLVSPPLIDRTSGEYLAHNGVRTFACSETVKFGHVTFFWNGNRSGYFNEKLEEYVEIPSDSGISFNVQPKMKALEIAEKARDAILSGKFDQVRVNLPNGDMVGHTGDIEATVVACEAADRAVRTILDAIEQVGGIYVVTADHGNAEDMVKRDKSGKPALDKEGNLQILTSHTLKPVPIAIGGPGLSAGVRFRQDIETPGLANVAATVMNLHGFVAPSDYETSLIEVVEK

SEQ ID NO: 66947 - protein, 902 aa, Oryza sativa (japonica cultivar-group)
MEPEREASSEWGDGVGVLGFRVKASSCEPAAQKAANEPCLLSHIRIYNKSVLEWEITAGLRYNKPDTFVKVRPRCEAPKRDILYPANHTPCRYVRISCMRGNPIAIFFIQLIGIPIPGLEPDLQPLVNYLLPHITAHKQSSQNIHLQLLKDIASRLPPFLPQIEADLASVTDTPDSSVHFLALLAGPFYPILQLTNERDFTKSLISSADSDALKSSLASTPTMLVHLPINLVKLEEAQPRRSRSPSSVQPACFLAFRSETAVLLLRKAHRDRALGIVCLKASKVLQELLEPDPLLDDASDQPLLCCKLAEKGSDMWSVLPLVQALLPGLTIPVETGSIHPEKVQRGEKDAADQMPPQAPSPAPAPSGSVGGAAWRHLLLLLTGLPLALAALAFALQWRGGGVDDPTARWPPQAFPGMGMTDPTPPSLPSSACGEVLIASSGPSFPYLGGWSFPFGFRFRRGPLTPRVCVQTSTSAGLDQILPWLFYHKVVGVAQFLLFVEGRAAKPQVAGVLESIPGVKVVYRTQELEEQQARSRIWNETWLAGFFYKPCNYELFVKQSLNMEMAIVMARDAAMDWIIHLDTDELLYPGGGAEYSVRHLLADVPGDVDMVIFPNYESSVERDDIKDPFSEVSMFKKNYDHLPKDTYFGMYKEATRGNPNYFLTYGNGKSAARVQDHLRPNGAHRWHNYAKSPNEIKLEEAAVLHYTYTKFSDLTSRRDRCGCKPTKDDVKRCFMLDFDRAVFNNLFEAFTFFLKFRESLCLRESLLLHYDGNNTAIAASWYNERVVWNDKQLNLKLLRKGVLTRIYTPMAIVQGLRESGVFTSSIAAAQSLVNDKVSLKENNVQNKNHTKLEKVSRKFIRANSQASARKILHAVEPASHDSNVSAVPPLSPPSLDNHLLELS

SEQ ID NO: 66948 - protein, 426 aa, Lactobacillus plantarum WCFS1
MTKKAAFHNDEVVLDIHDRPKLGSWLGLSVQHLFSMFGSTVLVPILVGLNPGIALFSSGVGTLMYILITRGKIPAYMGSSFSFIVVMQSLMKTAGYPAIAQGTVAVGCVYLLVSLLVTLIGSDWIDKALPPIVVGPIVMVIGLSLAGTAAKDATMNGSSYDIKYFGVAMATMLLTVIFNMYLRGFMSLVPILLGIVCGYIIAVLVGIVDFSGVEKAQWFAMPAFQLPFISYHPGIYWGAILSMAPIAFVTMSEHMGHIMVLNKLTKRNFFKDPGLNHTLAGDGTASIIAGFVGGPPVTSYGENIGVLAITRVHSIYVLGGAAFFAIVFSFVGKLSALIESIPSPVIGGVSFLLFGVIASSGMRILIDNKVDFNQKRNLMIASAILVIGIGNAYLQLGSFQFSGLAVATVLGIVMNLVLPKTAVNEK

SEQ ID NO: 66949 - protein, 113 aa, Oryza sativa (japonica cultivar-group)
STECRYASICAMESPTKVDDEQWLAYWILYSFITLLEMVAEPVLYWIPVWYPVKVLFVAWLVLPQFKGASFIYKKLVREQLRKYRARGGAAATVTAGEDHKVHIAKAEHDHGH

SEQ ID NO: 66950 - protein, 713 aa, Rhodospirillum rubrum ATCC 11170
MEKVLTVCPYCGSGCKINLLVENDQVIGAEPAQGVTNQGELCLKGYYGWDFLNDPKLLTPRLRKPLIRRTRDSAFEEVSWYEAINFAATRLQEIKHKYGPDSIMLTGSARGPGNEANYVMQKFARAVVGTNNIDHCARVCHGPSVAGLQVTLGNGAMSNSVEEIENTKCVFVFGYNAAVSHPIVARRILKAKEKGAKIIVCDPRFIETARIADLWLPLKNGTNMALVNAFAHVLLEENLYDKDFVAKYTEGLDDYKATVAKYTPEYAEKITGVPAQQIREAMRMYAGAETATVMWGMGVTQWSQAVDVVKGLSGLALLTGNLGKPSCGVAPVRGQNNVQGACDHGALPNMLPGYQPVTDAAARAKFEKAWGVSNLPDKPGVCLTEVPKMVKAGKLKAYYIFGEDPAQTDPDLHEVRESMRDLEFVICQEIFMTKTAMMADVVFPATSWGEHEGVYSSCDRGFQRFYKAIEPQGDVKPDWEIISLMATAMGYPMKYSNTQEIWDELRELCPIYYGATYEKMAGLGYIQWPCPDLDHPGTPYLYADKKFQTPSGKGLLFACEWRPPMEKVDAAYPLILSTVREVGHYSCRTMTGNCHALQTLADEPGYISMHSKDAKALGISDQHLVSISSRRGKIIARADIDDRINEGAVYMTYQWWVGACNELTAEHLDPISKTPEYKYSAVKVEAIADQAWAENHVQEVYSQLKADLANAVA

SEQ ID NO: 66951 - protein, 300 aa, Oryza sativa
MRPPRGRGFGRGGRGDGGGRSGGGGRGFGRGGDSGGRGGRGRGGGRTPRGRGGGRGGGRGGMKGGSKVVVVPHKHNGVFIAKAKEDALCTKNMVPGESVYGEKRISVQNEDGTKVEYRVWNPFRSKLAAAVLGGVDNIWIAPGTRVLYLGAASGTTVSHVSDIVGPTGLVYAVEFSHRSGRDLVNMAKKRTNVIPIIEDARHPARYRMLVGMVDVIFSDARILALNASYFLKNGGHFVISIKANCIDSTMPAEAVFASEVEKLKADQFKPSEQVTLEPFERDHACVVGGYRMPKKQKGTS

SEQ ID NO: 66952 - protein, 232 aa, Coccidioides immitis RS
MASSRAVTRLVAYRRPAALPYSLPSSSSVHRSASTPALTFSTSAVQNATPHGPPQPGFRMPTPKRWDQDEDSTLDKAGKYFLMTELFRGMYVVLEQFFRPPYTIYYPFEKGPISPRFRGEHALRRYPSGEERCIACKLCEAICPAQAITIEAEEREDGSRRTTRYDIDMTKCIYCGFCQESCPVDAIVESPNAEYATETREELLYNKEKLLANGDKWESEIAAAARADAPYR

SEQ ID NO: 66953 - protein, 406 aa, Zea mays
MSDQALFSNKRAPHDKPRAAVGRRRIQTESRRRHHYYHPRPNELLPTPTPAQSDPRTTPCARAASRPSSPARRAARAAARISPSPCPSARSPPPSPSRSLSRQPPPPPGGPPRRASPRPPPRRSSSSSRPPLAELERVRRVGSGAGGTVWMVRHRGTGRPYALKVLYGNHDDAVRRQIAREIAILRTAEHPAVVRCHGMYERGGELQILLEYMDGGSLDGRRIAAEPFLADVARQVLSGIAYLHRRHIVHRDIKPSNLLIDSARRVKIADFGVGRILNQTMDPCNSSVGTIAYMSPERINTDLNDGSYDGYAGDIWSFGLSILEFYLGRFPFGENLGRQGDWAALMCAICYNDPPEPPPTASREFRGFIACCLQKNPAKRLTAAQLLQHPFVAGPHPQPLAAPPPS

SEQ ID NO: 66954 - protein, 646 aa, Xanthobacter autotrophicus Py2
MAFPCGSPPPGAGARPSPRPRWAPPATRCCGCSTSPMRTRSPRSAPIRPLPFWRPTARRSRPTCASASASPAPPFPCPAPPEIPQGSPTPKRVGLMYVYDEFDRTFLQERVAEFRDQVARRLSGELNEEEFKPLRLMNGVYLQLHAYMLRVCIPYGTLSSQQLRALGAVARKYDRGYGHFTTRQNIQFNWIKLNELPDAMADLAKVGIHGLQTSGNCIRNTTTDPWAGAAADEVEDPRLYAEVIRQWSTLHPEFTYLPRKFKIAITAAKHDRAAIRVHDIGLRLHKRDGETGFEVMVGGGLGRSPFIGKTIKDFLPKEHLLSYLEAVLRTYNLGGRRDNIYKARIKIQVHEMGAEAFAKKVEAEWVEIRDGALKLDEAALDAIRDRFKIPDLEALDDQPAELARALATDAAFARWHANSVAPHKAKGHAIVTLSLKPVGAPPGDATAEQMDAIADLADQYAYGEIRVAHEQNLTFPYVRQKDLPALWAKLKAIGVATPNVGLVTDIISCPGLDYCSLANTRSIPIAQKLTERFADEARIADIGRLHVNISGCINACGHHHVGHIGILGVEKKDEEFFQITLGGKGNSKARIGELIGPAVAESEIVDVVESLVDTYLNLRTSPAETFVAAVERLGIEPFKERAYAPR

SEQ ID NO: 66955 - protein, 1442 aa, Arabidopsis thaliana
MDYDPAHAMSRGGSMRQTISRSVSKASRNMEDIFNTSSRRTKSVNEDEEALKWASIEKLPTYNRLRTSLMPELGEDDVYGNQILNKAVDVTKLDGEERQKFIDMVFKVAEQDNERILTKLRNRIDRVGIQLPTVEVRYDHLTVKADCYTGDRSLPSLLNAVRNMGEAALGMIGIRLAKKAQLTILKDVSGIVKPSRMTLLLGPPSSGKTTLLLALAGKLDKSLDVSGEVTYNGYRLNEFVPIKTSAYISQNDLHVGIMTVKETLDFSARCQGVGTRYDLLNELARREKDAGIFPEADVDLFMKASAAQGVKSSLITDYTLKILGLDICKDTIVGDDMMRGISGGQKKRVTTGEMIVGPTKTLFMDEISTGLDSSTTFQIVKCLQQIVHLTEATVLISLLQPAPETFDLFDDIILLSEGQIVYQGPRDHILEFFESFGFKCPERKGTADFLQEVTSKKDQEQYWVDPNRPYRYIPVSEFASSFKKFHVGSKLSNELSVPYDKSKSHKAALMFDKYSIKKTELLKSCWDKEWMLMKRNSFFYVFKTVQIIIIAAITSTLYLRTEMHTRNEIDANIYVGSLLFAMIVNMFNGLAEMAMTIQRLPVFYKQRDLLFHPPWTYTLPTFLLGIPISIFESTAWMVVTYYSIGYAPDAERFFKQFLIIFLIQQMAAGIFRFIASTCRTMTIANTGGVLVLLVVFLTGGFLLPRSEIPVWWRWAYWISPLSYAFNAITVNELFAPRWMNKMSGNSTTRLGTSVLNIWDVFDDKNWYWIGVGGLLGFTVIFNGFFTLALTYLDPLGKAQAILPKEEDEEAKGKAGSNKETEMESVSAKKGMVLPFTPLAMSFDDVKYFVDMPAEMREQGVQETRLQLLKGVTSAFRPGVLTALMGVSGAGKTTLMDVLAGRKTGGYIEGDVRVSGFPKKQETFARISGYCEQTDIHSPQVTVRESLIFSAFLRLAKEVSKEDKLMFVDQVMELVELVDLRDAIVGLPGVTGLSTEQRKRLTIAVELVANPSIIFMDEPTSGLDARAAAIVMRAVRNTVDTGRTVVCTIHQPSIDIFEAFDELLLMKRGGHVIYSGPLGRNSHKVVEYFESFPGVPKIPEKYNPATWMLEASSLAAELKLGVDFAELYKASALCQRNKALVQELSVPPQGATDLYFATQFSQNTWGQFKSCLWKQWWTYWRSPDYNLVRFIFTLATSLMIGSVFWQIGGKRSNVQDLTMVIGAIYAAVVFVGINNCSTVQPMVAVERTVFYREKAAGMYSAIPYAISQVTCELPYVLIQTTYYSLIIYSMVGFEWKASKFLWFIFINYFSFLYWTYYGMMTVSLTPNQQVASIFASAFYGIFNLFSGFFIPRPKIPKWWVWYYWICPVAWTIYGLITSQYGDVETPIALLGGAPGLTVKQYIKDQYGFESDYMGPVAGVLVGFTVFFAFIFAFCIKTLNFQSR

SEQ ID NO: 66956 - protein, 290 aa, Clostridium perfringens SM101
MNINSLKEEVDQSLKAYFDKDREYNKVLYDSMAYSVNVGGKRIRPILMLLSYYIYKSDYKKILTPAIAIEMIHTYSLIHDDLPCMDNDDLRRGKPTNHKVFGEAIAVLAGDALLNEAMKILVDYSLEEGISALKATKIIADAAGSDGMIGGQIVDIINEDKEEISLKELDYMHLKKTGELIKASIMSGAILAEASERDIKKLEDFGYKLGLAFQIKDDILDVVGNAKDLGKNVHKDQESNKNNYITIFGLEECKKKCVNITEECIDILSSIEGNIEPLKVLTMKLLERKF

SEQ ID NO: 66957 - protein, 838 aa, Coprinopsis cinerea okayama7#130
MAYTPSDFDGNQDEYAPPEHHVIEPDMRGMEEALGFSVSAFARSRSRAATPTEAGPSTVKQQPFSPAIAADKKGKQRAERQMDVAGAFTQNAEAQRSKKEKKKVKKKRQSVVPVVKLSGFGSKDDPFTLDDSDDDAGKASATAPVGGVSWAESNLNPPSTVTATATAPLPPLPVRPPAPPPTLVATSSTTATTGTARANATAILSDPHVAGGTKAPALEPAVSTSTAIGSSVKDASKGSKLKELLEQERSRVAASTPVPIPRPASQAPVTPSIASVPLAPTSNPTVSPDKSFTETRGGESRGSSEEQESRDTSAKSTPSSAVVLPSSATKAVPVLGTSMTTAVGVHSREEGMEDEDDDLPTLPLTGPEEVGTSDENAAMEVDDLLVPSRQSSAEIEDITVALGSQDIANGEPSRQPSSDEDEGSPSTPEDQDNSEFDVANDEDDDDELALVPGQPPPPLESKTARIEKFKAAAVTTPARTGASGFQQLTFHDYRLHLQNTPFEVYYARDLPHSLQDGINNTKDMHLLAGMRDLFKAFIQEHTVQDEPDAPPIDIINNIDDEPAPPWEFHYSNQMWHSDNVPPPDVKNLEGCDCVGRCTKSCACLRRQKKLLDPEGPPGQVNDFMYDKKGRLRHPEFQEPIVECNALCGCDQDCVNRVVQNGRKVQVSIQKTKHKGWGVFAGPKKIPKGTFLGVYSGELLTDEEGDERGKVYNKFGRTYLFNLDFWFLKANLTPEEAEEWDNKYVVDAFNVGNFTRFLNHSCDPNCKIHPCFINEANKEKPLLTVFTDRDIDPYEEICFNYTGMDADEAKARVSEMAKTDKIYEPCMCGAKNCCGVMFE

SEQ ID NO: 66958 - protein, 480 aa, Glycine max
MAAASRRLRDLQSSAGNKICVDCSQKNPQWASVSYGVFMCLECSGKHRGLGVHISFVRSVTMDSWSDIQIKKMEAGGNDKLNAFLAQYSIPKETDIVTKYNTNAASVYRNRIQAIAEGRPWRDPPVVKENLSAGKGKPPLTQTRRNNDSGWDDWGNEGSPRSKSMSTGDFRTLNGAGGAPARSRSTEDIYTRSQLEASAANKEGFFARKMAENESRPEGLPPSQGGKYVGFGSSPTPPPQRRNDAQNDYFSVVSQGIGKLSFVAASAANVVQVGTKEFTSKVKEGGYDHKVNETVNVVTQKTSEIGQRTWGIMKGVMAMASQKIEEYTKDDPNWKNDNWQRNENDTNGYYQDFNREKKGWNSSTGREQSSSGEYKTESSSSWDDWDHKDSRKEEPAKGSTHSSGGQFSTYNSSSWDDWEHKDSRKEEPAKGSAPHNNDDWAGWDNAKDDGFDNIYEGASNKKGVGHKGKSDGTWTEEGFL

SEQ ID NO: 66959 - protein, 579 aa, Zea mays
MEVRGGVGQGSAARHPPAPEPSRAAARVQAGDALPLPIRHTNLIFSALFAASLAYLMRRWREKIRSSTPLHAVGLAEMLAIFGLVASLIYLLSFFGIAFVQSIVSSGDDDEDFLVGSGSSGSAAAPSRQHAQAPAPCELLGSPAAAPEKMPEDDEEIVASVVAGKVPSYALEARLGDCRRAAGIRREALRRITGRDIEGLPLDGFDYASILGQCCELPVGYVQLPVGVAGPLLLDGRRFYLPMATTEGCLVASTNRGCKAIAESGGATSVVLRDAMTRAPVARFPTARRAAELKAFLEDPANFDTLSVVFNRSSRFARLQGVQCAMAGRNLYMRFSCSTGDAMGMNMVSKGVQNVLDFLQDDFHDMDVISISGNFCSDKKPSAVNWIEGRGKSVVCEAVIGEEVVKKVLKTDVQSLVELNTIKNLAGSAVAGALGGFNAHASNIVTAIFIATGQDPAQNVESSHCITMLEPVNAGRDLHISVTMPSIEVGTVGGGTQLASQSACLDLLGVRGASRDRPGSNARLLATVVAGGVLAGELSLLSALAAGQLVKSHMKYNRSSKDVSSTTATEKTRQREVDV

SEQ ID NO: 66960 - protein, 86 aa, Glycine max
MGRDTETSEATYAVEHLAALNRYKPDIQADLENYVHDHGSTQTYSPDANLCLLLLCQNEPEKMSSQIEARILVKALMAMPAPDFNL

SEQ ID NO: 66961 - protein, 155 aa, Brassica napus
  misc_feature (36)..(36): Xaa can be any naturally occurring amino acid
  misc_feature (111)..(111): Xaa can be any naturally occurring amino acid
  misc_feature (129)..(129): Xaa can be any naturally occurring amino acid
MQQAYEQALDEEAGYDDYYSDDNGLDEYDEEEEEEXPPKEEVEYLELRQRIKESIRKKSGSGGVTAAQSSQDRRKKQLPYNDFGSFFGPSRPVISSRVIQESKSLLENEIXNSNQLKKRPVPASSSGDXNVSHEKKRPKVLSATRKKVETLRDPE

SEQ ID NO: 66962 - protein, 332 aa, Candida glabrata CBS 138
MVRIAINGFGRIGRLVLRVALSRSNIEVVAVNDPFITTDYAAYMFKYDSTHGRYAGEVTHDDKHIIIDGKKIAVHQERDPANLPWGSENIDIAIDSTGVFKELDTAQKHIDAGAKKVVITAPSSTAPMFVVGVNEDKYTSDLKIVSNASCTTNCLAPLAKVIDEAFGIEEGLMTTVHSLTATQKTVDGPSHKDWRGGRTASGNIIPSSTGAAKAVGKVLPQLQGKLTGMAFRVPTVDVSVVDLTVKLQKETTYDEIKKVIKQASEGKLKGVLGYTEDAVVSSDFLGDSRSSIFDASAGIQLSPKFVKLVSWYDNEYGYSTRVVDLVEHVAKN

SEQ ID NO: 66963 - protein, 426 aa, Bacillus licheniformis ATCC 14580
MAVEQMTMPQLGESVTEGTISKWLVSVGDHVNKYDPIAEVMTDKVNAEVPSSFTGTIAELVGKEGETLQVGDVICKVETNEEAKPEAEAVSKPDQEEAEPAKPEAKDTSQKKRYSPAVLRLAGEHNIDLEQVEGTGAGGRITRKDIQRIIASGAVPQTDAAPEKQPGANAAGAIEPDQKPAQAAPQAAPPQSAAGDVEIPVTGIRNAIATNMVRSKHEIPHAWTMMEVDVTGLVSYRNKIKNEFKKKEGFSLTFFAFFVKAVAQALKEFPQMNSMWAGDKIIQKKDINISIAVATEDALYVPVIKHADEKTIKGIAREISELAHKVRSGKLTSGDMSGGTFTVNNTGSFGSVQSMGIINHPQAAILQVESIVKRPVVMEHGMIAVRDMVNLCLSLDHRVLDGLICGRFLARVKEILEQIDDHTSIY

SEQ ID NO: 66964 - protein, 327 aa, Bacillus licheniformis ATCC 14580
MPVMSYIDAVTLALKEEMEKDPRVFVLGEDVGKKGGVFKATAGLYDQFGEERVMDTPLAESAIAGVGIGAAMYGMRPVAEMQFADFIMPAVNQIISEAAKIRYRSNNDWNCPIVIRAPYGGGVHGALYHSQSVEAVFANQPGLKIVMPSTPYDVKGLLKAAIRDDDPVLFFEHKRAYRLIKGEVPSDDYVLPIGKADVKREGEDITVITYGLCVHFALQAAERLAKDGISAHILDLRTVYPLDQEAIIEAASKTGKVLLMTEDTKEGSIMSEVAAIISEHCLFDLDAPIKRLAGPDVPAMPYAPTMEKFFMVNPDKAEAAMRELAEF

SEQ ID NO: 66965 - protein, 345 aa, Pisum sativum
MVVPSPTSMIRTKKTKAVGIPTIDLSLERSQLSELVVKACEEYGFFKVVNHSVPKEVISRLDEEGIEFFSKNSSEKRQAGTSTPFGYGCKNIGPNGDKGELEYLLLHSNPISISERSKTIAKDHPIKFSCIVNDYIKAVKDLTCEILELAAEGLWVPDKSSLSKIIKDEHSDSLLRINHYPPVKKLGNDNWDPSKIQNSNNNNIGFGEHSDPQILTILRSNNVGGLQISTHHGLWIPVPPDPSEFYVMVGDALQVLTNGRFVSVRHRVLTNTTKPRMSMMYFAAPPLNWLISPLSKMVTAHSPCLYRPFTWAQYKQAAYALRLGDTRLDQFKVQKQEDSNDSHSL

SEQ ID NO: 66966 - protein, 422 aa, Desulfovibrio desulfuricans G20
MERSRNLFERAQKLIPGGVNSPVRACLSVDSAPVFVERGQGSKLYSVDGREYIDFVESWGPLLLGHAHPAVNKAIHEAVDKGSSFGAPCEDEIRLAEAVVDAVPSIEMVRMVSSGTEATMSALRLARGYTGRNKLIKFEGCYHGHGDAFLASAGSGVATLSIPGTPGVPDTVVADTLLAPYNNLERVKALFENHGADIAAVIVEPTAGNMGLVRPAAGFLQGLRELCDRYGALLIFDEVITGFRLSYGGAQQYFGITPDLTTLGKIIGGGMPVGAYGGRREIMERIAPCGDVYQAGTLAGNPVAMAAGIATLAELKKADYPALEKRVDALASEIEAILKAKGVPVTVNRLASMFTIFFTEEPVTDYDSAKKADGTLYTRFYQQMRDQGIYLAPSGFECAMVSLAHTEDDFAAMLAAVRNVTF

SEQ ID NO: 66967 - protein, 473 aa, Bacillus licheniformis ATCC 14580
MATEYDLVILGGGTGGYVAAIRASQLGLKTAVVEKQKLGGTCLHKGCIPSKALLRSAEVYRTAKKADEFGVVIPEVGLRFSQVQSRKQKIIDQLHNGVKHLMKKGKIDVYEGIGRILGPSIFSPMPGTVSVEMANGDENEMLIPKNVIIATGSRPRSLPGLELDGENVLSSDEALELEQLPASMLIVGGGVIGIEWASMLNDFGVDVTVIEYADRILPTEDADISREMQAQLAKKGITMITGAKVLPDTLEKGDAVSIQAEKDGEKQSYSAEKMLVSVGRQANIEGIGLENTDIQVENGFIVTNSMYQTKESHIYAIGDVIGGLQLAHVASHEGITAVEHIAGENPHAIDYSLVSKCIYSSPEAASVGLTEGEAKAQGKSVKVGKFPFQAIGKALVYGETDGFVKIVADRETDDILGVHMIGPHVTDMISEAGLAKVLDATPWEVGQTIHPHPTLSEAIGEAALAVDGKAIHF

SEQ ID NO: 66968 - protein, 342 aa, Lactobacillus plantarum WCFS1
MADVQLDWNNLGFEYRNLPYRYRAYWKDGAWYKKELTGDATLHISEGSTALHYGQQDFEGLKAYRTKDGSVQLFRPDRNAARMQTSCERLLMPQVPTDMFVDAVKQVVKANQDYVPPYGTGATLYLRPLMIGVGGNIGVHPAQEYIFTVFAMPVGSYFKGGMTPTNFTTSEYDRAAHKGTGAYKVGGNYAASLFPGQEAHANGFSDCVYLDPVEHRKIEEVGSANFFGITKDGTFVTPKSPSILPAVTKYSLLYLAEHKFGMKTEQGDVYIDDLDRFAEAGACGTAAVISPIGGLEHQGKLHVFYSETEVGPVTKKLYDELTGIQFGDREAPEGWVQKVELD

SEQ ID NO: 66969 - protein, 302 aa, Arabidopsis thaliana
METTVDTTITWVIKNFSSLQSAPIYSDIFVVGGCKRIMAYPKGINKAHDSFSLFLNVPDNESLPTGWRRHAKVSFSLVNQGSEKLSQRKVTQHWFVQKAFTWGFPVMITHTELNAKMGFLVNGELKVVAKIEVLEVVGKLDVSKESSPIMKTIDVNGFQVLPSQVDSVKRLFEKNLDIVSKFRLKNPYLKTACMNLLLSLTETLCQSPQELSNDGLSDAGVALAYLIETGLKLDWLEKKLDELKEKKKKEESCLVRLREMDEQLQPFKKRCLDIEDQISKEKEELLAAREPLSLYDDIDNNV

SEQ ID NO: 66970 - protein, 322 aa, Desulfovibrio desulfuricans G20
MQELLEYLGAIQPKVNETLAAETGTLNTMVQPVATHVLSAGGKRLRPLLAILFARALGRGGDDIYPLACSVELLHSATLLHDDIIDDAALRRGLPAAHTLFGSTRTILAGDALLALANLIVSRYGDTRLTECIARAIIETATGEIAEIEYLRSTGHPQETYIEIIKGKTAWMIQASCQLGAIAAGATAQQEQAACDFGMNLGIAFQIVDDALDFSPSAGETGKPVAGDLREGKLTPPLHMYLERLEGADRQEFLHKFTTGTFSDADVDNVARAVRGQGLDKATRDLADTYLKKAADALHMLDESREKTVLRQTVDYVKNRSR

SEQ ID NO: 66971 - protein, 117 aa, Arabidopsis thaliana
  misc_feature (58)..(58): Xaa can be any naturally occurring amino acid
  misc_feature (66)..(66): Xaa can be any naturally occurring amino acid
  misc_feature (98)..(98): Xaa can be any naturally occurring amino acid
MALGATTKRTIGLAATLRRVVRPLVTDAGVESDTRRGGTGRVSGIQEGHFFGRGIKYXPVRTVTKXGSGKLGKGKINFVSTLKWENPLWGWPFTGDPXAKVGDFVFVLDPEKAVNFL

SEQ ID NO: 66972 - protein, 397 aa, Clostridium perfringens SM101
MNFNKKTIEDVQVKGKKVLVRCDFNVPLKDGVITDENRLNGAMPTIKYLVDNGAQVILCSHMGKPKGEAKPEFSLAPVAKRLSEMLGKEVVFAADDNVVGENAKKAVAEMKDGDVVLLQNTRYRKEETKNGEELSKELASLAEMFVNDAFGTAHRAHCSTVGVTEYLKPAVCGYLIQKELKFLGDAVETPERPFVAILGGAKVSDKINVINNLLEKVDTLIIGGGMAYTFLKAQGYTVGSSLVEEDKVEYAKEMLAKAEEKGVKLLLPVDHRVAKEFKDVEAVVTEDQNIAEGFMGLDIGPKTEAIYAEAIKDAKTVIWNGPMGVFEFENFNKGTIAVAKAMAEADATTIIGGGDSAAAVNILGFGDKMSHISTGGGASLEFLEGKVLPGIAALNDK

SEQ ID NO: 66973 - protein, 1263 aa, Arabidopsis thaliana
MNPREFISNLPDEILGKILSLLPTKLGVSTSVLSKRWRNLILLVDNFDLEDSSTSGFSAFLEQTVARLNTCPIKRLSLNGRHYRFSSADSWISTAFERGCLELHLQSQYLDTGILSSNTLVKLTLSDQIYLQGLVPHDGTVFFPALKTLSLGAVVADRDVYESLISGCPVLDELSIRDGCDDPPTWKKSVVNKSVKRLTVSFHHPMSAWAYEDNVWFKTQSLVFLDYSAFVSQGYTIVDRMDSLVEARLDLRLWVSTDSYDSDYEDKDFDVYRPYDVFGDVTSLVSGIRKVKTLHLSPDSLEAFFFCCNHMPVFNNLRNLSLESDEEKGWQALPLLLNNSLNLHTLSIKGLVHRVTSRCGDACACISERKTGMCCLSACRIKVLEITGYGGSFIELKQMRHFLGKLQCLETVRIGVERDGNNEHLRANLSSLHRASSECNIQFCGILNLVASVLAMTEVASSVVYEVLGRRAQDVDEPIMDYIINVLADEDFDFGEEGEGAFDAVGELLVAAECVSDFEECRLVCSKLSDKFGKHGLVKPTPTVRSLAMPVRMNDGMDDGPVKKKKPEPVDGPLLTERDLAKIERRKKKDDRQREVYSNGSFFTGFELRICFLSCVYLLLQYQQHVAEMEAAKAGMPTVSVNHDTGGGSAIRDIHMDNFNVSVGGRDLIVDGSITLSFGRHYGLVGRNGTGKTTFLRYMAMHAIEGIPTNCQILHVEQEVVGDKTTALQCVLNTDIERTKLLEEEIQILAKQRETEEPTAKDGMPTKDTVEGDLMSQRLEEIYKRLDAIDAYTAEARAASILAGLSFTPEMQLKATNTFSGGWRMRIALARALFIEPDLLLLDEPTNHLDLHAVLWLETYLTKWPKTFIVVSHAREFLNTVVTDIIHLQNQKLSTYKGNYDIFERTREEQVKNQQKAFESSERSRSHMQVSFLLLENELINSVSNSSLAFIDKFRYNAKRASLVQSRIKALDRLAHVDQVINDPDYKFEFPTPDDKPGPPIISFSDASFGYPGGPLLFRNLNFGIDLDSRIASKKAPPLSLDYEITQMIHVYKPSSIICGNNKCSIKEHNFNLYIWFSRRFAVVGPNGIGKSTILKLISGDLQPSSGTVFRSAKVRVAVFSQHHVDGLDLSSNPLLYMMRCYPGVPEQKLRSHLGSLGVTGNLALQPMYTLSGGQKSRVAFAKITFKKPHLLLLDEPSNHLDLDAVEALIQGLVLFQGGICMVSHDEHLISGSVDELWVVSDGRIAPFHGTFHDYKKLLQSST

SEQ ID NO: 66974 - protein, 775 aa, Coprinopsis cinerea okayama7#130
MSDITLKEEGNVLDINLRDIEKTLENESPADTHSFTTTLSGRRSDDYSVFDPNYDSDLDNLEDDSPYPEVRSAVANTDDPDMPASTLRAWIMGVLWAIIIPGMNQFFYFRYPSVLIGGLVAQLLIFPVGRAWVRLLPCVKIFGYELNPGPFTIKEHVLVTIMATVGAQSAYATDIIAVQKVFYGQEWSFAYKWLLVMSTQLIGFSIGGIARRFLVTPPSMIWPNTLVSCALFNTLHSQQYAGIGQHDGISRERYFLYVFVGAALWCLLPGYLFKALSVFTWVCWAAPDNVKINQIFGYHSGLGFSLLTFDWSQIAYIGSPLATPWWAEANVMIGFFIFYWILTPILYYTNVWHSEFLPISSIHAFDNTGKRYNHTRIIDQNATLDVEAYENYSPLYLSTTFVMSYGLSFLSITSTITHALIYFWKPIRLQMRRSMREQPDVHARLMSQYPQVPDWYYACIFVWPTGMTIWALVIALLIALFYVIPIGMIQAITNRQVGLNVITELIVGFMLPGRPNAMMIFKTYGYVTMSQAMQFTADFKLGHYMKVPPRPMFWCQIIATVIAGTVQLGVQAWMFNNIPDICTSGQKDSFVCASTNVFGTASVIWGLIGPAEHFGKGQIYHVLTYFFLIGAACPVLLWLVTKRYPRSILNYLNFPLIFTGVGQIPPATAVNYVPWAIVGFIFQYVIRRKHFSYWTKYNYVLSAALDAGTAIGLILIYFCLQYPMGGNIGKNTIQTWWGNRVYKETLDWKSAPLRQLSQGDTFGRPLNSVTRLFGL

SEQ ID NO: 66975 - protein, 250 aa, Aspergillus nidulans FGSC A4
MGVAIDKCETRPANIEAILSGLDRYNPETTTVFQDYVVQQCEDRTFDCYANLALLKLYQFNPHLLQPETVTNILVKALTVFPSPAFSLCLALLPAYTQPFPSSEAEATAAQMSDFVESVQKLARLSSLLESAQYAQFWSTLNSDDLYADLVADVAGFEELVRIRIAVEVGKAFREVNAEVLEQWLDVRNSEALEKFVTEVCSWEVDKSGSATVVKVPTNKENEARSEVKSERVGVDMFGRVIRRGFEQAA

SEQ ID NO: 66976 - protein, 458 aa, Streptococcus agalactiae 2603V/R
MENHRYEDEGKFQRKMTSRHLFMLSLGGVIGTGLFLSSGYTIAQAGPLGAVLSYLIGAVVVYLVMLSLGELAVAMPVTGSFHTYATKFISPGTGFTVAWLYWICWTVALGTEFLGAAMLMQRWFPNVPAWAFASFFALVIFGLNALSVRFFAEAESFFSSIKVIAIIIFIILGLGAMFGLVSFEGQHKAILFTHLTANGAFPNGIVAVVSVMLAVNYAFSGTELIGIAAGETDNPKEAVPRAIKTTIGRLVVFFVLTIVVLASLLPMKEAGVSTAPFVDVFDKMGIPFTADIMNFVILTAILSAGNSGLYASSRMLWSLANEGMLSKSVVKINKHGVPMRALLLSMAGAVLSLFSSIYAADTVYLALVSIAGFAVVVVWLAIPVAQINFRKEFLKENQLEDLSYKTPFTPVLPYITIILLLISIVGIAWDSSQRAGLYFGVPFIIFCYIYHKLRYKKW

SEQ ID NO: 66977 - protein, 331 aa, Magnaporthe grisea 70-15
MASVVKLDFSQFTHGSAKDRKKFGDELVKALNKSGFVKLSNHGLSDQEVEDVMQISRDFFHLPQSKKQELACPPGPNPQRGWTGPGSGEYVAKTRKENYEGLDVNKLIDAREHFDVGPEDDTQFPNRWPSDQDVPGFREKATRHYQTCRRIALQILEGIEVGLDLPGIFVNRCRTDASELCINVYPEIQAEKIDDYTKRIWPHTDYGVITLLFQDGVGGLELENQDAPGTFLPVTPTPPGESIEMVVNAADCFERWTNGFIKAGLHRVTTPCHVTEGKVVLPERCSLAYFLKATRDTMVGPLPQFVSEANPARFEEMTALEFQQLRNAVLY

SEQ ID NO: 66978 - protein, 198 aa, Streptococcus agalactiae 2603V/R
MAEEFLNTHNASILLSAANKSHYPQDDLPEVALAGRSNVGKSSFINTLLGRKNLARTSSKPGKTQLLNFYNIDDKLRFVDVPGYGYAKVSKTERAKWGKMIEEYLVTRDNLRVVVSLVDFRHDPSADDIQMYEFLKYYEIPVIIVATKADKIPRGKWNKHESSIKKKLNFDKKDHFIVFSSVDRTGLDESWDTILSEL

SEQ ID NO: 66979 - protein, 101 aa, Zea mays
  misc_feature (62)..(62): Xaa can be any naturally occurring amino acid
MDEKATMESKLSSAAAFVEGGVQDACDDACSICLDAFCDSNPSTMTKCKHDYHLQCILEWCXIIHRSSQCPMCWQHISMKDPMSQELLEAVEQERNIRANP

SEQ ID NO: 66980 - protein, 536 aa, Phanerochaete chrysosporium
MGLTQAQRLVLGQLARLVAPALAVCVLLAAARRTQLVRAPVWADALIALIAIPLFHVGRAHWRVDVLQLVDEAYRRGFLSDYFYEKFGELGHTYNFYVLWDMDYCTEDAAVIKAVLATDFNNWVKGERFDSYMHSVLGTGVFNADGELWKFHRSMTRPFFARERITDFETFNRHAEEAILKMKERLREGFAVDFADLISRFTLDAATEFLFGACTTSPRRSARRRTQSRIARASRTDTPMRTVDRYLTPIIERALAMSRAAKQAPQGEKEEVADGETLLDHLARYTTDPTILHDEILNIMIAGRDTTGGTLTFVIYFLTQHPDVLQRLRQEILDVVGPSNLPTYDDIKQMKYLRAVLNETQRLYPPVPWNMRYAVEDSIVPNSEPEGKPWFIPAGASVSYSVHCMHRRKDYWGPDAEEFDPDRFLDERLHKYLTPNPFIFLPFNAGPRICLGQQFAYNEMSFFLVKLLQTFEDISFERDAFEPNALPPAEWAKFPGRKGKEKFWPRAHLTLYSEVRMTAGGMWVKMREAQAMGQVA

SEQ ID NO: 66981 - protein, 801 aa, Staphylococcus aureus subsp. aureus MRSA252
MAKQKLVMIGNGMAGIRTIEEILERANDLYDITVIGKEPYPNYNRIMLSNILQNKMTVEETIMNPYEWYEEHDIKLITNDPVVDVDRANQNVTTANGIEVAYDKLIFATGSKAFVIPVPGSTLPSVIGWRTIDDTEQMMNIAKTKKKAIVIGGGLLGLECARGLLDQGMEVTVLHLAEWLMEMQLDRKAGNMLKADLEKQGMKFEMQANTTEILGEDDVEGVKLADGREIPTDLVVMAVGIRPYTEVAKESGLDVNRGIVVNDVMQTSDSNVYAVGECAEHNGKVYGLVAPLYEQGKVLADHLTNKETNGYKGSTTFTSLKVSGCDLYSAGQIVENAEIKGIEIFNSVDNNYKKIFLKDGNVVGAVLYGDIDDGSRFYNMMKKGESTEDYTLVSLLTKGGEEASLSIADMADDETICGCNGVDKGTIVNAITENGFTTVEEVTAKTKAGNSCGKCKPQIAQILQHTLGDDFVAAKPAGICGCTDLTRDQIVTQIRAKGLKTSKEVRHVLNFKNKGGCPKCRPAINYYLNMVYPHDHEDERESRFANERYHANIQNDGTFSVIPQMRGGVTDADQLIRLGEVAKKYHVPLVKVTGSQRVGLYGVKKEELPNIWEDLGMRSASAYGKKTRSVKSCVGKEFCRFGTQYTTRLGIRLEKTFEYIDTPHKFKMGVSGCPRSCVESGVKDFGIISVENGFQIYIGGNGGTEVEKAEFLTTVETEDEVIKLCGALMQYYRETGIYAERTAPWLRRLGFENVKEVLLDPERQNELFERIMDAKKAVEAEPWEAITSNAQARKIFEVEKV

SEQ ID NO: 66982 - protein, 567 aa, Xanthobacter autotrophicus Py2
MHARENCPPARSLLGRRHRRQRDTPAHRRGGGRPGDPGGCALPLWPVQGQGGAGFHHRDRDPAARAPGAGHRHQPDPGGGGQDHHHHRPWAMPWARLGTRAAVCLREPSLGPVFGAKGGATGGGRAQIIPMQDINLHFTGDLHAITAAHNLLSALIDNHIHWGNGLDLDARRISWRRVMDLNDRVLRHVTVGLGGPGNGFPREDGFDITVASEVMAILCLATDLADLEERLSRMVIGQTRGRRLVTAEELGGVGAMVALLRDAFQPNLVQTMEGTPAFVHGGPFANIAHGCNSVMATKAALGLADVVVTEAGFGADLGAEKFLDIKCRQAGLAPSAAVVVATVRALKMHGGVSLKELGTPDPHAVTRGCANLKRHVENLEKFGLPVVVALNHFTSDTPEETQAVRATLAPLGVGVHVCGHWAKGGAGAEDLARAVLELVARPSTFHTLYPDQMPLTAKIETIARQIYRAARVDITPAAARKLHEYEIAGFGDLPVCMAKTQYSFSADPAARNAPEGHVLPVREVRLSAGAGFVVALAGDIMTMPGLPSAPAAEQIFVMPDGFIAGLS

SEQ ID NO: 66983 - protein, 130 aa, Glycine max
MVRTSVLNDALKSINNAEKAGKRQVLIRPSSKVIVKFLQVMQKHGYIGEFEEVDDHRSGKIVVQLNGRLNKTGVISPRYNVKLADLEKWTVRLLPSRQFGYVILTTSAGIMDHEEARRKHVSGKIIGFFY

SEQ ID NO: 66984 - protein, 382 aa, Oryza sativa (japonica cultivar-group)
MQRLQKQLLPALRAAFPLPASHFSSRLLSASTATLSPTRFVDEDALVAACGLTGAEALKASKRLQKVPSNLDAALTFLAFLADFRLSKDDIAAASSRYPRFLHLKVDETLTSQVARLRDIGLSTPEIGRLITIAPCILSNPRTISRLEFYLSFLGSYPRVHSALRNNSSLLRRNNIESEVKPNIAFLEQCGLTTCDIAKILMSGSRILIMQPEHVKEIVACADKFGMPRESAGFRYALMAVTGISPVRVSAKLDFLRMVIGCSDAQLHIAVSRFPLILTYSEVKLSRSLEFLKAEVGLEPQYIVLRPALLGYSIQKRLMPRYHVMKVLNEKGLLKKDTDFYSMVKIVEESFFKKFLLPYHRSVPGLEKAYLAAREGKMFPEI

SEQ ID NO: 66985 - protein, 463 aa, Salmonella typhimurium
MLAFLNQVRKPTLDLALDVRRKMWFKPFMQSYLVVFIGYLTMYLIRKNFNIAQNDMISTYGLSMTELGMIGLGFSITYGVGKTLVSYYADGKNTKQFLPFMLILSAICMLGFSASMGAGSTSLFLMIAFYALSGFFQSTGGSCSYSTITKWTPRRKRGTFLGFWNISHNLGGAGAAGVALFGANYLFDGHVIGMFIFPSIIALIVGFIGLRFGSDSPESYGLGKAEELFGEEISEEDKETEENEMTKWQIFVEYVLKNKVIWLLCFSNIFLYVVRIGIDQWSTVYAFQELKLSKEVAIQGFTLFEVGALVGTLLWGWLSDLANGRRALVACVALALIIATLGVYQHASNQYVYLASLFALGFLVFGPQLLIGVAAVGFVPKKAIALADGIKGTFAYLIGDSFAKLGLGMIADATPVFGLTGWAGTFAALDAAAIGCICLMAMVAVMEERKIRREKKIQQVNIA

SEQ ID NO: 66986 - protein, 118 aa, Oryza sativa (japonica cultivar-group)
MAMATSSASTVSFSARPSAASAVRPCAAAGRARARAAAGESGKWWAPLLGWSGKADYIEAPAPAVVAAAEESEARRRPFVGGLTEEKARELRARMVETESFHDAMYHSAIASRLARSA

SEQ ID NO: 66987 - protein, 418 aa, Ralstonia eutropha JMP134
MTASSGKRRFARIDRLPPYVFNITAELKMAARRRGEDIIDMSMGNPDGATPPHIVAKLVEAAQRPDTHGYSASKGIPRLRRAISHWYRERYDVEIDPDTEAIVTIGSKEGLAHLMLATLDRGDSVLVPDPSYPIHIYGAVIAGADIRSVPLVPGVDFFAELERTIRGSYPKPKMIVLGFPSNPTAQCVELDFFERVIALARKHDIFVVHDLAYADIVFDGWKAPSIMQVPGAKDIAVEFFTLSKSYNMAGWRIGFMVGNPDLVAALTRIKSYHDYGTFTPVQIAAIAALEGDQECVKEIAAHYQSRRDVLAKGLIESGWLVDIPKASMYIWARIPEPYRALGSLEFAKQLLAKAKVSVSPGIGFGDYGDEYVRFALIENEARIRQAVRGIKAMFRADGLVKVPASEHADGHGKEKGKG

SEQ ID NO: 66988 - protein, 249 aa, Glycine max
MVVAVLNVQNTTNFFVFIFRLFPEVIASILSDSLKRERVLSLCDASDVLREAFSQTEAHMNNYYEGCTATVLLVWTDGDENFFAQCANVGDSTCIMSVNGKQIKMSEDHKFTNYSERLRIEETGEPLKDGETRLYGINLARMLGDKFLKQQDSRFSSEPYISQVVHIDQASKAFAILASDGLWNVISVKKAIQLVLQMRERCYSERQNTAEKIASLLLNEAKTLRTKDNTSVIFLDFDTFNRFSCKVES

SEQ ID NO: 66989 - protein, 366 aa, Clostridium perfringens SM101
MMQPIKKIAILTGGGDCPGLNAVIRAVTRTAILKYGYEVIGYKFGYRGLYNNDFVKLDLDSVSGILHRGGTILHSSNKDNLFDYQVEDENGKIVKKDVSDVGVENLKKEEVDALVVIGGDGTLTSARDFSRKGVNVIGVPKTIDNDLLATDVTFGFNTATEIATEALDRLHTTAESHHRIMLLEVMGRNAGWIALESGIAGSADVILLPEIPYDINKIVEKVKEREESGKQFTIIVVAEGAKPKDGEVVVSKIVDDSPDPVRLGGIANKLAMDLEGLIKNHEIRSTVLGHIQRGGNTSTYDRILSTKYGVKAVELINSNLFGNMVALKGNKVSYESLENVIGNTKNVDPEGELVNTAKSIGISFAD

SEQ ID NO: 66990 - protein, 339 aa, Glycine max
MDHSADAQRTDLMTITRFVLNEQSKHPESRGDFSILLSHIVLGCKFVCSAVNKAGLAKLIGLAGETNVQGEEQKKLDVLSNDVFIKALISSGRTCILVSEEDEEATFVEPSKRGKYCVVFDPLDGSSNIDCGVSIGTIFGIYLIKEDHEPTVEDVLQPGKNMLAAGYCMYGSSCTLVLSTGSGVNGFTLDPSLGEFILTHPDIKIPKKGKIYSVNEGNAKNWDGPTTMYVENCKYPKDGSSPKSLRYIGSMVADVHRTLLYGGIFLYPADKKSPNGKLRVLYEVFPMSFLMEQAGGQAFTGNQRALDLVPKKLHERSPIFLGSYEDVEEIKALYSADEK

SEQ ID NO: 66991 - protein, 337 aa, Zea mays
NPPTTRSSGRGGGGGSFVAGQQPTRTRGRAALALVGLCAAGIGVGRRRTRRGGGATGGGEGGVGEKRGLCCSCQEMSLGTCPAAAGDATAEELLQRARGLVPPALAAARAATGFGGRWKAIAARLEKVPPCLSDLSSHPCFSKNSLCRELLQSVAATLAEAAELGARCHEPPKAGKLQMQSDLDALAGKLDLNLRDCSLLVKTGVLSDATVPAAPAACAQADVRELLARLQIGHAEAKHRAVDGLLDALREDEKSVLSALGRGNVAALVQLLTATAPKVREKAATVLCLLAESGSCEGLLMSEGALSPLVRLAESGSLVGREKAVITLQRLSMSCGG

SEQ ID NO: 66992 - protein, 275 aa, Oryza sativa (japonica cultivar-group)
MGVYLSTPKTEKLSEDGENDKLKFGLSSMQGWRATMEDAHSALLDIDNDTSFFGVFDGHGGRVVAKFCAKYLHREVLRSEAYSAGDLGNAAHKAFFRMDEMMRGQRGWRELQALGDKINQISGMIEGLIWSPRGSDSNDQHDDWAFEEGPHSDFAGPTCGSTACVAIVRNSQLVVANAGDSRCVISRNGQAYNLSRDHKPELEAERERILKAGGYIQMGRVNGTINLSRAIGDIEFKQNKFLSPDKQMLTANPDINTVELCDDDDFLVLACDGIW

SEQ ID NO: 66993 - protein, 335 aa, Xanthobacter autotrophicus Py2
MALVLPFEPNEPSIEALVALVKADMERVNATILARTGSDVAMIPEVANHLISSGGKRLRPMLTLACASLSGYRGDGHVKLAASVEFMHTATLLHDDVVDESDMRRGKLAARKLWGNEASVLVGDFLLGQAFKMMVEVGSMTCLDILATAACVIAEGEVMQLAAAKNTATSEDDYLAVIRGKTAELFAAACEVGAVLGQRPKAEQAACRSYGMNLGIAFQLVDDALDYGGSQAKLGKNVGDDFREGKITLPVLLAFRRGDASERAFWQRCLEKGEGNDADLDQAIGLMTRHRAIADTVERARHYGAIAKDALALFPNGQAKDALMEAVDFCLSRAH

SEQ ID NO: 66994 - protein, 411 aa, Halobacterium sp. NRC-1
MSRSPSLPDRPTLDVDPESTPAERLNALQDHYVDIVAVNGELQAQLDDVEARREELREEVNRLQRENETLKTASLYLATVEDLPEDGSAVIKQHGNNQEVLTELSPRLADTLEVGDRVAINDSFSVQRVLDDETDARAQAMEVDESPSVTYADIGGLDDQLREVREAVEDPLVNPEKFDAVGVEPPSGVLLHGPPGTGKTMLAKAVANQTDASFIKMAGSELVRKFIGEGSRLVRDLFELAEQKDPAIIFIDEIDAVAAKRTDSKTSGDAEVQRTMMQLLSEMDGFDERGDIRIIAATNRFDMLDSAILRPGRFDRLIEVPNPNPDARERILEIHAGEMNVADSVDFSDLAADTAEFSGAQLASLATEAGMFAIRDDRDEVHRQDFDDAYEKLVAEGDTESSGPRYPSYIQ

SEQ ID NO: 66995 - protein, 525 aa, Rhodospirillum rubrum ATCC 11170
MTDRTSVSATDRILIIDFGSQVTQLIARRVRESGVYSEIQPFNTVTAASIAAFAPKGVILSGGPASVTAADTPRAPIELFTMGLPVLGICYGQQTMVAQLGGRVEAPDHREFGRAFVEVTAGCALFDGVWTPGERDQVWMSHGDRVDAIPEGFSVVAVSEGAPYAAIADEARHFYGVQFHPEVVHTPKGAALLRNFTHGICGCGGDWTMAAFKDQAIARVREQVGSGRVICGLSGGVDSSVVAALIHEAIGEQLVCVLVDHGMMRQGETEQVVRVFRDRFNITLVHRDASELFLGKLDGVVDPEAKRKIIGATFIDVFDEEARKVGGADFLAQGTLYPDVIESVSFTGGPSVTIKSHHNVGGLPERMKMALVEPLRELFKDEVRDLGRELGLPDEMVGRHPFPGPGLAIRIPGQPLTREKLDILRRADAIYLEEIRNAGLYDVIWQAFAVLLPVRTVGVMGDARSYDFALALRAVTSTDGMTADYYPFDHTFLGRVANRIINEVKGVNRVVYDITSKPPGTIEWE

SEQ ID NO: 66996 - protein, 145 aa, Nicotiana sylvestris
MASLAAFAAVQPTTNVKGLAGSSITGTKLHLKSSRLNLKPTKSRAGPVVAKYGDKSVYFDLEDLGNTTGQWDLYGSDAPSPYNSLQSKFFETFAAPFTKRGLLLKFLILGGGSTLAYFSSTASGDILPIKKGPQLPPKLGPRGKI

SEQ ID NO: 66997 - protein, 224 aa, Zea mays
MAAVATETPFHVLAVDDSLPDRKLIERLLKTSSFQGKLSHRMIIPVSFASALSLTKVTTVDSGSKALQFLGLHDQDSTVPPVHTHQLDVAANQDVAVNLIITDYCMPGMTGYDLLKKIKESSSLRDIPVVIMSSENIPSRINRCLEEGADEFFLKPVRLSDMNKLKPHILKSRCNQEQHQQSDSHSGERRNPTISSSDSINNRKRKGAGTEEILPQLANRSRHS

SEQ ID NO: 66998 - protein, 102 aa, Citrus jambhiri
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFG

SEQ ID NO: 66999 - protein, 223 aa, Cucumis melo
MAAAPSVREENVYVAKLAEQAERYEEMVEFMEKVSASLDKEELTVEERNLLSVAYKNVIGARRASWRIISSIEQKEESRGNDDHVSVIRDYRSKIETELSNICDGILKLLDSRLIPSAASGDSKVFYLKMKGDYHRYLAEFKTGAERKEAAESTLTAYKAAQDIANAELPPTHPIRLGLALNFSVFYYEILNSPDRACSLAKQAFDEAIAELDTLGEESYKDS

SEQ ID NO: 67000 - protein, 304 aa, Arabidopsis thaliana
MALLRLPGISLQILGHKSNQKNPNPNVAFTNHSLSLSTPSLCRLHRHATFPDSIPAKSRNLTSYFSTTTQEPVLDSSSSSSSAPEVVEEEISKTRLIAQNVPWTSTPEDIRSLFEKYGSVIDIEMSMHKKERNRGLVFIEMASPEEAATALKSLESCEYEGRRLKVDYAKTKKKKTYAPRETPSPVPTFNLFVANLAFEARAKHLKEFFDADTGNVVSTEVIFHENPRRSSGYGFVSFKTKKQAEAALIEFQGKDFLGRPIRLAKSKQFVKLQAKEGLQPPEEEAEEEPSQSETMTQEHETPAA

SEQ ID NO: 67001 - protein, 205 aa, Brassica napus
GGSYAFMIPTISIIHDSSLTRIEDPQLRFLSTMRAVQGAVIVASSVQIILGFSQMWAICSRFFIPVGMVPVIALTGFELFNRGFPMVGTCVEIGIPMLILFVLFSQYLKSFQFRQLPVVERFAMIIALIIVWAYAHLLTASGAYKHRPHQTQVNCRTDMSNLISSAPWIKIPYPLQWGAPSFDAGHAFGMMAAVLVSLIESTGAF

SEQ ID NO: 67002 - protein, 271 aa, Haemophilus influenzae R2846
MINKDTQLCMSLSGRPGNFGTTFHNYLYDKLGLNFIYKAFTTQDIEHAIKGVRALGIRGCAVSMPFKEACMPFLDEIHPSAQAIESVNTIVNDNGFLRAYNTDYIAIVKLIEKYHLNKNAKVIVHGSGGMAKAVVAAFKNSGFEKLKIYARNVKTGQYLAALYGYAYINSLENQQADILVNVTPIGMKGGKEEMDLAFPKAFIDNASVAFDVVAMPVETPFIRYAQARGKQTISGAEVIVLQAVEQFELYTHQRPSDELIAEAAAFARTKF

SEQ ID NO: 67003 - protein, 387 aa, Clostridium perfringens SM101
MAKRDYYEVLGLQKGASDDEIKRAFRKMAMKYHPDRNPGDKEAEENFKEVNEAYDVLKDPDKKAKYDQFGHAAFDGSGGFGGGGFGGFDAGGFDFSEMGGFGDIFESFFGGGFGGGSSRRRNAPQRGADLEYRLNITFEEAVFGCEKEISITRTENCETCNGTGAKAGTSPKTCPKCNGSGQIRVQRQTPLGSFVSTTTCDQCGGTGKVIEDPCPDCKGKGTVRKNRKITVKIPAGVDTGNIIPLRGQGEQGANNGPAGDLYIRVNVAPSKIFRREGSDIYYDYKISMAKAALGAEITVPTVDGNVKYKVPAGTQPGTKFRLKGKGVPYVNGGGRGNQYVHMVVEVPKHLNKEQEEALKAFMKASGESVDDIDEKDEGFFSKFKKKK

SEQ ID NO: 67004 - protein, 548 aa, Cryptococcus neoformans var. neoformans JEC21
MSVHLEYDDKKDAAYDYTQQVAPADAVPSSSDVEDVEVKSGLKRNLKSRHMAMISLGGVIGTGLFLGTGSALANGGPLGLFLGYATMGSICYCVMICLGEMISFLPIPGGHIKLAERFVDPALAFTMGWNYWYNWVIILPAELSAAAVLINLWNDTINNALWISICLVVVVAINFLGFFGECEFWFASIKILTIVGLIILGIIITAGGGPDHTSIGFQYWRNPGPFVQYEGISGSLGRFLGYWAVLTQAAFSYIGTEIVAIAAGEAKNPRRNLPRAIKRVYIRILVFYLGGTFIIGLLVPSNDEGLALNSGNALASPFVIAIRRAGIPVLPSIINACLLTSAWSAASSDLYTSSRALYGLSITRQAPKIFSRTTRRGLPWVSISFCALFAALSYMSLQSTAGEVFGYFSNLTAAAGLMTWWGICFIYIRFEKGLRVQGIARSSLPYSSRLNYRASAAWYGIIMITIILFFSAWSVFLKDNWSTSTFVTNYLPLWLFPILWVGYKYIKKTHFVRASEMDFVSGLQAIEAECHDETPPSTILGKFWDFLM

SEQ ID NO: 67005 - protein, 489 aa, Roseovarius nubinhibens ISM
MQSFEMLINGAWVAAGDGASFDTVSPADGKVWAKIPEATEEDVDRAVRAAHAACYEGPWSRMTPTERGHCLRRLAELLKDNAERLGEIETRDTGKMFKETRWQANYIAEFFHFYAGCADKIHGDTLPIDKPDMFVFTHREPLGVIAAIVPWNSQLFLTAVKIGPALAAGNTVVLKASEHASAAMLEFGKLIAEAGIPDGVVNIVTGHGEPCGRALTSHPLVARISFTGGPGAARHVLMNSTKNFAEVSLELGGKSPFIVFEDADIESAVNGSVAGIFGASGQSCVAGSRLIVHEDVADAFLARMVEIARAVKIGDPMAEETEMGPLCTLGQLETIEREVARAVEEGGRVLCGGKRAEAGEMYFEPTIIDCPSPDLHIVDTELFGPVLSVLRFRTEDEALRLANDTEHGLAAGIFTRDGARALRMSRAVRAGIVWVNTYRAISPVAEFGGMKGSGYGRESGFQAMYDYTRPKTVWMNASSEPLGSMFVAR

SEQ ID NO: 67006 - protein, 78 aa, Phillyrea latifolia
LLPLIDWLFHEPNPIGLNTALAQLGVVRPVFRLPYVPLPLAKRVEFVNIVKELGRENFVGEKDVQVLDDDDFILIGRY

SEQ ID NO: 67007 - protein, 193 aa, Zea mays
  misc_feature (51)..(51): Xaa can be any naturally occurring amino acid
  misc_feature (65)..(65): Xaa can be any naturally occurring amino acid
  misc_feature (81)..(81): Xaa can be any naturally occurring amino acid
SALTYAVLQHISAPKAAMLPAAFSRFMTPSSAHLQDREFKTATVLDVLKCXGKMADGSWLWCTTXDSRYDTVKSMTHDNVXALVVDKPGQNKSIAGIVTERDYLRKIIVQGRSSKSTKVGDIMTEENKLITVNPDTKVLQAMQLMTENRVRHIPVIDGTGMLGMVSIGDVVRAVVAEHREELNRLNDYIQGGY

SEQ ID NO: 67008 - protein, 544 aa, Magnaporthe grisea 70-15
MTPQGLLAVCTGLLLLKIFISFVSRYRRHQILIRQHGCLPPPKAKLKDPIFGIDVILSNGRAAREHRSLQTFEERFYSIGATYSTKHGFPLIITMEPDNVRAVINQNFHDYALAPFRQPALKHFLGDGIFTTDGEKWHSSRALLRPNFNRDQIANLEAIETHVKDLFALLPRDGATPVDLKGLLLRFTMDSTTEFLFGQSVYSLRRNGARDGDSLEAQFETAFTGAQAECMEFIGMGPLARFARVNSQKQVEIVHRYIDKFVDRAIAFRKEYGKQGHRSESSLTGFVPGPAYSQPGYPCHAFRKEYEAGGGGPIGTGKEKPKYLFLQELAKQTTDRTRLRSELLNILMAGRDTTASLLGNLFFMISKSPEIMAKLQQEVDSLNGARPSYSSLRDMKYLKYCLRESLRLHPVAPVNTRIAVTDTVLPRGGGPDGSKPVLVPKGTAVGWSVYAMHRRKDLYGPDADRFRPERWETLNTRSEYLPFNGGPRICLGQQYALTEASYVTVRMLQEYEMESRDPGEWEEELAITACNRRGCLVALKARSE

SEQ ID NO: 67009 - protein, 223 aa, Brassica napus
METLATDPGFIDSGVYLRLGLIVEGKIRLKKPPTLLSRLASSLERSLLLHDKSISPPEFQHSAVTVFDGRSPPEITISDYLDRIFIYSRCSPSCFVAAYIYILQFLDVTRAHLTPLNVHRLVVTSVMLAAKVFDDRYYNNAYYARVGGVSTRELNRLEMKLLFALDFKLQVDPHTFHAHCCQLEKQNSDGIQIEWPIKEACRLDKETWRKSTPESVCSQTTAR

SEQ ID NO: 67010 - protein, 175 aa, Phillyrea latifolia
ACDDACSICPEAFFETDPSTMTSCKHEFHLQCILEWCQRSSQCPMCWQSVSLKDPSSQELLDAVEHERNIRMNPPRNTAIFHHPALRDFELQLLAVSAGDSELEERIIQHLAAAAAMGRARQLARREGERSGSSTRTHPRFLVFSSNPNPTSATSPALSPAQRGGPGPFHAAMIA

SEQ ID NO: 67011 - protein, 423 aa, Arabidopsis thaliana
MTVLSGGSHPPLNGVGPTDRERISPLASGHVGTADAGRGSLKKRRPSCRSRDLHRGAVKPKNNQSCGGTEGTDSANVPRPGKKVSTRTTFLLRADASENDSSRMKGNSHWWAYPSQPGVCWDSRRAAPYDVHDQSDLDVPVGTRGDRYDRYCIRIEEMRQSLRIIVQCLNQMPSGMIKADDRKLCPPSRCRMKLSMESCVVKLRSSVYSTSIHHFELYTEGFSVPASSTYTAVEAPKGEFGVFLVSNGSNRPYRHKIRAPGSAHSQGLDSMSKHHMPADVVTIIEMNRVAVKRVMVDPDSTVNLIPMSTRHSKRKDWRSTSRGTGTETSYSRKKCGTSVARRALTAKPIAKARPPADLDDQERKMARLPTRQWPFSPWSIRWEVQGQKIEHIDSARSRPSLQGLPLGVVSTPYCRAAKLTLVH

SEQ ID NO: 67012 - protein, 105 aa, Brassica napus
MYSPTMAVPLQTKYTLSPITNNIPRSHCPSLLRARVTCSLIPAKKSHPNREKLVLEKRLVNPPPSNDTTLQSTLTHRLWVGAGCTTVFASFAKSIIGGFGSHILL

SEQ ID NO: 67013 - protein, 228 aa, Staphylococcus aureus subsp. aureus MRSA252
MPKLILCRHGQSEWNAKNLFTGWEDVNLSEQGINEATRAGEKVRENNIDIDVAFTSLLTRALDTTHYILTESKQQWIPVYKSWRLNERHYGGLQGLNKDDARKEFGEEQVHIWRRSYDVKPPAETEEQREAYLADRRYNHLDKRMMPYSESLKDTLVRVIPFWTDHISQYLLDGQTVLVSAHGNSIRALIKYLEDVSDEDIINYEIKTGAPLVYELTDDLEVIDKYYL

SEQ ID NO: 67014 - protein, 410 aa, Oryza sativa (japonica cultivar-group)
MDRASENRRLAAVGKPVPGIGEMGNRRPLRDINNLVGAPPHPSAIAKKPMLEKSGKEEQKPALVVSHRPMTRNFAASLTRKEQLDHQVSVADAAVVCTDPQKNPIPDGTVDDDVESCESNDYIAVDECNDTDEDESMMDIDSADSGNPLAATEYVEELYKFYRENEEMSCVQPDYMSSQGDINEKMRAILIDWLIEVHHKFELMDETLFLTVNIVDRFLEKQVVPRKKLQLVGVTAMLLACKYEEVAVPVVEDLVLISDRAYTKGQILEMEKLILNTLQFNMSVPTPYVFMRRFLKAAQSDKQLSLVEYQMLKYRPSLLAAAAVYTAQCALTRCQQWTKTCELHSRYTGEQLLECSRMMVDFHQKAGAGKLTGVHRKYSTFKFGCAAKTEPALFLLESGAGGYNLQKQPC

SEQ ID NO: 67015 - protein, 307 aa, Bacillus licheniformis ATCC 14580
MHHITEILPDTIKRALSGLGDHEIDQIEEIRVRTSRPLELVNKGKPRFLPYVATPEDSALLLNRLGNYSMYTLEEELKKGYVTIRGGHRVGLAGRVVVENGAVKGIREISSFNIRIAKEKIGISKPYVPHLFQNSWLNTLIIGPPQTGKTTLLRDLARLISSGSGNAPAKKVGIVDERSEIAGCVNGIPQYRLGDRADILDACPKAEGLMMMIRSMSPEVMIADEIGRMEDAEALLEAVHAGVTVIVSAHGYTYADLARRPSLKMLQEHRVFERIVELSRKNGPGSLSRILNGNGEPLGAAKRMLSC

SEQ ID NO: 67016 - protein, 544 aa, Methylococcus capsulatus str. Bath
MAVEIRKTTPYPDQKPGTSGLRKKVKVFLQGNYLENFVQSVFDTVETADGATLVVGGDGRYFNRQAIQIILRMAAANGVGRVLVGRGGLLSTPAASCVIRKHRALGGFVLSASHNPGGPEEDFGIKFNVANGGPAPESFTDRVYQRSRVIDAYRIVSAPDLDIDTPGRSRIGDMEIEVIDPVADYAELMEHLFDFGLIRSGFRSGALTLRFDAMHAVTGPYAKRILEETLSAAPGSVVNAVPLEDFGGGHPDPNLVHARELAAVMYSGRPPTLGAASDGDGDRNMIMGANCFVTPSDSLAILAANAHLVPGYKDGLRGVARSMPTGRAVDRVAAAMGIECYETPTGWKFFGNLLDARRITLCGEESFGTGSDHVREKDGLWAVLFWLNLIALRKQSVAAIVADHWRRFGRDYYSRHDYEGIEVPVAEGIMGRLQDLLAELPGRAFGDYRVTLADDFRYVDPVDGSVSEHQGIRIAFDNSSRIVFRLSGTGTEGATLRVYMERYERDPNLHNLPTQEALADLIAIAEDLCQVKKRTGMAQPSVMT

SEQ ID NO: 67017 - protein, 120 aa, Triticum aestivum
MRPPRGGGGFRGRGGDQGGRFGGGGRGRGRFGGGGGGFRDEGPPAEVVEVSTFLHACEGDAVTKLTNEKVPYFNAPIYLQNKTQIGKVDEIFGPINESAGFFARLELAVYHFEFSVLNLK

SEQ ID NO: 67018 - protein, 73 aa, Cucumis melo
LPVPPVIGNPSPGAKKPCPPSGKETCPIDTLKLGGCVDLLGGLVHIGIGDPAANACCPIISGLAELEAAVCLC

SEQ ID NO: 67019 - protein, 294 aa, Glycine max
MEQYEKVEKIGEGTYGVVYKGRDRVTNETIALKKIRLEQEDEGVPSTAIREISLLKEMQHRNIVRLQDVVHDEKSLYLVFEYLDLDLKKHMDSSPEFAKDPRQVKMFLYQILCGIAYCHSHRVLHRDLKPQNLLIDRSTNALKLADFGLARAFGIPVRTFTHEVVTLWYRAPEILLGSRQYSTPVDIWSVGCIFAEMVNQRPLFPGDSEIDELFKIFRIMGTPNEDTWPGVTSLPDFKSAFPKWQPKDLKNVVPNLEPAGLDLLSSMLYLDPSKRITARSALEHEYFKDIKFVP

SEQ ID NO: 67020 - protein, 165 aa, Aegilops speltoides
VMASSATTVAPFQGLKSTAGLPVGRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNLRQVQCVSFIAFRPPGCE

SEQ ID NO: 67021 - protein, 234 aa, Mannheimia succiniciproducens MBEL55E
MKKIEQLFANNHSWALRMKEENSSYFKELADHQTPHYLWIGCSDSRVPAEKLTNLEPGELFVHRNVANQVIHTDLNCLSVVQYAIDVLNIEHIIICGHTNCGGIKAAMANQDLGLINNWLLHIRDIWYKHSHLLGNLSPEKRADMLTKINVAEQVYNLGRASIVQDAWKRGKKLSLHGWVYDVSDGFLIDQGVLATSRESLEISYRNSIARLKTLDEEDIFRKGNKENNDEIIG

SEQ ID NO: 67022 - protein, 165 aa, Aegilops sharonensis
VMASSATTVAPFQGLKSTAGLPVSRRSSASLGSVSNGGRIRYMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCE

SEQ ID NO: 67023 - protein, 297 aa, Saccharomyces cerevisiae
MASMSVSTASTEMSVRKIAAHMKSNPNAKVIFMVGAGISTSCGIPDFRSPGTGLYHNLARLKLPYPEAVFDVDFFQSDPLPFYTLAKELYPGNFRPSKFHYLLKLFQDKDVLKRVYTQNIDTLERQAGVKDDLIIEAHGSFAHCHCIGCGKVYPPQVFKSKLAEHPIKDFVKCDVCGELVKPAIVFFGEDLPDSFSETWLNDSEWLREKITTSGKHPQQPLVIVVGTSLAVYPFASLPEEIPRKVKRVLCNLETVGDFKANKRPTDLIVHQYSDEFAEQLVEELGWQEDFEKILTAQ

SEQ ID NO: 67024 - protein, 164 aa, Aegilops bicornis
VMASSATSVAPFQGLKSTGGLPVSRRSRGSLGSVSNGGRIRCMQVWPIEGIKKFETLSYLPPLSTEALLKQVDYLIRSKWVPCLEFSKVGFVFREHNSSPGYYDSRYWTMWKLPMFGCTDATQVLNEVEEVKKEYPDAYVRVIGFDNLRQVQCVSFIAFRPPGC

SEQ ID NO: 67025 - protein, 130 aa, Brassica napus
MAAAASASTPQGVAERRGIPAAAFVEDVEAYLRQAGLDVNSALAFLQERLQQYKIVEMKLLAQQRDLQAKIPDIEKCLDIVSTLQAKKDLGEALIADFELSEGIYSCAKIEDTDSVCLWLGANVMLEYSC

SEQ ID NO: 67026 - protein, 525 aa, Pseudomonas fluorescens PfO-1
MALDIHAHRILILDFGSQYTQLIARRVREIGVYCELHPFDMDEDAIREFAPKGVILAGGPESVHEANSPRCPQAVFDLGVPVFGICYGMQTMAEQLGGKVEGSELREFGYARVDVVGKSRLLDGIEDHIDADGLFGLDVWMSHGDKVTKMPSDFHILASTPSCPIAGMFNDERAYYGVQFHPEVTHTKQGGRILSRFVLDICGCEALWTPSKIAEDAIANIRAQVGTDNVLLGLSGGVDSSVVAALLHKAIGDQLTCVFVDNGLLRLHEGEQVMAMFAENMGVKVIRANAEDQFLNNLAGEADPEKKRKIIGRTFIDVFDAESCKLDNIKYLAQGTIYPDVIESAGAKSGKAHVIKSHHNVGGLPEEMNLKLVEPLRELFKDEVRRLGLELGLPYDMVYRHPFPGPGLGVRILGEVKKEYADLLRRADHIFIEELRKADWYHKVSQAFVVFQPVKSVGVVGDGRRYAWVVALRAVETIDFMTARWAHLPYELLETVSGRIINEIEGISRVTYDVSSKPPATIEWE

SEQ ID NO: 67027 - protein, 449 aa, Streptococcus agalactiae 2603V/R
MTSGKTYVASVLEKVKKQNEHEEEFLQAVEEVFESLVPVFDKYPQYIEENLLERLVEPERVISFRVPWVDDKGQVQVNRGYRVQFSSAIGPYKGGLRFHPTVTQSIVKFLGFEQIFKNSLTGLPIGGGKGGSNFDPKGKSDNEVMRFTQSFMTELQKYIGPDLDVPAGDIGVGGREIGYLYGQYKRLNGYQNGVLTGKGLTYGGSLARTEATGYGAVYFAKEMLAARGQDLTGKVALVSGSGNVAIYATEKLQELGATVVAVSDSSGYVYDPDGIDLETLKQIKEVERARIVKYTEKHPKANFTPADQGSIWSIKADLAFPCATQNELDEEDAKLLVENGVLAVTEGANMPSTLGAIKVFQKAGVAFGPAKAANAGGVAVSALEMAQNSSRRAWTFEEVDQELQRIMKTIFVNASEAADEFGDSGNLVLGANIAGFLKVAQAMSAQGIV

SEQ ID NO: 67028 - protein, 554 aa, Treponema denticola ATCC 35405
MKTDIEIAREAKLKKIAEIADGLGIHDDNVIPYGKYIAKVPYSVIDDAKVKKNNLILVTAITPTKAGIGKTTVSIGLALGLNKIGKKAVAALREPSLGPCFGMKGGAAGGGYAQVLPMEDINLHFTGDFHAITSAHNMISALFDNYIFRAQGTPKAIKTVLWKRVLDVNDRNLRQVVTGLGEGNGVVMESGFDITPASEIMAIFCLAKDIEDLRRRIENIILGYDTENNAVKVKDLGIAGSIVVLLKNAINPNLVQTTENTPAFIHGGPFANIAHGCNSVIATKTALTYGEYVITEAGFAADLGAEKFFDIKCRKAGLNPKLTIIAATTGGLKMHGDVPEKEISKPNAEALKKGLANLDKHIENMKKFGQTVVVALNRYGYDIDSELELVRKHCEAQGVGFAVNNAFVEGGKGAVELAELVVKTIETNPSKPLKFVYEDKDSIKTKIGKICKEIYGAADVTYSGAADKMIKKIEEAGMADFPVCVAKTQYSFSSDPKLYGVPTGFEMNVRDIVLNSGSEMIVAIMGDMMRMPGLPKDPQAVRIDLVNGNVEGLS

SEQ ID NO: 67029 - protein, 545 aa, Yarrowia lipolytica CLIB122
MSLQRALQYLWDAEPHNTDHVTPLFCLGQVYDADTSLKEVNDDTEEDGIVVPLDTSNDTSWPPDFLADVQSRIWLSYRTGFPLIPKSDGSGTIHLGKLKNMIRGGGFDPRGYTSDVGWGCMIRTSQSLLANALLFRHLGRGWRWNKGDDFVYLSEGNTESRGGESRNGGANKEQETAVSEETAVSEETIISWFLDSPDSPFSIHKFVRHGEKACSTPAGDWFGPSAAGSSIYALCNEFPDSGLKVYYNGNGGGDVYEDELLETGFPLLVLCGLRLGIDNVNPIYWDSLRQMLSLPQSVGIAGGRPFTSHYFFGFQGEQLFYLDPHQPKPAVKTTDKDTTSFHSSRIWKLHLKEMDPSMLVGFYITSEADWETFKGSLTASKEKTSSQIVHIHPSRHNIPSFDEEDEYVSIGGASDDDFVDVTKRARKVAAMTGNTGSGRSSPSILDSHLVTETRDIIESVPPRKRVDNDLTSAPVDVPKPVQKRSQSHGDWEKVEEPEEEMVEVESMKGMQDNGCSAEYGSLVDRDAEADDSTLSTETTDRDWVV

SEQ ID NO: 67030 - protein, 375 aa, Prorocentrum minimum
MASEITALVVDNGSGMCKAGFSGADAPRTVFPSIVGRPKMPSIMVGMDTRDSYVGDEAMSKRGILSLRYPIEHGMVTNWEDMEKIWHHTFYNELRVNPDEYPVLLTEAPLNPKANRERMTQIMFETFNVPAVYVAIQAVLSLYASGRTTGIVMDSGDGVSHTVPVYEGFALPHAIERLDLAGRDLTEYLTKILTERGYSFTSSAEKEIIRDVKEKLCYVAMDFDAELKAATESSDRERTYELPDGILIAVGSERFRCAEVLFQPSLVGKEASGVHEATFRSIMQCDIDVRRALYANVVLSGGTSMFPGMGERMTRELSALAPPTMKVKVIAPPERKYSVWIGGSILSSLSTFQQMWVSREEYDESGPGIVHRKCF

SEQ ID NO: 67031 - protein, 85 aa, Phillyrea latifolia
RGLSIPECQKVLPAAKPGGEPLPEGLLWLLLTGKVPTKEQVDSLSKELRSRATIPDHVYKTINALPVNAHPMTQFATGVMALQVQ

SEQ ID NO: 67032 - protein, 498 aa, Geobacillus kaustophilus HTA426
MTMISAQTTEADLWIDGEWRPAASGERFDVIDPATGEVTARVANAGEDDVDAAVAIAEEAFSDRRWLAISPLERGRILRRIAELIRQHHCELAQLMTRENGMPINLALFIEIPLAADCFDFFASLVVKPQGEVLPFSVAGSAPDYMAWTMKEPIGVAGLITPWNFPLLMPTWKIAPALAAGCTMVVKPAPETPLTALKLAEICHEAGVPEGVINVLPGLDEAGKALVRHPRVPKIAFTGETETGRHILQAAAPHIKRVTLELGGKSPNIIFADADLEQAAKSALFGVFYNSGQVCQAGSRILVERTVYEPFVERLAERAKKLKVGPGTNPRSDLGPVISREQYEKVLRYIEIGKQEGARLAAGGRALDGGGGGYFIEPTVFADVSPSMRIACEEIFGPVAAVIPFADEEEAVRIANGTMYGLAAAVWTNDIKRALRLARRVKSGTVWLNTYQVLSPTAPFGGYKQSGLGRELGMQALDAYLETKTVICDLNDRPMTLF

SEQ ID NO: 67033 - protein, 368 aa, Geobacillus kaustophilus HTA426
MAKAAVLHRYGEPLSIEELDLASPKRGEVKVKMKAAGLCHSDWHVVQGQLPLPLPIVLGHEGAGIVEEVGEGVTSVKQGDHVVLNWVPSCGTCSYCRTGRPDLCEEAARLMATGTLPDGTTRFSLHGKPVYQFLTAGAFSEYTIVPEQAAIPIRRDVPFELAALISCSVMTGVGAAIHTAQVRPGSTVAVIGAGGVGFNIIQGAALAGAKQIIAVDIVEEKLAMTKTFGATHTVNAREDDAVSAVLDLTDGIGVDYAFEAIGRPETMADAYNMTRKAGTTVIVGIAAPHEAVEINAFSLPSQSKALTGSWLGQGNPPIDYPKLLDLYAAGKLKLEPLISAVYSLDQINDGFAALKSGQNIRGIIRFEE

SEQ ID NO: 67034 - protein, 324 aa, Robiginitalea biformata HTCC2501
MHKIAVLTSGGDSPGMNAAIRSVVRTCAYMNVECMAIYRGYQGMIEGDFVAMNARSVNNIINKGGTILKSARCEDFKTPEGRKKAHEQLVQAGISGFVVIGGDGSFTGATIFNKEYDFPVIGIPGTIDNDIFGTRYTLGFDTALNTVVDAIDKIRDTASSHNRLFFVEVMGRDVGHIALNAGVAAGAEEILIPEENLGLDRLLESLRRSKKTGKSSSIVVVAEGDKTGKNVFELKEYVEEHLPIYDVRVSVLGHMQRGGPPSAFDRVLASRMGVKAVEALIAGKTNLMVGIIDNEIVLTPIAEAIKGHTKIDRELVRVSDIMTI

SEQ ID NO: 67035 - protein, 452 aa, Staphylococcus aureus subsp. aureus MRSA252
MNYTQQLKQKDSEYVWHPFTQMGVYSKEEAIIIEKGKGSYLYDTNGNKYLDGYASLWVNVHGHNNKYLNKVIKKQLNKIAHSTLLGSSNIPSIELAEKLIEITPSNLRKVFYSDTGSASVEIAIKMAYQYWKNIDREKYAKKNKFITLNHGYHGDTIGAVSVGGIKTFHKIFKDLIFENIQVESPSFYRSNYDTENEMMTAILTNIEQILIERNDEIAGFILEPLIQGATGLFVHPKGFLKEVEKLCKKYDVLLICDEVAVGFGRTGKMFACNHEDVQPDIMCLGKAITGGYLPLAATLTSQKIYNAFLSDSHGVNTFFHGHTYTGNQIVCTVALENIRLYEKCKLLSQIETTSSTLEKQLHALKRHRNVGDVRGRGLMFGVELVTDKDSKTPLEIEKVERIVRNCKENGLMIRNLENVITFVPVLSMSNKEVKTMVRIFKKAVHNILDRKC

SEQ ID NO: 67036 - protein, 127 aa, Robiginitalea biformata HTCC2501
MKKIIQTDKAPAPIGPYNQAVWAGNTLYVSGQIALDPATGKLIDESIEAETEQVMQNLSAVLREAGLGFGDVVKASIFVKDMHQFARINAVYGNFFDADTAPARETVEVANLPKFVNVEISVIAVRS

SEQ ID NO: 67037 - protein, 358 aa, Desulfovibrio desulfuricans G20
MEMRICLLAGDGIGPEIMEQGVRVLETVAGKFGHDMEFTDALIGGAAIDETGDPLPQETVEACKAAQAVLLGAVGGPRWDNLTGAERPEAGLLGIRKALGLFANLRPAKLFPELASACFLRPDIVANGIDVMVVRELTGGIYFGTPAGEETRDGLRTAFNTMVYNEEEVRRIARVAFEAARKRSGRVCSVDKANVLAVSRLWREIVTATHADEFPDVELSHMYVDNAAMQLVRDPSQFDVIVTGNLFGDILSDEASVITGSIGMLPSASLGAGGPGLFEPIHGSAPDIAGQNKANPLATILSTAMMLRHSFGLEKEAEAVEGAVQQVLKAGYRTGDIMDQGGTLVGCNTMGNLVNERI

SEQ ID NO: 67038 - protein, 165 aa, Aegilops tauschii
VMASSATTVAPFQGLKSTAGLPVSRRSSGSLGSVSNGGRIRCMQVWPIEGIKKFETLSYLPPLSTEALLKQVDYLIRSKWVPCLEFSKVGIVFREHNSSPGYYDGRYWTMWKLPMFGCTDATQVLNEVEEVKKEYPDAYVRVIGFDNLRQVQCVSFIAFRPPGCE

SEQ ID NO: 67039 - protein, 186 aa, Oryza sativa
MALANKIGNLLKRATSSSPALYQSIRCMSSSKLFVGGLSYGTDEQSLRDTFANYGQVIEAKIINDRETGRSRGFGFITYASSEEASAAITALDGKDLDGRNIRVNTANERTGGFRSGGGGYGGGGYSGGGGYGGGGYSGGGGGGGGYRGGGGGYGGNKWRVWQQGVVVEVVMELQKDLQMPSLEST

SEQ ID NO: 67040 - protein, 165 aa, Triticum urartu
VMASSATTVAPFQGLKSTAGLPVSRRSSGSLGSVSNGGRIRCMQVWPIEGIKKFETLSYLPPLSTEALLKQVDYLIRSKWVPCLEFSKVGFVFREHYSSPGYYDGRYWTMWKLPMFGCTDATQVLNEVEEVKKEYPDAYVRVIGFDNLRQVQCVSFIAFRPPGCE

SEQ ID NO: 67041 - protein, 495 aa, Xanthomonas campestris pv. vesicatoria str. 85-10
MTFRSHRPISISHAIAALCVFALAPTAGAATLLSPSISTTSDRSIDTLMPPLLRTPATVSVATTQRDALGTSLAASRAFPQVTRDFKAFLDAQAQLSYATRGAAAKVSDPTAFAEMQRYLFNRYNGLTVLRSVQQDGKVFDCIPSAQQPALRDGSTPAAPPSLSSNKGTVAPVNPGQRCDTGSVPFERIGLAEMSKHANLRSFLRGTTPRAIAPRQADAVPAVQEAAPVTHYYSIVFLDTAGTSVTGAGADINLWAPTLRSTNEKQTISQIWIVGESASEQVQTLEVGWEIQPDAGWGNKPIVFIYSTQDGYVTTGCHNLDCSDFVQTSTRHVLGAQPAAGFSIAGGKQTLLGVEFQKNTDGNWWLRLDDEWIGYYKASLYSGDLADGRVAYVSAGGEVSTNSGVASTRMGSGQFAAAGYRQAAFQANHFYRDAAMVTHPVQRLSSLSVEHPSCYTLAMAGYSYPYALDAGVTRTGLSPEMQNGGFYFGGPGCER

SEQ ID NO: 67042 - protein, 919 aa, Medicago truncatula
MEEVEDKPTSSRNVEPNSLADAPQENTDIITAPTDNHSSIEASINSLADKNIVEHDTHFQETNFSEIESKSTRASDEQSIGQDEHLLTDDSISTPKEETVHEIEENHLGAITSDSELEALEDIQDGGSTVTANGDVDHNLMELSTSSSVTEDLQIDPKDRPQTEVIDAPQENLASTSDAEVHVTEQSHQEPVVTDSEQETLDDIVNMHKDGGFSDSFLDNQLDLTASSSETEEFQNDHKELKVNLPQIKIPDVAVGGADSPASEKKIAENRGIIDTAAPFESVKEAVSKFGGIVDWKAHRMIAVERSKEVEQQLEKLYEEIPEYRKRSEDSEQEKVQVLQELDSAKRLIEELKLSLERAQTEEHQARQDSELAKLRVEEMEQGIAEDSSVAAKAQLEVAKARYTSAITELTSVKHELDSLRVEYASLVDEKGEAIDKAEDAVAASKQVEKTVEDLTIELIATKESLESAHSAHMEAEEHRIGTVMARDQDSLNWERELKQEEQELEKLNQKILFAMDLKSKHSKASALLLDLKAELNAYMESKSNQEGDDDEGVSKEQLDKSHIEMQAAVESAKKELEEVKLDIEKATSEVNNLKVAATSLRSELEQEKSSLASIGQREGMASITVASIEVELNKTKSDIAFVQMKEKEGKEMILELPKKLQEASEEANKANLLAREACEVFRRVKEEAEQAKAGASTMHSRLLAAQKEIEAARASERLAIQAIKALQESESARSNNNEVDPSNGVILSVEEYYRITKQVHDAEERANSRVATANSEIDIAKETELKTMEKLNEVNKEIVARRESLKIAMDKSEKAREGKLGVEQELRKWRAEHGQRRKAGEIGQNVVNQNINHSGKLDQNHSETIPVHYFSSPKSYVHANNENGSSPDVKSGKKKKKSLFPRIFMFFARRKAHPTPSG

SEQ ID NO: 67043 - protein, 165 aa, Triticum turgidum subsp. dicoccoides
VMASSATTVAPFQGLKSTAGLPVGRRSSGSLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAYRPPGCE

SEQ ID NO: 67044 - protein, 89 aa, Arthrospira maxima
GDVAAGASVFSANCAACHMGGRNVIVANKTLSKSDLAKYLKGFDDDAVAAVAYQVTNGKNAMPGFNGRLSPLQIEDVAAYVVDQAEKGW

SEQ ID NO: 67045 - protein, 404 aa, Nocardia farcinica IFM 10152
MITGGAFDKPLPEGVGPATLGVRGGLRRSGFEETAEALYLTSGFVYESAEAAEAAFTGEVEHFVYSRYGNPTVAMFEERIRLMDGAEAAFATASGMSAVFTALGALLGAGDRLVAARSLFGSCFVVCNEILPRWGVETVFVDGEDLDQWERALSVPTAAVFFETPANPMQTLVDVRRVTELAHAAGAKVVLDNVFATPLLQKGFDLGADVVVYSGTKHIDGQGRVLGGAILGDREYIDGPVKTLMRHTGPALSPFNAWTLLKGLETMPLRVRHSTESALRIARFLESNPAVSWVKYPFLESHPQYDLARAQMSGGGTVVTFELKAAEGEAKKRAFEVLDRLRIIDISNNLGDAKTLITHPATTTHRAMGPEGRAGIGLTDGVVRISVGLEDVDDLLSDLEHALS

SEQ ID NO: 67046 - protein, 165 aa, Triticum aestivum
VMASSATTVAPFQGLKSTAGLPVGRRSSGSLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLIEVEEVKKEYPDAYVRVIGFDNLRQVQCVSFIAFRPPGCE

SEQ ID NO: 67047 - protein, 445 aa, Oceanobacillus iheyensis HTE831
MGKSFTKDEVIKQIKEENVKFIRLQFTDMLGTIKNVEIPYSQLDKALDNKMTFDGSSIEGFVRIEESDMLLYPDLDTFVVFPWTSEKGKVARFICDIYNPDGTPFEGCPRYNLKRNLKKMEELGFDAFNIGTEPEFFLFKLDEKGEPTLELNDHGGYFDLAPTDLGENCRRDIVLELEEMGFEIEASHHEVAPGQHEIDFKYSDAVKHADDIQTFKLVVKTIARKHNLHATFMPKPLFGVNGSGMHVNMSLFNGKENAFYDTSGELELSNTAYQFIAGIIKHATNFTAVTNPTVNSYKRLVPGYEAPCYVAWSGSNRSPLIRIPSSRGLSTRIEVRSVDPAANPYMALSVLLASGLDGIEQGLEAPESVDRNIYVMDKAEREANGVQDLPATLKDAMENLKKDKILVDSLGEHLFEHFIEAKEIEWDMFRTTVHPWEREQYLSNY

SEQ ID NO: 67048 - protein, 382 aa, Pseudomonas fluorescens PfO-1
MITSKLPNVGITIFTQMSQLAAQTGAINLSQGFPDFDGPQALRDAVGRHIASGHNQYSPMTGLPALRQQIAAKIARSYGANVDADTEVTVTPGATQAIFCAIQAVIRTGDEVIVFDPAYDSYEPAVELAGGRCVHVQLGLKDFSIDFDRLSAALSPRTRMIILNTPHNPSGALISRAELDQLAALIRDRDIYVISDEVYEHLVFDGVPHVSVLAHEELYQRAFVVSSFGKTYHVTGWKTGYVVAPPALTAELRKVHQYVSFCGVTPLQYALADYMAEHPEHVEELPGFYQAKRDLFCDLLAPSRFSFTRVTGTYFQLVDYSQIRPDLNDVEMAMWMTREHGVASIPVSVFYQHPPEGQRLVRLCFAKREETLREAAAKLCVI

SEQ ID NO: 67049 - protein, 429 aa, Synechocystis sp.
MKRVLAIILGGGAGTRLYPLTKLRAKPAVPLAGKYRLIDIPVSNCINSEIVKIYVLTQFNSASLNRHISRAYNFSGFQEGFVEVLAAQQTKDNPDWFQGTADAVRQYLWLFREWDVDEYLILSGDHLYRMDYAQFVKRHRETNADITLSVVPVDDRKAPELGLMKIDAQGRITDFSEKPQGEALRGMQVDTSVLGLSAEKAKLNPYIASMGIYVFKKEVLHNLLEKYEGATDFGKEIIPDSASDHNLQAYLFDDYWEDIGTIEAFYEANLALTKQPSPDFSFYNEKAPIYTRGRYLPPTKMLNSTVTESMIGEGCMIKQCRIHHSVLGIRSRIESDCTIEDTLVMGNDFYESSSERDTLKARGEIAAGIGSGTTIRRAIIDKNARIGKNVMIVNKENVQEANREELGFYIRNGIVVVIKNVTIADGTVI

SEQ ID NO: 67050 - protein, 576 aa, Oceanobacillus iheyensis HTE831
MTKSNISKDNGPLDEVEGIKERSNFLRGTIAEGLEDRITGAISDEDNKLLKFHGSYQQDDRDLRDERRRKKLEPAYQFMIRVRTPGGVTTPEQWLVMDDLAHKYANGSMRLTTRQTFQLHGIVKWDLKKTMQGMNQALMTTIAACGDINRNVMCNVNPEQSDVHAEVYEWSKKVSDHLLPETNAYHEIWLEDKKIVDSREESEPIYGSTYLPRKFKIGIAVPPSNDIDIYSQDLGFIAIVEEGKLLGFNVAVGGGMGMTHGDTNTYPQISRVIGFCVPEKVTEVAEKVVTIQRDFGNRSNRKNARFKYTIDSRGIDWFIDELNERLGWELEGKRHYEFDSNGDSYGWIEGKDYWHLTLFIQNGRIKDVEDYPLMTGLREIAKVHTGDFRLTPNQNLIIANVSSDNKKQINDLVEKFNLTEGKTYSGLRRNSMACVAFPTCGLAMAESERYLPELLDKIEVILDESGLREEEIVIRMSGCPNGCSRPALAEIAFIGKAPGKYNMYLGGSFNGSRLNKLYKENIGEEEILNTLRPIFIDFAKDKQKDEHFGDFVIRAGYVEEVKSGLDFHSSKEDVRS

SEQ ID NO: 67051 - protein, 288 aa, Bacillus cereus ATCC 14579
MPQQKNFITMPAQHQNKQPGIESLMSPLPQFEDANYKGSEKLKGKNVLITGGDSGIGRAVSIAFAKEGANVAIAYLDEEEDANETKQRVEKEGVKCVLLPGDLSNEQHCKDIVEETARQLGSLNILVNNVAQQYPQQGLEYITAEQLEKTFRINIFSYFHVTKAALSHLKKGDVIINTASIVAYEGNETLIDYSATKGAIVAFTRSLSQSLVQKGIRVNGVAPGPIWTPLIPSSFDEKKVSQFGSNVPMQRPGQPYELAPAYVYLASGDSSYVTGQMIHVNGGVIVNG

SEQ ID NO: 67052 - protein, 564 aa, Yarrowia lipolytica CLIB122
MCGIFAAYKLPDVAEYKTHALQLSKRIRHRGPDWSGNCSKNNTIICHERLAIVGLDTGAQPITSPDESIVLGVNGEIYNHRILRKEFPDYKFKTHSDCEPIIPLYEKYGIDAPKKLDGMFAFVLYDSNKDRIIAARDPIGITTLYMGRSYKNPQTVWFASELKCLVDDCDEIKAFPPGHVYDSDTDKITRYFEPSWWDGSKIPTKRVDYKELREALEAAVRKRLMSEVPYGVLLSGGLDSSLIASIAARETRRAAPEKTVNQDLAGVDEQGHLTNSSGSRLHSFSVGLPGAPDLLAAQKCAEFIGTIHHEYTFTVQEGLDALRDVIYHLETFDVTTIRASTPMYLLSRKIKAGGVKMVLSGEGSDEVFGGYLYFGAAPSPEAFHTECVQRVKNLHYADCLRANKSTMAWGLEARVPFLDKQFLEVAMNIDPKDKIIDKDHIEKYSIRKAFDTSDEPGAEPYLPDEILWRQKEQFSDGVGYSWIDGLKDAAENTITDEQLKNPKPHWGADVPKTKEAYWYRCMFDELFPQPAAATTVMRWIPKADWGCAEDPSGRYVKSHSAHKQ

SEQ ID NO: 67053 - protein, 716 aa, Glycine max
  misc_feature (27)..(27): Xaa can be any naturally occurring amino acid
  misc_feature (514)..(514): Xaa can be any naturally occurring amino acid
  misc_feature (526)..(526): Xaa can be any naturally occurring amino acid
  misc_feature (554)..(554): Xaa can be any naturally occurring amino acid
  misc_feature (563)..(563): Xaa can be any naturally occurring amino acid
FIFQWLQQAERRIPPFRRRKSTPHEQXLSHHSSNNNNNIDSMSKAIAQYTEDARLHAVFEQSGESGRSFNYSESIRIASESVPEQQITAYLVKIQRGGFIQPFGSMIAVDEPSFRILGYSDNARDMLGITPQSVPSLDDKNDAAFALGTDVRALFTHSSALLLEKAFSAREISLMNPIWIHSRTSGKPFYGILHRIDVGIVIDLEPARTEDPALSIAGAVQSQKLAVRAISQLQSLPGGDVKLLCDTVVESVRELTGYDRVMVYKFHEDEHGEVVSESKRPDLEPYIGLHYPATDIPQASRFLFKQNRVRMIVDCHASAVRVVQDEALVQPLCLVGSTLRAPHGCHAQYMANMGSIASLVMAVIINGNDEEGVGGRSSMRLWGLVVCHHTSARCIPFPLRYACEFLMQAFGLQLNMELQLAAQSLEKRVLRTQTLLCDMLLRDSPTGIVTQSPSIMDLVKCDGAALYFQGNYYPLGVTPTEAQIRDIIEWLLAFHGDSTGLSTDSLGDAGYPGXLPRLGMQFVGWXVAYITEKDFLFWFRSHTAKEIKWGGAKXILRTRMMGXRMHPRSSFKAFLEVVKSRSLPWENAEMDAIHSLQLILRDSFKDAEHRNSKAVVDPHVSEQELQGVDELSSVAREMVRLIETATAPIFAVDVDGHVNGWNAKVSELTGLPVEEAMGKSLVHDLVFKESEETMNKLLSRALKGILSNTLAFWSIH

SEQ ID NO: 67054 - protein, 511 aa, Geobacillus kaustophilus HTA426
MDLRTVWTKNIERFGPYPALIFEGNEYTNVDCDARSSQLAHALIELGVKPGDRVVVTMPNSPEVVVAFSGVLKAGAVVVPVLPLLQTQELHYIFKDCEPKVVLTAEMLWAKAKEAANGLPAPPMMFTIDDPHSPRSLRTRMEQAPASMPLAAVTENAPAALLYTSGTTGHPKGVVLTHRNLYANAEAAAEMAKRLPTEYDRVGLGVLPISHAFGFTMMNVALLLGDKIVLLPYFEPKKVLETIERHRVTHTAMVPAMFHALCYCPEADRYDTSSLVACVSGSASLPPSLAWQFQRKFNCLILEGYGLSEAAPIVTATDPTKPIKPGSVGLPLPGVQVAVVDEHGNRLPPNEVGELIVSGPNVFQGYYGKDEETRQALRDGWLYTGDMARIDEDGYVFIVDRKKDVIIRGGFNIYPRDIEELLMSHPDVLEAGVVGVPSPKMGEEVAAYVVVRRGSQVTEEELIEFCQKRVAKYKSPRFLKKVGYLPKNIIGKIDKKKLREWASEFIPAVQS

SEQ ID NO: 67055 - protein, 158 aa, Zea mays
MVSGLINENPTVYERKERRVRTDSTNSDEFSVEPIDQLEIFDHIRDIRDPEHPYSLEQLKVLTEDSVEVDDLKSYVRVTFTPTVEHCSMATIIGLSIRVKLMRNLPPRYKIDIRVAPGSHATEAALNKQLNDKERVAAALENPNLVEMVDECLSPSFE

SEQ ID NO: 67056 - protein, 287 aa, Triticum aestivum
MSSGRYMAYSPSPSTTPHSPRISGLRASSAAVADQEKYLAELLAERHKLNPFVPVLPHSIRLLNQEILRVSTLLENASLLNQSGFEHGSPLTSGGLYSNGAATDMNGWTSAFQSESSSAYSWLGGSQGSSSGLIVKKTMRVDIPVDKYPTYNFVGRILGPRGNSLKRVEATTDCRVLIRGRGSIKDPAREEMMRGKPGYEHLNEPLHILVEAELPVEIIDARLMQAREILEDLLRPMQDESQDFFKKQQLRELAMLNGTLREEGMQRSGSASPFHNSLGMKRAKTRG

SEQ ID NO: 67057 - protein, 220 aa, Brassica napus
  misc_feature (190)..(190): Xaa can be any naturally occurring amino acid
NELPPDIIREILLRLPAKSIGRFRCVSKLLCSLSSDQGFAKSHLDLTIHRKLIISGHNLYALDFDGIGDGFEGIIDLVGVELNYPLKEVPSKFAELIHRIIREDAVVGDELIDLNTELHLSKCVQFIGYSNGLVCISPAADAVFLYNPTTGDSKRLPELAGGKEYQTHVHYASVYSSKSDSWRRCCRYEXSTVSIHWVFILEEANKRVVVAFDVKTEEFR

SEQ ID NO: 67058 - protein, 165 aa, Triticum aestivum
THGNLPSAAAAEDAADALLGHARLAARLVPHRFFITSSILDLTIGGVDSAENDSTLQAQQPHYLKTCCKPSLDHGSVVYLLGHTGKKELVIGDGKVVIGTDNLIKLSTDGVTWCPGSAGFDAQGNLAFMICDPMKLASSPTARSSSASSSSSHSSKKDQQMQFGI

SEQ ID NO: 67059 - protein, 332 aa, Brassica napus
  misc_feature (14)..(14): Xaa can be any naturally occurring amino acid
MSTAPLSGFFLTSXSPSQSSLQKVSLRSSPTVASLPSSSSSSSSSPRSVPILIRNEPVLAAPAPIITPYWSEEMGSESYEDALEALKKLVIEKDDLKTVAAAKVDQITAELKKISSSDGKPFDPVERIKEGFVTFKKEKYDTNPALYGELAKGQSPKYMVFACSDSRVCPSHVLNFHPGDAFVVRNIANMVPPYDQVKYAGVGAAIEYAVLHLKVENIVIIGHSACGGIKGLMSFALDGNNSTDFIEDWVKICLPAKSKVLAEAESSAFEDQCGRCEREAVNVSLANLLTYPFVREGVVKGTLALKGGYYDFVKGAFELWELQFGLSPVHPI

SEQ ID NO: 67060 - protein, 199 aa, Neisseria meningitidis FAM18
MALKTSNLEHAMLVHPEAMSVGALADKIRKIENWPQKGILFHDITPVLQSAEYFRLLVDLLVYRYMDQKIDIVAGLDARGFIIGAALAYHLNVGFVPIRKKGKLPFETVSQSYALEYGEAAVEIHTDAVKPGSRVLLVDDLVATGGTMLAGLELIRKLGGEIVEAAAILEFTDLQGGKNIRASGAPLFTLLQNEGCMKG

SEQ ID NO: 67061 - protein, 229 aa, Saccharophagus degradans 2-40
MTDQKVIMIRHAQSEWNAKGLFTGWADPVLTPLGRKEAAEAASNLAKLGLKFDRIYTSVLQRATETASIIAKSLNCQVPLTKSWQLNERHYGVLQGKSKEALAKQVGAEQVWRWRRGFEDMPPPMPLASPMHARFDTKYDGVEPTSLPSVESLKHTQIRAVNYWQKEVLPSIRNNSSVLVAAHGNTLRALIMYLANMSVQEVEGFEIPTGIPIELNINKHGRCSSWRYI

SEQ ID NO: 67062 - protein, 210 aa, Brassica napus
  misc_feature (198)..(198): Xaa can be any naturally occurring amino acid
STHASALSSLSRVCHCDGLLLCTTEAYSWLAVWNPFTSQTRWICVEPISIRHRKIWYSHALGYEKGKSCRVYKILRFAGNVHEVYTLKSSDSWRALDVSPDWDIGYDNHGVSFQGNTYWYAKVAGGVGFLLCFDFTGERFGQLLPLAFECFSEDSVILSSVGGEQQQLAGLFQHRETVEMEVWVTTKVEPDAVSWSNXLAVDMGPLTGFR

SEQ ID NO: 67063 - protein, 457 aa, Medicago truncatula
MEDTSLKTFKRRRKTEQINTDWINTLPDSLLCHILSFLPTKITVTTIPLVSRRWRHLWENLQVFDFYLKYNKHTINNNDFRKFAAFVNSVLSIRRSRDIRKMRLSCGHSEVDPFFSNSIDSWIRSATGSCLQELDITLFYTDREYVFSIFLTILAPCTNLVSLSLCGDIYVVLERSSAFFLPSLKKLQLDIGYVEMNSMDNLLSSCPILETLELSISPDRLARLRVPPSLKRLKFTVENNFGAYLEIDAPGLKYLSLVNITFGDAATVGNLDQVEEAYLDVFSTPENESVDPLFDLFRALSRIKHLVLCLSTTKWLFAAPVMDLSEFRYLLHLEVILPSFSLSFLLSLLHKCPMLQDLIIQNDKRLAPPTLYGLAAKTKNVPNCLVSHLNFIHFKGYQTFLHEMEFAAYVLRNGLVLKTMLISGLLLDKKEKWEKYLILKEFADIPKGSANCQLKFD

SEQ ID NO: 67064 - protein, 712 aa, Oryza sativa
MNATMQKQARVQGCPARTAKLAALRPQPVRAPRRAVAPQAAAVEAPAKVSQETIDKCVNAIRFLAIDAVNKAKSGHPGLPMGAAPMSYVLFNETMKFNPKNPAWANRDRFVLSAGHGSMLQYALMHLVGYESVQLDDIKQFRQWDSKTPGHPENFLTTGVEVTTGPLGQGICNAVGLAVAEAHLAARFNKPDAKVIDHYTYCIMGDGCMMEGISNEACSLAGHWGLGKLIALYDDNNISIDGHTEISFTEDVAARFEALGWHVQHVKDGNTDFDALRKAIANAKAVTDKPSLLKVSTLIGYGSPNKADTHDVHGAPLGPEETAATRDNLKWPYAEFEVPQEVYDVMRGAVSRGAAAEEEWNAAMAAYKSKYPKEAEELEGLLSGKLPAGWEKALPSYTPEDKGLATRQYSQIMLNALAPVLPGLIGGSADLAPSNLTLMKMFGDFQKDSNAERNLRFGVREHGMGAICNGIGLHNSGLIPYCATFYIFTDYMRAAMRMSALSEMGVIYVMTHDSIGLGEDGPTHQPIEHLASFRAMPNMLMIRPCGGNETAGAYKVAVSNRKRPSTIALSRQGMANLPGCSVEGVEKGAYVIHGGDAKPDVIFIGTGSELPLAVEAAKKLEAEGKKVRVVSMPCWELFAEQSAEYKESVLPKDVTARVAVEAGSSFGWERYTTSNGKFVGIDDFGASAPAGILYEKFGITLDNVVAAAKSLL

SEQ ID NO: 67065 - protein, 406 aa, Arabidopsis thaliana
MAAFLQTNIRLEIIPGRYSSLTDHKFRAPYRIRCAAASPVKKRYNITLLPGDGIGPEVISVAKNVLQKAGFLQGLEFDFQEMPFGGAALDLVGVPLPEETSTAAKQSDAILLGAIGGYKWDKNEKHLRPEMGLLNIRRDLNVFANLRPATVLPQLVDASTLKKEVAQGVDMMIVRELTGGIYFGEPRGITINENGEEVGFNTEIYAAHEIDRIARVAFETARKRRGKLCSVDKANVLDASILWRKRVTALASEYPDVELSHMYVDNAAMQLVRDPKQFDTIVTNNIFGDILSDEASMITGSIGMLPSASLGESGPGLFEPIHGSAPDIAGQDKANPLATILSAAMLLKYGLGEEKAAKMIEDAVVDALNKGFRTGDIYSPGNVCKLVGCKEMGEEVLKSVDSKVPV

SEQ ID NO: 67066 - protein, 524 aa, Erysiphe necator
MYIADILSDLLTQQTTRYGWIFMVTSIAFSIILLAVVLNVLSQLLFRRPYEPPVVFHWFPIIGSTISYGIDPYKFYFDCRAKYGDIFTFILLGKKVTVYLGLQGNNFILNGKLKDVNAEEIYTNLTTPVFGRDVVYDCPNSKLMEQKKFMKTALTTEAFHSYVTIIQNEVEAYINNCVSFQGESGTVNISKVMAEITIYTASHALQGEEVRENFDSSFAALYHDLDMGFTPINFTFYWAPLPWNRARDHAQRTVARTYMNIIQARREEKRSGENKHDIMWELMRSTYKDGTPVPDREIAHMMIALLMAGQHSSSSTSSWIMLWLAARPDIMEELYEEQLRIFGSEKPFPPLQYEDLSKLQLHQNVLKEVLRLHAPIHSIMRKVKNPMIVPGTKYVIPTSHVLISSPGCTSQDATFFPDPLKWDPHRWDIGSGKVLGNDAVDEKYDYGYGLTSTGASSPYLPFGAGRHRCIGEQFATLQLVTIMATMVRFFRFRNIDGKQGVVKTDYSSLFSMPLAPALIGWEKR

SEQ ID NO: 67067 - protein, 165 aa, Secale cereale
VMASSATSVAPFQGLKSTAGLPVSRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCV

SEQ ID NO: 67068 - protein, 358 aa, Methylococcus capsulatus str. Bath
MGNPDQPTPQHIVDKLIESSRKGTNHRYSVSKGIPRLRRAICHWYLNRYGVELDPDSQAIVTIGSKEGLAHLALATVGPGDAVLVPNPAYPIHPYGFVLAGADVRHVPLLPGVDFFAELEMAIKTSWPKPKMLVLNFPANPTAQCVDLEFFEKVVEIAREYKIWVVHDLAYADLVFDGYVAPSILQVPGAEDIAVEFFTLSKSYNMPGWRVGFMCGNRELVSALGRIKSYLDYGTFTPIQVAAITALEGPQDCVENIRLMYQNRRDVLCKGLNDIGWPVEKPKGTMFVWARIPERYQSLGSLEFAKKMLLDAHVAVSPGIGFGEFGDDHVRFGLIENEHRTRQAIRGVRDMMRKDNAV

SEQ ID NO: 67069 - protein, 164 aa, Bromus catharticus
VMASSATSVAPFQGLKSTAGLPVSRRSTGLGSVSSGGRIRCMQVWPIEGIKKFETLSYLPPLSTEALLKQIDYLIRSKWVPCLEFSKVGFVFREHNASPGYYDGRYWTMWKLPMFGCTDASQVIKELEEVKKEYPDAYVRIIGFDNLRQVQCVSFIAFKPPGCE

SEQ ID NO: 67070 - protein, 429 aa, Mycobacterium sp. MCS
MPIIEQVGAREILDSRGNPTVEVELALTDGTFARAAVPSGASTGEHEAVELRDGGSRYGGKGVDKAVQAVLDDIAPAVIGMSADDQRLIDQALLDLDGTPDKSRLGANAILGVSLAVSKAAAESAGLPLFRYLGGPNAHILPVPMMNILNGGAHADTGVDVQEFMVAPIGAPSFKEALRWGAEVYHSLKSVLKKQGLSTGLGDEGGFAPDVAGTKAALDLISSAIEAAGFKLGTDVTLALDVAATEFYTEGTGYSFEKETRTAEQMAEFYASLLDAYPLVSIEDPLSEDDWDGWVSLTTQIGDRVQLVGDDLFVTNPERLEEGIERGAANALLVKVNQIGTLTETLDAVALAHNSGYRTMMSHRSGETEDTTIADLAVAVGSGQIKTGAPARSERVAKYNQLLRIEETLGDAARYAGDLAFPRFALETK

SEQ ID NO: 67071 - protein, 795 aa, Mannheimia succiniciproducens MBEL55E
MKFSEQWVREWVNPAVNTEQLCDQITMLGLEVDGVEAVAGEFNGVVVGEVVECAQHPDADKLRVTKVNVGGERLLDIVCGAPNCRQGLKVACAIEGAVLPGDFKIKKTKLRGQPSEGMLCSYRELGMSEDHSGIIELPADAPVGKDFREYLILDDKEIEISLTPNRADCLSIAGVAREIGVVNQLAVTEPAINPVPVTSDEKVAINVLAPEACPRYLLRSVKNVNVNAETPVWMKEKLRRCGIRSIDPIVDITNFVLLELGQPMHAFDAAKLAQPVQVRFAADGEELVLLDGTTAKLQSNTLVIADQTGPLAMAGIFGGQASGVNAQTKDVILEAAFFAPLAITGRARQYGLHTDSSHRFERGVDFELQHKAMERATSLLVEICGGEVGEICEVVSETHLPKLNKVQLRRSKLDALLGHHIETETVTEIFHRLGLPVSYENEVWTVTSASWRFDIEIEEDLIEEIARIYGYNSIPNNAPLAHLSMREHHESDLELSRIKLALVGNDFHEAITYSFVDPKLQSILHPEQAVWILPNPISSEMSAMRVSLLTGLLGAVVYNQNRQQNRVRLFETGLRFIPDESAEFGIRQELVFAAVMTGSRLSEHWASKAEPADFFDLKGYIENLLSLTKAGPYIKFVAKEFPAFHPGQSAAIVLDGEEIGYIGQLHPMAAQKLGINGKAFACELIVDKVAERNVANAKEISKFPANKRDLALVVAENIAASDILDACREVAGSKLTQVNLFDVYQGQGVPEGHKSLAISLTIQDTEKTLEEDDINAVISVVLSELKDRFNAYLRD

SEQ ID NO: 67072 - protein, 180 aa, Zea mays
NDPSPGYNIEQGRDVSFSGILSFIEAGAMEKLKNKECTPAALCYSLQETIFAMLVEITERARAPCDSKDVFFVGGVGCNERFQERRKIMCSERGGGGFATDDRYCIAKGARIAYTGLLGYAQGMPPPLGGWTFTQRFRTEEVHAIWREKERPVLNNTHSDPIAEVFKEEASMPPPIVIDY

SEQ ID NO: 67073 - protein, 313 aa, Bacillus cereus ATCC 14579
MRNVFCIGELLIDFVCRNTNVSLVNGSDFEKKAGGAPANVAAAITKLGGHATFMGQVGNDPFGEFLEQTLQRAQVDTSMLIKDKQTTLAFVSIDQDGERDFTFMRGADGEYQFNSIDLSKIQTNDLIHFGSATALLSSPLKETYFQLLQYAKDKGHFISFDPNYRSALITNTEQFSQDCLTFIKHAHFVKVSQEEATMLSKESDLQQAALKLLNYGAKVVAITLGKDGTLLATNEGQTIVSSISIQQVDTTGAGDAFVGAMLYQIAQSEHTLSYHFKDLTAFISFANKVGAITCTNYGAIASLPSLTDIKAYD

SEQ ID NO: 67074 - protein, 141 aa, Pseudomonas fluorescens PfO-1
MAVQRTFSIIKPDAVAKNVIGKITTRFEDAGLRVVASKLKQLSKAEAEGFYAEHSARGFFGELVAFMTSGPVVVQVLEGENAIARNRELMGATNPKEAAPGTIRADFAESIDANAVHGSDSEAAAAREIAYFFAATEVTTR

SEQ ID NO: 67075 - protein, 277 aa, Zea mays
  misc_feature (223)..(223): Xaa can be any naturally occurring amino acid
  misc_feature (266)..(266): Xaa can be any naturally occurring amino acid
MNFSVGAGGSGDGGGEGGRVQAERWLEIAAKLLAARDLVGCKRFAERAVEADPLLPGADELLAVADVLLTSQAMLYTGEPDPFAVLQVPSKTTDHGAISRAFRRLALLLQSSNPHPGADVALRIVNDAYELLSDPSRQPLRSARTNIPSGAPSQPAAAAAPAAEATDFWTACPFCCYVHQYPRELVGRALKCPNESCRPGGLVAVEIPTQPTIVPGTEMYHCXAWGFFPLGFPNSADLGGNWKPFYKVFPWNNAPSGGGAIGRNYXNYGGGSNGRQP

SEQ ID NO: 67076 - protein, 272 aa, Bacillus cereus ATCC 14579
MTLQEQIMKALHVQPVIDPKVEIRKRVDFLKDYVKKTGAKGFVLGISGGQDSTLAGRLAQLAVEEIRNEGGNVTFIAVRLPYKVQKDEDDAQLALQFIQADQSVAFDIASTVDAFSNQYENLLGESLTDFNKGNVKARIRMVTQYAIGGQKGLLVIGTDHAAEAVTGFFTKFGDGGADLLPLTGLTKRQGRALLQELGADERLYLKMPTADLLDEKPGQADETELGITYDQLDDYLEGKAVPADVAEKIEKRYTVSEHKRQVPASMFDDWWK

SEQ ID NO: 67077 - protein, 442 aa, Arabidopsis thaliana
MDQDGEKRVRAKQSDDEVDWLRDLPESLLCHILLNLPTKDVVKTSVLSSKWRNLWRLVPGLDLDSSDFTENNTFVSFIDRFMSFHSDLYLKKFKLRFFCNLNGDEVSENAHIARWINDVVKRKVHNLDLTWGAVEIPPILYLCNSLVSLKLCGVTLPNLELTSLPCVKVIVLEWVKFANDLALEMLISGCLVLESLTLCRRPNDNVKILRVSSQSLLRFSYNGSSYKGLHDDLVLEINAPKLKILKLFSHQLTTSFIRNTSSSIVEADINIGLGKKFDPKDLPKRNVICNFLAGISSVKNLFIAPCTLEVIYDYSRCEPLPLFCNLSYLSVDFYNNSWEILPIFLESCPNLKSLVVGSITSPKRRTSVLSGPRRLLSSLEYVEIESPLTGEVFEMKLVSYLLENSPILKKLTINLDDSSRKKAECELLTIPRRSTSCQVVVL

SEQ ID NO: 67078 - protein, 397 aa, Saccharophagus degradans 2-40
MTDNQDDNLAGLALDTLAIRAGHHRTHEGEHSEPIFTTSSYVFESAAQAAARFGGSEPGNVYSRYTNPTVRLFEERIAALEGAEDGIATASGMAAILSTCMALLEAGDKVVCSRSVFGTTTVLFTKYMQKFGIEVVMVPLTNLDAWRDAVCEKTKLLFVETPSNPLCDVADIAALAEIAHSKDALLVVDNCFCSPALQKPLALGADLVVHSATKYLDGQGRCLGGAVVGPAEPIDLIRGFIRSCGPSMSPFNAWVFAKGLETLRLRMEAHSKSALELALWLQANPAVEKVFYAGLPEHPGHALAAKQQSAFGGVLSFRVKGGQAEAWKVIDSTKFLSITANLGDAKTTICHPATTTHGRLSDQEKVEAGITQNLIRVAVGLEDIDDIKADLARGLGA

SEQ ID NO: 67079 - protein, 460 aa, Glycine max
MASRAIVQQQQARGEAVVGGGKQQKKNGVADGRNRKALGDIGNLANVRGVVDAKPNRPITRSFGAQLLANAQAAAAADNSKRQACANVAGPPAVANEGVAVAKRAAPKPVSKKVIVKPKPSEKVTDIDASPDKKEVLKDKKKEGDANPKKKSQHTLTSVLTARSKAACGITNKPKEQIIDIDASDVDNELAAVELAAVEYIDDIYKFYKLVENESRPHDYIGSQPEINERMRAILVDWLIDVHTKFELSLETLYLTINIIDRFLAVKTVPRRELQLVGISAMLMASKYEEIWPPEVNDFVCLSDRAYTHEHILTMEKTILNKLEWTLTVPTPLVFLVRFIKASVPDQELDNMAHFLSELGMMNYATLMYCPSMVAASAVLAARCTLNKAPFWNETLKLHTGYSQEQLMDCARLLVGFHSTLENGKLRVVYRKYSDPQKGAVAVLPPAKFLLPEGSASQHS

SEQ ID NO: 67080 - protein, 321 aa, Arabidopsis thaliana
MAKFGEGDKRWIVEDRPDGTNVHNWHWSETNCLEWSRNFFTKQFSGVDILSGEGEAKDSDGKTLLKADGLVDMPYISDENADEDPEIRFSVKDEGPIGRTLKEAMVKKGKEIILEKVRVYVEAMARGGPCRDELESKKVAPKSVAAGSATVAVEKSGAAPVVSAAAVESKVVKEKKKAKTKEGFKTITMTEKFNCRARDLYEILMDENRWKGFTQSNAKISKDVNGPISVFDGSVTGMNLELEEGKLIVQKWRFGSWPDGLDSTVKIVFEEPQPGVTIVNLTHTDVPEEDRYGNATVVENTERGWRDLIFHRIRAVFGFGI

SEQ ID NO: 67081 - protein, 460 aa, Saccharomyces cerevisiae; identical to SEQ ID NO: 1098

SEQ ID NO: 67082 - protein, 230 aa, Gloeobacter violaceus PCC 7421
MDLDILKQTAARRAVELVEDGMVVGLGTGSTAAFAVSVLAERVRLGLRVVGIPTSERTARQAEAEGIVLGTLAEQSRVDLTIDGADEVALGELALIKGLGGALLREKIVAAASERLIIIVDATKLVEQLGSHGPLPVEVAPFGWQATARALERLGAEVNLRAQHGQAFLTDGGHYILDCRFGPIARPAELEAAIDRIPGVVESGLFVGMASAVIVADEGGIEVLTPSAAP

SEQ ID NO: 67083 - protein, 637 aa, Arabidopsis thaliana
MVLPLFRRAAIARTSSLLRARLFAPASEFHSRFSNGLYHLDDKISSSNGVRSASIDLITRMDDSSPKPILRFGVQNFSSTGPISQTVLAMPALSPTMSHGNVVKWMKKEGDKVEVGDVLCEIETDKATVEFESQEEGFLAKILVTEGSKDIPVNEPIAIMVEEEDDIKNVPATIEGGRDGKEETSAHQVMKPDESTQQKSSIQPDASDLPPHVVLEMPALSPTMNQGNIAKWWKKEGDKIEVGDVIGEIETDKATLEFESLEEGYLAKILIPEGSKDVAVGKPIALIVEDAESIEAIKSSSAGSSEVDTVKEVPDSVVDKPTERKAGFTKISPAAKLLILEHGLEASSIEASGPYGTLLKSDVVAAIASGKASKSSAFTKKKQPSKETPSKSSSTSKPSVTQSDNNYEDFPNSQIRKIIAKRLLESKQKIPHLYLQSDVVLDPLLAFRKELQENHGVKVSVNDIVIKAVAVALRNVRQANAFWDAEKGDIVMCDSVDISIAVATEKGLMTPIIKNADQKSISAISLEVKELAQKARSGKLAPHEFQGGTFSISNLGMYPVDNFCAIINPPQAGILAVGRGNKEVEPVIGLDGIEKPCVVTKMNVTLSADHRIFDGQVGASFMSELRSNFEDVRRLLL

SEQ ID NO: 67084 - protein, 666 aa, Oceanobacillus iheyensis HTE831
MSGKVEQLSINTIRTLSIDAIENANSGHPGLPMGAAPMAYTLWTDFMNHHPKNSKWFNRDRFVLSAGHGSMLLYSLLHLSGYDVSIEDLKGFRQWDSKTPGHPEVHHTDGVEATTGPLGQGIAMSVGMAMAEAHLGATFNKDKYSVVDHYTYALVSDGDLMEGISHESASLAGHLGLGKLIALYDSNDISLDGDLDRSFSEETEKRFEAYGWQVLRVEDGNDVNAIREAIKEAQRNTKQPTLIEVKTIIGYGSPNKSASAASHGAPLGEDEIILTKEYYEWEHEPFHVPDEVYADFQEKIVNDGEKKEAAWNQLVEEYKKSYPELGEQFDLAIKGQLPEGWEKELPIYEPGSSIATRASSGEVLNAVAKAVPNFFGGSADLAGSNKTTIKEEGDFTKEDYSGRNVWFGVREHAMGAALNGMALHGGLQVFAGTFFVFSDYLRPAVRLAAIMNMPVNFVFTHDSIAVGEDGPTHEPIEQLASLRAVPNLSLIRPADANEVQAAWRLALESEHQPTALVLTRQNLPTLEGTKENAYEGVKKGAYVISKSEKETPDALLLATGSEVQLAVRAQETLKEKGIDVQVVSMPSWDRFEAQEDAYKNEVLPKEVKARVGIEMAASFGWERYVGLDGKVIGINRFGASAKGDKVIEEYGFTVENVVKHVEDLLK

SEQ ID NO: 67085 - protein, 515 aa, Oryza sativa (japonica cultivar-group)
MAGGFSVSGSGVEFEAKITPIVIISCIMAATGGLMFGYDVGISGGVTSMDDFLREFFPTVLKKKHEDKESNYCKYDNQGLQLFTSSLYLAGLTATFFASYTTRRLGRRLTMLIAGVFFIVGVIFNGAAQNLAMLIVGRILLGCGVGFANQAVPLFLSEIAPTRIRGGLNILFQLNVTIGILFANLVNYGTAKIHPWGWRLSLSLAGIPAALLTLGALFVVDTPNSLIERGRLEEGKAVLRKIRGTDNVEPEFNEIVEASRVAQEVKHPFRNLLQRRNRPQLVIAVLLQIFQQFTGINAIMFYAPVLFNTLGFKTDASLYSAVITGAVNVLSTLVSVYSADRVGRRMLLLEAGVQMFLSQVAIAVVLGIKVTDRSDNLGHGWAIMVVVMVCTFVSSFAWSWGPLGWLIPSETFPLETRSAGQSVTVCVNLLFTFVIAQAFLSMLCHLKYAIFAFFSAWVVVMSLFVLFFLPETKNIPIEEMTERVWKQHWFWKRFMDDADKHHVVPNGGKSNGATV

SEQ ID NO: 67086 - protein, 374 aa, Bromheadia finlaysoniana
MAPVPFLPTAVTENTLRESFVRDEDERPKVAYNVFSHEIPVISLRGSTMREMEVEIEICWKIVAACEDWGIFQVVDHGVDAGLIADMTRLAREFFELPPEEKLRFDMSGGKKGGFIVSSHLQGEVVQDWREIVTYFSYPIRTRDYSRWPDKPEGWRAVVEEYSAKLMELACNLLGVLSEAMGLDREALAQACVDMDQKLVVNFYPKCPQPDLTLGLKRHTDPGTITLLLQDQVGGLQATKDGGETWITVQPVQNAFVVNLGDHGHYLSNGRFKNADHQAVVNSNCSRLSIATFQNPAPDGVVYPLAVREGEKPVMEEAITFAEMYRRKMSRDLELARLKKMGKMESKQKGAAGENAEAIGAAATKPKALNEILA

SEQ ID NO: 67087 - protein, 529 aa, Oryza sativa (japonica cultivar-group)
MAGGVVVNNGGGKDYPGKLTMFVLFACIVAATGGLIFGYDIGISGGVTSMNPFLIKFFPSVYRKEQAAEKNQSNQYCKFDSPLLTMFTSSLYLAALVASFFASTVTRVAGRKWSMFGGGVTFLVGAALNGAAKNVLMLILGRVLLGVGVGFANQSVPLYLSEMAPARLRGMLNIGFQLMITIGILCANLINYGTAKIKGGWGWRVSLALAAVPAAIIAVGALFLPDTPNSLIDRGHTDAAKRMLRRVRGTDDIEEEYNDLVAASEESKLVAHPWRNILQRRYRPQLTMAIAIPLFQQLTGINVIMFYAPVLFKTLGFADDASLMSAVITGLVNVFATFVSIVTVDRLGRRKLFLQGGTQMLACQIVVGGLIGAEFGFSGVADIPKAYAAFVVLFICAYVAGFAWSWGPLGWLVPSEIFPLEIRSAGQSINVSVNMLFTFIIAQAFLPMLCRFKFILFFFGAWVVIMTLFVAFFLPETKNVPIEEMVLVWKSHWYWGRFIRDEDVHVGADVEMPAAGNRNGKVDPAKLAN

SEQ ID NO: 67088 - protein, 284 aa, Zea mays
  misc_feature (191)..(191): Xaa can be any naturally occurring amino acid
  misc_feature (207)..(207): Xaa can be any naturally occurring amino acid
  misc_feature (243)..(243): Xaa can be any naturally occurring amino acid
SESESEAASRRQGEMGKGAQGSDAAAAGGEVEENMAAWLVAKNTLKIMPFKLPPVGPYDVRVRMKAVGICGSDVHYLREMRIAHFVVKEPMVIGHECAGVVEEVGAGVTHLSVGDRVALEPGVSCWRCRHCKGGRFNLCEDMKFFATPPVHGSLANQVVHPADLCFKLPDGVSLEEGAMCDPLSVGVHACXRRAGVGPETGVPRGGXAGPIGLVSLLAARAFRAPARVVVLDVDHHRLAVGRXLGAGAALRVSPPAGGPGDKVEPFPPGLGSTLLYLDGPGYQT

SEQ ID NO: 67089 - protein, 538 aa, Oryza sativa (japonica cultivar-group)
MGVLGDGSGWCFCSGGAKLERIKNSVLAAKGAAVAAVSFPAGGGGGGRGGSGFLIHRALLLTTHGTIPSAAAAAAAEVRLSHGRLPARLVPQRFFITSPILDLTIVGLDVVNDELNSHGQQPHFLKTCLNPSLDLGSTVLLLGHTKRKDLTIGEGKVIITTDNLIKFSTDEVAWYPGSAGFDMHGNLAFMVCDPMKLAPSTPTGYASASSAALLSAKKDVPTQFGMPIPAVCGWLKQHWNGNLEDVSKPMMPPARLISTGQRSECSSVGRLNYIKTMEREGGDGMSSSQIPPRLTQHHGSCSSASAKISCGENDSVDSHSIHEQQDLTSQMHESKIEQSASLMDNNFPPGHPRSIRLPLPLKHMMSHENKIKPNPSFSHEAQLANVRINCGTLHNVAYQENCWSEAQSSSSPPDISELGDERGGFSSGEETMYSAETRESRNIPSPKEKNPKMVGRSQSFVNHSKWDSPKSVESSKGAPSKSHTFIPLRKPHLQAAAISQKSQDFFSPTVSSSMKKRNLSQIPMKPRQSAQVTSKWII

SEQ ID NO: 67090 - protein, 554 aa, Ostreococcus tauri
MFRSQGARGAQMCSVLAMYDPNAALESGREELMRELSARMRTRGPDGSGYFGSKRYGLAHERLAIMDPEGGKQPIVYEDGAKTYAVCANGEIYNFRKLQAKYGLTAAKTGSDSEVLLQLYKHLGCDFVKELNGIFGFVVIGDDGDHMIAARDHAGIKPLYVGYGENGVMWFASELKAICDQKCERIEEFPAGYYWTPKDGFVKWYNPAWDFDDAVGTKDTSHVRAILEEAILDQTMADVPIGLLLSGGLDSAVVSTVLKPFLEKSGQEYLSFTVGQEGSPDVTAARMMSEFLGTKHHEYLFTSEEACANIENVIYHLETYEPELIRSAIPNYFLAKLTSQHVKVVLTGEGSDELFAGYLYFRDAPSSKHVHNELRRIFGHLHNVNCQRADRMTMAHSLEARVPFLDPRVIDAVMEVDPQYKTIEGEEKPEKHALRALFDGEIPDPVLWRTKAMQCEGVGLNWVDDLQTFCNEQVSDEDYAKAEEIYPINPPQSKEEMYYRRIFEKYYHGMDKFVHVWEGGCRAGGAAWENNQYTRAGVKNVKQLAKGLTGVRGA

SEQ ID NO: 67091 - protein, 126 aa, Phillyrea latifolia
GAGGGYDPHDFFATTVAFQGPGVHGHDYDRGPKGHHGVTGAVRHRSGSSGSSSSEDDKLEGRRFKKNPLIEKVPGEKLKPGGTPTEGTYGGTPPGPGTTGQHHQEKGPMDKIKEKLPGTFGHSPDD

SEQ ID NO: 67092 - protein, 436 aa, Ostreococcus tauri
  misc_feature (1)..(1): Xaa can be any naturally occurring amino acid
XGALKARVREAIPETNARLKAIRAAHGEKRVGEVTVGMVMGGMRGITGMLYETSLLDAEEGIRFRGHTIPDLQRRLPKATANGEPLPEGIMWLMLTGEIPSDAEVKTLSQELAARAELPKAVHDVLDALPKNTHPMTQLSCALMAMQPESKFAKAYQDGVHKTTFWEYAFEDSMDIIARLPAVCAAIYRRTFKDGKLIAADKNLDWAGNFAHMMGHDSEAVKELMRLYMTIHVDHEGGNVSAHTTHLVGSALSDPYLSLVAGLNGLAGPLHGLANQEVLKWLNETREKVGDDATKEQLTEFVWDTLKSGRVVPGYGHGVLRKTDPRYTCQREFALKHLPNDPMFKLVGKLFEVVPDVLTQTGKVKNPWPNVDAHSGVLLQYYGITEENFYTVLFGASRAIGVLSQLILSRASGYPIERPKSVTSKWIEDKFGKVEA

SEQ ID NO: 67093 - protein, 178 aa, Medicago truncatula
MVMGEMRKSFKDSLKALEADIQFANTLASDYPSETDGARFQMRLSYSPAAQFLLFMFKWTDCHLAGALGLLRVLVYKTFEDGKTTMSVYERKASLKEFYGVIFPSLLQLQRGITDVEERKQKDLCATKYKPKDVIGKGKLSEIDLEREEECPICMEMNNKVVLPNCYHSLCMRCYNDW

SEQ ID NO: 67094 - protein, 307 aa, Pinus banksiana
ATDRTYCFSEVELISRKVAAGLAKLGLQQGQVVMLLLPNCIEFAFVFMGASVRGAIVTTANPFYKPGEIAKQAKAAGARIIVTLAAYVEKLADLQSHDVLVITIDEAPKEGCHHISVLTEADETQCPAVKIHPDDVVALPYSSGTTGLPKGVMLTHKGLVSSVAQQVDGENPNLYFHSDDVILCVLPLFHIYSLNSVLLCALRAGAATLIMQKFNLTTCLELIQKYKVTVAPIVPPIVLDITKSPIVSQYDVSSVRIIMSGAAPLGKELEDALRERFPKAIFGQGYGMTEAGPVLAMNLAFAKNPFP

SEQ ID NO: 67095 - protein, 357 aa, Saccharophagus degradans 2-40
MSKKIVLLPGDGIGPEIVAEAKKVLEAVDAKFKLGLKFEEDLIGGCAIDVHGVPLAQSTLDRCKAADAVLMGSVGGPKWDALDSNIRPEKGLLKIRYEMGLYANLRPAILYPQLADASSLKPEIVSGLDILIVRELTGGIYFGEPRGIRLLDNGERQGYNTYVYAEHEIERIGRTAFEMAMKRDKKVCSVDKANVLEATVLWREVIQSISKDYPEVELSHMYVDNAAMQLVRAPKQFDVVVTGNMFGDILSDTAAMLTGSIGMLPSASLNQDSKGLYEPVHGSAPDIAGQGVANPLATILSAAMMLRYSLNEAAAADAIEAAVGAVLDDGLRSADIFSEGMKKVSTQEMGDAVAAKI

SEQ ID NO: 67096 - protein, 251 aa, Brassica napus
MNSVSTFSELLRSENESPVNTEGGDYILAASCPKKPAGRKKFQETRHPIYRGVRLRKSGKWVCEVREPNKKSRIWLGTFKTAEIAARAHDVAALALRGRGACLNFADSAWRLRIPETTCAKDIQKAAAEAALAFEAEKSDTTTNDHGMNMASQVEVNDTTDHDLDMEETIVEAVFREEQREGFYMAEETTVVGVVPEEQMSKGFYMDEEWMFGMPTLLADMAAGMLLPLPSVQWGHNDDFEGDADMNLWNY

SEQ ID NO: 67097 - protein, 359 aa, Mannheimia succiniciproducens MBEL55E
MVIMTHKIAVIPGDGIGIEVINEGVKVLNCVSQLDPKIQFEFTHFPWGCEFYSKTGRMMDDDGIERLSKFDGIFLGAVGYPGVPDHISLWGLLLRIRKSFDQYVNVRPVKLLKGAPCPLKEKSPKDINMIFIRENSEGEYAGSGSWLYRDKPNEVVIQDGVFSRVGCERIIRYAFELARTEKKSLTSISKGNALNYSMVFWDQIFQQLSQEYPDVETHSYLVDAAAMLMITKPERFEIVVTSNLFGDILTDLGAAIAGGMGLAAGANLNPEGNFPSMFEPIHGSAPDIAGKQLANPLATVWSASQLLEFFGYKEWAARLIDAIEYLLVEQKTLTPDLGGTAKTADVGDAVVAYLQKHFA

SEQ ID NO: 67098 - protein, 198 aa, Zea mays
RDFPPEVFLGFLGSPTLGGFKEFFGPERVNPSAAKGLPFWGGNGGGSPVFKGNQGVSGVFSFPPTLFPGFLPTLLYKGGTPPLNGKLSPLMKWFFSPPNLFPLTPFLVQLGGARPFFRLPSFPLLFKKGAGFFRFFGSFGRENFWGRRGAPVLDDGVFVLSRGFWEKDFPLFFFLGNKLFFFPLRSDFFFFFPRRGVF

SEQ ID NO: 67099 - protein, 227 aa, Phillyrea latifolia
KARIRPQGSSARTNSFDDVKSDKILEIDSGKPYATPKQRNLFHSSHFSLNSDQYSYSLTTSKESTAHQTVPSPSSCGNQPLSPLKFNQELEEACFCTADNSPQFYSASSKGGSSKRGPFTPTKSDGSRSCLSGYSDHPNYMSYTESAKAKVRSMSAPKQRPHYERSSSIKRYSIHGYSESRTNSQKGSFYASFTGKAYPGSGRLDRLGMPVIRADPSGFSGGLRHRY

SEQ ID NO: 67100 - protein, 550 aa, Yarrowia lipolytica CLIB122
MIIHSTGTLPIFNGTVTDYLRTKPSYSSTDPAYIDVVTGNSISYSEVWKLADRLSSALYNDYGLTDAKPDENVGPVVMLHAVNSPLLASVHYALLDLGVTITPAAATYEAGDLAHQIKVCSPSLVICNQQFEPKVKSASSNTKLIFIEDLLKTQSSAPWKKFTTSNPNRVAYLGMSSGTSGLPKAVQQTHINMSSSTEAVISSQTIFSARKNVTAAIVPMTHVYGLTKFVFHSVAGSMTTVVFPKFSLVDLLEAQIKYKINILYLVPPVVLALAKDSRVQPYIKSICELTTLIATGAAPLPPTAGDALLERLTGNKEGNRDNGMDPLVLIQGYGLTETLQVSVFKPEDPERDLKTVGKLLPNTEVRIVGEKGDVPRSKWSFVTPPTGEIYIRGPHVTPGYFNNDSANSESFDGEWLKTGDIGYMDLEGRLTIVDRNKEMIKVNGRQVAPAEIESVLLGHPMVKDVAVIGVTNPDRGTESARAFLVTEARALPVIKQWFDRRVPSYKRLYGGIVVVDAIPKSASGKILRRVLRERKGDSVFGEYVEEVAKL

SEQ ID NO: 67101 - protein, 104 aa, Phillyrea latifolia
RELRWFTAWKQKDHLEEFLLPIEISRSLSQTTVPFGYGYIQFLDTAVAAEICEELFSPIPPHAELALNGVEVFMNASGSHQEIRKLDVRLRALWVLHIAREEWR

SEQ ID NO: 67102 - protein, 983 aa, Burkholderia vietnamiensis G4
MSLDTQNVRQGGCGSGQCACKSAAAARARDPFDETDYGTPQRHADTDVTLEIDGQAVTVPAGTSVMRAAIEAGVNVPKLCATDSLEPFGSCRLCLVEIEGRRGYPASCTTPAEAGMKVRTQSDRLQKLRRNVMELYISDHPLDCLTCPANGDCELQDMAGVVGLREVRYGFDGANHLRDRKDESNPYFTYDPSKCIVCNRCVRACEETQGTFALTIAARGFESRVAAGASESFMASECVSCGACVAACPTATLQEKSVVQLGQAEHSVVTTCAYCGVGCSFKAEMKGTQVVRMTPHKNGLANEGHACVKGRFAWGYATHKDRITKPMIREKITDPWREVSWEEALTYAATQFRKLQQKYGRDSIGGITSSRCTNEETYLVQKLVRAAFGNNNVDTCARVCHSPTGYGLKTTLGESAGTQTFASIGQADVIVVMGANPTDGHPVFGSRLKRRVREGAKLIVIDPRRIDVVDGPHVKATHHLQLRPGTNVAMINALAHVIVTEGLVADAFVAERCDTRAFEQWRDFVSRGENSPEATAEVTGVPAEQVREAARLYATGGNAAIYYGLGVTEHAQGSTTVMGIANLAMATGNIGREGVGVNPLRGQNNVQGSCDMGSFPHELPGYRHIGDASVRSQFEHAWSATLQPEPGLRIPNMFDAALDGSFKGLYCQGEDIVQSDPNTQHVAAALSAMECIVVQDIFLNETAKYAHVLLPGSTFLEKDGTFTNAERRISRVRKVMPPLAGYADWEVTLMLSQALGYDMHYTHPSEIMDEIARLTPTFSGVSYEKLDALGSIQWPCNDEAPEGTPTMHIDAFVRGKGRFVITQFIPTPEKVTQRYPLILTTGRILSQYNVGAQTRRTENVQWHEEDRLEIHPHDAEDRGIHSGDWVGIESRAGQTVLRALVSDRMQPGVVYTTFHFPESGANVITTDSSDWATNCPEYKVTAVQVMPVAQPSDWQRSYARFNSEQLELLERRASAPGVATTGK

SEQ ID NO: 67103 - protein, 469 aa, Capsicum chinense
PIPVPVFGNWLQVGDDLNHRNLTDYAKKFGDIFLLRMGQRNLVVVSSPESAKEVLHTQGVEFGSRTRNVVFDIFTGKGQDMVFTVYGEHWRKMRRIMTVPFFTNKVVQQYRGGWESEVASVVEDVKKNPESATNGIFLRKRLQLMMYNNMFRIMFDRRFESEDDPLFVKLRALNGERSRLAQSFEYNYGDFIPIFRPFLRGYLKICKEVKEKRLQLFKDYFVDERKKLANTKSMDSNALTCAIHHILDAQQKGEINEDNVLYIVENINVAAIQTTLWSIEWGIAELVNHPHIQQKLREEIDTVLGPGVQVTEPDTQKLPYLQAVIKETLRLRMAIPLLVPHMSLHDAKLAVYDIPAESKILVNAWWLANNPAHWKKPEEFRPERFLEEEKHVDANGNDFRFLPFGVGRRSCPGIILALPILGITLGRLVQNFEMFPPPGQSKLDTSEKGGQFSLHILKHSTIVMKPRSF

SEQ ID NO: 67104 - protein, 320 aa, Oryza sativa (japonica cultivar-group)
MSELAYSPTQEVKVNSLFCNGITERSSRFSPSIWLAPDITEGYRKCQRQVFWYSFLKLHVTLEVFQQEGWKDSLPVDFPKPSDNENSVEVAHPNIKPFSVHPLPLLMDITSYGKDSLPVDFPKPSDNENSVEVAHPNIKPFSVHPLPLTKNSDVLLESSNGSDSLKEEKNHYYPGKEIKRRKRHRRKQYVDQEPCIMRGVYFKNMKWQAAIKVDKKQIHLGTVGTQEEAARLYDRAAFMCGREPNFELSEEEKKELQNYTWKDFLDMTRDTITSKKQRKVGLIRRNKTDSLVGQSDGDTEMINGGGSSHSEDGDAETSAS

SEQ ID NO: 67105 - protein, 117 aa, Glycine max
  misc_feature (31)..(31): Xaa can be any naturally occurring amino acid
  misc_feature (68)..(68): Xaa can be any naturally occurring amino acid
  misc_feature (84)..(84): Xaa can be any naturally occurring amino acid
  misc_feature (89)..(89): Xaa can be any naturally occurring amino acid
LDGLIHMLPACVVMKAIVLGKYRQVLTFLVXAKQPRMLLTENEIFKRQPVPVCVAQAVNDGGQSVRQXSIAAFQTHSTRVLRAXGTGRXLPTKKSIPQSPNGEGFVILKDNPEYRKE

SEQ ID NO: 67106 - protein, 241 aa, Ipomoea batatas
MGRGRVELKRIENKISRQVTFSKRRSGLLKKAHEISVLCDAEVGLIVFSTKGKLFEYSTDSSMENILDRYERYSYAEQRMTTNDSEQQQNWSCQYPKLVSRIELLQRSTRNFLGDDLEPLGLRELQSLEQQLDTGLKRIRTRKNQLMHESISELQKKERALQVQNNILAKQLEQQKLVLNSASTSMPPQPLVSPLPLPNLTIGSIARATEAAKNSENRGQAPPCSTSLVPPWMLRHPNNKD

SEQ ID NO: 67107 - protein, 817 aa, Saccharomyces cerevisiae
MDLKTSYKGISLNPIYAGSSAVATVSENGKILATPVLDEINIIDLTPGSRKILHKISNEDEQEITALKLTPDGQYLTYVSQAQLLKIFHLKTGKVVRSMKISSPSYILDADSTSTLLAVGGTDGSIIVVDIENGYITHSFKGHGGTISSLKFYGQLNSKIWLLASGDTNGMVKVWDLVKRKCLHTLQEHTSAVRGLDIIEVPDNDEPSLNLLSGGRDDIINLWDFNMKKKCKLLKTLPVNQQVESCGFLKDGDGKRIIYTAGGDAIFQLIDSESGSVLKRTNKPIEELFIIGVLPILSNSQMFLVLSDQTLQLINVEEDLKNDEDTIQVTSSIAGNHGIIADMRYVGPELNKLALATNSPSLRIIPVPDLSGPEASLPLDVEIYEGHEDLLNSLDATEDGLWIATASKDNTAIVWRYNENSCKFDIYAKYIGHSAAVTAVGLPNIVSKGYPEFLLTASNDLTIKKWIIPKPTASMDVQIIKVSEYTRHAHEKDINALSVSPNDSIFATASYDKTCKIWNLENGELEATLANHKRGLWDVSFCQYDKLLATSSGDKTVKIWSLDTFSVMKTLEGHTNAVQRCSFINKQKQLISCGADGLIKIWDCSSGECLKTLDGHNNRLWALSTMNDGDMIVSADADGVFQFWKDCTEQEIEEEQEKAKLQVEQEQSLQNYMSKGDWTNAFLLAMTLDHPMRLFNVLKRALGESRSRQDTEEGKIEVIFNEELDQAISILNDEQLILLMKRCRDWNTNAKTHTIAQRTIRCILMHHNIAKLSEIPGMVKIVDAIIPYTQRHFTRVDNLVEQSYILDYALVEMDKLF

SEQ ID NO: 67108 - protein, 228 aa, Pseudomonas putida
MALQIGFLLFPQVQQLDLTGPYDVLASLPDVQVHLVWKDLVPVTSSTGLQLKPTTTFEDCPVLDVICVPGGAGVGPLMEDEQTLDFIRSQAAQARYVTSVCTGSLVLGAAGLLQGKRATTHWAYHDLLPTLGAIPVKDRVVRDGNLFTGGGITAGIDFALTLAQELVGVDTAQLVQLQLEYAPAPPFDSGSPDTAPSAVVDEARKRAAPSLKLRTEITERAAAKLNLR

SEQ ID NO: 67109 - protein, 175 aa, Candida albicans SC5314
MFRRSLLSTSRFINKSSSSLSPGLLLNNFRGNFQQSRFISTELKDALDKAVTTSPVVLFMKGTPEFPQCGFSRATIQILGQQGVDPEKFAAYNVLEDSELREGIKEYSSWPTIPQLYVNGEFIGGCDIITSMAQNGELAELLEESNALIPEENEPTTSEENQETVQSANIKPNRN

SEQ ID NO: 67110 - protein, 288 aa, Oryza sativa (japonica cultivar-group)
MAAAAAACVESPDEGVEIREVWAGNLEAEIAAIRDEVDRYPYVAMDTEFPGIVCRPVGNFRTTDEFNYANLEANVNMLKLIQLGLTLSDEGGDLPRRGTGGRRCIWQFNFRGFDPRTDPSNADSIQMLRTCGIDFDRFAAEGADPIRFAELLMSSGVVLNADVQWITFHSGYDFGYLLRLLTGRNLPDNMPAFFDLIRIYFPVLYDIKHLMRFCSNLHGGLSRLGELLDVKRVGTCHQAGSDSLLTLGCYNKIKEVYFKGSTEKHAGVLYGLVIEDGVNRPPPTQPNE

SEQ ID NO: 67111 - protein, 560 aa, Aspergillus nidulans FGSC A4
MPFRSRWQIEIPNTHLASLLLTSPTEPLSKTHRCFSEAARPDTHYFTTHDFRLWSQRFAAGLRKSGLQKGDRVLLFSGNDIFFPVIFMGIIMAGGIFTGANPTFVARELAYQLQDSGAIYLLCAEDSLDTGIEASKIAGLDMDKVFVFNNALYDGKGEGMKGCRYWGELVASVEEGAGFAWEELDTPEKANTTLALNYSSGTTGRPKGVEISHKNYVSNMLQYNHLFYLNPNWREKAKRARWLCFLPMYHAMAQNIFIAAALNRGVPVYVMPKFDFIKMLEYTEKFRISDYILVPPVVVALAKHPAVKSGKYDLSSVEDIGSGAAPLGREVCEEVEALWPPGKINIKQGWGMTEATCSILGWSPMEKCLTASVGELNPNCEAKIVADDGVTELGKNQRGELLVRGPNVMKGYWRNPQATKETLTEDGWLRTGDIAFVSNEGWFHVVDRKKELIKVKGNQVAPAELEAILLEHPAVADAAVIGVPKDEDEAPRAYIALKPGKNATAKDITTFMEGKVSRIKRITGGVVFVEAIPKNPSGKILRKALREQAKQELQGVYAKL

SEQ ID NO: 67112 - protein, 191 aa, Saccharomyces cerevisiae
MQTLKCVVVGDGAVGKTCLLISYTTNQFPADYVPTVFDNYAVTVMIGDEPYTLGLFDTAGQEDYDRLRPLSYPSTDVFLVCFSVISPPSFENVKEKWFPEVHHHCPGVPCLVVGTQIDLRDDKVIIEKLQRQRLRPITSEQGSRLARELKAVKYVECSALTQRGLKNVFDEAIVAALEPPVIKKSKKCAIL

SEQ ID NO: 67113 - protein, 555 aa, Lactococcus lactis subsp. lactis Il1403
MKTDIEIAQAADIQPITKIAEKIGLSFDDIELYGKYKAKIPLEVLDKFDQQSEGKLVLVTSINPTPAGEGKSTVTVGLADAFARQGKNVMVALREPSLGPVMGIKGGAAGGGFAQVLPMEDINLHFTGDIHAITTANNAISAFLDNSLHQGNPLNIDPRRIIWKRVVDLNDRALRHVTVGLGGPLNGVPREDGFDITVVSEIMAVLCLATSISDLKERLGKIVLAQSYDRKPVTLGDLGVQGAIAMLLKDALKPNLVQTIEGTPALIHGGPFANIAHGCNSVLATKTALKLSDIVITEAGFGADLGGEKFLDIKTRQLGKQPDAVVIVATLRALKMHGGLDKKELTKENVEAVKKGFANLERHIKNMQSYGLPVIVAINEFASDTKSEISALKDLTEALGVPVSLTQVFAKGGEGGLDLAEKLSGMLQEKSDFSYLYDLKEPLSAKIDKVVTEIYGGSKVNYSPKAKRQMREIEENGWNDLPVCMAKTQYSFSDQPNLLAAPEGFEVTVRELLPKIGAGFIVALLGDVMTMPGLPKNPASLKMDVTDDGKISGLF

SEQ ID NO: 67114 - protein, 515 aa, Mycobacterium sp. MCS
MSQPFYITTAIAYPNGDPHVGHAYEYIATDAIARFKRLDGYDVRYLTGTDVHGQKMAETATALGVPVADLARRNSDVFQRLQEKLNISFDRFIRTSDTDHYRASEDIWQRMNAAGDIYLDAYSGWYSVRDERFFTEGETTLREDGVRIATETGAPLTWTEEQTYFFKLSAYTDRLLAHYEAHPEFIQPDARRNEIVSFVSGGLRDLSISRTTFDWGVPVPDHPDHVMYVWVDALTNYLTGVGYPDTSSEEFQRYWPADLHMIGKDIIRFHTVYWPAFLMSAGLELPRKVFAHGWLLNRGEKMSKSIGNVVDPVNLVDTFGLDQVRYFFLREVPFGQDGSYSEDAIIGRINADLANELGNLAQRSLSMVAKNLGSAVPEPGEFTAEDLALLDAADALMDRVRRHFDEQAMHLALEAIWSVLGAANRYFSAQEPWVLRKSEAVHDQVRFRTVLYTTLETVRIAALLSQPVMPDSTATLLDLVGQPADQRTFAAVSTRLTPGTALPKPVGVFPRYQVD

SEQ ID NO: 67115 - protein, 448 aa, Mycobacterium sp. MCS
MNGLHENLQGIFEEVARRNPGETEFHQAVYEVLQSLGPVVAKHPEYADSAIIRRLCEPERQILFRVPWVDDSGAVQMNRGFRVEFNSALGPFKGGLRFHPSVYLGIIKFLGFEQIFKNSLTGMPIGGAKGGSDFDPKGRSNGEIMRFCQSFMTELYRHIGEYTDVPAGDIGVGMREIGYLFGQYKRITNRYESGVLTGKGITWGGSLVRTEATGYGTVYFIADILKSRGESFEGTRAVVSGSGNVAIYAIEKIQHLGGTVIACSDSDGYVVDPDGIDLALLKEVKEVQRGRVADYAEMRCGRARFVHGNVWDVECDIAVPSATQNEINGADAAALVKGGCRIVAEGANMPCTPEAVKLFAEAGTVFAPGKAVNAGGVATSALEMQQNASRDSWTFDETEDKLAEIMGRIHDRCLQTAEEYGQPGNYVAGANIAGFTRVADAMLALGII

SEQ ID NO: 67116 - protein, 393 aa, Oenococcus oeni PSU-1
MSNFILPLNKTVDNLRRDPILDFQAKIRNIDDLIQLTFGEPGFTVDDRIKAVAKVSIDHDRSHYANSQGEINLRRAAVSYFNRHFQLNLKGVNDVLVTQGVSEAINVVFMTILERGDGVIIPEPSYSPYSTSLALAGGVKVPLDTCEHNFKITPELIEKTIDNANIPVKAILINYPANPTGVTYSKEELLAIADTLKKHKIWVISDEIYAALTYSGEHTSLYKIIPEQSILLTGLSKSHAMTGYRIGFIFASSELIEKMLTVHEALAFAVSTLSQDAAFAALTVGEDVPEYALKAYRKRRDRLLKKLTELGFESVNPQGAFYVFTKIPKSFGNNGYKFAVDLANNAKVAVLPGEAFSKNAKNYIRISYASSDSDLDEALRRMTNYIEKGTKYE

SEQ ID NO: 67117 - protein, 429 aa, Rickettsia akari str. Hartford
MTDTKPKIKTPRSPYVKKYNSWRVRILYSIIIGYATFYLCRQNFNIATPAIREYFGVTKTQIGWILTASSIMYGVSKACNGFISDKVNARIFMVLGLLVVGIITILIGFSYSLWFIGILWISSNWFQSMGWPPATKMLTHWFASKELGTKWAMGTTSNQIGGAIAMISCGYLIDKFDWRAAFFVPGVVACVVSLFLYNRLRNSPKEVGLSTVEEYKEYPPESIGDYEKLLTPQLLRMVFCNRLIWYVCLANMFVYIIRSGVIYWAPTFLKDLRNISLANAGLQIGLYEMIGIPGALIAGFLSDKLFQGRRGPIGAICMVLLSLLLVLFWTIPIQSELLSIVILSLIGFFVAGPQLLVGIAAADFSTRQAVGTANGLSGLFGYLGASIAGIGVGWISDHYGWNGVFIFFSISALLGGGLFALTWNRSAKK

SEQ ID NO: 67118 - protein, 140 aa, Rickettsia akari str. Hartford
MTIQYTFSMIKPDAIKRNKIGQVNAYLENGGLKIVAQKMRFLTKYEAECFYDEHRARTFFNSLVEYITSGAVVLQVLKGEDAIILNRTIMGATNPAEAEAGTIRKDLGESIEANSIHGSDSENSAKREIAFFFNKSEIIE

SEQ ID NO: 67119 - protein, 434 aa, Mannheimia succiniciproducens MBEL55E
MNNAVLNQPNKYDLVKDTLVLILAGGRGSRLHELTDKRAKPALYFGGNRRIIDFALSNCINSGLNRIGVITQYAAHSLLRHLQTGWSFLPQERGEFVDMLPARQQIDDNTWYRGTADSVYQNLAIIRGHYKPKYVLILAGDHIYKMDYSQMLLDHVSSGAKCTVGCIEVPREEAKEFGVMAVNETLKVKAFVEKPQDPPAMIGKPNSSLASMGIYVFNADYLYEALDRIKTPNTSHDFGKDVMPLALNDGVLYAHPFDRSCKGRNTEGAIYWKDVGTLDSFWQANIDLVSEEPQLDIYDQTWPIRGNPVQAYPSKFFYDEPNCKQVDNSLIAGGCMVKNASISYSVLFDNVSVNAGSSIEQSVILPQVKIGKNCMLRRCIIDRHVQIPDGMQIGVDLELDSKRFRISKNGIVLVTESMLHKLNGKSVASEAHLD

SEQ ID NO: 67120 - protein, 372 aa, Arabidopsis thaliana
MDRLLQPPSSHSIAPSKTQSRPSPLLLHRLHSPNLTTFPSSRRLESRRISSISCFFRHNPLPDTSPGLNQSSNFLIASSQTDASKPNPGFIQRIVSSFEQRKTISAGMVILVSAIAALLLNPILVPPAFASFQTATNSGGAAVVGGKLLRTEVLTSAWTGFFAGCLHTLSGPDHLAALAPLSIGRTRMESAAVGALWGCGHDAGQLIFGLLFLLLKDRLHIEVIRTWGTRVVGLTLLVIGAMGIKEASEMPEPCVVTLENGETDEKSLKKKKIGFATFATGIVHGLQPDALMMVLPALALPSRIAGASFLIMFLIGTVIAMGSYTVFIGSCSEALKEKVPRITEKLTWASSLVAIGLGLAIIVSQFFGFSLY

SEQ ID NO: 67121 - protein, 1230 aa, Cryptococcus neoformans var. neoformans JEC21
MSSFTPAFRLHHTHSSSVSPTASNDVAPSSPTPNQPHQLAARSPLYATSPNCASKITKGSSLSSSTAHHGLKYVRPSTSPLLRSPKGESFSAYLGNWGSQELITFLNIHKCGQYLAIFQKNDINGKILLDLDMTALKSMGIGKISERVRLIGGIKDLRRCVADESIRAPFTQRSYPSERTLLPSLPSHSNVLLDKWDCSSSASRLGKRQITLRPPPLDLQGHMPPRLLSHASLGIATIDTHDIHTTNSKIEVYIQQNPPGQPQSMPTKRSDSLTLCAAPSRNVGRRSPSSRHFEGCKSQTDGLTTLNLTLDRQVPSSTMNNVTLREDCHLQREERLPLSHQVPHSRNAFASPHKTSLSGRCPLARGDTTSHQPSGPAIAEQDSPVNYRISNTVTNTKEISQGDLKQPFVMKSLESQSHLLAGVSDMSHDPVTDGFKPKGKASVPLTVMSSSDISAVNANPAALSLADLRRQLVKFINTEDDTIRTVNVMHVTSGVEILERALKKFGKFGTGIHGSPDVYGDEDGDGTLEIDGWEVYTESTPDESSKPLSEFNLLKTCTFHREGTAIQDKGLFLRKKQRMQKRKNIQDFFGETPPPSMSPTSPTLITGPHLSLVQGKSQPTSGSAFSSSSRLSTLTHKGRNRASMISVMSGLGVPIINTLPSPQGNGLRLTGSVHSHEKKSMYNFFGHRPPSELISNHLTDYFPSAKKSDVEKARHSLLRLSGGTVAYKKSGIYEGDSTPDHWSKPGDNQPPSLPPFEPSQDTLSDSLQAFASSTPVHLSRPKHTVALRRRRDSDSSSRSHTSMLMQTRRNRDHSDTTSLLTVDEITAEVENRRVSTIQRGDYIEETEDSSSIEGDTLPQDDESKGVLRAICSDSNKLVDSGKSYQGDSDIDQQHELEDEEEDKLDDDEEEEEEEEEEDNEQGKAFTSTGSKRIIKWIKGALIGAGSFGSVYLGMDAQSGLLMAVKQVELSAGSAKNEDRKRSMLSALEREIELLKELQHENIVQYLDSSVDANHLNIFLEYVPGGSVAALLNNYGAFEEALVRNFVRQILTGLNYLHMRGIVHRDIKGANILVDNKGGIKISDFGISKKVENSLITGLRTNRPSLQGSVFWMAPEVVKQTSYSPKADIWSVGCLVVEMLTGTHPWADLTQMQAIFRIGSLARPAPPSDISVQADEFLRKTFEIEHAKRPTAAQLLKHPFIGSPRVRTAASNFINGAIASETMEVQVVEES

SEQ ID NO: 67122 - protein, 661 aa, Mannheimia succiniciproducens MBEL55E
MLKNQTGKPYPLGATLVEVNGTKGVNFSIFSASARAIELCLFDNSGREVRFPILDKTDDIFHIWVPNVPLGTKYGFRIHGDERHNPKKLMLDPYAKMVVGKPDLTSKENQAWYLLSDERDNSKIAPKSIIIDGEFDWEQDKPLNIPWTETIIYELHVKGFSKLRADLPEEIRGTYSALAHPSVIAYLKELGITAVELLPINFSISESHLQERGISNYWGYNPMAMFAVEPQYAATEDPVHEFKTMVKTLHQAGIEVILDMVFNHSAESERDFPTFSYRGIDEQTYYWSDAQGNYLNWSGCGNLLHLAHPYMRRWAIDCLRYWVEEYHIDGFRFDLATNLGRETPAYKAHSELFKAMRLISGFKNTKFIAEPWDMGEDGYQMGNFPPFFAEWNDRFRDDINRFWLWQSGELGAFAERFAGSADIFKQEGKYPHNSVNFITAHDGFTLRDLVSYNHKHNNANGEDNRDGRNENYSHNHGIEGSTDGLDEPQKTAVENARILSSQSLLCSLLLSNGTPMLLAGDEFGNTQFGNNNGYCQDSGLTWLKWSNFNLDLFEIVKKLIIVRKGIQSLVNDKWWTEGNVRWFNEFGSLMNVSDWQERGAKALQVLLDEQWLCVVNAKTELQVFSLPEGDWNMEISMTGCKNQNNQLIVDNLSFCLLRRIL

SEQ ID NO: 67123 - protein, 234 aa, Thermus caldophilus
MRAENPVFFLDYDGTLAPIAQRPEEAFPHPEAPRVLRALMERHPVYVVTGRRVRDLEPLLPLPGLPVVGGHGLEEGVLFGEVRPLFPVDLGPLRARLPSCPGVRVEDKGFALALHYRGAEDEEKARACLEALLKAVEGLLEALGLEALPGKKVLELKPKGVDKGQAVLRLLGRHPDHTPVYIGDDTTDEAAFLALRGRGLTFKVGEGPTAAQGRLKDVEEVLAYLQTYLRPTSL

SEQ ID NO: 67124 - protein, 583 aa, Magnaporthe grisea 70-15
MCGIFACHAHPDVQKFKPTALRLAKAIRHRGPDWSGSVTCNQTILCHERLSIVGVESGAQPLTNEDESIILAVNGEIYNHRLVRKSLKTPYHFKTTSDCEVIIPLYMEHGLDAPKYLDGMFSFVLYDKKQNRTIAARDPIGVTTFYQGWSSSEPGAVYFGSELKCLYQVCDKIEAFPPGHIYDSLTGERTRYFQPTWWDPKRVPETPLDLTKLREALEKSVRKRLMAEVPYGVLLSGGLDSSLVASIAQRETKRLKKLAIEAGLEDLPAEPTGNHDQGEGLVGIDDENKLSTMTYLPQLNSFSIGLPGSPDNKAALEVAKFLGTKHHVMTFTIEDGLNALSDVIYHLESYDVTTIRASTPMYLLSRKIKAMGIKMVLSGEGSDEAFGGYLYFHNAPDKDAFHDETVRRVKNLHLSDCLRANKSTSAWGLEARVPFLDKEFLELAMNIDPKEKMITKERIEKYIVRKAFDTSDDPNAEPYLPDNILWRQKEQFSDGVGYGWIDALKDNAEIQVTDEMMKNPKPEWGDDIPDTKEAYWYRCMFDEHFPPHCASTVERWTPTWSKQTDPSGRAIAVHAAKYDHISE

SEQ ID NO: 67125 - protein, 122 aa, Glycine max
MVVAGGAKFNLRRGNGSSHNVVNGYSSDGDLCRISKSGCFSSVAEVDRDPSCVSFTTFNILAPIYKRIDPQNQGLRESDFRAFWLARNERILDCLLSESSSIMCLQVTIYLLSRWWALSLVK

SEQ ID NO: 67126 - protein, 395 aa, Pseudomonas fluorescens PfO-1
MTAALMNTYQPLDLSFIKGLGTRLWDLSGREYLDAVAGVAVTNVGHSHPRIVSAISEQAGLLLHTSNLYSIDWQQSLARKLTQLAGMERAFFNNSGAEANETALKLARLYGWHKGIEQPLVVVMANAFHGRTLGTLSASDGPAVRLGFNELPGDFVKVPFGDLEALEQVQRKHGQRIVAILVEPIQGESGVQLAPPGYLKALRELCNRHAWLLMLDEIQTGIGRTGRWFAFQHEGIVPDVMTLAKGLGNGVPIGACLARGRAADLFTPGSHGSTFGGNPLACRVGCTVLEIIEEQGLLENARVQGERLLTRLRAELADNPNVLAIRGQGLMIGIELKQPIRDLTLIAARDHGLLINVTRGKTIRLLPPLTIDEREVGMIVRGVGRSLSHVSSLGQ

SEQ ID NO: 67127 - protein, 438 aa, Treponema denticola ATCC 35405
MKKTDFSISTLGECKIQSPIMLSETHGDLIANYVTDNEFIRYNLDASLGETGEPLTHADIIEKAGPRQKIYFSPNYVHAAIATCGGLCPGINDVIRAIVRCLWTRYGVRRISGIKFGYKGFISEYGFSPVPLTPEAVNGIHKTGGSFLGTSRGGGTRVTEIVDGIEQMNINMVFFIGGDGTQKGALEVSREIERRKLKISVIGIPKTIDNDLSFIQKSFGFDTAIAKATESVAAANMEASSQINGIGLVKLMGRESGFIATHTAIACHEAHFVLIPEVRFELGGENGFLKLLEKKLIENGYALIVAAEGAGQHLMNIEEETDASGNKKLADIGLFLKKEITEYFDKIGMHINLKYIDPSYQIRSSIAAPIDSVYCERLGNNAVHAAMAGKTRTLIGLVNNKFVHLPIEQVVSERKYVNPESSLWRDALDATGQPTTMI

SEQ ID NO: 67128 - protein, 188 aa, Triticum aestivum
  misc_feature (103)..(103): Xaa can be any naturally occurring amino acid
  misc_feature (116)..(116): Xaa can be any naturally occurring amino acid
  misc_feature (144)..(144): Xaa can be any naturally occurring amino acid
MDPKLVEVTQLFDRFKAAFKASNFDVCSTLLSQLKVLLTKFPSLPPLFQQTPNAVEELKLAREIYEQAVILSVKMEDQDAFERDFCQLKPYYMDTCGIIPPSXEEYPIMGANLLRXLLVQNRIAEFHTELELLPPQALDMAYIXHGVELEQSFMEGAYTGVRSQRRRTLCSKSILRAGAPRPHPRCFW

SEQ ID NO: 67129 - protein, 182 aa, Triticum aestivum
MGRKKGAAGGAKSVALPVPAQTEVGVEKEAKKAAPRKRNPCPGIRAVGGRIYDPENGKTCHQCRQKTTDFAVACKQPGGKGPCSTHFCHTCLFNRYGEDAKKAAKKARWACPKCRGICNCSFCRKKKGETPTGILAHAAKATGHSSVHELLKQGSDMVAAAQTLTSPPCRDQEGTKEAPGDR

SEQ ID NO: 67130 - protein, 277 aa, Burkholderia mallei ATCC 23344
MNGVDSRRAAPPRGGLAADFRGRTALVTGAAQGIGAAIADAFAAAGASVAIADVQGDAAAAFAARLAARGAADGQTVRAYRVDAARRDELFGLVAQAEADSGRLDIVVHNAAYFPLTPFGAIAPDVLERTLAVNLSALFWLTQAALPAFERVGRGRVLATSSVTGPRVAYPGLAHYAASKAGVNGFIRAAALELARRNVTVNGVEPGMIRTPAAGNLGDAAHGERIARGVPLGRLGEPEDIAAAMLFLASDAAGYITGQTIVVDGGATLPETAAALG

SEQ ID NO: 67131 - protein, 236 aa, Magnaporthe grisea 70-15
MPRLPNSEDPPERPDFITNIINGLERYNPEAVGTLEQYLTTQCEERFCDCNANRTLLKLYQLNPDRIKDEVITNILVKAMTLFPSPQFSQALHLLSPSALSQQSELSEAVSKLRALNNQLEGAQYARFWATIESDDLYADLTTDIQGFEEMVRLRIAVLVSQAFREVQLSLMEQWLGLDEAPLKTFITEACGFKIEGDIVQIPKNPDNEAKKAEIREDVNVEMFSRVIRRAWEEVA

SEQ ID NO: 67132 - protein, 747 aa, Zea mays
MGGAVMVAIAASIGNLLQGWDNATIAGAVLYIKKEFNLQSEPLIEGLIVAMSLIGATVITTFSGAAADCVGRRPMLVASAVLYFVSGLVMLWAPSVYILLLARLIDGFGIGLAVTLVPLYISETAPTDIRGLLNTLPQFSGSGGMFLSYCMVFGMSLMPKPDWRLMLGVLSIPSLIYFGLTVFYLPESPRWLVSKGRMAEAKRVLQRLRGREDVSGEMALLVEGLGVGKDTRIEEYIIGPDDELADEGLAPDPEKIKLYGPEEGLSWVARPVRGQSALGSALGLISRHGSMAASQGKPLVDPMVTLFGSVHEKMPEIMGSMRSTLFPNFGSMFSVADQQQVKADWDAESQREGEDYASDHGGDDIEDNLQSPLISRQATSVEGKEIAAPHGSILGAVGRSSSLQGGEAVSSMGIGGGWQLAWKWTEREGEDGQKEGGFQRIYLHEEGVQGNRGSILSLPGGDVPPGGEFIQAAALVSQPALYSKELLEQRAAGPAMMHPSEAVTKGPRWADLFEPGVKHALFVGIGIQILQQFAGINGVLYYTPQILEQAGVGVLLSNLGLNASSASILISALTTLLMLPSIGIAMRLMDMSGRRFLLLATIPVLIVALLVLVVSNIVDVGDVAHAALSTASVIVYFCFFVMGFGPVPNILCAEIFPTTVRGVCIAICALAFWLGDIIVTYTLPVMLNVVGLAGVFGVYAVVCVLALAFVFVKVPETKGMPLEVITEFFSVGAKQAKEEEEEEAREG

SEQ ID NO: 67133 - protein, 354 aa, Bacillus halodurans C-125
MKALNLYGIQDLRFEETPAPSIEHDDDIIIKVKAVGICGSDLSRYKKLGPYVPGMTFGHEFAGEVVKIGRSVTGFSIGDRVAACPTYTCGQCRYCQLGEPTRCERLSVIGARHPGAYAEYVKLPAKHVIPLPNVVNYDEAALIEPASVVAHGFYRTNIKPGASVAIMGVGSIGLLAVQWAKIFGATTVFAIDIDEQKLNVANQLGADVLISSLQRPAHKQILEYTNGIGVDVAVESAGTPSTSAQVFALPKKGGEVVFLGIPYADVQIERFYFEKIVRNELHVYGSWNALSSPFPGKEWATTIHYMSSGQLNVAPMISYRLPLAKGPETFQQIAKGELKPTKVLFYPEKLSERK

SEQ ID NO: 67134 - protein, 325 aa, Triticum aestivum
  misc_feature (116)..(116): Xaa can be any naturally occurring amino acid
  misc_feature (136)..(136): Xaa can be any naturally occurring amino acid
MKLQTEAAAAAGGEGRLMIRQVWANNVESEFQAIRQVAERFPYVSMDTEFPGVIHCPSKHHATLTPSERYAALKANVDALHLIQVGLAFAASPDAAPAVAFEINLREFDPRVHRHXPASVALLAGHGLDFAKQRRXGVDARVFAALLMSSGLVCSGASAPTWVTFHSAYDFGYLVKLLMGRKLPRTLTEFLGLVRVFFGDEVYDARHVMDSCAGLYGGLDALAAQLGVKRAAGMSHQAGSDAALTWDVFRRIREVYFAGNSRQGQGQGVGNFAGVLYGLDLELHLAAPADNGNGNGNRNNNKNKCGSGNGAGGRGNNRRAVAALR

SEQ ID NO: 67135 - protein, 444 aa, Neisseria meningitidis FAM18
MTDLNTLFANLKQRNPNQEPFHQAVEEVFMSLDPFLAKNPKYTQQSLLERIVEPERVVMFRVTWQDDKGQVQVNRGYRVQMSSAIGPYKGGLRFHPTVDLGVLKFLAFEQVFKNALTTLPMGGGKGGSDFDPKGKSDAEVMRFCQAFMTELYRHIGADTDVPAGDIGVGGREIGYLFGQYKKIRNEFSSVLTGKGLEWGGSLIRPEATGYGCVYFAQAMLQTRNDSFEGKRVLISGSGNVAQYAAEKAIQLGAKVLTVSDSNGFVLFPDSGMTEAQLAALIELKEVRRERVATYAKEQGLQYFENQKPWGVAAEIALPCATQNELDEEAAKTLLANGCYVVAEGANMPSTLGAVEQFIKAGILYAPGKASNAGGVATSGLEMSQNAIRLSWTREEVDQRLFGIMQSIHESCLKYGKVGDTVNYVNGANIAGFVKVADAMLAQGF

SEQ ID NO: 67136 - protein, 484 aa, Saccharophagus degradans 2-40
MSNKYDVIVIGSGPAGYVAAIRCAQLGLKTACIEKWKDKDGKGVNGGTCLNVGCIPSKALLDSSHRYEDAHKGFASHGIKAPNVEIDVPSMIARKDKIVKQMSGGITGLFQANKVTSLYGTGKLLAGRKVQYVALDGKEEVLEAENVILASGSIPVNIPVAPADGDVIVDSTGALEFQAVPERLGVIGAGVIGLELGSVWGRLGSKVVCLEAMDSFLAMMDQQIATEAKKILVKQGLDIRLSCRVTGTEVVEAKGKKEVIVTYTDKDGNEAKETFDKLIVCVGRRPFTDGLLSEDSGVKLDERGSIYVNDLCSTSAPGVWAVGDVVRGPMLAHKGSEEGVMVAERIAGQKTVMNYDIIPNVIYTHPEIASVGKTEEQLKADGEAYEVGTFPFLAIGRAVAADCAEGMVKMIAHADTDRVLGCHIVGPNAADLVQQVAIAMEFGATSEDIGMTVFGHPTFSEAVKEAALAVHGHAIHMPNRKKRK

SEQ ID NO: 67137 - protein, 343 aa, Bacillus halodurans C-125
MKALVKTQHGTGHFAVQEKPEPTPGKHQVKIKVKYTGVCGSDIHTYEGHYPVAAPVTLGHEFSGEIVELGEGVTGFNVGDRVTSETTYSICGKCSYCTSGDYNLCSHRKGLGNQQDGSFAKYVIARQESLHHLPAGVDDRSAAMTEPLACTHHAIAKTSINKGDLVVVTGPGPIGLLAAQVAKSHGGTVIITGLSNDQVRLKKAKEVGIDYAIDTQEVDIKELVSELTDGYGADVVLECSGAVPAAKQGIDLLRKKGQYAQVGLFAQPEIQFNFEKIIQKEISVVGSRSQKPADWEPALSLLNEKKVNAKTLVTHEYTISEWDKAYHAIKSGEAIKVLLTPID

SEQ ID NO: 67138 - protein, 301 aa, Sulfitobacter sp. EE-36
MRDFDIICIGEPLVEFNQIKGTQWHQGFGGDVSNVAIGAARLGARSAIATRLGDDGFGQELRNLWSREGVDASCVATDASAPTGLYFVRHGSDGHRFEYRRAGSAASRMTADSLPVEAIERARFTHLSGITLAISASARDAGLDAMRIARAAGRQVSFDPNLRLALWPLEQARSVIIQALGLADIALPGLDDARQITGLDTPEDIVRAFHKMGPDIVALTLGEDGALLGHAGTITHIPGVRVTALDATGAGDCFDGAFLTRLSKGDTPEAACRYAVAASALSVQGYGAVAPLPTVADMAAG

SEQ ID NO: 67139 - protein, 385 aa, Nocardia farcinica IFM 10152
MSQREWIEKDYYKELGVSSTASQDEIKKAYRKLARDLHPDANPGDSKAEERFKAVSEAHAVLSDPAKRKEYDETRRLFAGGGYPRGGFGPGGAGGFSQGFDIGDIFGGTAAGDGGLGDILGGLFNRGGTRTTSRPRRGADVETETTLGFREAAQGVTVPLRMTSPSPCTTCHGSGAKPGTSPRVCPICNGTGVVSRNQGAFGFSEPCDGCRGTGSIIDDPCVDCHGSGIQNRTRTITVRIPPGVSDGQRIRLAGQGEAGLRGAPSGDLYVTVHVSQDKVFGRNGDDLTLVLPVSYAELVLGTTVSVPTLDGRVGVKVPPGTADGRTLRVRGRGVPKRGGGAGDLLVTVKVAVPQKLDDDALEALERYREAEKASGFDPRAGWAGA

SEQ ID NO: 67140 - protein, 274 aa, Mycobacterium sp. MCS
MGRPPLNKDTRLCISLAGRPSNIGTRFHNHLYEVLGLDFLYKAFTTTDIGAAIGGVRALGIRGCSVSMPFKQDVLDLVDEVEPSARIINAVNTIVNDDGHLTASNTDYLAVQRLIDQYGLDSGCSVMVQGSGGMASAVGAAFRDRGFATGTVVARNETTGRALAERLGYDYAAQVASRSAEVIVNVTPIGMAGGPEERQQAFDADTIAQAHTVFDVVATPAETPLITAARQAGVAVITGAEVVALQAAEQFERYTGVRPTPEQVAEASAISRRD

SEQ ID NO: 67141 - protein, 187 aa, Magnaporthe grisea 70-15
MKVFTNKDTFNYSWEEVSTANWRKYCPWNDKSTHVIAVDTISRSVDSQTGILRTERLITCRQNAPDWVCKVLGASNGESLMYEVSYVDAANKKVTMVSQNMTWSNLINVQETVVYSPLNDKQTQFVQDAKITALCGGWQKIRNSIEDAIVTRFRENAAKGREGFESVLAMSRRVFAEERARQVVMAQ

SEQ ID NO: 67142 - protein, 355 aa, Triticum aestivum
  misc_feature (211)..(211): Xaa can be any naturally occurring amino acid
MASYDKQFKVLEVPPIVQELVGAGVQEPPSQYVLPEQDRPAAAVSEMPEPIPIIDLSRLSAGSAEEFDKLRSALENWDLFLAVGHGMEPSFLAEAMKATREFFNLPLEEKQKYSNIVDGEKLGMDGYGNDMVVKENQVLDWNDRLNLLVEPEALRTYRLWPTQPPSFRDILSEYTVRCKAAANLVFRNMAKILNLQEEHLVNMIGGELHHXAIFNYYPQCPRPDHVLGLKAHTDGSIITVNFADAEGLQLQRNGVWYNVPIVPNALIMNVGDIMEILSNGFFKSLVHRVVTNAEKERLSLVLVYTLELETELEPVSDLVDDKRPARYMKIKLHDYMEKYHDTYATGTLAIDGVKI

SEQ ID NO: 67143 - protein, 204 aa, Ostreococcus tauri
MSSDEAPYDHLVKILLVGDSGVGKSSIVTRFVSDSFEELSPTVGVDFKLKRLDVDGKRLKLTVWDTAGQERFRTLTSSYYRGAHGVVFVYDVTSAASFAALRETWLKEVDMYGTIESSVKIVIGNKIDKDSERAVTREEGVAFAKENGCLFLECSAKTKVRVAEAFDELVKGILETPGLLVDSNDGEDRVKLGAYADHAGSGCC

SEQ ID NO: 67144 - protein, 337 aa, Burkholderia vietnamiensis G4
MSIARRTTLSKFLIEQQRETNNLPADLRLLIEVVARACKAISYNVSKGALGDALGTAGSENVQGEVQKKLDILSNEILLDANEWGGNLAAMASEEMETFFPIPANYPRGEYLLVFDPLDGSSNIDVNVSIGTIFSVLRCPHGKQATEESFLQPGTEQVAAGYAVYGPQSVFVLTTGNGVNCFTLDREVGSWVLTQSNMQIPADTREYAINASNARHWYEPVQRYVSELNAGKEGPRGDNFNMRWIASMVADVHRILNRGGIFMYPADKRTPDRPGKLRLMYEANPMSFIVEQAGGAATTGTQRIMEVQPTGLHQRVPVFLGSKNEVERVTAYHNEGK

SEQ ID NO: 67145 - protein, 102 aa, Triticum aestivum
  misc_feature (59)..(59): Xaa can be any naturally occurring amino acid
  misc_feature (92)..(92): Xaa can be any naturally occurring amino acid
NAVSAYCATWDASKPLSWRMKYGWTAFCGPAGPTGQAACGQCLLVTNTATGASITVRIXWTKCSNGGLGPGLRHGFNPSDTNGQGFQAGTSXQLPFLNCGDN

SEQ ID NO: 67146 - protein, 447 aa, Treponema denticola ATCC 35405
MKIKENEKLGLGSCVTILVGGCIGSAIFSLSGMTMYYAGPAALITWFVAALILGLYGIQVAELSIRYPKSGGVFVFPAKAMGKNEREGKVWGFISAWGYVISNIIAVAFSAIYVAVYLGVGFQALAGFRIPLAIISIVICTALNLIKVTSAGKYNNVLVALLVITMLTFVSIAMFAGRWNPQNMVPFFTQGAKGVAGFIQAIPNAMVGYGSVVAIAFMVGEVENPNRTVPKSLAISLILVVLLYQLMILGTMGNITTEFLIKNPGMRFIPMFAAAFTSLNMFPWLSKLISISALLALLTTMLVVGFLNARAVCSMANAKMLPAFFGKVNKNGVPSTACLTLSACTIVLSCFPSITELLVNLGSISAAITIVIVCFSLIASRKKLPHVEGNYAAPGGNIVSILTIILILVCYIPAIFNGSVYMWLFTFILYGIGGIIMFIMMKKNKAD

SEQ ID NO: 67147 - protein, 338 aa, Glycine max
MGKVKIGINGFGRIGRLVARVALQRDDVELVAVNDPFITTDYMTYMFKYDSVHGHWKHHDVTVKDEKTLLFGDKPVTVFGHRNPEEIPWGSTGADIIVESTGVFTDKDKAAAHLKGGAKKVIISAPSKDAPMFVVGVNEHEYKPELDIISNASCTTNCLAPLAKVINDRFGIVEGLMTTVHSITATQKTVDGPSAKDWRGGRAASFNIIPSSTGAAKAVGKVLPALNGKLTGMAFRVPTVDVSVVDLTVRLEKEASYDEIKNAIKEESEGKLKGILGYTEDDVVSTDFVGDSRSSIFDAKAGIALNKNFVKLVSWYDNEWGYSSRVIDLLVFVAKKSF

SEQ ID NO: 67148 - protein, 348 aa, Treponema denticola ATCC 35405
MSIKIRTAAVTGPHKVEILELNTPDLRSGEVLVKVHAVALCTLEQRIFRGEIPMPLPCTGGHEVSGEVVALGDGVNTKKWSAGDRVAVRLLYNCGECHYCHSGHNNLCERAQKKPVRENLLVGPGGLCDYIIVNTSALFPISDELSYEEACLTEPLACCVHSIERANLQLGEDVVVIGGGIMGQYHIMLAKCRGCRVILSEVDPERCKLGKQLGADIVFNPLEHDPVTFIQSLTNGRGADAVFNTTPIPGVVPQAIAMTGKCGRMIQYSSMHPDSPTPVSPQMLHGSEIVLTGAISPDERNFYTANRLLSTGIINCKPLIAKKFPFEEAQKAFEAAIVPGTFRMIITD

SEQ ID NO: 67149 - protein, 718 aa, Geobacillus kaustophilus HTA426
MLHISRTFAAYLDEMDQIVVLAPKSLGFDGMAPFTLVAPSGEEIPLSVQHVEDVGETVKYVCRFASAFEFGATYWVRSCRGEETDVQIGAVVRTPAFDDRFFYDGPLGAEYLKEQTVFRVWAPTATAVSVKLVHPHLDEIRCVPLVRGERGVWSAVVPGDWERARYTYIACINRVWREAVDPYATAVSVNGEFGVVIDWEKTKLAPPSLPLPPLCSPTDAIIYELSIRDFTSHPDSGAVHKGKYLGLAETNTSGPNGTATGLSYVKELGVTHVQLMPFMDFAGVDERDPQAAYNWGYNPLHLYAPEGSYATDPADPYARIVELKQAIHTLHENGLRVVMDAVYNHVYDREQSPLEKLVPGYYFRYDAYGQPANGTGVGNDIASERRMARRWIVDSVVFWAKEYGIDGFRFDLMGVHDIETMKAVRDALDAIDPSILVYGEGWDLPTPLPPEQKATMANAKQLPRFAYFNDRFRDAVKGSTFHLPDRGFALGNPGGREQVKLAIAGSLRALGGLFCHPRQSINYVECHDNHTFWDKMEAANHDEPEWLRRKRQKLATAIVLLAQGIPFLHSGQEFYRTKGGDGNSYRSPDAVNQLDWERKSRYEDDVRYVQGLIALRRAHGAFRLATEAEVLRHFTFLEPLPPSVIAYRLHDAAVYGPWEDIIVVHHNEEKETAIALPDEREWAVVCDGQRCGTTPFGQARGMLRLDGIGTWVLVHPAG

SEQ ID NO: 67150 - protein, 474 aa, Oryza sativa (japonica cultivar-group)
MDALLIALFLLLLIALMETARVRRSGTQRRAGNVPPPPPEPAGLPLVGHLHLFRKPLHRTLARLAARHGGAVFGLRLGSRRVAVVSSAPAAEECLGAHDVAFADRPRLPSGRILSYDWSTMGTASYGPYWRNVRRVAVTEILSARRVQHFADVHVREARRHGAPPSPRGALCSDDDGKVSKEARWFREMVEETMALSGASTVWDFLPAALRWVDVGGVGRRLWRLRESRTRFLQGLINDERKEMEQEQGGDRAQPAARRRTMIGVLLSVQRQDPDACPDQLIRSLCISSLEAGTDTSADTIEWAMSLLLNNPNVMRKARDEIDAFIGQPCIIMETLRLYPPAPLLVPHEASTDCSIAGFHITRGTMLLVNTFAIHRDPQVWNEPTSFIPERFENGRSEGKMAIPFGMGRCKCPAENLGMQMVGLALGTMIQCFEWERVGEELVDMTEGSGLTMPKEVPLQAFYQPRASLMHLLY

SEQ ID NO: 67151 - protein, 108 aa, Zea mays
  misc_feature (47)..(47): Xaa can be any naturally occurring amino acid
  misc_feature (73)..(73): Xaa can be any naturally occurring amino acid
MSGRGKGGKGLGKGGAKRHRKVLRDNIQGITKPAIPKLAKKGRLKRXSGLINKRTPGGLKIFLKTLFRNAVTXTKPPRRRTVTALNFVYLLKRQGRTFYGFGGKVALF

SEQ ID NO: 67152 - protein, 909 aa, Robiginitalea biformata HTCC2501
MKTLTATQKELSVYRYGDKRADGTREMKNLLGGKGANLAEMSRIGIPVPPGFTITTEVCTLYTQEGKEAVLKKIEIEVREAIAAIEESMGTTFGDPQNPLLLSVRSGARVSMPGMMDTVLNLGLGEQTLEGIIKKTGNERFAWDSYRRFIQMYSGVVMGLKPETKQDLDPFEEIIDHLKDKRNIRHDTEFTVQDLKDLVYDFKDIVRKRTGKEFPTDPWEQLWGAVFAVFNSWNGDRAVYYRKMNGYPEHWGTAVNVQAMVYGNMGTDSGTGVCFTRDAATGENKFNGEYLINAQGEDVVAGVRTPQQITRHGSEQWAKLAQVSESDRRENFPSLEELMPDIYKELFEYQQKLETHYLDMQDMEFTIQKGKLWILQTRNGKRTGSAMVKIAMDMLREGSIDRETALLRIDPAKLEELLHPVFDPAAIKEAQVIAQGLPASPGAATGQIVFFADEAGKFKNSILVRVETSPEDLEGMHLARGFVTARGGMTSHAAVVARGMGKCCVSGAGALKIDYANRILRVGDHEYHEGDWISINGTTGNILEGKVATREPELSGEFAELMELSDTFARMEVRANADNPTDARVARNFGARGIGLARTEHMFFEVDRIKAMREMILADTVKGRRQALKELLPMQQKDFEGIFRAMEGLPVTIRLLDPPLHEFVPHQLATQKELAEDLHISLDAVKSKVAELEEFNPMLGHRGCRLGNTYPEITEMQTRAILQAALALKVEGIETRPEIMVPLVGTVEEFVQQKAIIDQTAAEVFRQRKDSVEYSVGTMVEVPRAALLADKIAEHADFFSFGTNDLTQMTFGYSRDDSGKFLPVYLEKGILPADPFEKLDQEGVGLLVRMGTELGRRGRPGIKTGICGEHGGEPTSVEFCHRTGLDYVSCSPFRVPIARVAAAQAVLRD

SEQ ID NO: 67153 - protein, 403 aa, Saccharophagus degradans 2-40
MTIEIKAPTFPESVQDGTVATWHKQPGEACSRDELIVDIETDKVVLEVVAPADGSIAEIIKGEGEIILSGEVIAKFVAGAAGSAPAPAAAEAAPAASEASEDVIAAPAARKLAAEKGIDLALVKGTGKDGRITKEDVAGYKPAAAAAPAPAAAPKAAAPASTGAVAPTGLREEKRVPMTRLRARIAERLLDANNNTAMLTTFNEVNMAPVMNLRKQYKDLFEKTHNGSRLGFMGFFVKAAVEALRRFPAVNASIDGNDMVYHGYQDVGCAVSTDKGLVVPVLRNAENLSIAEIENGIRDFGLRARDGKLGIEEMTGGTFTITNGGVFGSLLSTPILNPPQAAILGMHKIQERPMAVNGEVKVLPMMYLALSYDHRIIDGKEAVQFLVTIKDLLEDPARMLLEV

SEQ ID NO: 67154 - protein, 849 aa, Magnaporthe grisea 70-15
MARQQPAKIKKMFLVRNAAKLIFGSGSQESLIELPQGQLYLVRPLSPKGYSELIFKDAAASIRRTAQDFQYQLVVQRFYEEGEAELLNEGDEEETAEDALSSERDEKTFLLDEALHLRVENREGSSERVICWRDLSGDAGDVYEFVCDSSAATSAARVDDFVRIARQCQYERKYRKPHTTASEADLESFDFDEQLIPPASPIHSPSISRTLEANESMFSTITNTPNKAVKRAPKPEPEPELESEPEVETAPLEAEVTPTKASKGNDREIGPPPAAAPPEATEILAAELGELHFFDFPSGAFVLQASSVTATVSEVGKWEYWLQISSSEKDFVGLPVIADMNPVFNFEFLSFIFNHFSDHGAVSWLVRFKDTETLERFQEGLMRALWEQLNEIKWEKIKEKERDYVTEAFADLAMEDSPEAQLLEEEEEEEEEEEEEDTDDGARSEHYDSDEEDDDVETGTKGGAKNKALAVGYKHDRSFVVRGSQIGVFKHTANNKLEFSTNISKVETPKGGLFSPKKVMLHNEDRNMILQNDADPNKLYRMDLEYGKVVDEWNVHEDIPVVTFAPENKFAQMTHEPTFLGISRNALYRIDPRLSGTKLVDSQLKQYVSKNDFSSVATTEKGHIAVASNKGDIRLFDRLGINAKTHIPALGEPILGLDVSADGRWVLGTCRTYLLLIDALQKDGKNEGKLGFEKSFAADSKPQPRRLALTPEHVAQFAYETGKGVSFTPARFNTGSGQEETQIITATGPYVVEWSLRKVVAGNKAAYKIKRYSDEVMADDFKFGSDKNIIMALPHEVNMVDNKTLKKPTRQSIAGNALLGSGRRSSARIGTRDSGRYKLGKDDVVDSPY

SEQ ID NO: 67155 - protein, 451 aa, Burkholderia mallei ATCC 23344
MNAPTEPTAPDTTVRTDAEWLDAHWMPFTANRQFKRDPRIIVEGKGAYYTAADGRQIFDGLSGLWCCGLGHGRAEISDAVARQVARLDYSPAFQFGHPQSFELANRIKAMTPAGLDYVFFTGSGSEAADTSLKLARAYWRAKGKGTKTRLIGREKGYHGVNFGGISVGGIGPNRKLFGQGIDADFLPHTQLPENRFSRGLPERGAELAERLLDLIALHDASNIAAVIVEPFSGSAGVVVPPKGYLQRLREICTAHDILLIFDEVITGFGRTGAMTGAEAFGVVPDIMNVAKQVTNGAQPLGAVIASKDVYDAFMAAGGPDYMLEFSHGYTYSAHPVACAAGVAALDLLVKEDALGRVRELAPYFEAAVHGLKGVRHVADIRNCGLAAGLTIEHAPGEPARRPYEIAMHCWKNGFYVRYGGDTIQLAPPFIAEKREIDSLIGALNDALLATD

SEQ ID NO: 67156 - protein, 529 aa, Zea mays
MPAPTAEPALPAAFLCVPSPLLSTPLPGAALSASPAPSSHHASFLPRPRGGPRALSVAISVPGPTFSVASRLHQMWGEFARFVRLHGNQIAPLGFASMGLGFGGGGGDNVGGGGGGGGGDVDGVGEVEEAAARAEAPKKVLILMSDTGGGHRASAEAIKAAFTQEFGDDYQVFVTDLWTDHTPWPFNQLPRSYSFLVKHGPLWKMTYYGTAPRVVHQPHFAATSTFIAREVAKGLMKYQPDVIISVHPLMQHVPLRILRSKGLLDKIPFATVITDLSTCHPTWFHKLVTRCYCPSTEVEKRALKAGLKPAQIKVYGLPVRPSFVKPVRPKDELRRELGMDEDLPAVLLMGGGEGMGPIEATAKALGDSLYDENLGEPTGQILVICGRNKKLVNRLQSINWKVPVQVKGFVTKMEECMGACDCIITKAGPGTIAEAMIRGLPIILNDYIAGQEAGNVPYVVENGCGKFSKSPKQIAKIVADWFGPRSDEFRVMSQNALKLARPDAVFKIVHDLHELVREKCFVPQYACAT

SEQ ID NO: 67157 - protein, 318 aa, Xylella fastidiosa Dixon
MYFKAVALINSKSITVLSLSGIITALVTPFDRDGAFDRDAWIRLLDMQLAGGVQGVVIAGSTGEAATLTDAEYDEMLCSAVVRVGGRVPVLAGTGLSGTAKTISQTKRAADNGAGYALVVTPPYIRPNQGGLKAHYLAVADQGGLPVVLYNVPSRTGCDLLPETVADLAEHTNIVGIKEACASHERVQALLALRRPGFAVFSGDDSSAARSMLDGADGLVSVASNVLPSAYRHLCDLARAGERGAIDLWNARLSDFHAFCGLDSNPIPIKALLQRIGIGYGLRLPLLPLSVCHHDIADHLADQVAALEALSSRKIVVA

SEQ ID NO: 67158 - protein, 375 aa, Mesorhizobium sp. BNC1
MRTRAAVAVAAGKPLEIMEVDLDGPREGEVLVEVKATGICHTDDFTLSGADPEGLFPAILGHEGAGVVVDVGPGVTSVKKGDHVIPLYTPECRQCPSCLSRKTNLCTAIRATQGQGLMPDGTSRFSLNGEKVHHYMGCSTFSNFTVLPEIAVAKVNPDAPFDKICYIGCGVTTGIGAVINTAKVEIGSTAIVFGLGGIGLNVIQGLKLAGADMIIGVDLNNDKKEWGERFGMTHFVNPKEVGGDLVPYLVNLTKRGADTIGGADYTFDCTGNVTVMRQALEAAHRGWGESIIIGVAGAGQEISTRPFQLVTGRVWKGTAFGGARGRTDVPKIVDWYMDGKIEIDPMITHILSLDEINKGFDLMHSGESIRSVVVY

SEQ ID NO: 67159 - protein, 454 aa, Saccharophagus degradans 2-40
MADVISYNLFILLQESVMTDKKATLTVDGLDDSIELPVYSGSVGPDVIDVRALTGKGYFTYDPGFVSTASCESKITYIDGDKGVLMHRGYPIETLAEKSDYLETCYLLLHGELPSAAEYEEFKGIITHHTMVHESIARFFRGFHYDSHPMAMMCGIVGALSAFYHDSLDISNPEHRLISAHRLIAKMPTLAAMCYKHSQGQPFMYPDNNLGYAENFLHMMFGTPCDDPKVNPVIARAMDRIFLLHADHEQNASTSTVRLAGSSGANPFACIAAGIATLWGPAHGGANEAVLSMLEEIGDEKNIDAYVAKAKDKNDPFRLMGFGHRVYKNFDPRAKVMKETCDEVLTELGLENDPLLKIAKRLEQIALEDEYFIQKKLYPNVDFYSGIIMKAIGIPTDMFTVIFATGRTVGWIAHWHEMISEGFKIGRPRQLYTGSVLREFEERDSRPKANPAKF

SEQ ID NO: 67160 - protein, 561 aa, Geobacter metallireducens GS-15
MKLRVVVIGANAAGAKAASKAKRMNPHAEVTLIERGNFISYGACGIPYFVSDTVADVKELMSTPVGVVRDAAFFNKVKGVHVITGTEVVSLDRQSRTVQLFEKESAKAFSLEYDRLVLATGSSPSLPPLKNRDLGNILTVKAIEDAELLKERAVTGKRACIVGGGLIGLETAEALRQKGLEVTIVEMRDQLLPGILDPEMASLVERHIRQNGVEVETSCRVAGFDGTGVVNKVLTERGEIPADVVVLAPGVTPNVKLAKEAGLEIGPTGAIAVDSRMGTSDPAIYACGDCCETTHLVTGKKVHVPLGSTANKQGRVAGINASGGEATFAGILGTSILRVFSVNAGKTGLTESEARAQGYDVETVLSPAPDKAHFFPGAKPIALKLVADRATGRILGLQAVGEGAVDKRVDAAAAAITFGATADQLSHLDLAYAPPYSAAMDNLIVAADILKNKLAGHARGISPRKVRQMLDDGDDFILLDVRSPAEHAEVGIEGATLIPLGALREKLESLPKDKEIVTFCKISLRGYEAQKILDAAGFRDVKFLDGGIMTWPYELRRGGGA

SEQ ID NO: 67161 - protein, 216 aa, Sulfitobacter sp. EE-36
MDNAKPLPNYLVQRYHGWKATSYAENEAWYRRLATDGQHPRAMIISCCDSRVHVTSIFGADQGEFFIHRNIANLVPPYQPDGQQHGTSAAVEYAVQSLKVAHVIVLGHSSCGGVQGCLDMCKGNAPALDAKDSFVGRWMDILRPKYDAVSDIEDPKEQARQLEKHAVMTSLENLMTFPFVAQQVKAGELTLHGLWHNIGEGGLECYSADKEMFRPV

SEQ ID NO: 67162 - protein, 490 aa, Bacillus halodurans C-125
MKRDHYRMVINGERVDSDETFETFNPAKGEILATVAKASREHAEKAVQAARHAFDHGKWRKYPVGKRARVLNQIAAIMRERFQELVEIEVLNSGKAISAAQAQINQAIEDFEFYAGAIVGHRGTVNNVPNGFLNYTQKEPVGVCAQIIPWNYPLMMAAWKVAPALAAGCSVVVKPASLTPITAILLNEICHEAGVPEGVVNTVAGAGSVVGDYLVGHEDVNKVAFTGSTPIGKDIMEKASHTLKRVTLELGGKSPNLVFADADMEAAVAGSLFGIYFNTGQSCEARSRLFVHEEIYDEFIEEFITRAKKLQLGDPFDKGTHVGSIISRDQLEIIDSYVRSAEEEGATIALGGKERRVEGFENGHWYEPTVITNVTPDMKAVQEEIFGPVVVVETFQDEREVIKRANDTKFGLGSAIWTKDQGRATRVAHQLEAGIVMVNCPFSAFPGTPFGGYKESGFGRELCVETLDLYMEDKSILSYYGPKPINPFGV

SEQ ID NO: 67163 - protein, 488 aa, Oryza sativa (japonica cultivar-group)
MHDRRAHLRYKDAARYVTARQRMPYEAEAEPLGAIESTPRAVPALPQLVDDEYDDLDDFIVDNDDDVVLGEEQQDEFEEEEEEQEEEEEEEEPPVGQVEILTLREQLKADIRRKNQAQQGATAGRASCSSSVQPLAKDRFGSFFGPSRPSLARRVIEEGCSSIIKEKQNVPSNKSSVSSASKKQPIPSGQQQKPKFVKEEKRKVDALRQNRDYSCLFSDDADTPQATKEQPDNMPVLPMKYDVGDIASTSKLISQTDKVSKDSGLKGPSIQSRVGLVGKEPHPNTKRTIASSAKNGSSLPAMKKIQRVQPSSNGQKMQQTLQSKRPQAMLSQSHGQQSLQSRKPKPSLNGQNFRQKVSAPLAQKHLAPSSRPKPSSAVHNDHGKGKTRRLVKRKSKEDGCDEEEVDYKSIIRGMFNYNPAKFVGRDEDDRDMEANYASIQMEERRSARLARQEDDEELRRIMDEERREKQERKRKKLAQKAVVDASQD

SEQ ID NO: 67164 - protein, 293 aa, Nocardia farcinica IFM 10152
MCLVLLGWRAHPDYRLIVAANRDEFYTRPAEPARWWPEVPGLLAGRDLGAERREPGAPPGTWLGLAAIGPHSRFAAVTNVRNPDDQRADARSRGALLMDFLRGASDRAPEPDFPGPARYLAEVAAAPDDYNGYNVLVSDLSTLWWHSNRSTRPPHELTPGFHGLSNGTFVTSAGPGPDAELVAPQPVWPKVGNGLTELRKVVESDPGAVDRYFDILADRTEAPDDLLPHTGVPLSMERALSARFIANDQHGTRASTVLLVREDGSFDMVERSFTTFGRPLGAVSFTGRMVVAD

SEQ ID NO: 67165 - protein, 295 aa, Oceanobacillus iheyensis HTE831
MNFGKVLTAMVTPFDKHEEIDFQALDHLIDHLINNGSDGLVVAGTTGESPTLTHEERIKLFEYVVKKVNGAVPVIAGTGSNYTKASIELTKEVAKTGVDGVMLVAPYYNKPSQDSMYEHFKVIAESTELPVMLYNVPGRTGVDMDVSTVVRLSQIDNIVSIKDASGNLEKMTNIIRLTDDNFSVYSGEDSLTLPALAIGADGIVSVSSHIIGNDMQEMIQRFEQGQVAEAANIHQRVLPVMQEMFANPSPVPVKTALNLQSVPVGKVRLPLIELTDEQLQNLQSVLSDFEHSKMI

SEQ ID NO: 67166 - protein, 315 aa, Zea mays
MAATSLTAPPSFSGLRRISPKLDAAAVSSHQSFFHRVNSSTRLVSSSSSSHRSPRGVVAMAGSGKFFVGGNWKCNGTKDSIAKLISDLNSATLEADVDVVVSPPFVYIDQVKSSLTDRIDISGQNSWVGKGGAFTGEISVEQLKDLGCKWVILGHSERRHVIGEKDEFIGKKAAYALSEGLGVIACIGEKLEEREAGKTFDVCFAQLKAFADAVPSWDNMVVAYEPVWAIGTGKVASPQQAQEVHVAVRGWLKKNVSEEVASKTRIIYGGSVNGGNSAELAKEEDIDGFLVGGASLKGPEFATIVNSVTSKKVAA

SEQ ID NO: 67167 - protein, 212 aa, Oceanobacillus iheyensis HTE831
MVKTILFDFDGTIANTLPLCFEAFRTVFKEFDQVILTNDEIKEMFGPSETEIIQLNVKHPDKLQAIERFYEVYETLHPSYVKPMEDLHNLLDELDGNGINLGIVTGKAKRSLDISLQQLNIRSNFAVVITGDDVTNPKPHGEGVILAMQELSVTPEEVLFVGDSEADILAGKEANVTTVGVHWSEEVQSADFNTKPDYYLTSIEQFYVELLP

SEQ ID NO: 67168 - protein, 767 aa, Pyrus communis
MAVLLSTLATEIVIPVAAVVGIVFSLVQWFLVSLVKVTPERNAPPSGPNSNKNGCNDYLIEEEEGLNDQNVVVKCAEIQNAISEGSTSFLFTMYQYVGVFMVVFAILIFLFLGSVEGFSTKSQPCTYDAAKTCKPALATAIFSTVAFVLGGITSVLSGFLGMKIATYANARTTLEARKGVGKAFITAFRSGAVMGFLLAANGLLVLFITINLFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHEFTPMLYPLLISSVGIIVCLITTLFATDFFEIKAVKEIEPALKKQLIISTVLMTIGIAIVSWIALPSSFTIFNFGVQKVVKNWQLFLCVAVGLWAGLIIGFVTEYYTSNAYSPVQDVADSCRTGAATNVIFGLALGYKSVIIPIFAIAVSIYVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGTAKPDYATCVKISTDASIKEMIPPGALVILTPLIVGTFFGVETLSGVLAGSLVSGVQIAISASNTGGAWDNAKKYIEAGASEHARTLGPKGSDPHKAAVIGDTIGDPLKDTSGPSLNILIKLMAVESLVFAPFFATHGGLLFKIF

SEQ ID NO: 67169 - protein, 468 aa, Zea mays
GEVLLCVCFVQTKKQRREAGAMRRRDRHHHHRRQPRDERCVSCTTFNILAPIYKRMDNENCRESQYRAYWFSRNEKIIDRLLADHSSIICLQEVWLGNDELVDMYQKRLGDANYMLFKLARTNNRGDGLLTAVHRNYFNVLNYRELLFNDIGDRVAQLLHVESAMPFLQNRSTSCVHQQSLIVNTHLLFPHDHSLSIVRLRQVYKILQYIEAYLEEHKLGPLPIILCGDWNGSKRGQVYKFLRSQGFVSSYDTAHQYSDSEEDAHKWVSHRNHRGNICGVDFIWLLNPDKCRKPLKTSWNEAVFGIIKYFLQVVAFLSEENAFALLKADSLYDHITYSSFYQALCQLGMVHPDRLKSEEIEELWSEADRDGDGVINYKEFQCIWSPNCCSQEEEDTEIDITDESLDTFEANNEAFGFTVKEAVLFPPEVEKGMWPENYSLSDHAPLTVVFSPIRMPCSPRNRGGALAI

SEQ ID NO: 67170 - protein, 691 aa, Mesorhizobium sp. BNC1
MRVEIGLPYPLGATWDGSGVNVAVFSAHAEKIELCLFDAQGRREIRRIPLPEYTHEVWHGYFPDMRPGQVYGLRAYGPYDPANGHRFNPNKLLIDPYAKQLLGDIRWHDACFGYRVGGARQDLAIDRRDSAFVMPKCVVTDTAATWGNDVRPHRPWEETIIYEAHVKGMTALHPDVPEQFRGTFGGLADSRVIDYLVKLGITAIELLPVQAFFDDRYLVEKRLTNYWGYNTIGFFAPTPRYISPRGGLHEFKRMVRKLHEAGIEVILDVVYNHTAEGNELGPTLSFRGLDNASYYILGDDPRYYYDTTGCGNTLNLKHPRVLQMVMDSLRYWVEECHVDGFRFDLATALGRERDNFEPSSVFFDTVRQDPVLSRVKLIAEPWDLGPDGYQLGNFPPGWGEWNGAYRDWVRSFWRGDERVAPDLASGLLGSAAMFDRRGRRPWASVNFITAHDGFTLHDLYAYNERHNEANLEDNRDGHSDNRSWNCGAEGPTDDETIKALRAKMRRNAIATLLLSQGTPMVLMGDEVGRTQNGNNNAYCQDNEINWLAWENRDPDDEAFLQFVRRLIAYRRAHPRLRLKNFLHGNVVAGKYRDVSWLRPTGEPMTDEDWSDPGFKSFGLMLCDERGTCILILINGFHEPLGFSLPRELGAAGWKMIMRTDTGQWPVWEAMRSPHTLELADRSMVVLEGRVR

SEQ ID NO: 67171 - protein, 518 aa, Oryza sativa
  misc_feature (33)..(33): Xaa can be any naturally occurring amino acid
MEEERMEPPPPPPYIHIETNDFLHRRHKRQKEXDIAVCECQYNLLDPDSACGDRCLNVLTSTECTPGYCLCGVYCKNQRFQKSQYAATRLVKTEGRGWGLLADENIMAGQFVMEYCGEVISWKEAKRRSQAYENQGLTDAYIIYLNADESIDATKKGSLARFINHSCQPNCETRKWNVLGEVRVGIFAKQDIPIGTELSYDYNFEWFGGAMVRCLCGAGSCSGFLGVKSRGFQEATYLWEDDDDRFSVENVPLYDSADDEPTSIPKDILIKDEPNTQDGNNNTIQNTGIPIIASSSEFTPMNVEPSIASSNEFTPMNVEPLNVSSNELTPMTIEPLNAIPMGVDFTQNGSIEYGAQCAEDALQNSTRGVANLQNQSVPRDNNHTELVAVKRRPTLRGGKAKRAMRKQLNVVGICDRLASEVAREEILYCEEMKNEAAAEIDSLYDEIRPAIEEHERDSQDSVATSLAEKWIEASCCKYKADFDLYASIIKNLASTPLRSKEDAAPTEQNGLMYLENGP

SEQ ID NO: 67172 - protein, 569 aa, Saccharomyces cerevisiae
MMTKAFFNKLPFEVFRRYVRTGKSIPQRSPRTRKSLLVGGTIASAVVLYNFNDTFHDSVKHTALTTKRIAVVTQATTRCFYHYKRALNKSYENKKEREVALNKCHKMCALITLHALRSNGGIYIKLGQHIGAMTYLLPKEWTDTMIPLQDHCPESTYEEIDELFKEDLGTSIEDMFLEFNKTPIGVASLAQVHVAKLKNSDGKGSSVAVKCQHPSLKEFIPLDVMLTRTVFELLDVFFPDYPLTWLGDELQSSIYVELNFTKEAENAEKTRHYFSKFKKQTALKIPKVIESHKRILIMEYVGGKRLDDLEYIDSHGISRSEVSSCLSHIFNNMIFTPNVGIHCDPHGGNLAIRSVKPAKDNGYHNFEIVLFDHGLYRYPSTRTRRLYAKFWLSLLFDKDQTKMKKYAKGFANITDEQFPLLAAAITGRSIDAALNYDISTSRTQEEMDVMANGILEGTLLSDLMSILSRIPRVVLLILKTNDLTRHLDECLQNPLGPERTFLIMTQYCAKTVYDEKVERINSEYARWSIKWMWENLTNWIVYERRINQLYFYDFVLWWKKFIPKTWLSS

SEQ ID NO: 67173 - protein, 425 aa, Oryza sativa (japonica cultivar-group)
MWDPRRVMTAMSATELVITSRVRLLPPMEPSRRLLLSDYDGAIVSPLPSPPPSSATPFRPGVAVVVGILTSVFSITFLLLLYAKHCKRNAAESSGPYGSGGAFGSSGGGGAGERRNSGVDRAVVESLPVFRFGALRGQKAGLECAVCLGRFEPTEALRLLPKCRHGFHVECVDTWLDAHSTCPLCRSRVDPEDVLLLPEPPKPSTTGPPDPPETKVAAAAAAATAKDKEASLAPAAPAPSPAFRGFFSGRHSTGSVRAPGRVGPASRRSADLVGGDGGAVVGCFEAAKVRKDRVLLMEPAAAVAEPDPEAYDRRFGHRILVSTAGGCEDETAPAAKQRWSEVRPSDLMFVRSEMLVTEAGRYSCSAAVHSGNGRSVISARSLSELAGVSRLPPIRASGEPRAGARRWPGSSWWARGPPALNGPST

SEQ ID NO: 67174 - protein, 1141 aa, Aspergillus nidulans FGSC A4
MTYAATSSTSAVHGDPQASLKLAASRPRPKLHHIFTSSAIPAALAPTYASSYTTTPTSLPPSCTPSNDSSPLGTPFLSAVDSLRDRVTPLPPTSAPSLELGDSIMAVPATISASYPGDTVIPNSIKGTGLMRRISRGAANKLTRRRTSNSHNDKRDRSSGPVIMRRRSDSKTGTQTGRDSALDSSYEEDSNDALDALGGWAGSEASSVPNDNTPTVPRNPAVVAPTVDSAIQRGTILTKVTKKRRKQVRFLLNLDAGKVYWDPSNPAKRFYIDDVKEIRVGADARNYREEHQVSQDAENRWFTIVIADAERSKGRPVKTIHLIAPNERLLKLWTTTLEYISRYRVGLMAGLAASNQNESVLKAHWQREMTRLFPNGMKAGDTETLDFAAVESVCQSLHINCSQNMLRAHFLKADTGKHGKLNFDEFKDFVTRLRERRDVREIFRSHADDHREGLTLEEFLIFLRDVQKEDIDSDRAYWISVFDKLVRKSKSRTQSPTGTSSEDQSSRMSLDAFSSFLASARNGVYASRSPQSRFDRPLNEYFISSSHNTYLLGRQVAGSSSTEAYISALTQGCRCIEIDCWDGADGRPIVSHGRTMTTSVLFADCITVINRYAFFSSEFPLVISLEVHCNPEQQIAMVKIMKETFGEKLILEPLSNSFVLPSPEELKRRILIKVKTCDETENIRQDPITSFHGRKRSSSSPFIRPSMSDGPTLPNLPSLSSPPTIGADCPGPFLVPERRSLTTTSISSATEDSDGGLVSVRKERRRRQKSKITKPLSDLGVYTRGYKWHSFASAESQAFNHVYSFAERSFESICREPSNKALFEKHNSKYLTRVYPSGFRLRSSNFDPLKFWRRGVQMAALNWQTYDIGMQMNQAMFAAGSDRTGYVLKPESLRVVSSEKDTRITERKLVRFSVDVISAQQLPRPQNMSSDGNINPYVEIEMFSADDRGQSFAFGEGGMNASARNGMSGIGFPHRRRTKIEQRNGYSPNFNESFRLSLETKYPDLVFVRWTVWSSLDGRSTGTNGSVQLATFTAKLTSLSQGYRYLPLYDGSGDQYIFSTLFCKISKEEPISVRRLNADELRAERLGILRQIGQTVFKRTSSTEREKQDQSDKGTETPICLEGKEISPALTPTISTTSTAS

SEQ ID NO: 67175 - protein, 265 aa, Glycine max
  misc_feature (237)..(237): Xaa can be any naturally occurring amino acid
MMAQLLHTPFIPSSSSALRRAATIPHRKTTSRLVVRAKIREIFMPALSSTMTEGKIVSWTKSEGDKLSKGDSVVVVESDKADMDVETFYDGYLAAIVVEEGGVAAVGSPIAFLAETEDEIPQAKSKASSSSSSSSAPAPAPAPAPAPAQAPPVESQPEKVAAPVAAAVSAPVIASSHPASEGGKRTVASPYAKKLAKELKVELGRIVGTGPMGRIVAKDVEAFAAAGNVAAAALAPXKSAAPAGMELGSVVPFTTMQSAVSRNML

SEQ ID NO: 67176 - protein, 204 aa, Zea mays
PPESDPAAGARNPTPAAMEMGGMSDAERLFFFEMACKNSEVAYEQNPNDADNLTRWGGALLELSQVRTGPDSLKLLEDAEAKLEEALQIDPNKSDALWCLGNAQTSHGFFTPDNAIANEFFTKATGCFQKAVDVAPELHLEIQRQMVFQAATQASSASNPRQSRKKKDNDFWYDVCGWVILGAGIVAWVGLARASMPPPTPPAR

SEQ ID NO: 67177 - protein, 328 aa, Bacillus halodurans C-125
MGSQQQTMLQAINQTLDDLLATNDDVMLLGEDIGINGGVFRATDGLYEKYGKDRVVDTPLAESGIIGSAIGLAMNGKRPIVEIQFLAFIYPGFEQLISHAARMRYRTRGQYNVPMVIRTPYGAGIRGPELHSESVEAFFAHTPGLKVVAPSNPYDAKGLLTAATSDPDPVIFLEDTKLYRAFKEDVPNTLYEIPLGQAKVVQEGEDVTVIAWGGMVREALQAAKEAEKAHGWSCEIIDLRTIAPIDRETIIESVKKTGRAIIIHEAHKTAGLGGEITALINEEALIYLKAPVKRIAGFDIPVPQFLSENQYLPTIERMFRGIEETVSF

SEQ ID NO: 67178 - protein, 414 aa, Bacillus halodurans C-125
MVEFRLPDVGEGMHEGEIISWFVQEGDHVKQDEPVVEVQTDKMNAELTAPVSGKIKRVYYKVGEVAEVGSLLFTIDENLSTFKSETHERTKRENSTEQTRPISNISLTSQQKAPVRKGLATPYVRQLAREMNINLEDVVGTGPGGRVLEQDLQNDTNLQKVKTVPSGVANVQESIERTGSSAEKRIPLKGIRKAIAEKMIKSVATIPHVTHVDEIEMDALKELREQLKHYSEQKGIKLTFLPFFIKAIVSALKEFEYFNASIDEETNEIVLKKDYHIGIATDTEKGLIVPVIQNADQKSLLELAGEITQLSTQARKGTLNVQQMTGSTFTISNVGPIGGLHATPIINYPEVAILALHKMEPRNVVREWESVIKLMMNMSLSFDHRLVDGATAVRFTNRMKELIENPNLLLMELR

SEQ ID NO: 67179 - protein, 104 aa, Zea mays
  misc_feature (64)..(64): Xaa can be any naturally occurring amino acid
  misc_feature (85)..(85): Xaa can be any naturally occurring amino acid
LCWAGVELGSSKPQIATQAEMAEARVPLAYRDQCGHLIIPLNKCWVTEFYLPWKWDPERHAYEXCQYELVMERMLQMQKIREAQXTTLKAGASFGLIPATAKLA

SEQ ID NO: 67180 - protein, 473 aa, Bacillus halodurans C-125
MVVGEVAVEVDTVVVGGGPGGYTAAIRLGQLGKSVVLIEKNQLGGVCLNRGCIPSKALIQMAEKFDELTHLKEMGVELPGKPASIDLHKWQKWKQEITTKLNTGIHQLCQQNGVTVVTGEAHFLSSHRVGVETGNAFDVYKFEHAIVATGSSPRSLPFAEVDHTYILDSTSALELTEVPRSLSIVGGGYIGMELGLAFAKLGSAVTIVEMSPHILPATAPHISREVLNKAEKLGVTIKSSTSVEHLTVNDGYVELIVQSNGEQETLQSEKALMTVGRSPNTKGLGLEQVGVFFNEDGTLPINEECRTNIDHIFAIGDVTEGPALAHKASKQGIVAAEVIGGLPSAIDSSYIPYVVFTDPQIAGVGLTAKQAQEQGHRVKTARFPFQANGLALVASKPDGFAEVIVDEESHLLLGFHIVGADASNLIGEGVLALELGARVEDVALTVHPHPTFSEGWLGAAEAALGHAIHVVNK

SEQ ID NO: 67181 - protein, 399 aa, Arabidopsis thaliana
MADSQRLSTASGVKDGQPPWKKKKLSNDTTSNPSLPYDVILIILARVSRSYYTNLSLVSKSFRSILTSPELYKTRTLLGKTENFLYVCLRFPDEANPRWFTLYRKPNQTLTDHTTKKKKKKKKKEEKSSVNLLAPISILNSHPVEWSAIISVDHYLYAISADIEKAPYSNVPYLDCRTHTWNEAPRMRLAHTNSEFEGIVYLPGSFESPDSLNCVEVYNTMTQTWKPVPPEKRMFKLENLEKKIYYKSFHLDSRAGKGLSLSYKSKHLTCGLVVLDTVDSYLRSSCMIENIAYFYRKGNFIWRGLDGKILVYGKIEGLEGLPKFSRYSSVQLAEYGGKLVVLWDKYVPASGYKEKMIWCAEISLEKRNGKEIWGNVEWFDAVLTVPKSYKILCATAATL

SEQ ID NO: 67182 - protein, 453 aa, Triticum aestivum
  misc_feature (29)..(29): Xaa can be any naturally occurring amino acid
  misc_feature (337)..(337): Xaa can be any naturally occurring amino acid
  misc_feature (350)..(350): Xaa can be any naturally occurring amino acid
  misc_feature (447)..(447): Xaa can be any naturally occurring amino acid
AAASTFPRPAAEAPTSQHTQDGVRGGGGXAAAGKRQLSEDDLYLILHKYSPATILTALQEVTQHAQRRSIDWRALVAKTATGITSAREYQMLWRYIAYGYDFVENVEDGSPQPLGDESDLECEIEPSPKPSNEAAAEASRFAKILMYGPSREQGSSHRANSDVPLLNTPNEKIPRVPSDKQLAQSHRLTNGTGPVSNSKQASHTGLSPDPFDGNGPHKKTKKPKAWSNKEDADLMDGVHKCGEGNWLNILRKYNFDSTRTYVQLSQRWAVICRRQGTTKLAKVKSVTTEFDIKATQKAFSMALICLWGAWWIATLDQELHNKHSHPAPVLVLRHLSXSEHPLIIPLPVPXPAQGQIPLPRVQPAPAQAAASKVSNTSNKSQNSSKKQNAQANPTNAPSSIQAAAIAAGGRIAPASIATDLLKAAQSSQAVHITPKAKHMRPRGKGSXKTSYKL

SEQ ID NO: 67183 - protein, 166 aa, Brassica napus
MDSQMLVALGLSLVGGLSTSLGALFVVLSETPNMKMLGLLQGFAAGLMLSISFLDLAHNAINSIGFLKGNLWFFGGVIFFACIAKFIPEPTLGPSTDVKRRKKNGDEGGKDMAKKHRRQVLYSGIVTAMGISLHNFPEGMAVFSRINKGMRVGVNLALAIALHNIP

SEQ ID NO: 67184 - protein, 337 aa, Ostreococcus tauri
MSEATTYLERFVDKCDLEWEATRRAAIGRLTRAWCVDVDLAEVPAELQRILQTIGELDQRNARLRDVAQAKVDECASAPSQSSRGARSADVDAVNALKQEIESIHDTMSLVSNEKVRLAQMALDLVKGNATALDAELKTFHKELEDQGINPEEDVDDAYAVAAAHHAHKHQRHYQHHHHHHHRPAPQPQPSGQPVSSIDAGDLVAANVGALNQSAGGQEWIVAKVTRYSPSEGAFEIVDADEEAEKHVYRLPQKFVIPLPKTASVRESQNFPAGTSVLAVYPNTTTFYKAKVVQPARRLPNAEYSEFVLEFEDDGDADGQAHRAVPFRHVVLFPRLM

SEQ ID NO: 67185 - protein, 207 aa, Mesorhizobium sp. BNC1
MKSSNGPLRIGIGGPVGSGKTTLCEVLLKSMRDRYSMAVVTNDIYTKEDALILARLQAISEDRIVGVETGGCPHTAIREDASLNLAAIAHLNRRFPDLDIILIESGGDNLAATFSPDLADLTLYVISVAQGEKIPRKGGPAITRSDLLIINKTDLAPYVGANLDVMRSDTEKVREGRPYVMTDLSRRQGAEEVVAFIEKMGGLALAA

SEQ ID NO: 67186 - protein, 316 aa, Burkholderia mallei ATCC 23344
MCCRIIGIYPDVCRTQNAIHLAMDARRRATHVMDAFDFRRQISSTSAESARVRPALAVSDVVIGGYAQDIALRLYRRPDKSSLPVVLYFHGGGFVRGSLDDAERAARHLAEHVPALVVSVDYSLAPRHPFPAAPEDAYCAARWAEARARAFGGNPRKIGVAGHDAGGQLANCLAFIARDRGEIRIAAQALIGPMLDPSLTRLADATRLASSDTSAQECAACYRAYLPQPSQRMHPYAAPLESVRLAGLPPTLVATAQNDVLHVEAEKYASCLIDAGVPTQVVRYRDVSHAALADHASALEEVARFFQFRFSAGAPG

SEQ ID NO: 67187 - protein, 215 aa, Saccharomyces cerevisiae
MSRSGKSLTKYKIVFLGEQGVGKTSLITRFMYDTFDDHYQATIGIDFLSKTMYLDDKTIRLQLWDTAGQERFRSLIPSYIRDSRVAIIVYDITKRKSFEYIDKWIEDVKNERGDENVILCIVGNKSDLSDERQISTEEGEKKAKLLGAKIFMETSTKAGYNVKALFKKIAKSLPEFQNSESTPLDSENANSANQNKPGVIDISTAEEQEQSACQC

SEQ ID NO: 67188 - protein, 259 aa, Zea mays
MEEDYVFLLFPLSLKPNISLLLCWIKNQVDTLLDSVKWDSKGLAVAIAQNVDTGAILMQGFANKEALAKTISTRKATFFSRSRSSLWTKGETSMNFINVHDIFLDCDHDSIIYLGKPDGPTCHTGAETCYYTSVYDALQSSKPNEGRQVMTTLYSLEDTISRRHEEKVTDGGGKPSWTKKLLLDNQLLCSKIREEAGELIQTLLENEDQSRAASEMADLLYHAMVLLRVKDVKMEQVLEVLRKRFSQSGIEEKASRNKS

SEQ ID NO: 67189 - protein, 512 aa, Pseudomonas fluorescens
MNAHSDSIDIAIIGSGFAGLCMAIKLKEAGFTDLFVAEQADTLGGTWRDNHYPGCACDVQSHVYSFSFAPNPDWTRQFAPQAEIRAYLEDCAVRFGLAPYLRFGMGLKRAVFDEQLQRWQLSFSDGRHVSARVLVSGMGALARPALPEIPGLETFKGKRFHSQQWDHAYALKGKRVAVIGTGASAIQFVPQIAPQVAHLDLFQRTPPWIMPKPDRGISAFERWLFRHLPVTQRLVRGAFYWALEGRVLGFALHPQLMKMVQKVALRHLRKQVPRPSLRKALTPDYTIGCKRVLISNDYYPALSRSNVEVVTDKILRIEADGVITADGIKHPADCLIFGTGFQATDPLPRDCIIGRDGVDLMDTWRDGAHAYKGTTVPGYPNLFLIIGPNTGLGHNSMILMIEAQVTYILDALRQMQRHRIATVDVKPMVEQAYNRQLQDQLKRTIWNTGGCQSWYLDPRTGKNTTLWPASTWRFKRVTRQFALKDYAVDLLPLTAPPRPATAPHSTAEGSLS

SEQ ID NO: 67190 - protein, 589 aa, Pseudomonas chlororaphis
YLDNNIKLLLNRKVVEIDRVKRRVIAEDGSEAEYDRLLIATGSTPFILPIPGNTLDGVIGYRDIADTQAMINTAKTHKHAVVIGGGLLGLEAANGLKLRGMDVTVVHLGEWLLERQLDKTSGQLLQTALENRGLKFRLSEQTQALHDAGNGRVGSVQFKNGDIIPADLVVMAAGIRPNTELAEKSGIPCNRGILVNDTMQTYDPRIYAIGECASHRGTAYGLVAPLFEQAKVCANHLAQLGFATYKGSVTSTKLKVTGIDLFSAGDFMGGEGTETITLSDPIGGVYKKLVIKDDVLVGACLYGDTADGGWYFRQIRENHAISEIRDHLMFGENALGDVGHQGQDKAMSMADSAEVCGCNGVCKGTIVKAIQEHGLFSVDDVKKHTKAASSCGSCAGLVEQILINTVGGAADVKPKSEKAICGCSDLNHGQIRQAIRDQHLLTIAGTMSYLNWRTPNGCATCRPALNYYLISTWPGEAQDDPQSRLINERAHANIQKDGTYSVVPRMWGGVTNPAELRRIADVADKYNVPMVKVTGGQRIDLLGIKKQDLPGVWKDLDMPSGHAYGKSIRTVKTCVGSEFCRFGTQNSTQ

SEQ ID NO: 67191 - protein, 340 aa, Candidatus Kuenenia stuttgartiensis
MEKPADKSEKKAPASQFEKTWVSTFPRVCEGCSQLTNKQFFLINPVLKITTIGTFIKNANAKFVLSKIIVEDFYEGEIYLLLSLKLAITIGNILLLLEDEAIKENANKENFDADCADGFKEFSNQVCGILDNDLRLKLPKPIHLKLLSVEPINKENMTTVLKDDILNEECLFLSTSLRIMGFDDDQFIICVPKLIGEEFFGEIIEEENKEYRGTILAVDDSNTDLRIIRKLLGNDYKVLVTDNPGHALSTLGKTNIDLVLMDIYMPGVDGITLCERIKRNAMVEDVPIIICSAHPTQENVIRAVRAGAADFIVKPVTRQKLMEKINKHMLNKSLKIPANR

SEQ ID NO: 67192 - protein, 354 aa, Oryza sativa (japonica cultivar-group)
MGEVWSLFPFLVMCGGACARLPVAEEGGGATPTFDALPVSCVQEEKVKEEAAAEKGKEAAVAEEKEAAAAGEEKKEDAPPAAATAGGGGDAGLHALRRVRSQGVEDVVADSKAHKVIVKGKKAAADPMKVVHRVQKKTGRKVELLSPMPPPVEEKKEEEKKEEPEPPKPEEKEPTVIAVVLKVHMHCEACAQVIRKKILKMKGVQSAEPDMKASQVTVKGVFEESKLTDYVHKRIGKNAAVVKSEPAPPPENAGDANAKDDKKAAEGGEEKDESKEEKKEGDDEKEKEKEKDDSNAAEVEEKDKEKDPSALAAANLYMHYPRFSNPGGYGVPGYAYPYAPQLFSDENPNACVVM

SEQ ID NO: 67193 - protein, 1003 aa, Geobacter metallireducens GS-15
MHSSELNARIVSRGKEFFTSIAGEKPSLFDKGAWMGKAMDWSMRNDQFKVQLFRFVDVFPSLTTSRLLTEHIREYFGDEEAMPPFMATGAKVAGMLGSFGGAVLNRVLTSNVEDMARQFIVGETTKEAVKNLEKLRKDGFAAVVDVLGEATLSEEEAEAYTNTYLELLETLKKEQGTWKGLPGTGGDPDLDWGHAPRVNIAVKPTALYCLANPQDFEGSVVAILNRMRRIFRKVMALNGFLCIDMESYRFKDMTLEVFRRLRLEHPGYPHLGIALQAYQKDTDRDLDGLLAWAKEQGVPISIRLVKGAYWDYETVRARQNGWEVPVWTIKAETDAAFERQSRKILENHAVCHFACGSHNIRTISAVMELARELNVPPDRYEFQVLYGMAEPVRKGILRVAGRIRLYCPYGSMVPGMGYLVRRLLENTANESFLRKSFAEEARIEQLLEDPAVAAEREREARAARPEKERTGPDGLPPFGNEPMVDFTRPDHRAAFPDALARVRTQRGKTYPLFINGKEVLTAELMPTVNPNNPSEVLGQICQAGTKEAGDAVAAAKAAFPAWRDTDPRTRADYLLKAALIARTRIFDLSAWQILEIGKQWDQAYADVTEAIDFLEYYAREMMRLGEPQRLGHAPGELNHYCYEPRGVAAVIAPWNFPLAISTGMAAAAIVTGNCVVYKPSGLTPIVGWHLAELFREARLPDGVFNYVPGRSSVMGDYLVDHPDVSLIAFTGSLETGLRINERAARVQPGQANVKRVICEMGGKNAIIIDDDADLDEAVPQVLSSAFGFQGQKCSACSRVIVLDAIHDRFVARLVAMARAISVGPPEDPAHSMGAVADDNAMKRIREYIEIGKTEGQLLHEGPVPAGTGYYVPMTIIGGIRPEHCIAREEIFGPVLAVMRAKDFDEAIQWANAPRFALTGGVFSRSPEHLAKARREFRVGNLYLNRGITGALVERQPFGGSRMSGGGTKAGGPDYLLHFMDPRTVTENTMRRGFAPSDEESGRL

SEQ ID NO: 67194 - protein, 496 aa, Nicotiana attenuata
MSTLMAKMMSGSTPTNPGSTGTSSPSLTPPPASLPVRTIPGGYGWPLLGPISDRLDYNWFQGPNTFFTKRIEKHKSTVFRTNVPPCFPFFLGVNPNVVAVLDVKSFSHLFDMEIVEKANVLVGDFMPSVKYTGDMRVCAYLDTSEPKHTQIKNFSLDILKRSSKTWVPTLVNELNSMFETFESDISKSNSASLLPTMQKFLFNFFSLSLLGANPSASPEIANSGYVMLDTWLAIQLAPTVSIGLLQPLEEIFVHSFNYPFFLVKGSYEKLIQFVKNEAKEVLNRGKSEFGLTEQEAIHNLLFILGFNAFGGFSIFLPTLLGNLGDEKNAELQEKLRNEVREKVGLKTENLSFESVKEMELVQSFVYETLRLSPPVPSQYARARKDFKLSSHDSVYEIKKGELLCGYQPLVMRDPKVFDDPEKFVLERFTKEKGKELLNYLFWSNGPQTGRPTESNKQCAAKDVVTLTASLIVAYIFQRYDSVSFSSGSLTSVKKAS

SEQ ID NO: 67195 - protein, 353 aa, Petroselinum crispum
MEEIVSLIYNGCRLARDLEVNLPNLANRPEILWNNCDEIVRIFTDTRDRINAQFGGGNIQSENVGGAMQQWLQLVQQQEGGSEGAVMAPSETERWTAGGRGDQLQPLDAAGSAARGATFQRMRRRKDDADKRSVRVPAPQMGNTEIPPEDGFTWRKYGQKEILGSRFPRGYYRCTHQKLYQCPAKKQVQRLDDDPFTFEVIYRGEHTCTGSSTAPSMSALPENTEASRVMFQQAAATMSSTQLLHSSSTTTSLPGSHWLSIRTQAADVDTTNTNNPFVNMHMFSNITGRVDSSSGNVAGPSTARDSGDQYYEPLAEFVDVMFNSGSSSNSNMDLIFTTALEDQKWDGGENKQD

SEQ ID NO: 67196 - protein, 258 aa, Xylella fastidiosa Dixon
MTQSRWRLDGRTALITGASTGIGLAVARELLGLGADVLLVARDADLLGRVRDELAEEFPERELHGLAADVADDVDRRAILDWVEDCSNGLHVLINNAGGNVTRAALEYTEDEWREIFEINLFSAFELCRYTQPLLACHASTAIVNIGSVSGLTHVRSGVPYGMSKAALHQMTRNLAVEWAEDGIRVNAVAPWYIRTRRTSEPLSDVCYYEQVIERTPMRRIGEPEEVAAAVAFLCLPASSYVTGECIAVDGGFMRYGF

SEQ ID NO: 67197 - protein, 505 aa, Sulfitobacter sp. EE-36
MNTPKPVVLCILDGWGLRDDPQGNAPLLAKTPHVDRIMQSCPSATLTTFGPDVGLPQGQMGNSEVGHTNIGAGRVVAMDLGQIDLAIEEGAFATHQPLLDFAETLKQTGGTAHVMGLVSDGGVHGHLTHMIAAVRTLRAQGIPVVIHALTDGRDVAPRSALGYFETLQAALPDGASIATVSGRYFAMDRDNRWDRVAKAYEAIVQGKGSAAPTARDAVNDAYGLDENDEFITPTVLEGYTGVQDGDGIFCLNFRADRAREIMSALADPEFDAFDTGARPAWSAVMGMAEYSDAHGAFMTTMYPKPEIVNTLGAWVAQHGLRQFRLAETEKYPHVTFFLNGGEETPTTGEDRYMPKSPNVATYDLQPEMSCAEVTDRFVQAIKDRYDLIVVNYANPDMVGHTGDLDAAIAACEAVDTGLGRVLEALEDVGGAMIVTADHGNCETMIDPETGGAHTAHTLNPVPVAVVGGPDGASLRSGRLADLAPTVLQLMGLDQPAEMTGKSLLE

SEQ ID NO: 67198 - protein, 142 aa, Marinobacter sp. ELB17
MANERTLSIIKPDAVAKNVIGKITSRFENADLHVVAAKMMHLSQDQAEGFYAEHKERPFFNDLVAFMTSGPVVVQALEGEGAILKNRDLMGATNPKEAEAGTIRADFASSIDANAVHGSDSAASAEREIAYFFNDNEICPRG

SEQ ID NO: 67199 - protein, 177 aa, Glycine max
  misc_feature (117)..(117): Xaa can be any naturally occurring amino acid
SQVVSKKQIMIKWMPPDQRWYKLNSDGLKVGDSGGTGYGGLIRDENGRWVVGFVRNLGIASAYVAKSWGVLEGVTLARQRGIDFLEINVDSKVVADGLKGDKQGCLEGWTIVGAIRXMVSGLEQVKISHIYREANQCADLHVNHARTQRGGFDDFGASYRAVDPSCCLWILVEKLLM

SEQ ID NO: 67200 - protein, 549 aa, Zea mays
MYQKKSHFCLCSANMALEPIALLLTVLIAAPLTVLLLFLVAGNKKAARAASPTPPRRRDRLRLPLPPSPRGLPLVGHLHLLGALPHRALMSLARAHGPVLLLRLGRVPTVIVSSAAAAEEVMRARDLTFANRPASAMAERLLYGRDVAFAPYGEYWRQVRRVCVVHLLSARHVGSFRRVREQEAAALAARVARDSAGGAAVGLSDLLTEYANAVVSRAAFGDESARGLLDEFDSGRRQRKVLSDLQKLIGTTPLGELLPWLGWVDAVTGLEGKIRRTFEALDGLLEKVIDDHRRRPRNGEDGSHRDFVDVLLDVHEKDQEHGIQLESNEIKAIILDMFAAGTDTTTTVMEWAMAELVTHPRAMRRAQDEVRAAAAGSTGVNEDHVAQLDYLKAVLKETLRLHAPVPLLVPREPAADTEILGYHVPARTRVLVNAWAIGRDPATWERAEEFVPERFLGGGAAANVGFKGQHFELLPFGAGRRMCPGIAFAEGSAEMALASLLYHFDWEASRGQNREGTPSLDMTEMSGITVHIKSGLPLVSKPWSGSPLN

SEQ ID NO: 67201 - protein, 447 aa, Oenococcus oeni PSU-1
MTKLTKEAIKKSVKDEGVDFLRVMFTDVFGMIKNVEIPVSELDTVLDDNLLFDGSSIDGFVRIEESDMYLYPDLDTFRILPDSMTGEHDGKVAMIVANVYTSDRLPFEGDPRNNLIRVLAEMRKDGFSDFNVGTEPEFFLFKLGEDGKPTMKLNDNGGYFDLAPLDLGEHVRREIVLTLEKMGFEVEAAHHEVAPGQHEVDFRYADAVTAADHIQLFKLIVKTVARKYGYYATFMPKPIAGINGNGMHTNMSLSKDGKNAFDDPTDKLGLSKVAYHFLGGLLDHAQNFVAITNPTVNSFKRLTPGFEAPVYIAWSASNRSPMVRVPASRGASTRLELRMVDPTANPYLAFAVVLNSGLDGVEKETTPEHSVDRNIFLMDANERKKAGIKDLPDTLLTAVDNLSKDEVVISAISKRIADTFVEAKKLEYQSYRASVSKWEIKQYLQTF

SEQ ID NO: 67202 - protein, 224 aa, Zea mays
  misc_feature (14)..(14): Xaa can be any naturally occurring amino acid
  misc_feature (37)..(37): Xaa can be any naturally occurring amino acid
MKKLYQGGKGRRVXPAPADASAARGAAGPPVLALASXALTAEEQEVLAYLLSCGGGGGRHHHGRRRGAHPPEMGCACFGCYKSFWARWDASPNRHLIHRIIDAVEEEGGAGGPRRPPRRRRRGGGAGGGRRGGGDAADEDAAETGPGVDHDNLPACDGGSGMDMDHRCHGEYDGDGDGDEEEEETSSVDGDDASVDSEGGGSAEKSTVGRLVRFIGEKVWGAWN

SEQ ID NO: 67203 - protein, 335 aa, Brucella abortus
MAVRVAINGFGRIAVTILRAIVESGRTDIQVVAINDLGPVETNAHLLRYDSVHGRFPKEVEVAGDTIDVGYGPIKVHAVRNPAELPWKEENVDIALECTGIFTSRDKAALHLEAGAKRVIVSAPADGADLTVVYGVNNDKLTKDHLVISNASCTTNCLAPVAQVLNDTIGIEKGFMTTIHSYTGDQPTLDTMHKDLYRARAAALSMIPTSTGAAKAVGLVLPELKGKLDGVAIRVPTPNVSVVDLTFIAKRETTVEEVNNAISEAANGRLKGILGYTDEKLVSHDFNHDSHSSVFHTDQTKVMEGTMVRILSWYDNEWGFSSRMRDTAVALGKLI

SEQ ID NO: 67204 - protein, 302 aa, Pseudomonas chlororaphis
MPAQGRPAVPRFGLRQARGLPAAQLADRPGNRPGPGPGRGLRPSPFGPGRKRPGAAGPAGRKLMDRQITASTCCYCGVGCGVLIEHDGERILGVSGDPAHPANFGKLCSKGSTLHLTGDLAARALYPELRLGKGLARARSDWDSALDHAASVFAETIAEHGPDSVAFYISGQLLTEDYYAFNKLARALVGTNNIDSNSRLCMSSAVVGYKRSLGADAPPCSYEDLELSDCVMIVGSNMAYAHPILFRRLEEAKSRRPQMKIIVIDPRRTDTCDLADLHLAILPGTDVALFHGILHLLLWEDW

SEQ ID NO: 67205 - protein, 492 aa, Pisum sativum
EMIAGVNPHIIKKIQTFPIKSNLDSQLYGDNTSTITKEHLEPNMGGVSVQVAYEANRLFVLDHHDPLFPYLRKINATDTKAYATRTVLFLQDNGTLKPLAIELSTPHPQGDSFGPVSKVYLPAGEGVEASIWLLAKAFVVVNDSCYHQLVSHWLNTHAVVEPFIIATNRHLSVVHPIHKLLLPHYRDTMNINALARDVLVNAEGIIESTFLWGNYAMEMSAVVYKDWVFTDQGLPNDLIKRGVAVKDPSAPYGLRLLIEDYPYASDGLEIWAAIKSWVEEYVNFYYKSDGAIAQDAELQAFWKELVEVGHGDLKNATWWFKMKTRAELIEACTILIWIASALHAAVNFGQYPYGRYILNRPTKSRRFMPEVGTSEYNDLAKNYEKAYLRTITPKNDTLTDLTIIEVLSRHASDEQYLGERIEGDDWTSDSQPKEAFKRFGRKLAEIEQKLTQRNNDESLRNRYGPVKMPYTLLYPSSEEGLTCRGIPNSISI

SEQ ID NO: 67206 - protein, 115 aa, Salmonella enterica subsp. enterica serovar Typhi str. CT18
MSTTIEKIQRQIAENPILLYMKGSPKLPSCGFSAQAVQALSACGERFAYVDILQNPDIRAELPKYANWPTFPQLWVDGELVGGCDIVIEMYQRGELQQLIKETAAKYKTQEPDAE

SEQ ID NO: 67207 - protein, 447 aa, Bacteroides thetaiotaomicron VPI-5482
MKYQVIIIGGGPAGYTAAEAAGKAGLSVLLIEKNNLGGVCLNEGCIPTKTLLYSAKTYDSARHSSKYAVNVSEVSFDLPKIIARKSKVVRKLVLGVKAKLTSNNVAMVTGEAQIIDKNTVRCGEETYNAENLILCTGSETFIPPITGVETVNYWTHRDALDSKELPASLAIVGGGVIGMEFASFFNSLGVQVTVIEMMDEILGGMDKELSALLRAEYAKRGIKFLLSTKVVALSQTEEGAVVSYENAEGKGSVIAEKLLMSVGRRPVTKGFGLENLNLDKTGRGAIKVNEKMQTSLSGVYVCGDLTGFSLLAHTAVREAEVAVHSILGKEDAMSYRAIPGVVYTNPEIAGVGETEESASAKGITYKVVKLPMAYSGRFVAENEGVNGVCKVLLDEQERIIGAHVLGNPASEIITLAGTAIELGLTAAAWKKVVFPHPTVGEIFREAL

SEQ ID NO: 67208 - protein, 490 aa, Oryza sativa (japonica cultivar-group)
MHQGAAGPGPSGGGGDRLSALPDAVLFRIVSHLKAREAVRTSGLSRRWRHVWASAPRVDVRYPCACDGRAVDQKSFRDFVTILLLRRRPLAPFKALRLSWSHDEDDVSAWIAHAVRRGAEEIDLSARRHHGYPVPDYKHFISPKIKILKLTHLGTTRFTADNTLDLLCSGCTSLEELELKDIKSLWGGIQSDSLKRLSIINCHVTSDGFLVEAPNLISLCCIRPARAVPWFSHMVSLVEATVVLDDSRLSDDYQQPVLEDDNDGSDYDDNFFAPKAEGPDDKRDNEADNDSGDKRNRDGSKSDLDDHDGEYDHEDGSESGDKEVDDLEGGDDRTVTYGEIADESSSYGIPIPSDEYGGNYGNHDYTIFGGDHMLDHLSDVRTLGLLGHQGEDIHRSRGGINPTGGSFACNNLKKVKITCRKDDVMVHMLAKFLQRNGISLQKIFVRRTSSTHNGEEGTGKDSSAKRKAQDEAARRAVKQLRRARNSRSPE

SEQ ID NO: 67209 - protein, 560 aa, Xanthomonas campestris pv. campestris str. 8004
MSQARPWLQSYPAGVAAEIDLEQFSTVAEVFATSVARFADRPAYHSFGKTITYREADQLVDQFAAYLLGELQLKKGDRVALMMPNCLQYPIATFGILRAGLTVVNVNPLYTPRELKHQLIDSGSSVLVVIDNFGTTVQQVIADTQVKQVITTGLGDMLGFPKAALVNFVVKYVKKLVPEYRINGAIRFRDALALGRKHRVPTLQIEPDDIAFLQYTGGTTGVAKGAMLTHRNLVANMQQAHQWLAGTGKLEEGHEVVITALPLYHIFALTANGLVFMKIGGCNHLISNPRDMPGFVKELKKTRFTAFTGVNTLFNGLLNTPGFDQIDFSSLKMTLGGGMAVQRSVAERWKQVTGLTLVEAYGLTETSPAACINPMDLVDYNGSIGLPIPSTDACIKDDDGKVLALGEIGELCIKGPQVMKGYWKKADETAKVMDAEGWLHTGDIARMDERGFVYIVDRKKDMILVSGFNVYPNEIEDVIATMPGVLEVAAVGVPDEKSGEIVKVVIVKKDQALTAEDVKAHCRTNLTGYKQPRVIEFRKELPKTNVGKILRRELRDAAKA

SEQ ID NO: 67210 - protein, 323 aa, Xylella fastidiosa Dixon
MTFQKHVPHTQPAKLATTPSTQGTATTPSLMSEDDDHRTITESQEKRRSWLERLSAAFSGDPHTLDDLLVILRSAEHHGIIATDTLRMMEGAIAIADLTVGDVMVPRSQMVSLPVESDLQTITKQMVESGHSRFPVHGENKDEVLGILLAKDLLRGVSANHTITNVHELLRPVGMIPESKKLNVLLKEFRLSHNHMAIVVDEYGGVAGLVTIEDVLEQIVGDIDDEHDETEDQTKMIAIQADGCYIVDALTPIEDFNERFNAEFPDDDYDTIGGLVTEAIGHLPETGDELTIGRFAFRVAKANARRIHILHVTVLPPNEQNTA

SEQ ID NO: 67211 - protein, 261 aa, Anabaena variabilis ATCC 29413
MIIGLNSFIIINPGQAGVLSILGKARDGALLEGIHLKPPLISAIDVYDLTVQKFEVPAESSTKDLQNLSARFAINFRLDPIQVVDVRRKQGTLENIVSKIIAPQTQEAFKIAAARRTVEEAITKRSELKEDFDNALGDRLDKYGIIVLDTSVVDLTFSPEFARAVEEKQIAEQRAQRAVYVAREAEQEAQAEINRAKGKAEAQRLLAETLKAQGGQLVLQKEAIEAWKTGGAQMPKVLVMGGESQGSVPFIFNLGNTQNLN

SEQ ID NO: 67212 - protein, 713 aa, Sulfitobacter sp. EE-36
MKPADQLAHEQRRRAEVEALLEQTQAELCAAYRKLDDHAQNVSVEISETRAEVENIRGENKRVMSDLCAAREQIELTQRRLWHSVETIHDGFAFFNKDNEMIMANRSYLAVFDGIDAIRPGVSYSTILRVLTDEGIVNIGRRTPEEWRAKMLLRSQQKAPAPIIIKLWNGAYIKIVDQRGKGGDIVSLARDITETVEYQRKLVDARATAEAANSAKSLFLAKMSHEIRTPMNGIVGMTEVLGDTALTQDQRLYVDTIKTSGEALLVIINDVLDFSRIEANRLSIHPAPFDLERVFQEVLLLLQPLAVQKGLDLALDYDLFLPRKLVGDAGRIRQVLTNLVGNAVKFTQNGHILIRATGLPDAGSGNVLIKILIEDTGIGIAPDMIEHIMGEFTQASSDPSPNAEGTGLGLAICQRLVQLMGGEIWVTSEHGIGSCFGFELPLKAQEDSAAPPLKPPPFLRHVLIVERETICRSILQRNLEHIGVRVTSCGTGSEGLAALDGSIDLLLVDDTLPDMDGIEFARAVHVSDPATQVILYSQTPDKIRDSMDDTSVRRIMKNPISVTELLAEVSTMQPVPVGTRPMRVLAAEDNKTNRLVLRKMLQRLNIDLQLATNGQEAVALFETFRPDLVFMDISMPKMNGKDAAAAIRALEDGASSCPIVALTAHAIQDEKERILAAGLDHFLTKPLRKAELVALLNRYCPNAAFPLEGQLVG

SEQ ID NO: 67213 - protein, 401 aa, Oryza sativa
  misc_feature (65)..(65): Xaa can be any naturally occurring amino acid
  misc_feature (222)..(222): Xaa can be any naturally occurring amino acid
MALRRFAVAGRVLLHRVESLPPPRPPLAFLSSESRGHLVRRFSTPSSTPPHFMVQYLVSKCGLSXPAAAAKAAPRFAHLDSASRPDAALAFLRSQGLTRAQVREVVSWKPELLLSDVDATLDPKFRAVRALGLGRADVARLFALYPPALTYGIHTNLLPRVLFWIDFLGSAKLLMKWLAKTWLLRYSVDALLRNLSTLRSLGVQQSRITTTVRLQEFGTRDXATLITQTPARFQKLVGRVEACGVPPSSGMYMWAFFALHNVSEGSFRAKKAAVVGAAGCTEEEFDAMFRRAPCLVFVPAALLRRKVEFLMAEAGCDATHIVTNPVLLTLSLGKRMAPRCRVVEALRSRGVGIGKKANLGSVMRYPEDKFVERYVLRYKEEVPELLELYPPRLCKGSSQTR

SEQ ID NO: 67214 - protein, 120 aa, Glycine max
  misc_feature (108)..(108): Xaa can be any naturally occurring amino acid
  misc_feature (112)..(112): Xaa can be any naturally occurring amino acid
HLKTYLSLLLNGRYTISSRKLAYNPKLSDFFEILATSDDGDGKTILFTLRGMKYAVTVNLLQLKKNAYECATSLKAPHTHDAIKVTQSTADSLITEATICTDTPDADXVRDXLIYNYKPT

SEQ ID NO: 67215 - protein, 801 aa, Coccidioides immitis RS
MTTTGPNNVHLTLQRLHDQAPLAAYPDGFAESTDHLVHSPWDATSSLLLICASTGKLTHAPPGDSTTWSPGCLGQPGTTATISSSNPPDSSASIPLRSFTPNSRPSSEFSSSLLDDSREKQGARRSPSSSPPPPSTPSESTFSVWSDTGDLAEQLASEEDPLHIQLRKSLDQQAFSRTGARSKRSRSRRVHYSEQEEERDVLGDSGISKEAIRVPEPPPRKPSRVETILASIMSPGNRRTAQMHGLVGKPLLYFTSVFVSLGVFLFGYDQGVMSGIITGPFFKDYFNQPTRAEIGTMVAILEVGAFISSLCVGKVGDIIGRRKTILYGSIVFFIGGAFQTFATGIPMMLVGRIVAGLGVGALSTIVPVYQSEISPPHNRGQLACIEFTGNICGYAASVWVDYFCSFINSHYSWRIPLFLQCVMGTLLGVGSLIICESPRWLLDNDHDEEGMVVIANLYGGGDIHNDKARQEYRDIKMDVLIQRQEGERSYADMFRRYYKRVFIAMSAQAFAQLNGINVISYYAPLVFESAGWVGRNAILMTGINAISYLGSTIPPWYLVDRWGRRPILLSGAVAMIISLSLIAYWIYLDIPATPTLTVVFVMIYNAAFGASWGPIPWLYPPEILPLSIRAKGASLSTAANWAFNWLVGELTPVLQEVIQWRLYLMHAFFCATSFVVVYFLYPETSGVRLEDMDVLFGDATTAMPTPVTPAERNALMGPGSPVPSLDIRRGPDGRLPPEYDIPGLNIEPPTPSAKTGRSVEETGSREGIGGWISNMVRRGRQGKKDNDDQGEYRRVGQDEEG

SEQ ID NO: 67216 - protein, 476 aa, Mycobacterium sp. MCS
MKSVPTGLWIGGEEREAKSTFNVLDPSSDEVLVAVGDATAEDAVAALDAACAVQAEWAATPARKRGEILRSVFETLTDRADDIAALMTLEMGKVLAESKGEVTYGAEFFRWFAEEAVRIGGRYTPSPAGTGRIIVTKQPVGPCYAITPWNFPLAMGTRKMGPAFAAGCTMIVKPAQETPLTMLYLAKLMAEAGLPKGVLSVLPTSSPGPVTEALVDDGRLRKLTFTGSTGVGKSLVKQSADKLLRTSMELGGNAPFIVFDDADVDAAVDGAMLAKMRNGGEACTAANRFHVANSVREEFTEKLVKRMSEVTLGNGLDESATLGPLINNKQLQKVTELVSDAVSRGATVAVGGVAPGGPGNFYPATVLADVPADARILKEEVFGPVAPITGFDSEEEGVAAANDTEYGLAAYVYTRSLDRALRVAEAIESGMVGINRGVISDAAAPFGGIKESGFGREGGTEGIEEYLDTKYIALTK

SEQ ID NO: 67217 - protein, 133 aa, Pisum sativum
RPTKSRRFMPEQGSPEYEELAKDYEKAYLSTITPKNETLLNMTVMEVLSTHVSDEQYLGHRIEGDLWTSDSQPIEAYKRFGTKLAEIEKKLIERNNDETLRNRYGPVKMPYTILYPSSEAGLTFRGIPNSISI

SEQ ID NO: 67218 - protein, 554 aa, Mycobacterium sp. MCS
MTADDQLTDISATSAWQALQRHHGEIAGRHLRELFAEDPSRGTELTVSVGDLYIDYSKHRVTRETLRLLVDLARAAGLEKRRDAMLSGVHINTSEDRAVLHTALRLPRDASLTVDGQDVVADVHEVLDRMGDFTDRLRSGEWTGATGERIRTVVNIGIGGSDLGPAMVYESLRHYADAGISARFVSNVDPADLVAKLDGLDPATTLFIVASKTFSTLETLTNATAARRWLTNTLGDAAVARHFVAVSTNQKLVDEFGIDTANMFGFWDWVGGRYSVDSAIGLSVMAAIGRERFAEFLAGFHLVDEHFRTAPLEANAPALLGLIGLWYSNFFGAQSRAVLPYSNDLSRFAAYLQQLTMESNGKSVRADGTPVSTDTGEIFWGEPGTNGQHAFYQLLHQGTRLVPADFIGFSQPTDDLPTADGTGSMHDLLMSNFFAQTQVLAFGKTAEEIAAEDTPADVVPHKVMPGNRPTTSILATKLTPSVVGQLIALYEHQVFTEGVVWGVDSFDQWGVELGKTQAKALLPVITADDSPAEQSDTSTDALVRRYRAERGRSA

SEQ ID NO: 67219 - protein, 393 aa, Chlorokybus atmophyticus
MTMLETKTDPMVISMGPHHPSMHGVLRLIVTLDGENVIDCEPVLGYLHRGMEKIAENRTIVQYLPYVTRWDYLATMFTEAITVNAPERLANIEVPKRASYIRVIMLELSRIASHLLWLGPFMADIGAQTPFFYIFREREMIYDLFEAATGMRMMHNYFRIGGVAADLPYGWVDKCLDFCDYFLPKVDEYERLITNNPIFLKRVKDIGKISKEDAINWGLSGPMLRASGVKWDLRKVDNYECYDELDWSIQWQSDGDCLARYQVRIGEMRESIKIIQQALKAIPGGPYENLEARRLSKGRKSEWNNFEYQFIGKKPSPTFKMPKQEHYVRVEAPKGELGVFLIGDDNVFPWRWKIRAPGFINVQILPQLVQGMKLADIMTILGSIDIIMGEVDR

SEQ ID NO: 67220 - protein, 175 aa, Chlorokybus atmophyticus
MFNFINNIQNYSKEAVQAAQYIGQGFMVTFDHMSRRPVTIQYPYEKLIPSERFRGRIHFEFDKCIACEVCVRVCPINLPVVNWEFQKEKKKKQLQTYSIDFGVCIFCGNCVEYCPTNCLSMTEEYELSVYDRHELNFDNFALGRLPSMVENDAMVKNMKGLGYLPKGVIESHASS

SEQ ID NO: 67221 - protein, 267 aa, Clostridium difficile 630
MNNVIFAFLITLLAGLSTGIGSCIAFFAKKTNTKFLSISLGFSAGVMIYVSMIEIFPKAQDALTKSMGEKLGSWSTVIAFFIGMAIIAAIDKLIPQEENPHEIKKMENIEEKNIKKNKSLLRTGIFTAMAIAIHNFPEGLATFISALDDVTIAIPIAIAIAIHNIPEGISVSVPVYYATGDKKKAFYYSFLSGMSEPLGAIIGYVLLRNFLNDITLGIVFAIVGGIMVFISLDELLPSAREYGEHHLSIYGLIAGMGVMAISLLLFK

SEQ ID NO: 67222 - protein, 291 aa, Medicago sativa
GENVEKIGEGTYGVVYKARDRVTNETIALKKIRLEQEDEGVPSTAIREISLLKEMQHRNIVRLQDVVHSDKRLYLVFEYLDLDLKKHMDSSPEFIKDPRQVKMFLYQMLCGIAYCHSHRVLHRDLKPQNLLIDRRTNSLKLADFGLARAFGIPVRTFTHEVVTLWYRAPEILLGSRHYSTPVDVWSVGCIFAEMANRRPLSPGDSEIDELFKIFRILGTPNEDTWPGVTSLPDFKSTFPRWPSKDLATVVPNLEPAGLDLLNSMLCLDPTKRITARSAVEHEYFKDIKFVP

SEQ ID NO: 67223 - protein, 335 aa, Chlorokybus atmophyticus
MAVRFLFEALQKAIDEEMEREKRVVLIGEDIGHYGGSYKVTQGLYGKYGKHRVIDTPIAEYSFVGAAVGAAATGLIPVVEGMNMAFILLAYSQISNNMGMLCATSGGHFQVPMVLRGPGGIGKQLGAEHSQRLESYFQSVPGLQIVTCSTPYNAKGLLKSAIRSKNPILFIEHVLLYNLKGEVPDNDYLLPLEKAELVREGSDITVLTYSRQRYNVIQAVKVLVEEGYDPEVIDLISLKPFDMETIGKSIQKTHKVLIVEECMMTGGISNVLQSLIIDNFFDALDAAPLILSSPNVPTPYTGPLEEATVVQTIDIIESIEYGITGKPPKPRTAKK

SEQ ID NO: 67224 - protein, 148 aa, Pisum sativum
VVYKARDRVTNETIALKKIRLEQEDEGVPSTAIREISLLKEMQHRNIVRLQDVVHSEKRLYLVFEYLDLDLKKHMDSSPEFVKDPRQVKMFLYQMLCGIAYCHSHRVLHRDLKPQNLLIDRRTNCVKLADFGLARAFGIPVRTFTHEV

SEQ ID NO: 67225 - protein, 356 aa, Zea mays
MTNQDVVVSEMGIAAGTALPGSSPALLACRGAAAGAMSLRYLDLAAAAARSASCTWVEAMRASSPTRSRAAADVDELTAWMRKHPSALGKFEQIASASQGKKVVMFLDYDGTLAPIVADPDAAYMSDVMRAAVRDVAKHFPTAIVSGRCRDKVRSFVDLSELYYAGSHGMDIEGPSSNPESVLCQPASEFLPVIDEVYKALVEKTKSTPGAKVENNKFCLSVHFRCVDEKRWNALAEQVKAVIKDYPKLKLTQGRKVLEIRPSIMWDKGKALEFLLESLGFASCSDALPVYIGDDRTDEDAFKVLRKRGQGVGILVSKCPKETNASYSLQDPGEVMDFLLRLVEWKRKSTTTRPPV

SEQ ID NO: 67226 - protein, 623 aa, Ashbya gossypii ATCC 10895
MSELVNKMENLSVGDSAQKKSAYVPPHVKRRMKEGGSEPSSRNTENFGNGGRFGGSEHNGFGGGRGSWFGGNARGGGPRSSDRGGSSRFGKWVDGKHVPMKRNEKLEVQLFGTPEDPNFQSSGINFDNYDDIPVDASGEDVPDPITEFTSPPLDELLLENIKLARFTKPTPVQKYSVPIVAKGRDLMACAQTGSGKTGGFLFPVLSQSFSNGPASTPDESGYYMRKAYPTAVVLAPTRELATQIFDEAKKFTYRSWVKPCVVYGGADIRQQIRELERGCDLIVATPGRLNDLLERGKISLCSVKYLVLDEADRMLDMGFEPQIRHIVEGCDMPTVENRQTLMFSATFPTDIQHLAADFLKDYIFLSVGRVGSTSENITQKVLHVEDIDKRSVLLDLLAASDGGLTLVFVETKRMADALTDFLIMQNLSATAIHGDRTQAERERALAFFRTGRANVLVATAVAARGLDIPNVTHVINYDLPSDIDDYVHRIGRTGRAGNTGLATAFFNRGNKNVVKELVDILEEANQEVPSFLSQIAKEMSYGGGGGKSSRGGRGGYSRGNSTRDFRRHGGGGGSEWSSANRASSGWGNATRTGSGWGDSSGFGGSTESWSNASKTVGSNNSWW

SEQ ID NO: 67227 - protein, 263 aa, Oryza sativa (japonica cultivar-group)
MEGRVLRRSVTLADQLAAVGPAGTAAATAAAGSCNLRDLLKLRDEDDLAAGRRAAVTLASAMAAERLTVAPASSAAAAAAAARTLLDIIRDDQLPSSSGGGGEGGDPLVRRAVSLPAPVTATPPPPPPPPETPPRQLPSVSPPTVGEEEEEEQGERVSLMALLEQTERQWSAGSGATVQQHLASPSAAASASVSAAAEDEAEAEAGKGAAGGGCCCVCMARAKGAAFIPCGHTFCRTCARELLAGRGRCPLCNAAILDVLDIF

SEQ ID NO: 67228 - protein, 160 aa, Neorickettsia sennetsu str. Miyayama
MFKFLSQMQLTRFFVGFRTVLWYFFAPKVTIKYPQEKGPISLRFRGEHALRRYKNGEERCIACKLCEVVCPAQAITIEAAPRESDGSRRATKYDIDMTKCIYCGFCQEACPVDAIVEGPNFEFARENREDLLYDKKKLLDNGSKWESALIKMLNRNDTTH

SEQ ID NO: 67229 - protein, 220 aa, Ashbya gossypii ATCC 10895
MSETQQAFVKRYTPLRPSPNSLALNGGPFEIGQSILGGAKTTVAHQASSSQVINVQTGVGFLDHMIHALAKHSGWSLIVECVGDLHIDDHHTTEDCGLALGQALREAIGQVRGVKRFGTGFAPLDEALSRAVVDLSNRPYAVVDLGLRREKIGDLSTEMIPHFLQSFAESARVTLHVDCLRGTNDHHRSESAFKAVAVALGDALTRTGTDDVPSTKGVLM

SEQ ID NO: 67230 - protein, 392 aa, Mesorhizobium sp. BNC1
MLQTVAAFDRIGEENAFAVLARATELAHQGRDIINLGIGQPDFHTPEHIVEAAVKALRDGHHGYTPANGILAAREAVARRTLATTGVEVSPENIMILPGGKPTMFAAILMFGEPGAEILYPDPGFPIYRSMIEFTGAKPVPVPIREENGFAFSAEETLSLITPKTRLLILNSPANPTGGVAPREEIARLVKGLEAHPQVAILSDEIYDVMTYDGEKATSLLTFPEIRDRLIVLNGWSKTWAMTGWRLGWSIWPDRLYGLVRKLAVNCWSCVNAPAQYAGIAAIDGPQDDVEKMMRAFASRRKLVVEGLNGLPGVTCLTPKGAFYAFPNIRGTGWKAKKLAAALLDEAGVALVGGPDFGVLGEGYIRLSYANSEENILRAIGRMGDFLARTGQ

SEQ ID NO: 67231 - protein, 317 aa, Oryza sativa (japonica cultivar-group)
MERQSASSSASCSPSSSAAGTSSSSSACGGKKRPDILNMIRSATCLNSSSTDTGKGRSKQSSNKVTHGFHLVEGKSGHDMEDYHVAEYKYDKSHELGLFAIFDGHLGDSVPSYLKANLFCNILKEPIFWTNPQEAIKNAYRSTNKYILENAKQLGPGGSTAVTAIVVDGKDMWVANVGDSRAVVCERGAANQLTVDHEPHTTNERQRIEKQGGFVTTFPGDVPRVNGQLAVARAFGDQSLKAHLSSEPDVRHVPINSSIEFVILASDGLWKVMKNQEAVDLVKSIKDPQAAAKRLTTEALARKSKDDISCIVIRFRC

SEQ ID NO: 67232 - protein, 147 aa, Lactococcus lactis subsp. lactis Il1403
MNFFNQIFHNQILMTAIVSWALAQLIKIIIELIRTHRINWQLIFATGGMPSSHSSLVVALATATGLRQGFDSSLFAIATVLAFVVLYDAQGIRRQAGNQARIINRMLQNVENAGIKVDKNLKELLGHTPIQVMGGTILGIIVALVMN

SEQ ID NO: 67233 - protein, 261 aa, Arabidopsis thaliana
MAQLAALSGKQADEYLNARPKYPTIWYKVLAGRTSNHKVAWDVGTGNGQAAIGVAEYYQKVVATDINESQLQRAMKHPKVTYYHTPSSMSDDDLVTLLGGENSIDIIIAAQALHYFDLKRFYPIVKRVLRKQGGIIVVWVYNDLIITPKVDSIMKRLVDSTLPYRNPTMNLAFDGYKTIEFPFKNIRMGTQGRPKALDIPHMLSLDGFLGFLKSWQPLVKAKEQGEDLLTSYMIDEFKEAWGDDEQVKDVHYKAFMLAGKL

SEQ ID NO: 67234 - protein, 337 aa, Mycobacterium smegmatis str. MC2 155
MSQDNSVVPVIDIAALHGDDEAAMIAVAAELDAACREIGFFQIRNHGISEDVIEAMYRTADEFFALPDEEKRLVAQPSSDAVRGYSSIGEQAFSYSEDVHQPRDLHEKFDIGPVDVDRDDPYYAPENAGPHFLPNLWPQRPAGMEAAWTTYFHAMNDLARKLMSAFALGLRLPADYFVDTIDRDISMLRAINYPHLNTPPQPGQMRAGAHTDYGSLTIVRQEAAPGGLEVFTKDGDWISVPVVPDALVVNIGDLMAQWTNDLWTSTRHRVRTPGPDASGDTRRMSLVFFHQPNYDAVIETLPTCITADNPRRYDPTTSGDHLTSKFEKTIALASTNG

SEQ ID NO: 67235 - protein, 335 aa, Xanthomonas oryzae pv. oryzae KACC10331
MTAPSKPVLVADIGGTNARFALADVDASVPLLDDTSREFAVVDFTSLGEAARYYLDQIGVQATQGVFAVAGRVDGDEARITNHPWVISRSRTASMLGFSTLHLINDFAAQAMAISLLRPQDVVQVGGASWRPAPIDQPRNYGVIGPGTGLGVGGLIIRHGRCFPLETEGGHVSFPPGTPEEIRILEILSEQFGRVSNERLICGPGLVNIHRALSEIAGVDPGPLQPKDITARAAAGDPRSSRTIDLFCAIFGAIAGDMVLMQGAWDGVFLTGGLVPKVLDSLQHSGFRQRFEHKGRFSAIMSRVPSLAVMHPHAGLLGAAAYAVDAQRQPPGEQR

SEQ ID NO: 67236 - protein, 199 aa, Streptococcus pyogenes M49 591
MAEEQVLNTHNASILLSAANKSHYPQDDLPEIALAGRSNVGKSSFINTILGRKNLARTSSKPGKTQLLNFFNIDDKLRFVDVPGYGYAKVSKSERAKWGKMIEEYLTTRDNLRAVVSLVDLRHAPSKEDIQMYDFLKYYDIPVIVVATKADKIPRGKWNKHESVVKKALNFDKSDTFIVFSSVERIGIDDSWDAILEQV

SEQ ID NO: 67237 - protein, 389 aa, Solibacter usitatus Ellin6076
MKANCWRGKKKMEVEQVPDPKILNSQDAIVKITSTAICGSDLHLYNGFVPSMQDGDIVGHEFMGEVMEVGKDVGKLKVGDRVVVPFPISCGKCFFCEKQMYSLCENSNPNAWLAEKLWGHSPAGLFGYSHLLGGFAGGQAEYARVPFADVGPIRIENGFTDEQVLFLSDIFPTGYMAAEACDIQPGDTIAVWGCGPVGLFAIKSAFLLGAERVIAIDRFPERLKMAREKCGAVTLNYEHVDVLDTLKEMTGGRGPDSCIDSVGMEAHGHGAMYAYDRAKQALMLESDRPIALREAIMACRNGGTVSVPGVYGGLVDKLPMGSVMNRSLVIKTGQTHVQRYLRPLLQRIENGEIDPSFVVTHRLPLDEAPKAYDMFLNKTDDCIKVVLKP

SEQ ID NO: 67238 - protein, 871 aa, Zea mays
MFGNIGKIPIIGDLTGSNKNAHLKGNLVLMRKTVLGFDVTSIAGSLMDGLGEFLGRGVTCQLVSSTVVDPNNGNRGKVGQEASLEQWLLHPPPLLAGEDQFRVTFDWEVEKHGVPGAIIVKNNHASEFFLKTITIDDVPGHGPIVFVANSWVYPQYKYRYNRVFFSNDTYLPSQMPAALKPYRDDELRNLRGDDQQGPYQEHDRVYRYDVYNDLGNPDAKNPRPVLGGSKHHPYPRRRPTGRKPTQTDPNSESRLTLTDGDVYVPRDERFGHIKNSDFYGYTIKAFVDGLVPILEGYLLGIEFNSFKDILQLYEGGIKLPDIPALEEFRKQFPLQMVKDLMPAGGDYVLNLPMPKIIKEDKKAWMSDEEFARETLAGVNPLIIRRLTEFPPKSTLDPSKYGDQTSTITEAHIAGSLEGLTVQQALDSNRLYILDHHDHYMPFLIEVNSLNDNFIYATRTLLFLRGDGTLAPVAIEMSLPELRDGITAAKSTVYTPAPPTAGAEAWVWRLAKAYVNVNDYCWHQGISHWLNTHAVMEPFVIATNRQLSVTHPVHRLLLPHYRDTMNINALARQKLINAGGIFEITVFPRKYAIEISSKVYGSWNFTEQALPDDLIKRGMAVPDPSSPYKVRLLIEDYPYASDGLAVWHAIEQWVTEYLAIYYPNDGVLQADVELQAWWKEAREVGHADLKDEHWWPKMQTVPELVKACTTIIWIASALHAAVNFGQYPYCGYHPNRPSVSRRPMPVPGSDAYKELEKNPEKFFVRSITAQFQAVVGISLLEILSSHSSDEVYLGQRDTKEWTSDAKAQEAFKRFGARLTEIEKRVEAMNKDPRFKNRYSAAQFPYTLLFPNTSDKGDNTGVTAKGIPNSISI

SEQ ID NO: 67239 - protein, 887 aa, Zea mays
MFWHGVADRLTGKNKEAWNEGKIRGTVRLVKKEVLDVGDFNASLLDGVHRILGWDDGVAFQLVSATAADPSNGSRGKVGKAAHLEEAVVSLKSTTDGETVYRVSFEWDGSQGVPGAVLVRNLQHAEFFLKSLTLEGVPGRGTVVFVANSWIYPHNLYSQERVFFANDTYLPSKMPAALVPYRQDELKILRGDDNPGPYKEHDRVYRYDYYNDLGEPDKGEDHARPVLGGSQEHPYPRRCRTGRRPTETDPNSESRLFLLNLNIYVPRDERFGHLKMSDFLGYSLKAIIEAVLPTLGRFVDDTPKEFDSFEDILGLYEPGPEAPNNPLVAEVRKRIPSEFLRSILPDGSHDHPLKMPLPNIIRSDVLKKAPEFKFGWRTDEEFARETLAGVNPVLIKRLTEFPAKSTLDPSQYGDHTSKITEAHIQHNMEGLSVQNALKKNRLFILDHHDHFMPYLNKINELEGNFIYASRTLLFLKDDGTLKPLAVELSLPHPDGQQHGAVSKVYTPAHSGAEGHVWQLAKAYACVNDSAWHQLISHWLNTHAVIEPFVIATNRQLSVVHPVHKLLSPHYRDTLNINALARQTLINADGIFERTVFPAKYALGMSSDVYKSWNFNEQALPADLVKRGVAVPDQSSPYGVRLLIKDYPYAVDGLVIWWAIERWVKEYLDVYYPNDGELQRDVELQAWWKEVREEAHGDLKDRDWWPRMDAVQRLARACTTVIWVASALHAAVNFGQYPYAGYLPNRPTVSRRPMPEPGSDDYKKLEAGQKEADAVFIRTITSQFQTILGISLIEILSKHSSDEVYLGQRDEPERWTSDARALDAFRRFGSRLVEIEKRIRTMNDSPTLKNRKGPVEMPYMLLYPNTSDVTGEKGEGLTAMGIPNSISI

SEQ ID NO: 67240 - protein, 427 aa, Burkholderia mallei ATCC 23344
MNNADLHARKNAATPRGVGVMCDFYAARAENAELWDVEGRRFIDFAAGIAVLNTGHRHPRIVKAIADQLGQFTHTAYQIVPYASYVELAEKINARAPIAQPKKTAFFTTGAEAVENAVKIARAYTGRPGVIAFAGGFHGRTMMGMALTGKVAPYKIGFGPFPGDVFHAPYPNALHGVTSADSIAAVETLFKADIDPKRVAAIIFEPVQGEGGFNPAPAEFVRALRKLCDAHGILLIADEVQTGFARTGKLFAMEHYDVSADLMTIAKSLAGGMPLSGVVGRADVMDAAAPGGLGGTYAGNPLAVAAAHAVLDVIDEEKLAERATVLGDKLKAKLAALRAELPQIVDVRGPGAMVAAEFVDPHTRASDAAFTKRVQTLALERGLLLLICGVDANVIRFLFPLTIEDAVFDEALGILESVLREAVGVPA

SEQ ID NO: 67241 - protein, 887 aa, Zea mays
MFWHGVADRLTGKNKEAWSEGKIRGTVRLVKKEVLDVGDFNASLLDGVHRILGWDDGVAFQLVSATAADPSNGGRGKVGKAAHLEEAVVSLKSTADGETVYRVSFEWDESQGIPGAVLVRNLQHAEFFLKTLTLEGVPGKGTVVFVANSWVYPHKLYSQERIFFANDTYLPSKMPAALVPYRQDELKILRGDDNPGPYQEHDRVYRYDYYNDLGDPDKGEEHARPILGGSQEHPYPRRCRTGRHPTKKDPNSESRLFLLNLNIYVPRDERFGHLKMSDFLGYSLKTIIEAVLPTLGTFVDDTPKEFDSFEDILGLYELGPEAPNNPLIAEIRKKIPSEFLRSILPNGSHDHPLKMPLPNVIKSDVLKKAPEFKFGWRTDEEFARETLAGVNPVIIKRLTEFPAKSTLDPRQYGDHTSKITEAHIRHNMGGLSVQNALRNKRLFILDHHDHFMPYLDEINELEGNFIYASRTLLFLKDDGTLKPLAIELSLPHPDGQQRGAVSKVYTPAHTGVEGHVWQLAKAYACVNDSAWHQLISHWLNTHAVIEPFVIATNRQLSVVHPVHKLLSPHYRDTLNINALARQTLINAGGVFERTVFPAKYALGMSADVYKSWNFNEQALPADLVKRGVAVPDQSSPYGVRLLIKDYPYAVDGLVIWWAIERWVKEYLDIYYPNDGELQRDVELQAWWKEVREEAHGDLKDRDWWPRMDTVQQLARACTTIIWVASALHAAVNFGQYPYAGYLPNRPTASRRPMPEPGSHDYKKLGAGQKEADMVFIRTITSQFQTILGISLIEILSKHSSDEVYLGQRDEPDRWTSDAKALDAFKRFGSRLVQIENRIKTMNDSPDLKNRKGPVEMPYMLLYPNTSDVTGEKAEGLTAMGIPNSISI

SEQ ID NO: 67242 - protein, 489 aa, Burkholderia mallei ATCC 23344
MTTAHETLALKDPALLRERAFVAGEWQAADGGATLEVRNPATGALIGTVPAMGAAETRRAIDAANAAWPAWRKKTAKERAAILRKWHDLMIAHADDLALILTTEQGKPLAEAKGEIGYAASFLEWFAEEGKRVYGDTIPTPAADKRIVVTKEPVGVCAAITPWNFPAAMITRKVGPALAAGCPIVVKPAEATPFSALAMAVLAERAGVPAGMFSVVTGEPKAIGGELTSNPIVRKLSFTGSTPVGRLLMAQCAATVKKVSLELGGNAPFIVFDDADLDAAVEGAIASKYRNSGQTCVCTNRFYVHEKVYDAFAEKLTAAVAKLKVGPGTEAGVVQGPLINGAAVRKVEAHIADALDKGARVTTGGQRHPLGHGFFEPTVLTGVTPDMKVAKEETFGPLAPLFRFSTEEEAIRYANDTEFGLAAYFYSRDIGRVWRVAEALEYGMVGINAGIISNEVAPFGGVKQSGLGREGSHYGIDDYVVIKYMCVAV

SEQ ID NO: 67243 - protein, 481 aa, Ustilago maydis 521
MDFTAAYRHASWRCISFSPGSTFLASVAADDACSVVVRASSTLQVIRTWTLEASISTLEWSPDGAFLLAAHPGQTEDGIVFVVSLDPAKEANDGSDAGSGWVARILSGSEGLSHATWAPPYGPKTLILFSHNHIRASLYNLVDQHISAVEGPKHDKIAWTAKQPNYFASILKGAERDSLYIFSAQKLTHKDLQQFTNKPKSDEMWKVEHGFHLSLNDAHDVLWAPDGSCLAVWEGPLEYKLQIYTPLGALRATFLIEPESDDGAPVTRSGPTAAEVGQTSKRRQKSTELTSGVAGGGSGIRHVEWHPSSLFIAVAGGDEMVRVLESIEWEEVACLDLSRASIRANKDSLSIPSYGPLIAWREPLNWLEETRARGIVALEQASLPISLSASKTESNKVKSPKGIAWIAWSPQGNLLAALNERLPHAVWIFGFAEPGQGRVVGSAPRLLAVLQLNSAARRVCWRPGHVGKLGVAESRGDPNTQ

SEQ ID NO: 67244 - protein, 822 aa, Oryza sativa (japonica cultivar-group)
MRQEIRSATSSMTSVPKPLKFLRPHYGTLKAYFETMPESDLKKYMADILSVLALTMSAEGERESLNYRMIGSEGDIGSWGHEYVRNLAGEIAQEFQKRQDDGMPTDSLKELVEQIVSFHMKHNAEPEAVDLLMEVEKLDLLVKHVDSTNYKRTCLYLTSSSKYLPAPDDMSALKIAFEIYMKFGDFANALRIALLLYDKSLELKPIFTATDDFQLKKQFAFIIARHGLSIEIDDDIAADENEKEALQDIISNIKLSEGYLTLARDIEVMEPKSPEDIYKVHLIDGRGATSSSLDSARQNLAATFVNAFVNAGFGQDKLMTTPSDSSSSGSSGNWLFKNKEHGKASAAASLGMILLWDSDSGLAQLDKYLHSNDIHVVAGALLGIGIVSCGVKSDCDPAFALISEYFSRDESIIRIGAILGLGIAYAGSQKEEVRENLTAFLTDSQVPLEVLVFSAISLGLVFVGSCNEEVAQTIICVLMERSEPELAEPIMRLLPVALGLLYLGKQESVEATAEVSKTFDEKIRNYCDVTLMSLAYAGTGNVLKVQKLLGICSEHLEKGETHQGPAVLGISLIAMAEELGAEMAVRSLERLLQYGEQNIRRAVPLALGLLCISNPKVNVMDTMSRLSHDADAEVSMAAIISLGLIGAGTNNARIAGMLRNLSSYYYKEAGHLFCVRIAQGLVHLGKGLLTLSPYHSDRFLLSPIALAGLVTVLHACLDMKSIILGKYHYMLYILTLAMQPRMLLTVDEDLKPLSVPVRVGQAVDVVGQAGRPKTITGFQTHSTPVLLAAGERAELATEKYLPLTPVLEGFVILRKNPEYHED

SEQ ID NO: 67245 - protein, 308 aa, Neorickettsia sennetsu str. Miyayama
MQGLRSIFKGIFTAIITPFKRNTLDVESLERLIEIQVASAVDGIVIADSTGEGHSLSQSEYCTLVKNVAAVLKNRVPLVVSVPHCSTTQAIDVITHLKNKTIEAFLVAAPYYLRPQQEGIFEHYRQITNKTKANIIMCNIPHRCAINVENATTLKIMDLPAISAIVDLSGDLEYPTILRRENDRVPILTGNDTTYAAHRLNGGDGIVSTLSNLIPKEMVTLERAIYKGNYENIKKLHKLIFPLAKSMSCETNPIPLKYAVSCIYKYVTPNVRLPLTDATTLTRQLIHTLLSNLEREKQEHEILSLIQS

SEQ ID NO: 67246 - protein, 369 aa, Magnetospirillum magnetotacticum MS-1
MAAKKLLILPGDGIGVEVMAQVRRIIDWMARKRKVEFEITEGLLGGAAYDVHGTPYPAETLEAALAADAVLLGAVGGPKWDDLPFDKKPERGLLGIRKDMGLFANLRPATVLDALADASTLKNEVVSGLDIMILRELTGGLYFGQPRGIDTLPDGTRKGYNTLVYTTPEIVRIGRVAFDLARKRNKKLCSVDKANVLECTVLWREEMIKLQKEEYPDVELSHMYVDNAAMQLVRNPKQFDVMVTENMFGDILSDCAAMLTGSLGMLPSASLGEADANGKRKALYEPVHGSAPDIAGKDMANPLATIMSFAMCLRYSFDMVAEADLIETAVKNVLKGGLRTADIMQPGKAKVSTTVMGEAVVRELDKLNS

SEQ ID NO: 67247 - protein, 312 aa, Oryza sativa (japonica cultivar-group)
MTAPNIEMIASSLRNCSLNGGGGGGGGRRRGRRAAAAEGSDDSEGVTVELNSEVALPYHWEQCLDIRTGQVYYINWEDGTRTTIDPRSSSAYSPSPASRSASSSSRRCSRARGRGGGGGAAAAASTTTSSGYTSVSSVGAVTAAAAAWRSHDSSGHGYGYGYGYGSYGYGYGYDGRDGDDEESHNSNNSSSSNSRSANSSRGSAVSSKLSSFSPHRRIGLRRRQRATPSATTAHTSSSPPAAGLASCTSWCRRPPTFLSGLAAVEYRACFGSWQGVMWVPSKVPTAYCWLAGAVARGFDFGREHILMMHHGV

SEQ ID NO: 67248 - protein, 475 aa, Gluconobacter oxydans 621H
MNDQVGTTETLLPQDDSSTSIFDATRFKIIAIGVIAALAGLMSGLDIGVVAGALDLFGKEYHASTVALEWVVSSMMAGAAAGALSAGWMSKALGRKHSLIVGGAIFVIGTIGCAMSWSVASMISFRVVMGIAVGISAFTAPLYLSEIASEDARGAMVSTYQLMVTVGIFIAFLSDTYFSYSGNWRWMFGVAGIPAVLFLIGVLFLPYSPRWLMAQGRQKEAKQILLDLRDDPLEAAKEIRAIREQLETKQEGFKLFLTNSNFRRSVALGVMLQMMQQLAGINIVMYYAPNILAAAHFDAQSQMWCTAIIGLVNMLATFVALSLVDRWGRKPILYAGFTVMALGMGVLAMLLQTGMTTQSSQIAAVFLLMIFCAGFAMSAGPLTWVLCSEIQPLAGRDFGIAISTFTNWMTNLLVGVSFLTLMQTLGTAGTFWLFAGLNALFLLLTILFVPETRGMSLAVIEKRLMQGVKLRKLGR

SEQ ID NO: 67249 - protein, 476 aa, Sulfitobacter sp. EE-36
MAHITNHMPTAELQSLDAAHHMHPFTTNDELAEKGARIITRAKGVYLTDSEGNEILDGMAGLWCVNIGYGRQEMADVAARQMLELNYYNTFFMTSHVPAIALAKEIASLAPGDLNHVFFAGSGSEANDTNIRMVRTYWAMKGKPEKSHIISRKNAYHGSSMGSGSLGGMSYMHEQGGMPIPGIHHINQPDWWVEGGDLTPEAFGLARAQELEAKILELGADNVAAFIGEPIQGAGGVIVPPSTYWPEIQRICDKYNVLIIADEVICGFGRTGSWFGSETMGIKPHIMTIAKGLSSGYQPIGGSIVCDEIAQTIGSGEFNHGYTYSGHPVCSAVALENLRIMQDENILDHVNNVAAPALKEGLAKLAEHPLVGTVNVAGLMASLPLSPRKETRSKFAGDAGTVGYMCRERCFANNLVMRHVGDRMIISPPLVITPEEIKVFMTRATKALDETYTAVKEGGLLKAAEDHAQDAESPLG

SEQ ID NO: 67250 - protein, 589 aa, Gluconobacter oxydans 621H
MGLGPAGRVEELPLPDITERYSAIGPEAEGVRLDEAIARALHQIEKMRDRLVGLPEEGREEIASLLMVYERMLGPSRLLRQVRSRIADEGLCAEAAVSEVTRELALQVSRMAEAVARENNNTQEADANLRLAGEFEEIGRRLVRNLTGISYRAFSSLPPGSVLVAEQLRPADVAMIDPARIAAVVTQGGGGADHTAILLRALDIPAILAVPNLMAQVQEGEMVVVDGHLGTVTLSPNETELRLAAESAQREVKEKRAFGRLKRLPAQLQSGEDIELSANLELPAELPMLMRNGAKGIGLLRSEFLFGEREDLPDEDGQTDAYRAIVQAMDGRPVTIRVLDWGGEKGRACMRRLGLAEQVADGDNPALGLRGVRLLLRVPEVLETQFAAILRAAEPAEGVPPGRVRILLPMVTSSDEIVDAREIYDRVVRRLKRKGHMLPDPLPPLGIMVETPAAALTVDTLARHADFMALGTNDLTMYTLAVDRADSMVADRYSPLHPGVLRLIEAAADSALRARRPISVCGEMASDPRVVALLIGLGLRSFSMNSASLPRVKRLIRTLTLEDCDQLRRQVMLETDPVVIRDLVRQFAT

SEQ ID NO: 67251 - protein, 154 aa, Triticum aestivum
  misc_feature (87)..(87): Xaa can be any naturally occurring amino acid
  misc_feature (131)..(131): Xaa can be any naturally occurring amino acid
  misc_feature (145)..(146): Xaa can be any naturally occurring amino acid
  misc_feature (153)..(153): Xaa can be any naturally occurring amino acid
MAVTAEAAAEMVLERRAYARVGLLGNPSDVYGGRALSFAIADFSATVHLRPSPELLIQPHPHHDLVAFPSLPQLVSRLQSEGYYGGXRLLMAICKVFYNYCVQNNISLKAENFTLSYDTNIPRQSGLSGSXAIVCAAPSCLLDFXXVRHLIKXK

SEQ ID NO: 67252 - protein, 593 aa, Glycine max
  misc_feature (333)..(333): Xaa can be any naturally occurring amino acid
MDVRRRPIPPSGDRRQTQKLKNTATTDSQTLLPLYLTNALFFAVFFSVAYFLLHRWREKIRTATPLHVVTPAETAAIVSLVASAVYLLGFFGVASRASLDELSDDEIILKEDSRAPGPCAAALSDSCSLPNNKIQDQFPLPPRAVHSLAKEKQHIPSPPQVDSPVSVSVSVSSSSDDEDEEIVQAVVSGSIPSYSLESRLGDTRRAATIRHEVVQRLTSRSLSGLPLEGFNYDSILGQCCEMPIGFVQIPVGVAGPLLLDGKEFTVPMATTEGCLVASTNRGCKAIYVSGGASSVLLRDGMTRAPVVRFPSAQRAAQLKFFLEDPLNFDSLAXVFNKSSRFARLQNIQCAIAGKNLYMRFRCSTGDAMGMNMVSKGVQNVLDFLQSDFPDMDVIGISGNFCSDKKAAAVNWIEGRGKSVVCEAIIKEDVVKKVLKTSVEAMVKLNMLKNLTGSAMAGALGGFNAHASNIVSAIYIATGQDPAQNVESSHCITMMEAINDGKDLHVSVTMPSIEVGTVGGGTQLASQSACLNLLGVKGANKESPGANSRLLATIVAGSVLAGELSLMSAIAAGQLVKSHMKYNRSSRDISTIVQ

SEQ ID NO: 67253 - protein, 447 aa, Acetobacterium woodii
VDYNLLKKNTGKKPARLILTTAINPTPAGEGKTTTTIGVADGLAKLGKNVLVALREPSLGPVFGVKGGAAGGGYAQVVPMEDINLHFTGDFHAIGAANNLLAAMLDNHIKQGNSLKIDPKKITWRRCVDMNDRQLRNIVDGLGGSGDGVVREDGFDITVASEVMAAFCLASDIVDLKERCGRIIVAYSVDGTPVKASDINAQGAMAALLKDALKPNLVQTLEGTPAFIHGGPFANIAHGCNSVIATRMAMHFADYVVTEGGFGADLGAEKFLDIKCRMANLKPDAVIIVATVRALKYNGGVAKADLNEENLVALKAGLPNLLKHVENITQVFKLPAVVAINEFPLDTPAELALVKEECQKLGVNVAISQVWAKGGEGGKELAKEVIRLIDESKGTFEFSYELDMPIKDKINAIATKIYGADGVDYTPEAEKQIANLTKLGFDKVPIC

SEQ ID NO: 67254 - protein, 322 aa, Mycoplasma hyopneumoniae 232
MSKKIGILTSGGDAPGMNSAISFLAKSALSLGFEPYLIFDGYSGIIARKILPAKNFPYNGISSFGGTAIGSSRFPEFKKEEVQNKAVEILSEIGISSLVVVGGDGTYNGGYKLHLKGIKVIALPGTIDNDIQFTDYTIGFDTALNTIVETIDKLRDTANSHRRCFVVEVMGRHCQDLALYSAIATGSEILITNTNILTPEEVSQRVLEQFAKGKPSVIVTITENILPNLKEFAAKIEELTKISTRSLEVGHTQRGGRPSAFDRILAAKMAMKAMELINQDKSGLAISYLDGKIQTFDIAKVVSKPVRKTNDLVLEINKINQN

SEQ ID NO: 67255 - protein, 446 aa, Clostridium formicaceticum
VDYNLLKKDNGGKKAKLILTTAINPTPAGEGKTTTTIGVSDALSRLGKKTIVALREPSLGPVFGVKGGAAGGGYAQVIPMEDINLHFTGDFHAIGAANNLLAAMLDNHINHGNQLGIDSRKITWRRAVDMNDRQLRNMVNGLGGKGNGIPREDGFDITVASEVMAAFCLASDIVDLKARLARIIVAYTRDDKPVTAGELNAHGAMAALLKDALKPNLVQTLEGTPAFVHGGPFANIAHGCNSVIATKMAMHFADYVVTEAGFGADLGAEKFLDIKCRMADLKPDAVIIVATVRALKYNGGVAKQDLNQENLEALEKGLPNLLKHVENITKVFKLPAVVAINQFPLDTEAELNLVKTKCKELGVNVALSAVWAKGGEGGEELANEVLRLTEQPSTLEYTYDLEMPIVDKIKAIAQKIYGADNADFTPAALKEIERLTKLGFDKLPIC

SEQ ID NO: 67256 - protein, 446 aa, Clostridium magnum
VDYNLLKKTPGKNGKLILCTAINPTPAGEGKTTTSIGVADALSKIGKNTIVALREPSLGPVFGVKGGAAVGGYAQVVPMEDINLHFTGDFHAIGAANNLLAAMIDNHIYHGNALDIDPRRIVWRRCVDMNDRQLRFVVDGMGGKANGMPREDGFDITVASEIMAIFCLSSSITDLKERLARIVIGYTRAGAPVTAGQINAQGAMAALLKDALKPNLVQTLEGTPAFVHGGPFANIAHGCNSIMATRMATHFADYVVTEAGFGADLGAEKFLDIKCRMAGLKPDAVVIVATVRALKYNGGVAKADLNNENLEALEKGLPNLLKHVENITKVFKLPAVVAINAFPFDTKAELDLVEAKCKELGVNVKLSEVWAKGGEGGVEVAKEVIRLIEAGENNFQFAYDAELPIREKIRAIAQKVYGADDVLFADQANKEIDELEKNGFGKTPIC

SEQ ID NO: 67257 - protein, 447 aa, Thermoanaerobacter kivui
VDYSLMSKLKDKKDGKLILVTAINPTPAGEGKTTTTVGLGDALSKLGKKTMICLREPSLGPVFGVKGGAAGGGYAQVVPMEDINLHFTGDFHAIGAANNLLAAMLDNHIHQGNELGIDPRRIIWRRCVDMNDRQLRFVVDGLGGKANGVPREDGFDITVASEVMAVFCLANDLKDLKERLARIIVAYTYDGKPVTAGDLKAQGAMTALLKEALKPNLVQTLEHTPAFVHGGPFANIAHGCNSVIATKLALKLADYVITEAGFGADLGAEKFLDIKCRYAGLKPDAVVIVATVRALKYNGGVPKANLNEENLDALKKGISNLLKHVENITQKFKLPAVVALNRFPTDTEAELKLVSEECKALGVNVVLSEVWAKGGEGGIELAKEVLRLIEEGKNEYAPLYPLEMSLKEKIETIAREIYGADGVDYIPAANKEIENLENLGYGKLPIC

SEQ ID NO: 67258 - protein, 148 aa, Magnetospirillum magnetotacticum MS-1
MVNIIEQLEKEQIEKLTADRGVPSFAPGDTVKVNVKVIEGNRERVQAYEGVCIARKNDGLNSSFVVRKISYGEGVERIFPLYSPNIASIEVVRRGDVRRAKLYYLRDRRGKSARIAEQTTGHSGKVSAAERADAAAAKAAKVAAAKVE

SEQ ID NO: 67259 - protein, 799 aa, Vibrio sp. Ex25
MVGIVVVSHSRRLAEGVAELATQMTQGKAKLAIAAGIDDPENPIGTDAIAVMEAIEQAHDQQGVVVLMDLGSALLSTEMALDLIDDHVRENVTLISAPIVEGTMAASVAAAAGLPLSTVVEEAQNALSVKREHLGDQPLTSAEIAPVLENFEHERTFDWVVQNPHGLHARPAAAIVGALAPFDCQLWLKKGERRVNAKSLNSIAKLGVRSQETITLCALGPQSSEAIKAFEALASEHFGEKETVEQGIVEPEESTDTLLDDMASSQIEGAVVGIRVNDGIATAPAVLFTHEMPAVPERDFQSEQDEIERVKRAIGVVVQHLQEQAKQPKGEIFSAHSMMLSDPELWASVESRIQTGMIAEQAWIESLQTLAEEFRQAESQYMREREADVHDIARQVMVEMTGVTPNAIDIQEPSILLARDLMPSDVAGLDKSKVLGICLSEGGKTSHSAILARAMGIPAIVKAQGCLDAVRAGQVVTIDGFRGHLWFSPSDSVQQELEAQQIEWQSTRQSALASAQQAAVTCDGVHIPVFANIGGPKDIDDALTSGAEGVGLFRTEFLFQNSDELPTEEAQYQVYRDIAAALGDKPLTIRSLDVGGDKPLAAYPMPSEDNPFLGLRGVRLCLQHESLFTAQLRAILRAFYEQPNIQLMIPMVAQVEEVRKVKALLAHQANQLGLDATHLPVGIMIEVPAAVLNADALAQEVDFFSIGTNDLTQYVMAADRGNAAVAELVNYFEPSVLKAIELTCAAGDRAGIPVSMCGEMAGDPNATETLLRVGLRKFSASSSMLPGLKAQIRQLSVDV

SEQ ID NO: 67260 - protein, 332 aa, Ehrlichia ruminantium str. Gardel
MKNLTVREALCAAIREEMERDHTVLIMGEEVGEYQGAYKVTQGLLEQFGPDRVIDTPITEHGFAGIGIGAAFSGLRPIVEFMTFNFAMQAIDQIINSAAKTSYMSGGQLSCPIVFRGPNGAAARVGAQHSQCYASWYAHIPGLKVIAPYFAADCKGLLKAAIRDPNPIIFLENEITYGHTHEVPDVVLTKDYISEIGKAAIVKEGTDITITAFSLQVKSALEAAELLEKEGINAEVIDLRTLRPLDVEQILNSIKKTNRIISVEEGWPYSGIGSEIAALTMEHAFDYLDAPMIRITAKDIPLPYAANLEKLALPQIQDILEAARTSCIRNYK

SEQ ID NO: 67261 - protein, 331 aa, Mesorhizobium sp. BNC1
MLSRQIKRFDAASAIASAARTLSTEQAALAALAEALDNGLSESFAEAVEMIARISGRVIVTGVGKSGHIGTKIAATLASTGTPAFFVHPVEANHGDLGMIAPDDAIIALSWSGESAELKGIVAYARRFSIPLIAMTSGSRSALARESSVVLCLPKVQEACPHGLAPTSSTLVQLAAGDALAIALLEARGFTPDHFRTFHPGGQLGAKLTRIGDIMHTGERMPLVSSGTGMREAILEISRKGFGCVGITNGEGALIGIVTDGDLRRHMDSDLLAMSVDEVMTHAPKTIKPDTLAAAALQMINSSAITTLMVVENGRPVGIVHLHDLLRIGAA

SEQ ID NO: 67262 - protein, 293 aa, Bacillus clausii KSM-K16
MVKRKVAVIGSINMDMVTSTDHVPAQGETVMGKGFKTVPGGKGANQAVAAARLGADVRMIGRVGDDAFGELLKQGLQDEGVCVDHVEPVTHCSSGVATILLSDGDNRIIVTAGANEYVNEAFLSTCEEVIADSDIVLIQLEIPLKAVEYAIALCKKHQVPVILNPAPAQKLSQQTYENSTWITPNESEQAQLFANTNVHLKEKLIVTQGAAGVIWTENGVEQRIAGHRVMPVDTTGAGDTFNGALAVALASGKPMREAVMYANAAAALSVQSFGAQGGMPSKEEVAAFLLERQ

SEQ ID NO: 67263 - protein, 589 aa, Triticum aestivum
  misc_feature (36)..(36): Xaa can be any naturally occurring amino acid
  misc_feature (60)..(60): Xaa can be any naturally occurring amino acid
  misc_feature (71)..(71): Xaa can be any naturally occurring amino acid
  misc_feature (97)..(97): Xaa can be any naturally occurring amino acid
MCGILAVLGCADDTQGKRVRVLELSRRLKHRGPDWXSGMHQVGDCYLSHQRLAIIDPASXGDQPLYNEGQXSSSVTVNGEIYNHEQLRAQLSSHTFXRTGSDCEVIAHLYEGHGENFIDMLDGVFSFVLLDTRDNSFIAARDAIGVTPLYIGWGIDGSVWISSEMKGLNDDCEHFEIFPPGHLYSSKQGGFKRWYNPPWFSEVIPSVPYDPLALRKAFEKAVIKRLMTDVPFGVLLSGGLDSSLVAAVTVRHLAGTKAAKRWGTKLHSFCVGLEGSPDLKAAKEVANYLGTMHHEFTFTVQDGIDAIEDVIYHTETYDVTTIRASTPMFLMSSKIKSLGVKMVISGEGSDEIFGGYLYFHKAPNKEELHRETCQKIKALHQYDCLRANKATSAWGLEARVPFLDKEFINEAMSIDPEWKMIRPDLGRIEKWVLRKAFDDEEQPFLPKHILYRQKEQFSDGVGYSWIDGLKAHAESNVTDKMMSNAKFIYPHNTPTTKEAYCYRMIFERFFPQNSAILTVPGGPSVACSTAKAVEWDAQWSGNLDPSGRAALGVHLSAYEQEHLPATILTGTSKKPRMIEVAAPGVAIES

SEQ ID NO: 67264 - protein, 357 aa, Anabaena variabilis ATCC 29413
MRKKIGILTSGGDCPGLNCVIRAVVSHATLTYDWEVFGIPYATQGLLERQAIALNMHGWDLRGIDPLLNMGGTILGTINKGDTLAHVDEMLASYEALALDALIVIGGDGSLGILHELASRGNWNLVAIPKTIDSDVALTERAVGFDTAVNTIVDALNRLTFTAASHDRVMIVEVMGRSAGHLALHAGIAGGADVILIPEISYTISGLCQYIAELRDRWQRKFAIVVVAEGAKLCLEDVQENIASACVSPKCGRGQYIAEQIARCSKNLIDTRVSVLGHIQRGGIPSALDRLTATVFGKTAVDLVAQGKFGQMVAWQNGEAIPVPIQDVVAQSPLHVNPQGSLVQSARCLGIYVGEKT

SEQ ID NO: 67265 - protein, 499 aa, Candida albicans SC5314
MFKKALPLVSKLTTPKGITYNQPLGLFINNEYVHPKQQKTFEVISPSTEEKITDVYEALEEDIDTAVEAAQAAYHNGWAQGPPEQRSKVLFKLADLIEENAELLAQIETWDNGKSLQNARGDVALTAAYFRSCGGWADKILGSQINTGNTHFNYTQRVPLVCGQIIPWNFPLLMASWKLGPVLATGSTTVLKTAESTPLSALYLSQLLVEAGMPKGVINIVSGFGATAGAAIAKHPKIEKVAFTGSTATGKIIMKLAAESNLKKVTLELGGKSPNIVFNDADLDKTIQNLIVSIFYNSGEVCCAGSRLLIQSGVYDQVVEKFKEAAESVKVGNPFDEDTFMGAQVSDVQLSKILKYVESGKSQGATVVTGGARADGKGYFVKPTIFADVKKDMDIVREEIFGPVVTLIKFDTVDEAVELANDSDYGLAAGIHSADVNKCIDVANRVKAGTVWVNTYNDFHPMVPFGGFSASGIGREMGEEVLHEYTQVRAVRMKINPPN

SEQ ID NO: 67266 - protein, 61 aa, Zea mays
  misc_feature (31)..(31): Xaa can be any naturally occurring amino acid
  misc_feature (36)..(36): Xaa can be any naturally occurring amino acid
  misc_feature (54)..(54): Xaa can be any naturally occurring amino acid
SPRTPKFDFDMPKGFFCGFCQKACPVSFYFXGPNFXFSPNTPEELLSHKKKFLXNGDPWET

SEQ ID NO: 67267 - protein, 107 aa, Hordeum vulgare subsp. vulgare
MAEAAHGGGLRGRGVLLGGVQDAPAGRENDLETIELARFAVAEHNAKANALLEFEKLVKVRQQVVAGCMHYFTIEVKEGGAKKLYEAKVWEKAWENFKQLQEFKPAA

SEQ ID NO: 67268 - protein, 339 aa, Oryza sativa (japonica cultivar-group)
MESVVVAGDLAAAPAPATPMWFVALVAVGLHAAVVWAGTFLAWLRRAFLRPGKGLCRRYGEWAVVTGATDGIGRAVALELARRGLHLVLVGRNPGKLSGVCKEVRAAAPACKVRTVVFDLAAPGDDDVGGGELSRGVARVAAAVEGLDVGLLVNNAGATYPCAAYFHEVPDAVWEAVLRVNVVAATRIARALVPAMAAKGRGAVVNVGSGSSVVVPAFPLYAVYAATKAYVDQLSRSLHVEYKHHGVDVQCQIPLYVATKMSPVQGNSPFIPSPEEYAKAAVRCIGYEPRCVPYWRHSIQWFFASLLPDSVLNLWRLQVGIRKRNQMKVLLGESDHGFS

SEQ ID NO: 67269 - protein, 292 aa, Lolium perenne
DRRAAAGKVTKFCRILSPQLAIQHILPCVKELSSDSSQHVRSALASVIMGMAPVLGKDATIEQLLPIFLSLLKDEFPDVRLNIISKLDQVNQVIGIDLLSQSLLPAIVELAEDRHWRVRLAIIEYIPLLASQLGVGFFDDKLGALCMQWLEDKVYSIREAAANNLKRLAEEFGPEWAMQHIIPQVLEKINNPHYLYRMTILQAISFLAPVMGAEITCQKLLPVVINSSKDRVPNIKFNVAKVLQSLVPILDQSVVEKTVKPCLVELSEDPDVDVRYYANQALQACDQIMMSS

SEQ ID NO: 67270 - protein, 556 aa, Zea mays
  misc_feature (98)..(98): Xaa can be any naturally occurring amino acid
  misc_feature (119)..(119): Xaa can be any naturally occurring amino acid
MPPWWGKSSSKEVKKSAKENLIDTFQRLISSNEQKGSRKSRSSRRHGKDTAGDKGCWSTAQSRSTSPSKEVSRCQSFAADRPHAQPLPLPKSRAKVTXTSSDITNSKSTLEKHGKGQLXPLPPIQPKKRPEATEPVTEVATASVSSNCSIDSDDPGDSQLQSPVGNEAENATRITATSSSSVVRKECSSAITRKNTKEVAKPNSAFLSNQILSTSPRGTFADGYQSNLQSPRQIALESAPNSLMSSPSRSPRNICPVQIPTSAFWAIKPHTDVTFLGSGQCSSPGSGQTSGHNSVGGDMLGPIFWQPSRGSPECSPIPSPRMTSPGPSSRVHSGSVSPLHPRAGGVTPESPTNRHAEGNKKQTHRLPLPPLSIANSSTFLPNSSNPTSPISRSPGRTENPPSPGSRWKKGKLIGRGTFGHVYAGFNSDRGEMCAMKEVTLFSDDPKSKESAKQLCQEISLLSRLQHPNIVRYYGSETVDDKLYIYLEYVSGGSIHKLLQEYGQFGEQAICSYTKQILLGLAYLHAKNTVHRDIKGANILVDPNGRVKLADFGMAKH

SEQ ID NO: 67271 - protein, 412 aa, Triticum aestivum
MQRYSRAADVLGFVYLHPLSKCVASPAAAVSKVAGQPLEMEEVEVAPPRAHEVRIRILCTSLCHTDVTFWRLKDFPGQHPIILGHEAAGVVESVGEHVHEVAVGDTVVPVFSAQCGDCPDCLSDRSNICSGLPARPGMPRDGTTRFSFAATGEPIHNFIGVSSFTEYTVVDVARVVRIGPGVPPEKACLLSCGVSTGVGAAWKVAAVEPGSSVAVFGLGVVGLAVAQGCRMRGAKQIIGVDLNPEKWDIGKRLGITDFVNPNDIGEKAVSEVIKEMTGGGADYCFECIGSTSVMAEAFQSSRKGWGKTVVLGVSSGGAPMSIPPHDILMGRSVVGSLFGGLKPKADIPILAQKYLDKELELDEFVTHEMGFHDINAAFELLTQGKCLRCIIWMDGAKANGVEALDNGRACKA

SEQ ID NO: 67272 - protein, 105 aa, Oryza sativa
MELSLITFTATGAAAAFTSPKIKRRMRMAPTMASKPGAKVKVSAGCKTCRGKGAVECPGCKGTGRNKKNGNIFERWKCFDCQGFGLKSCPSCGKEGLTPEQRGER

SEQ ID NO: 67273 - protein, 391 aa, Sulfitobacter sp. EE-36
MSATAPITQDVMTIPRKQAEGPVNLVGLTRDAMRAALIAEGTPEKQAKMRVGQIWQWIYQWGTRDFADMTNLSKAFRAELAEKFVIEVPEVVTKQVSEDGTRKYLVRIAGGHEVEVVYIPEEGRGTLCVSSQVGCTLTCSFCHTGTQKLVRNLTAAEIIGQVMVARDDLGEWPVPGTLTDAPRLLSNIVLMGMGEPLYNFENVRDAMKIAMDPEGIQLSRRRITLSTSGVVPEIARTAEEIGCQLAVSFHATTDEVRNKLVPINKRWNIAELIKALRAYPKVSNSERITFEYVMLDGVNDSDADAHRLIELIRGIPAKINLIPFNEWPGAPYKRSSNNRIRAFSEIVYQAGYASPVRKPRGEDIMAACGQLKSATERERKSRKQIEADAGM

SEQ ID NO: 67274 - protein, 270 aa, Alkalilimnicola ehrlichei MLHE-1
MTDRYAVMGNPIEHSKSPEIHRMFAEQTGQAIAYERMRVPLEGFEPAVRAFFASGGKGLNITVPFKEQAWVLVDRRAPRAERAGAVNTLLAEAGRLVGDNTDGTGLVRDLTVNHGAALQGRRVLVIGAGGAVRGVLPALLPEAPGEVVIANRTVARAEALVELFADQGRLSAVGFDRLQGPFDVVINGTSAGLAGELPPLPDDLLAPGATCYDMVYGDQPTPFVRWARAHGAAMAVDGLGMLVEQAAESFLIWRGVRPESAPVIAALRPE

SEQ ID NO: 67275 - protein, 296 aa, Solibacter usitatus Ellin6076
MSTQTPADPKESSQKKPPFDEPRQAPPAREKEMREKPDHGEESYRGADRLDGRAALITGGDSGIGKAVAIAFAREGADVAIAYLPEEEEDARDTERWIRQAGRRCLTLPGDIGQENHCREIVDRVNREFGRLDILVNNAAYQMTHEKLDEFGSEEWDHTFRTNIYAMFYLAKAAFPHMKPGSTIINTSSVQAYQPTGQLLAYATTKGAIVTFTKALSELAIKDRIRVNAVAPGPVWTPLIPSTMPDEKVKKFGQQSKMERPAQPAELAPAYVYLASQDSSYVTGSVMDLTGGKMLP

SEQ ID NO: 67276 - protein, 352 aa, Clostridium aceticum
IGAANNLLAAMLDNHINHGNQLGIDNRKITWRRAMDMNDRQLRNMVNGLGGKGNGITREDGFDITVASEVMAAFCLASDIVDLKERLSKIIVAYTKDDKPVTAGELNAHGAMAALLKDALKPNLVQTLEGTPAFVHGGPFANIAHGCNSVIATKMAMHFADYVVTEAGFGADLGAEKFLDIKCRTADLKPDAVIIVATVRALKYNGGVAKQDLNQENLEALEKGLPNLLKHVENITQVFKLPAVVAINKFPLDTEAELTLVKSKCQELGANVALSEVWAKGGEGGEELAKEVIRLTEQPSTLEYVYELDAPIKDKITAIAQKIYGADNADFTPAALKEIDRLTKLGFDKLPI

SEQ ID NO: 67277 - protein, 354 aa, Eubacterium limosum
IGAANNLLAAMLDNHIHQGNELNIDPKRITWRRCVDMNDRQLRNIVDGLGKKGDGAVRQDGFDITVASEIMAAFCLASDIVDLKNRMGRIIVGYTYDDEPVTAGQLKANGAMAALLKDALKPNLVQTPEGTPSFVHGGPFANIAHGCNSVIATKMAMHFASDYVVTEAGFGADLGAEKFLDIKCRMAGLKPDAVIIVATVRALKYNGGVPKDELNNENLEALEAGLPNLLKHVENITQVYKLPAVVAINRFPLDTEAELKLVEGKCRELGVNVALSEVWAKGGEGGIAVANEVIRLCEEGENSFQFSYEDDMSIKDKINAIATKIYGADGVDYTPEADAEIAKLTKLGFDKVPV

SEQ ID NO: 67278 - protein, 356 aa, Ruminococcus productus
IGAANNLLAAMLDNHIYQGNDLNIDPRKITWRRCVDMNDRQLRFVVDGLGGKTNGCPREDGYDITVASEIMAVLCLAKDITDLKERLGRIIVGYTYGKVSEQKPVTAHDLHAEGAMCALLKDALKPNLVQTLEHVPAIVHGGPFANIAHGCNSVIATKMALKLGDYAITEAGFGADLGAEKFLDIKCRMAGLTPSAVVIVATVRALKYNGGVPKAELNNENLEALEKGLPNLLKHVSNITNVYKLPCVVAINAFPTDTKAELDLVEAKCKELGVNVALSEVWAKGGEGGVALAKEVVRLVEEPNDFTFSYELEGSIEDKLNQIVQKIYGGKKAVLTANAQKQAAQLEALGYGNCPI

SEQ ID NO: 67279 - protein, 351 aa, Sporomusa ovata
ITTAHNLLAAVIDNHLHHGNALGIDSRRITWRRVVDLNNRALRNIVCGLGGKANGVPRETGFDITVASEMMAILCLAKDLDDMKERIGRIIVAYTYEGKPVTPQDLKVTGALTLLFKDAIKPNLVQTLENTPAFVHGGPFANIAHGCNSVSATKYALKLADYCVTEAGFGADLGAEKFLDIKCRFAGFKPSAVVIVATVRALKMHGGVPKNELAGENMAALEKGLANLTKHIENIQQFGLPAVVAINAFPTDTAAELSFVEEKCNAMGVEVALSEVWAKGSLGGQVLAEKVLAACEKPSNFSFIYDEQAPIKDKIAAIATKIYGADGVNYTAAAEKTSKELTALGFDKTPI

SEQ ID NO: 67280 - protein, 121 aa, Chlorokybus atmophyticus
MNLSEIVRKIEATQIKQEIPNISVGDYVKVGVLIQEGNKERVQPYEGTVIARHNAGSNTTITVRRIFQGIGVERIFLIHSPRVASIQIISRSKVRRAKLYYLRGRIGKGTRLKQRFNKIKN

SEQ ID NO: 67281 - protein, 351 aa, Sporomusa termitida
ITTAHNLLAAILDNHLHHGNALGIDSRRITWRRVLDLNERALRAIVCGLGGKANGVPRENGFDITVASEMMAILCLANDLDDMKARIGRIIVAYTYDGKPVTPNDLKVTGALTLLFKDAIKPNLVQTLENTPAFVHGGPFANIAHGCNSISATKYALKLADYCVTEAGFGADLGAEKFIDIKCRFAGFQPSAVVIVATVRALKMHGGVPKNQLAGENMAALEKGLANLTKHIENIQQFGLPAVVAINAFPTDTDKELNFVEEQCKAMGAEVALSEVWAKGSLGGQVLADKVLAACEKANNFTFAYDEKAPIKDKIAAIATKIYGADGVTYTTAAEKTIQELTAMGFDKTPV

SEQ ID NO: 67282 - protein, 136 aa, Triticum aestivum
  misc_feature (3)..(3): Xaa can be any naturally occurring amino acid
  misc_feature (31)..(31): Xaa can be any naturally occurring amino acid
VGXNAVYLPLLADDLARFLDTYSSPDFSGFXSCSLPFKVDAVHCCHEHDAVAKSIGAINTIVRKSDGKLVGYNTDYIGAISAIEDGIGGLGSKDAAMSPLSGRLIVVVGAGGAAKAIAYGAKKKGARVVVANRTYG

SEQ ID NO: 67283 - protein, 870 aa, Oryza sativa (japonica cultivar-group)
MLGGIIGGLTGNKNARLKGSLVLMRKNALDINDFGATVIDGISEFLGRGVTCQLVSSSLVDPNNGNRGRVGTEASLEQWLTSLPSLTTGESKFGVTFEWEVEKMGIPGAIIVKNNHAAEFFLKTITLDNVPGHGAVVFVANSWIYPASKYRYNRVFFSNDTSLPSKMPAALKPYRDDELRNLRGDDQQGPYQEHDRVYRYDVYNDLGEPDSGNPRPVLGGSPDRPYPRRGRTGRKPTKTDPTAESRLSLLENIYVPRDERFGHLKMADFLGYSIKALVDGIVPAIRTYVDLTPGEFDSFKDILKLYEGGLKLPSIPALEELRKRFPLQLVKDLIPAGGDYLLKLPMPHVIREDKKAWMTDDEFAREILAGVNPMVIARLTEFPPRSRLDPARYGDQTSTITAAHVERGLEGLTVQQAIDGNLLYVVDHHDHFMPYLLDINSLDDNFIYATRTLLFLRGDGTLAPLAIELSLPHLQDDGLITARSTVYTPAARGGTGAGAVEWWVWQLAKAYVNVNDYCWHQLISHWLNTHAVMEPFVIATNRQLSVAHPVHKLLLPHYRDTMTINALARQTLINGGGIFEMTVFPRKHALAMSSAFYKDWSFADQALPDDLVKRGVAVPDPASPYKVRLLIEDYPYANDGLAVWHAIEQWATEYLAIYYPNDGVLQGDAELQAWWKEVREVGHGDIKDATWWPEMKTVAELVKACATIIWIGSALHAAVNFGQYPYAGYLPNRPSVSRRPMPEPGTKEYDELARDPEKVFVRTITKQMQAIVGISLLEILSKHSSDEVYLGQRDTPEWTSDAKALEAFKRFGARLTEIESRVVAMNKDPHRKNRVGPTNFPYTLLYPNTSDLKGDAAGLSARGIPNSISI

SEQ ID NO: 67284 - protein, 157 aa, Triticum aestivum
  misc_feature (101)..(101): Xaa can be any naturally occurring amino acid
  misc_feature (107)..(107): Xaa can be any naturally occurring amino acid
MATTERTFIAVKPDGVQRGLIGHIISRFEARGFKLSGNQTSYLPIEQKLKEHYQDLSDKPFFSGLITYMGSGPICAMIWEGRDAVKTGRTILGATNPLASXPGTIRXGDYALDVGRNVCHGSDSVENAQKEISIWFSERERYNPGNPAQNDWVYEKP

SEQ ID NO: 67285 - protein, 376 aa, Arabidopsis thaliana
MEMIETEISLSGYLKRYGHLKFIELSDPPLTKRPRYSPSVIPPLPDQNPIFTLKLSPILLKNNKRKRFTPKSSSSRSVEEITKQVFDGVVRKSSSWIKSEFLGRGSYGSVYLATSKKAKTKTTMAIKSAEISRASSLMDEERILTRLSSPFIVRCYGHEIAREETLFGGERTNYNLILEYCSGKSLFDLVNSNLGGLSEKDVKLLARDILYGLDCIHRANIIHCDIKPENILLAPVENRIRPSGYVAKIGDFGLALEKGSSEYEKASGHRRGTTRYMSPELIRHGIVDYAVDTWAFGCTVLEMLTGQQVWGEHSDLGSVDWDILIGQSCYIPYIPDWLSEEAQHFLSRCLKRDPASRWGIGALLNHPFLQCGSIIV

SEQ ID NO: 67286 - protein, 678 aa, Arabidopsis thaliana
MSKKHLKPLETCFEDEEDDVIYLPPGLVTGATSKKNEEFCGGSGKVQPSEMKRRSEGTSTDMTSKRAKKVSAEDEKKVGEWTKNPYFQRLWSEEDEIVMLQGIIKFEDVTGKSPFEDRHGFIEFVKNSISFEASVQQYIGKISQLKRKYTRKRKNGFSEGHEQKCFKLAMSIWGTKETSKKTDLCSSPKGKKVKEEDGDVTNSDWFENSFLLPSIESLGVDSVKRKWNVVPMEFKKKIEERLELLEADESECKKMEEMLKVKNSECVKQKTNLLNELLQDAVPNICVSRLRFPAMALQATTTTFCFSGPTFRSTPHSLTSKRPISIKATTSSPSRLSNSRSNLKGRALSSDGSTQESPYVVCFGEMLIDFVPTTSGLSLADAPAFKKAPGGAPANVAVGIARLGGSSAFIGKVGEDEFGYMLANILKDNNVNNDGMRFDPGARTALAFVTLTNEGEREFMFYRNPSADMLLEESELDFDLIKKAKIFHYGSISLITEPCKSAHISAAKAAKEAGVILSYDPNLRLPLWPSADNAREEILSIWETADIIKISEEEIVFLTKGEDPYDDNVVRKLFHPKLKLLLVTEGPEGCRYYTKDFSGRVHGLKVDVVDTTGAGDAFVAGILSQLANDLSLLQDEERLREALMFANACGALTVKVRGAIPALPTKEAVHEALLKAVV

SEQ ID NO: 67287 - protein, 448 aa, Argania spinosa
MAAQIKKYITSDELKNHDKPGDLWISILGKAYDVSDWVTDHPGGSFPLKSLAGQEVTDAFVAFHPASTWKNLDKFFTGYYLKDYSVSEVSKDYSKLVFEFSKMGLYDKAGHIMFATLCFIAMLFAMSVYGVLRCEGVLVHLFSGCLMGFLWIQSGWIGHDPGHYMVVSDSRLNKFMGIFAANCLSGISIGWSKWNHNAHHIACNSLEYDPDLQYIPFLVVSSKFFGSLTSHFYEKRLTIDSLSRFFVSYQHWTFYTIMCAARLNMYVQSLIMLLTKRNVSYRAHELLGCLVFSIWYPLLVSCLPNWGERIMFVIASLSVTGMQQVQFSLNHFSSSVYVGKPNGNNWFETQTDGTLDISCPPWMDWFHGGLQFQIEHHLFPKMPRCNLRTISPYVIELCKKHNLPYNYASFSKANEMTLRTLRNTALQARDITKPLPKNLVWEALHTHG

SEQ ID NO: 67288 - protein, 425 aa, Thermotoga neapolitana
MKKFPEGFLWGVATASYQIEGSPLADGAGMSIWHTFSHTPGNVKNGDTGDVACDHYNRWKEDIEIIEKIGAKAYRFSISWPRILPEGTGKVNQKGLDFYNRIIDTLLEKNITPFITIYHWDLPFSLQLKGGWANRDIADWFAEYSRVLFENFGDRVKHWITLNEPWVVAIVGHLYGVHAPGMKDIYVAFHTVHNLLRAHAKSVKVFRETVKDGKIGIVFNNGYFEPASEREEDIRAARFMHQFNNYPLFLNPIYRGEYPDLVLEFAREYLPRNYEDDMEEIKQEIDFVGLNYYSGHMVKYDPNSPARVSFVERNLPKTAMGWEIVPEGIYWILKGVKEEYNPQEVYITENGAAFDDVVSEGGKVHDQNRIDYLRAHIEQVWRAIQDGVPLKGYFVWSLLDNFEWAEGYSKRFGIVYVDYNTQKRI

SEQ ID NO: 67289 - protein, 352 aa, Proteus vulgaris
ITSANNLLSAMLDNHIYQGNELNIDPKKITFKRCLDMNDRALRHTVVGLGGAKDGVTREDNFVITVASEVMSILCLAQDIDDLKQRLSRIIIAYSYDGNPITAKDLGAVGAMASLLKDAINPNLVQTLENTPAIVHGGPFANIAHGCNSVRATKLALGLADIVVTEAGFGADLGAEKFFDIKCRISGLKPDCAVIVVTTKALKYNGGLGKSEWNKEDLAALEKGIVNLEKHIENLKKYGLPVIVSLNAYITDSVAEHKFIEQFCQNRGCRFAITKVWENGGTGGIELANQVVDTLQNESAQFQLLYPDNFSLNEKIETIAKEIYGAKGITYSNNARNMLENIEKMGFGHLPI

SEQ ID NO: 67290 - protein, 448 aa, Mycobacterium smegmatis str. MC2 155
MTIAEIAGRTLTQERRLVTAIPGPISQELQARKQSAVAAGVGVTLPVYVVAAGGGVLADADGNQLIDFGSGIAVTTVGNSAPAVVDAVTQQVAAFTHTCFMVTPYEGYVKVAEHLNRLTPGDHEKRTALFNSGAEAVENAVKIARAYTRRQAVVVFDHAYHGRTNLTMAMTAKNQPYKHGFGPFANEVYRVPTSYPFRDGETDGAAAAAHALDLINKQVGADNVAAVVIEPVHGEGGFVVPAPGFLGALQKWCTDNGAVFVADEVQTGFARTGALFACEHENVVPDLIVTAKGIAGGLPLSAVTGRAEIMDGPQSGGLGGTYGGNPLACAAALAVIDTIERENLVARARAIGETMLSRLGALAAADPRIGEVRGRGAMIAVELVKPGTTEPDADLTKRVAAAAHAQGLVVLTCGTYGNVLRFLPPLSMPDHLLDEGLDILAAVFAEVK

SEQ ID NO: 67291 - protein, 608 aa, Candidatus Pelagibacter ubique HTCC1002
MSNNIRNITIIAHVDHGKTTMIDNLMKQSGSFRENEVVDERLMDSGELEKERGITILAKPASIDWQGTRVNIIDTPGHRDFAAEVERVLSMADGALLLIDSAEGVMPQTKFVLAKALKQGLKPIVVINKLDKADQRANEVLDETFDLFVSLDANEEQLDFPVMYASGRSGWADKEVDGPRENLHPLLDLIIEHVKPADLDKTKPFAMLSTLLYADSFLGRSLVGKISQGTAKANQPIKAINLKGEKVDEGRLTKIFRYEGTKKVPIEVGEAGDIVVIAGLEKANVADTICDLEVNDPLPATPIDPPTMSITISVNSSPLAGTEGKKLTSTQIRDRLVTEAQNNVGISFSQNANVDAFVISGRGELMLEILLTQMRREGFEMTVSPPKVLYQKDDNGNRLEPIEEITVDVDEEFSSKIIDSMNRRKGKLLDLKDTGKDKKRLIFHAPTRGLMGYTSRFLTLTKGTGVINRIFHGYGKFEGEMDGRKNGALISMANGKAVAFAIFNLQARGEMFVTHNDPVYEGMIVGLAPKPGDMIINVMKGKQLTNMRTQGTDENVVLTPVRQMSIAEQLSMLNTDEALEITPKSLRLRKAILNPNDRKKNEKSGTPL

SEQ ID NO: 67292 - protein, 352 aa, uncultured bacterium
ITSANNLLAALIDNHIQQGNELRIDSRQILWKRCLDMNDRALRNVVVGLGTKGDGFVREDHFVITVASEIMAILCLADDMEDLKKRLSRIIVAYNLDGEPVTAGELKAVGSMAALLKDAMKPNIIQTLEHTPAIVHGGPFANIAHGCNSVRATKTALKIADYCITEAGFGADLGAEKFFDIKCRMSGLKPDVVVLVATIRALKYNGGVKKEDLGGENLEALKKGIVNLEKHIENLQQYGVPVVVTLNSFITDTKAETDFVREFCENMGADSALSEVWEKGGEGGIALANKILNTIENKKSDFKPIYDDELSIEDKIKTVAKKIYGADDVIFEGRAKNAIKKLTELGFNNLPV

SEQ ID NO: 67293 - protein, 336 aa, Alkalilimnicola ehrlichei MLHE-1
MAIKVAINGYGRIGRNVLRALYEAGRTDEIQVVAINDLGNAETNAHLTRFDSVHGRFNGEVQVEGDSMIVNGDRVRVLAERDPARLPWGELGVDLVMECTGLFTTREKASAHLQAGAKKVLISAPGGKDVDNTVVFGVNHDTLTPEHTVVSNASCTTNCLAPLVKPLHEAIGVERGLMTTIHAYTNDQVLNDVHHKDLRRARSATMSQIPTSTGAAAAVGLVLPELNGKLDGYAIRVPTVNVSIVDLTFTAARETSVEEINQIVRGAAEGPLKGILAYNDAPLVSIDFNHDPASSTYDASLTKVNGNLVKVTAWYDNEWGFSNRMLDTALAMAQAG

SEQ ID NO: 67294 - protein, 352 aa, uncultured bacterium
ITSANNLLAALLDNHIQQGNVLGIDPRNVIWKRCLDMNDRVLRNVIVGLGAKADGTVREDHFVITVASEIMAILCLASDMKDLKERLSKIIVAYTYDNKPVTAADLNAVGAMAALLKDAIKPNIIQTLENTPAIVHGGPFANIAHGCNSVRATKYALKMADYVITEAGFGADLGAEKFFDIKCRQAGLKPDCVVLVATIRALKYNGGVDEKDLSVENINALEKGIKNLEKHIENLQQYKVPVVVTLNAFSSDTEAETEFVKKFCEDRNCEFALSKVWEFGGEGGIDLANKVLKSLDEKESNFEVLYDENLSINDKVKTVATKIYGAKDVNFSKEAQKMIDKITELGYGNLPV

SEQ ID NO: 67295 - protein, 665 aa, Alkalilimnicola ehrlichei MLHE-1
MPTRRDLANAIRALSMDAVQRAHSGHPGAPMGMADIAEVLWNDYLRHNPANPHWWDRDRFVLSNGHGSMLLYSLLHLSGYELGIDDLKAFRQLHSRTPGHPEYGYTAGVETTTGPLGQGLANAVGLALAERTLAAQFNRPGHELVDHWTYCFLGDGCLMEGVSHEACSLAGTWKLGKLIGFYDDNGISIDGKVEGWFTDDTPGRFEAYGWHVVREVDGHDAEAIKRAIDEARAVTDRPSLICCKTVIGFGAPNVCGTHGVHGAPLGDEEIQATREFLKWEHGPFEIPREIYSGWDARARGKQLEAAWHERLAAYRKAHPEMAAEFERRMKGELPERFAQHAEEALAEAVDESAKVATRKASEQALNRLGPYLPELLGGSADLSGSNNTKWEDCAVIGGAKADADGNYLHYGVREFGMSAIANGLALHGGFIPYTGTFLVFSDYARNAIRMAALMGIQQIFVHTHDSIGLGEDGPTHQPVEHLGSLRMIPGLDVWRPCDAIETQAAWQAALERRDGPSLLALSRQGLVAQQRTDEQVALIRRGGYVLAEPKQGEAELILMATGSEVAIMVEAAERLADRGRRVRVVSMPCLEVFQSQPADYREAVLPAGVPVIAMEAAHPMPWQALLGDRGRVIGIDTFGESAPAPALYEHFGLTVDAVVQATETL

SEQ ID NO: 67296 - protein, 392 aa, Alkalilimnicola ehrlichei MLHE-1
MAVIKMTDLDLKGKRVLIREDLNVPLKEGKVADDTRIRASLPTIRHALESGARVMLLSHLGRPKEGEPDPAASLRPVAEHLATLLGQEVPLAEDWLDGVEVAEGQAVLCENVRFNVGEKANDEALAKRMAALCDVYVMDAFGTAHRAQASTHGVGQYAPVACAGPLLAAELEALGKALEAPARPMTAIVGGSKVSTKLDVLETLSEKVDQLIVGGGIANTFIAAAGHPVGKSLYEADLVDKARQLMDTARANGGEIPVPTDVVVGREFSADTQAVVKRVDEVDDEDMIFDIGPETAQRYAGMMREAGTIVWNGPVGVFEFDQFGEGTRKLGEAIAESDGFSIAGGGDTVAAVEKYGLADRISYISTGGGAFLEFLEGKTLPAVAMLEARASD

SEQ ID NO: 67297 - protein, 352 aa, uncultured bacterium
ITSVNNLLAALLDNHIQQGNVLGIDPRNVIWKPCLDMNDRVLRNVIVGLGAKADGTVREDHFVITVASEIMAILCLASDMKDLKERLSKIIVAYTYDNKPVTAADLNAVGAMAALLKDAIKPNIIQTLENTPAIVHGGPFANIAHGCNSVRATRYAWKMADYVMTEAGFGADLGAGKFCDMKCRQAGLKPDCVVLVATIRALKYNGGVDKKDLSVENINALEKGIKNLEKHIENLQQYKVPVVVTLNAFSSDTEAETEFVKKFCEDRNCEFALSKVWEFGGEGGIDLANKVLKSLDEKESNFEVLYDENLSINDKVKTVATKIYGAKDVNFSKEAQKMIDKITELGYGNLPV

SEQ ID NO: 67298 - protein, 352 aa, uncultured bacterium
IGAANNLLAAMLDNHIQQGNSLNIDPRRITWRRAVDMNDRQLRNIVDGLGARADGTPRQDGFDITVASEVMAVLCLASDISDLKKRCARIVVGYTYDNKPVTAGDLKAQGAMAALLKDALKPNLVQTLEGTPAFIHGGPFANIAHGCNSVTATKLAMKLGDYAVTEAGFGADLGAEKFLDIKCRMANLKPDAVVLVATIRALKHHGGAAKDKLPEVNLDALKKGIPNLLQHVENITKVYKLPCVVAVNAFPKDSQEEIDLVIEECKKLGVNVALSEVYAKGGEGGMELAKEVVRLCDLDNDFTFAYEDNLTIKEKLEAIATKIYHADGVDLIGSAPKQLLQLEELGYSNMPI

SEQ ID NO: 67299 - protein, 352 aa, Bacillus clausii KSM-K16
MKALVLEANQSFTIKDIETPVPKEDEALIKVAYCGICGSDLARYFDGKVHNYPIVLGHEFSGTVEAVGASVDSVAVGDRVVVAPLLPNKDDPFMQKGSPALSSSYSFLGSRENGAMAEYVVVKAENLLVLPETVTLAEAALIEPLTVAIHGIERIVLPAGEHVCVLGAGTIGIMTILALKARGAGKVTAIDINDEKLAFAKKIGADDTINSLKEDPVSYASKHGKPGAVIETAGVPSSQEQAVALVEKKGKIVFVGTASGDVTFPAATFEKILREELEITGSWMSYSGPFPGYEWQAAIDYIASGKIDVKPLIHDVFKLEDGDKPFQAMKDPDNHSIKLLYQIAENEGQVGK

SEQ ID NO: 67300 - protein, 270 aa, Haloarcula marismortui ATCC 43049
MVAVENVVFVFVAGLLTALATGLGAIPFFLVDEFSDRWNVLLWGLASGIMVAASLFGLVREGLAYGSPVLLVPGVLAGVGLVAVAHELLDDFDQSPKQFEQADFTKLLLILGILTVHSFPEGVAVGVSFAELGLEAATPESAVGIVGVSVPLLAVFMTVAISIHNIPEGTAIAIPLRSLGVSEWKMVWWAVFSSLPQPVGAVIAYYFVTLAKAFLPFGFGFAAGAMVYLVLTEFVPEALEYGDGLPGGGKRELLTGIAVGVLAMVPLAFV

SEQ ID NO: 67301 - protein, 257 aa, Anabaena variabilis ATCC 29413
MSILDSLPDEPEEETSPESLNPQNPPSDQQEPQKHNAQTNGGEQHNLLSPQLKVDAPLRMVETAFLASTASLIWFINFYFPLGPVLRIFFPVPIALVYLRWGKRAAWMAAVTSGLLLSVLMGPVRSLLFVMPFAFMGVLLGATWYRRAPWIVSITLGTLLGTLGVFFRLWLLSVLSGEDLWIYLITQVTELIEWIFLKLGLLNSPSVLLIQFGAVALIIINNFIYLFVVHLAAWLLLDRLGNPIPRPPRWVQVLMDY

SEQ ID NO: 67302 - protein, 405 aa, Vibrio sp. Ex25
MAGVLGMILAGGEGSRLRPLTESRSKPSVPFGGSYRLIDFALNNFVNADLMRIYVLTQFKSQSLFHHLKKGWNINGITDRFIDPIPAQMRTGKRWYEGTADAIYQNLRFMELEEPEQVCIFGSDHIYKMDIKQMLNFHSEKQASLTVSALRMPLKEASQFGVIEVDSEGRMIGFEEKPANPKSIPGDPDYALVSMGNYVFEAQVLFSELVEDADNEASSHDFGKDIIPKMFPRGDVFVYDFSTNKISGEREEVYWRDVGTIDAYWEAHMDLLEKDAPFSLYNRKWPLHTYYPPLPPATFTDSDNGRVQIIDSLVCNGSYVRGSRIEKSVLGFRSNIASACDISECILLGDVKIGEGCVLRRVIVDKDADIAPGTQIGVNLQEDKKHFHVSEEGIVVIPKGARVGY

SEQ ID NO: 67303 - protein, 209 aa, Ashbya gossypii ATCC 10895
MTQGPLFSLSPASTLDDLLEANQRWRRQQEQRKPALFRSHAAGQTPHTLFLACCDSRYSEACLGVEPGEAFTYRTIANIMDPADPGFRAALEFALHVLQVSRIVLCGHTNCGGVSTCLTGTRRALATPQCSSLHAHLDSLDALCSANKPALASLPPAVQAEQLVIANVRAQYRALSQDAAVRAAVQQRHLTLHALLYHVDTGALTVVAP

SEQ ID NO: 67304 - protein, 896 aa, Oryza sativa (japonica cultivar-group)
MASALFLWLSWLVLSLLSIYLLDLLAHSRRRLPPGPRPLPLIGSLHLLGDQPHRSLAGLAKTYGPLMSLRLGAVTTVVVSSPDVAREFLQKHDAVFATRSAPDAAGDHTRNSVPWLPPGPRWRELRKIMATELLATHRLDALHELRQEKVSELVDHVARLARDGAAVDVGRVAFTTSLNLLSRTIFSRDLTSLDDRGASKEFQQVVTDIMGAAGSPNLSDFFPALAAADLQGWRRRLAGLFERLHRVFDAEIEHRRRVAGEEHGKVKDDFLRVLLRLAARDDDTAGLDDDTLRSTSVIDNGIAQLKKPNVTWMAHGWWARLRTLISGIIAQFLPQYCNGGFVSLAFMACALSLLSVYLLDLLAQSRRRLPPGPHPLPLIGSLHLLGDQPHRSLAGLAKTYGPLMSLRLGAVTTVVVSSPDVAREFLQKHDAVFATRSAPDASGDHARNSVALLPNSPRWRELRKIMATELFSTSRLDALHELRQEKVVELVDHVARLAREGAAVDVGRVAFTTSLNLLSHTIFSRDLTSLDDHGASKEFQQVVTDIMGAAGSPNLSDFFPALAAADLQGWRRRLAGLFERLRRVFDAEIEHRRRVVGKEHGKVKDDFLRVLLRLAARDDDTAGLHDDALQSIFTDLFAAGSDTSSSTVEWAMAELLRNPLPMAKACDELQRVIGSTRRIEESDIGRLPYLQAVIKETFRLHPPVPFLLPRQATTTIQILGYTIPKGAKVFINVWAMGRDKDIWPEAEKFMPERFLERATDFKGADFELIPFGAGRRICPGLPLAVRMVHVVLASLLINFKWRLPVKLLQSKEKDRSDLAYVINAVKDLMGAAAATTATNLTILPSPRVRKSKCEEAHVMPTTAKLHTPATTKHGLTDYVASCDNEAHIQDNKWPPS

SEQ ID NO: 67305 - protein, 246 aa, Zea mays
  misc_feature (20)..(20): Xaa can be any naturally occurring amino acid
  misc_feature (41)..(41): Xaa can be any naturally occurring amino acid
YTRGLPGSSGHVIGVPVISXAYGIEEEASRDPSSLARAATXDADHLAVSFTHPSPYASFGYKHSSSNHWVSKLSRRAQGFREHVTLGPKLSETVKGKLSLGARILQAGGVERVFRQAFSAADDDKQGERLLKALQCYIYTTGGPIAGMLFVSTRKVAFRSDRPVTVVTSSSSPAGAVRGTARVAYKVVVPLRRIRRVRPSENVHRPEEKYVHVATVDGFEFWFMGFVSFQRSCRCMQQAVSEVQTQ

SEQ ID NO: 67306 - protein, 364 aa, Buchnera aphidicola (Thelaxes suberi)
MTKKLYKIAVLPGDGIGPEIIQEAYKIIDVLQKKFSFNVKMHEYDIGGISIDKHGTALTQETIEGCENSDAILFGSVGGSKWDHLPEIEKPEKAGLLKLRKHFNLFANIRPCKLSQHLLDISPLKNSIIKKGIDLICIRELTGGIYFGKSNKITNIDDPYAFDTEIYFRSEIKRIAKIAFQIAQSRKKKIVSIDKANVLKSSILWRDTVNKMAYKFPNVKLEHMYIDNATMELIKNPSSFDVILCSNLFGDIISDECAAIIGSIGLLPSASLNKSGFGLYEPAGGSAPNIAGKTIANPIAQILSLSMLLKYSLHLPFLSSCIDEAVHEALVKKYMTMDISKNPQNFLKTNEIGDKISDLLAKKA

SEQ ID NO: 67307 - protein, 525 aa, Mycobacterium smegmatis str. MC2 155
MRLTVQGWQNLVLSVMGVVVFTGAIAGAVLVGRTDTLSDELINEIQPARVAAYQLQAALRDQETAVRGYAIAADPQFLAPYDEGQQAEADAAASIRDDLDGRDELLADLAVIEKAAAAWRAAYADPMIASIQPGRPHIGNDMVAERGKAQFDQLRGLFDVQNRHLSEARNVGIEDMERMRTWRNSVLIAMIVAFFAMAVVLAVLVRNAVNRPLAALAASCRRITEGNFTERIEPKGPKDIRAIAIDVEDMRQRIVDELDASKQARLALDEQAEELRRSNAELEQFAYVASHDLQEPLRKVASFCQLLERRYGDKLDERGVEYIGFAVDGAKRMQVLINDLLTFSRVGRLYSTTTEVDLNAVVDAALNNISTAVEESGAEIIRPQEPLPHIDGDPTLLIMVWQNLLGNAVKFRRDGVAPRIVIECHAQTGGGVDSWLFTVSDNGIGISEEFVDKVFVIFQRLHGRDSYSGTGIGLALCKKIIEHHGGNIWIDTSYTGGTRFCFTLPVMPTNKPGVLTDAQLEGNNT

SEQ ID NO: 67308 - protein, 352 aa, uncultured bacterium
IGAANNLLAAMLDNHIQQGNELGIDPKQITWKRCVDMNDRQLRNVVDGLGGKMHGVPREDGFDITVASEIMAVFCLSSDIIDLKKRLGRIIVGYTYAGKPVTAHDLKAEGAMAALLKDALKPNLVQTLEGTPAFVHGGPFANIAHGCNSITATKLALKLSDYTITEAGFAADLGAEKFLDIKCRMAKLKPSAVVMVATVRALKYHGGVAKADLNKENLEALEKGMPNLLQHVKNSTDIYKLPCVVAINAFPTDTKKELALVEKKCKELGVSAVLSEHWAKGGKGAMNLAKEVVRVCEKPNKFTYSYSLNGSIEEKLEAICKKVYHADGVVLTDNAKKQLKQLTALGFDKMPI

SEQ ID NO: 67309 - protein, 354 aa, uncultured bacterium
IGAANNLLAAMLDNHIHQGNELNIDPKRITWRRCVDMNDRQLRNIVDGLGKKGDGAVRQDGFDITVASEIMAAFCLASDIVDLKNRMGRIIVGYTYDDEPVTAGQLKANGAMAALLKDALKPNLVQTPEGTPSFVHGGPFANIAHGCNSVIATKMAMHFASDYVVTEAGFGADLGAEKFLDIKCRMAGLEPDAVIIVATVRALKYNGGVPKDELNNENLEALEAGLPNLLKHVENITQVYKLPAVVAINRFPLDTEAELKLVEGKCRELGVNVALSEVWAKGGEGGIAVANEVIRLCEEGENSFQFSYEDDMSIKDKINAIATKIYGADGVDYTPEADAEIAKLTKLGFDKVPV

SEQ ID NO: 67310 - protein, 352 aa, uncultured bacterium
IGAAHNLLSALIDNHIHWGNDKALDARRIVWRRVVDMNGPRAAHVVLSLGGVANGFPRQSGFDITVASEVMAIFCLATDLEDLQARLGKVVVGYTRDREPVYARDLDADGAMSVLLKDALNPNLVQTLENNPAIIHGGPFANIAHGCNSVIATKTALKLADYVITEAGFGADLGAEKFFDIKCRKAGLKPDAAVIVATIRALKMHGGVARDALGAEDVDAVKAGLENLGRHIRNVGQFGVPALVAVNRFTSDSDAEVAAVRDFCAGLGVDAHECTHWADGGAGTEGLAEAVAAVADAGRSQFRPLYDDDMTLWEKTRTVARSIYGADDIIADKRVRDQFVQFQEQGFGSYPV

SEQ ID NO: 67311 - protein, 438 aa, Zea mays
  misc_feature (125)..(125): Xaa can be any naturally occurring amino acid
  misc_feature (168)..(168): Xaa can be any naturally occurring amino acid
  misc_feature (204)..(204): Xaa can be any naturally occurring amino acid
MASEKHFKYVILGGGVAAGYAAREFAKQGVKPGELAIISKEAVAPYERPALSKGYLFPTNAARLPGFYVCVGSGGEKLLPEWYSEKGIELILSTEIVKADLSTKTLTSAAGANFTYEILLIATGXSSVIKLTDFGTQGADSNNILYLREIDDADKLVAAIQAKKGGKXAVVVGGGYIGLELSAALKINDFDVTMVFPEPWCMPXRLFTADIAAFYEAYYTNKGVKILKGTLAVGFDADANGDVTAVKLKDGTVLEADIVVVGVGGRPLTTLFKGQVAEEKGGIKTDASFETSVPGVYAIGDVATFPLKMYNELRRVEHVDHSRKSAEQAVKAIKGKESGEPVPEYDYLPYFYSRSFDLAWQFYGDNVGETILFGDSDPTSSKPKFGSYWIKDGKVLGAFLEGGSPDENKVIAKVAKTQPPVANLEELKKDGLQFASKI

SEQ ID NO: 67312 - protein, 351 aa, uncultured bacterium
IGIAHNLLSAMIDNHIYWGLDPQIDSRRVAWKRVVDMNDRALRNIVNSLGGVANGFPREDGFDIVVASEIMAVFCLSKDLNDLTNRLGKIVIAQDRARNSITAKDVKGPGPMSVLLKEAVAPNLVQALENNPAFVHGGPFANIAHGCNSVIATKTALKLCDYVVTEAGFGADLGAEKFFDIKCRKAGLTPAAAVIVATVRALKMHGGIAKADLGKENVEAVKQGCANLARHLENVKKFGVPPVVAINQFITDTDAELEAVRSTAEGMGAKAIICSHWADGGAGAEELANHVVDLVDSGQAEFKPLYPDEMPLVDKVRTIVQEIYGGDDISYDSAVEKRFEELQKDYGHFPV

SEQ ID NO: 67313 - protein, 360 aa, Arabidopsis thaliana
MDSSSSMCKQAQPIVRKARKKKVKGVVDPIKQAEKKNRRLEKAIATSAAIRAELEKKKQMKKEGQLEAADEEDSADAAKKKQERDELERIKQAENKKNRLEKSIATSAAIMAELEKKKLRKLEEQKRLAEEGAAIAEKKKRRLEKAIATTAAIRAELEKKKQMKKEGQLDAAVEEDSAYAAKKKQEREELERIKQAERKKRRIEKSIATSAAIRAELEKKKLRKLEEQRRLDEEGAAIAEAVALHVLLGEDCDDSYRNTLNQETGFKPWDYTTKINLFSGGINRFFPHQRCSSYAVHDNNRTRDSNWSSVSYEPFARGWDNNNNNMGISADLFDTQAVSSLQISENTDVDAIVFNGMFRR

SEQ ID NO: 67314 - protein, 351 aa, uncultured bacterium
IGIAHNLLSAMIDNHIYWGLDPQIDSRRVAWKRVVDMNDRALRNIVNSLGGVANGFPREDGFDIVVASEIMAIFCLSKDLNDLTNRLGKIVIAQDRARNSITAKDVKGPGPMSVLLKEAVAPNLVQTLENNPAFVHGGPFANIAHGCNSVIATKTALKLCDYVVTEAGFGADLGAEKFFDIKCRKAGLTPAAAVIVATVRALKMHGGIAKADLGNENVKAVKQGCANLARHLENVKKFGVPPVVAINQFITDTDAELEAVRSTAEGLGAKAIICSHWADGGAGAEELANHVVDLVDSGQAEFKPLYPDEMPLVDKVRTIVQEIYGGDDISYDSAVEKRFEELQKDYGHFPV

SEQ ID NO: 67315 - protein, 363 aa, Buchnera aphidicola (Pemphigus spyrothecae)
MTKIYNLAILPGDGIGPELLQKDLNFKVLKEQYKLKINTTEYDIGGIAIDKYGKALPKETLDGCKESDSILFGSVGGPKWQHLPPDQQPERAALLPIRKYFNLFSNLRPAKLYSTLNHLSPLRRDISEKGFDILCVRELTGGIYFGKPKGYIKNIIDKKAFDTEIYYASEIKRIAHIGFKLAQNRKYKITSVDKANVLESSVLWRETVNTISKEYPDVKLSHLYIDHAAMQIIKNPDKFDVILTSNLFGDILSDECAMITGSIGMLPSASLNDSNFGLYEPAGGSAPDIAGKNIANPIAQILSIAMLVRYTMKLPMISDHIESAVIDTLKKGYRTLDIANDKEKYVSTNDIGDIISDILKKRI

SEQ ID NO: 67316 - protein, 103 aa, Oryza sativa
MSGRGKGGKGLGKGGAKRHRKVLRDNIQGITKPAIRRLARRGSVKRISGLIYEETRGVLKIFLENVIRDAVTYTEHARRKTVTAMDVVYALKRQGRTLYGFGG

SEQ ID NO: 67317 - protein, 484 aa, Ashbya gossypii ATCC 10895
MEFYRDASWVLEYIEQEFARKSKVAGSLHSLVLQSHKKYKLKSDVRHVYAIVASFWKYKAYLDRIIEKSGLLKDVPRKKGEPAFKRSTLGLVVHDLLLSKKKRIHMGKHPLKAFVLKHQTRLRGEYAKQLVKLGVADLSVLVQDEREDATPVRWIRLNPFRIRGQREEVLQELQKKFPRRVADWRELTPGSIYEDEYVAGLYGVHPADKITSHELYKRGKIIIQDRASCFPAQILAPGRSDVIIDACAAPGNKTTHVAAHIFPEGGADHAQIHAFERDPQRAKTLRKMIATAGCDNAIEVHVGDFTRDAQPEIFKNVTGFIVDPSCSGSGIFGRQLVDATQETQKGTETDPSADVPEEETFEATKSAVELKNRLAKLSSFQFQIVKHAMSFPSAKKLIYSTCSVHAEENERVVIDLLLDSKVQKGGWKVASRSKVIPAWPRRGHQAEFEEVFPDQAEELAGGCIRVLPKEDGGIGFFAVCFERE

SEQ ID NO: 67318 - protein, 367 aa, Ashbya gossypii ATCC 10895
MHRSSATSLIHKATYATSKTLTIGLIPGDGIGKEVIPAGQRVLEAIGKKHDIRFSYEHLDAGWQTFLETGNALPGATVEALRERCQGALFGAVQSPTTKVEGYSSPIVALRRQLGLYANIRPVKSVSGTGQPVDLVIVRENTEDLYVQQERTYVDAATGKRVAEAIKRISEPATERIAEISLRLALQRQRMGGRGALTVTHKSNVLSQTDGLFKEVCREVYEANKKSYGSIEYNEQIVDSMVYRLFKEPHCFDVVVAPNLYGDLLSDGAAALVGSLGLVPSVNVGNNIIIGEPCHGSAPDIAGRGIANPIATIRSVSLMLQFLGLEEAASDIDQAVTGNLKDRQVVSPDLGGKNTTQEVLDDILARI

SEQ ID NO: 67319 - protein, 325 aa, Zea mays
MSMGRFVNSMDPTSGLEVIRDWNGVAQVVLRSPKGASARVSLCGGQVVSWRNDRGEELLFTSSKSVVFDVQATFKPPNAMRGGIQMCFPQFGYSGTLERHGFARNRIWSLDDEQPPLNHNDNGSKVSVDLILKPSEDDLKCWPHCFEFRLRASLSKDGDLSLISRIRNVNGKPFSFSFAYHTYLSVSDISEVRIEGLETLDYLDNLSHKERFTEQGDAITFESEVDRVYVSSPNVVAVIDHEKKHSFVIRKEGLPDVVVWNPWEKKSKTMVDLGDEEYKQMLCVDAAAVERAISLRPGEEWTGKLELSAVLSTNCSDHLDHPVSI

SEQ ID NO: 67320 - protein, 490 aa, Lotus japonicus
MEQGGNEDKDTTINKYALACVIVASMVSIISGYDTGVMSGALLFIKEDIGISDTQQEVLAGILNICALVGCLAAGKTSDYIGRRYTIFLASILFLVGAVFMGYGPNFAILMFGRCVCGLGVGFALTTAPVYSAELSSASTRGFLTSLPEVCIGLGIFIGYISNYFLGKLALTLGWRLMLGLAAIPSLGLALGILTMPESPRWLVMQGRLGCAKKVLLEVSNTTEEAELRFRDIIVSAGFDEKCNDEFVKQPQKSHHGEGVWKELFLRPTPPVRRMLIAAVGIHFFEHATGIEAVMLYGPRIFKKAGVTTKDRLLLATIGTGLTKITFLTISTFLLDRVGRRRLLQISVAGMIFGLTILGFSLTMVEYSSEKLVWALSLSIVATYTYVAFFNVGLAPVTWVYSSEIFPLRLRAQGNSIGVAVNRGMNAAISMSFISIYKAITIGGAFFLFAGMSVVAWVFFYFCLPETKGKALEEMEMVFSKKSDDKTVAT

SEQ ID NO: 67321 - protein, 504 aa, Xanthomonas oryzae pv. oryzae KACC10331
MTQTNGFDALHAHAQRLRGAAIPALLAAEPERPTQYAWQVGPLYFNFARQKYDRAALDALFAIARERDLAGAFQRLFRGEQVNVTEQRAALHTALRGDLTDAPVASEAYATAAEVRQRMGALIQQLEATDVTDIVSVGIGGSDLGPRLVADALRPVSGARLRVHFVSNVDGAAMQRTLATLDPARTAGILISKTFGTQETLLNGSILHAWLGGSERLYAVSANPERAAKAFDIAPGRVLPMWDWVGGRYSLWSAVGFPIALAIGFERFEQLLEGAAQFDAHALNTPLEENVAVLHGLTAVWNRNLLGSATHAVMTYDQRLALLPAYLQQLVMESLGKRVKLDGSAVDSDTVSVWWGGAGTDVQHSFFQALHQGTSVVPADFIGTVHNDDPYAENHVALMANVLAQTEALANGQDSSDPHRSYPGGRPSTVILLDALTPQALGALISMYEHSVYVQSVMWGINAFDQFGVELGKQLASQLLPALKGESADVADPVTRELLSKLRG

SEQ ID NO: 67322 - protein, 519 aa, Lotus japonicus
MTEGKVVTEAENANQKNLQDFDPQKKPKRNKYAFACAMLASMTSILLGYDIGVMSGAAIYIKRDLKVSDVKIEILLGIINLYSLIGSGLAGRTSDWIGRRYTIVFAGAIFFVGALLMGFSPNYWFLMFGRFIAGIGIGYALMIAPVYTAEVSPASSRGFLTSFPEVFINGGILLGYISNFAFSKLSLKVGWRMMLGVGALPSVILGVGVLAMPESPRWLVMRGRLGDAIKVLNKTSDSPEEAQLRLADIKRAAGIPESCTDDVVEVSKRSTGEGVWKELFLYPTPAIRHIVIAALGIHFFQQASGIDAVVLYSPTIFEKAGIKSDTDKLLATVAVGFVKTCFILVATFMLDRIGRRPLLLTSVGGMVLSLLTLGTSLTIIDRSDTKVTWAVGLSIATVLSYVATFSIGAGPITWVYSSEIFPLRLRAQGCAMGVVVNRVTSGVISMTFLSLSKGITIGGAFFLFGGIAICGWIFFYTMLPETRGKTLEDMEGSFGQSKSKIKGNKGVGNGKDNDQAGQV

SEQ ID NO: 67323 - protein, 447 aa, Erwinia carotovora subsp. atroseptica SCRI1043
MAQIVSLASFLDSVQQRDPHQPEFLQAVNEVLSTLWPFLEQNPHYADYSLLERLVEPERVIQFRVAWTDDKGQVQVNRAWRVQFSSAIGPYKGGMRFHPSVNLSILKFLGFEQTFKNALTTLPMGGGKGGSDFNPKGKSQGEVMRFCQALMTELYRHLGADTDVPAGDIGVGGREVGFMTGMMKKLTNNTACVFTGKGLSFGGSLIRPEATGYGLIYFTEAMLKRHGLGFEGMRVAVSGSGNVAQYAIEKAMELGARVVTVSDSNGTVVDENGFTPEKLALLEEIKNKRYGRVEDYAREAKLTYLAGKTPWEVPVDIALPCATQNELDLPAAQTLIANGVKAVAEGANMPTTIPATDAFLDAGVLFAPGKAANAGGVATSGLEMAQNAARLGWKAEKVDARLHHIMLDIHTACVQYGGEDSQTNYVRGANVAGFVKVADAMLAQGVV

SEQ ID NO: 67324 - protein, 350 aa, uncultured bacterium
IGAAHNLLSALIDNHIHWAMTRRSMRAVSFGAGSSITTARCDVVLSLGGVANGFPRQSGFDITVASEVMAIFCLATDLEDLQARLGKVVVGYTRDREPVYARDLDADGAMSVLLKDALNPNLVQTLENNPAIIHGGPFANIAHGCNSVIATKTALKLADYVITEAGFGADLGAEKFFDIKCRKAGLKPDAAVIVATIRALKMHGGVARDALGAEDVDAVKAGLENLGRHIRNVGQFGVPALVAVNRFTSDSDAEVAAVRDFCAGLGVDAHECTHWADGGAGTEGLAEAVAAVADAGRSQFRPLYDDDMTLWEKTRTVARSIYGADDIIADKRVRDQFVQFQEQGFGSYPV

SEQ ID NO: 67325 - protein, 351 aa, uncultured bacterium
IGRGAQPALGADRQSHPLGQQGARCAPYRLAPGRRYERPRAAHVVLSLGGVANGFPRQSGFDITVASEVMAIFCLATDLEDLQARLGKVVVGYTRDREPVYARDLDADGAMSVLLKDALNPNLVQTLENNPAIIHGGPFANIAHGCNSVIATKTALKLADYVITEAGFGADLGAEKFFDIKCRKAGLKPDAAVIVATIRALKMHGGVARDALGAEDVDAVKAGLENLGRHIRNVGQFGVPALVAVNRFTSDSDAEVAAVRDFCAGLGVDAHECTHWADGGAGTEGLAEAVAAVADAGRSQFRPLYDDDMTLWEKTRTVARSIYGADDIIADKRVRDQFVQFQEQGFGSYPV

SEQ ID NO: 67326 - protein, 351 aa, uncultured bacterium
IGVAHNLLAAMIDNHIYWGNELGIDVRRVSYRRVVDMNDRALRDVATALGGPGNGYPRQSGFDITVASEIMAIFCLATDLDDLQRRIGNIVIGTDRDLNPITCKQIGADGAMTALLKDALMPNLVQTLESTPAFIHGGPFANIAHGCNSVMATTAGLKLADYVVTEAGFGADLGAEKFLDIKCRKTGPKPDVVTIVATVRALKMHGGVAKTDLAGENVDAVKKGFVNLERHLQNIAKFGLPAVVAINKFTLDTPAEIEAIRSGCEAMGVKVIECSHWADGGEGTRELAEEIVSIIDKGESNFKYLYEDDMPIQEKVETVAKEIYRADGITFDAKVAKQFELFQERYGNFPV

SEQ ID NO: 67327 - protein, 354 aa, uncultured bacterium
IGAANNLLAAMLDNHIHQGNELNIDPKRITWRRCVDMNDRQLRNIVDGLGKKGDGAVRQDGFDITVVSEIMAAFCLASDIVDLKNRMGRIIVGYTYDDEPVTAGQLKANGAMAALLKDALEPNLVQTPEGTPSFVHGGPFANIAHGCNSVIATKMAMHFASDYVVTEAGFGADLGAEKFLDIKCRMAGLKPDAVIIVATVRALKYNGGVPKDELNNENLEALEAGLPNLLKHVENITQVYKLPAVVAINRFPLDTEAELKLVEGKCRELGVNVALSEVWAKGGEGGIAVANEVIRLCEEGENSFQFSYEDDMSIKDKINAIATKIYGADGVDYTPEADAEIAKLTKLGFDKVPV

SEQ ID NO: 67328 - protein, 352 aa, uncultured bacterium
IGAANNLLAALIDNHMHWENQLNIDPRRVTWRRVVDMNDRTLRTITSGLGGYHNGVVREAGFDITVASEIMAIFCLATGLDDLEKRLGNIVLGYTRENEPVTVRELNSQGAMTALLMDALQPNLVQTIENNPALMHGGPFANIAHGCNSVMATKTGLKLADYVVTEAGFGADLGAEKFFNIKCRKAGLKPNAVVLVATIKALKMHGGVAKTDLGEENVAALKDGLKNLGRHMRNLSQFGVPVVVGVNRFTADTDAEIQAVQEYCADFGVKAVSSNHWAEGGAGATDLAEEVVKLADSGSAQFRTLYSDELPLWEKAKRIATSIYGADDIIADQKIREQFAQFQEAGYGHYPV

SEQ ID NO: 67329 - protein, 365 aa, Zea mays
  misc_feature (257)..(257): Xaa can be any naturally occurring amino acid
ACEKLWQRAWRRARGGGERLHRAGVPREKLPFYISRDVYEASIDFFLPDPRITSAYALQVQLHADEETYRSMGKEHALVISNHRSDIDWLIGWILAQRSGCLGSTLAVMKKSSKFLPVIGWSMWFAEYLFLERSWAKDEKTLKWGLQRLKDFPRPFWLALFVEGTRFTPAKLLAAQEYAASQGLPAPRNVLIPRTKGFVSAVSIMRDFVPAIYDTTVIVPKDSPQPTMLRILKGQSSVIHVRMKRHAMSEMPKSDDXVSKWCKDIFVTKDALLDKHLATGTFDEEIRPIGRPVKSLLVTLFWSCLLLFGAIEFFKWTQLLSTWRGVAFTAAGMALVTGVMHVFVMFSQAERSSSAKAARNRVKKE

SEQ ID NO: 67330 - protein, 425 aa, Vibrio sp. Ex25
MSEDNRQAATPEEEHRQKALDYHAYPTPGKIAVELTKPAETAGDLALAYSPGVAEPVREIAQNPDNVYKYTAKGNMVAVISNGTAILGLGNLGPLASKPVMEGKALLFKRFAGLDSIDIEVKHRTIDEFVDTVASIADTFGGINLEDIKAPDCFEIEKRLIERCDVPVFHDDQHGTAIVTAAGMLNAIELQGKKLEDSTIVCLGAGAAAVACMELLIKCGAMREKIYMLDRKGVIHTRRDDLNEYKQLFANNTDKRTLEDVIEGADLFLGVSGPNLLPAEALKLMADKPIVFACSNPDPEIKPELAHAVRDDLIMGTGRSDYPNQVNNVLCFPFIFRGALDVRASEINDEMKLAAVEAIRELAKEPVPETVLKAAGVDKLEFGADYIIPKPMDSRLLPRVAKAVAQAAVDSGVARIEMPENYMAE

SEQ ID NO: 67331 - protein, 358 aa, Campylobacter jejuni RM1221
MKAYKVAVLAGDGIGPLVMKEALKILTFISQKYNFSFEFNEAKIGGASIDAYGVALSDETLKLCEQSDAILFGSVGGPKWDNLPIDQRPERASLLPLRKHFNLFANLRPCKIYESLTHASPLKNEIIQKGVDILCVRELTGGIYFGKQDLGKESAYDTEIYTKKEIERIAHIAFESARIRKKKVHLIDKANVLASSILWREVVANVVKDYQDINLEYMYVDNAAMQIVKNPSIFDVMLCSNLFGDILSDELAAINGSLGLLSSASLNDKGFGLYEPAGGSAPDIAHLNIANPIAQILSAALMLKYSFKEEQAAQDIENAISLALAQGKMTKDLNAKSYLNTDEMGDCILEILKENNNG

SEQ ID NO: 67332 - protein, 372 aa, Synechococcus elongatus PCC 6301
MDRAKAVAIAAGREVIDLSLGSSDLPAPDHVVAVIAASLQDPSTHGYLLHQGTLPFRQVAAAWYERKFGLGVDPETEVLLLIGSQEGTAHLPLAVMEPGEIALLQDPGYPSHAGGVYLAAGEIYRLPTTADRGFLPDFSTIPTEILSRSRLLVLSYPHNPTTAIAPLAFFEEAVAFCRHHQLVLAHDFPYPDLGFDGVEVPSIFQADRQKQQAIEFFSLSKSYNMGGFRVGFAIGNAELIGALRRLKAVVDFNQYQGILAGAIAALTGPQACVEATRQRFRDRRDIFINALAATGWTIPKPVSTMYLWAPLPEPWQTRSLEFCEKLVAETGVAASPGIGFGDCGEGFVRFALVHDRDRLEEAARRITQFLAR

SEQ ID NO: 67333 - protein, 360 aa, Ashbya gossypii ATCC 10895
MPPIVDRVAAMPMICDTRPGVGETASRNMSASYWDSSQRNKWQYSRESLARTRQKLWMLECQLYPQGTNILMEGGGKDAQPVTKNIPITHRDLHYDRDYNLRIYCYFLIMKLGRRLNVRQYALATAHVYLARFCLKASIREVNLYLLVTTCIYLACKVEECPQHIRTLVNEARSLWPEFVPPDPTKVTEFEFYLIEELQSYMIVHYPYRAMEQIAAALRRPPYNLVLSPDDLQNSWSLINDSYITDVHLLYPPHVIAMACLFITVCLRSAAGARDLQETFNRFMADSQVDLHEVMDTIQDFITLYDHWDKYNEPWIKFLLHNLYLRPHAGGTTVSGAAAGSAGPAGSVLTPNGTITGSTS

SEQ ID NO: 67334 - protein, 553 aa, Vibrio vulnificus CMCP6
MAMEQKTADVSFDSLLKIFTIPEGPDSTLTQIEAKLSQNLNKFLGEHIVAEEKPLREIEKDFSSAQIPERPSFVSDHTEHLLNTLVSHSVHTSSPSFIGHMTSALPYFLMPLSKIMIALNQNLVKIETSKAFTPLERQVLGMLHRLIYSQDEAFYSHWMHSAEHSLGAFCSGGTIANITALWVARNNALRAQGDFKGVEKEGLFRAMKHYGYEGLAVLVSERGHYSLKKAADVLGIGQAGLVAIKTDENNRVCPDALEAKIKELQAQNIKPFAVIGVAGTTETGSVDPLAEMAKICQKYGCHFHVDAAWGGATLMSNKYRSLLDGVELADSVTIDAHKQLYIPMGAGMVLFKDPNAMKSIEHHAQYILRKGSKDLGSHTLEGSRSGMAMLVYASMHIISRPGYELLINQSIEKAKYFADLIKQQDDFELISEPELCLLTYRYIPARVKQALAAANAKQQLELNELLNELTKFTQKRQRETGRSFVSRTRLNPAHWSRMNTIVFRVVLANPLTSFDILASVLEEQRNIIVHQAPNLLAKINKLADGILTSTQSS

SEQ ID NO: 67335 - protein, 136 aa, Mycobacterium sp. MCS
MTERTLVLIKPDGVQRRLVGEILGRIERKGLTLAALELKTVDDELARRHYAEHEGKPFFGSLLEFITSGPVVAAIVEGPRAIAAFRQIAGGTDPVEKATPGTIRADLALVTQDNLVHGSDSPESAAREIDLWFPGR

SEQ ID NO: 67336 - protein, 209 aa, Prochlorococcus marinus str. MIT 9303
MGIMTSLRQGDVHRVTAETDVLVRVGLDGCGQCNVSTGVAFLDHMLHQLSSHGLLDLEITATGDTHIDDHHTNEDVGIAVGQALSQALGDRRGIHRFGHFVAPLDEALVQVVLDCSGRPHFSYGLQIPSQRIGSYDSELVKEFFVAVVNNSGLTLHIRQLAGTNSHHIVEACFKAFARALRMAIEIDPRRAGAVPSSKGVLEQAGGQKS

SEQ ID NO: 67337 - protein, 217 aa, Ashbya gossypii ATCC 10895
MDGTNGGGTAGAQGGKEGQAMAERRWNDVGRSAGATDGEPGPAGPDRYGGEVVPPENFSPVVGEIYRSSFPRPENFAFLQERVRLRSILVLIPEEYPPENQEFVERAGIQLFQVGMSGNKEPFVNIPRDVLTRALAIALDPANHPILIHCNRGKHRTGCLVGCIRKLQNWSLTMIFDEYRRFAFPKARAMDQQFIEMYEDRELIVEAVRRRWLPIAW

SEQ ID NO: 67338 - protein, 450 aa, Erwinia carotovora subsp. atroseptica SCRI1043
MTKHYDYLAIGGGSGGIASINRAAMYGQKCALIEAKYLGGTCVNVGCVPKKVMWHAAQIAEAIHQYGPDYGFDTTVNQFNWGTLVKNRSAYIDRIHQSYDNVLGKNKVDVIHGFARFVDAHTVEVNGEKITADHILIATGGRPVHPNIPGAEYGIDSDGFFELDALPKRTAIVGAGYIAVEIAGVLNGLGSETHLFVRKHAPLRSFDPLIVDTLVEVMNTEGPTLHTESIPKAIVKNADGSLTLELENGQSQTVDCLIWAIGREPATDNLNLSVTGVGLNDKGYINVDKFQNTTVSGIYAVGDNTGAVELTPVAVAAGRRLSERLFNNKPDEHLDYSNIPTVVFSHPPIGTVGLTEPQAREQYGDDQVKVYKSAFTAMYTAVTQHRQPCRMKLVCVGKEEKIVGIHGIGFGMDEMLQGFAVAVKMGATKKDFDNTVAIHPTASEEFVTMR

SEQ ID NO: 67339 - protein, 178 aa, Oryza sativa
  misc_feature (132)..(132): Xaa can be any naturally occurring amino acid
  misc_feature (143)..(143): Xaa can be any naturally occurring amino acid
  misc_feature (158)..(158): Xaa can be any naturally occurring amino acid
  misc_feature (167)..(167): Xaa can be any naturally occurring amino acid
TGESLYSIYSKMIKKNLTMDDVHDIHGLRLGVDTEQDCYQALDIVHKLWPRVAGRFKDYILHPKLNGYRSLHTVIMCEGIHPFEVQIRTKEMHLQAEYGFAAHWRYKEGGCKHSFVLQMVEWARWVLTWQCXALSKERASGLXGRSDAIRAPCPVPSXHSEDCAYSXPRQVQHDGPTL

SEQ ID NO: 67340 - protein, 135 aa, Desulfitobacterium hafniense Y51
MLGKGLLTGMGIVLKKMLGPNITEFYPEVMPNLPKTVRSSMGLEPDKCISCTLCALACPNKVITLTSEKDENNKKVLKTYHMDVGRCLFCGLCTEACPTNALTVTQEFENSVFYPEDLYWDMIERSKRNGKEGNE

SEQ ID NO: 67341 - protein, 120 aa, Oceanobacter sp. RED65
MSSKNKIIQAIESAQLKSDVPEFGAGDTVVVQVKVKEGNRERLQAYEGVVIGKRNRGLNSAFTVRKISSGVGVERTFQTHSPVVDSIEVKRRGDVRKSKLYYLRERSGKSARIKEKLSSK

SEQ ID NO: 67342 - protein, 285 aa, Clostridium perfringens str. 13
MKGGDNMNNVLMAFLLTLLAGLATGIGSCIAFFAKKTNKKFLCVSLGFSAGVMIYVSMIEMFQTAKESLVGVMGIKAGNWITVISFFAGIAIIALIDKFVPEEENPHEVRSVEEVENEIEEYKGENKEGKADIKDKTLMRTGIVTALAIAIHNFPEGLATFVSALEGASLAIPITIAIAIHNIPEGISVSVPIFYATGDKKKAFLYSFLSGMSEPIGAIIGYTLLRNIFNDITLGILLSAVAGIMVFISLDELLPTARKYGEHHLAIYGLIAGMVVMAVSLLLFI

SEQ ID NO: 67343 - protein, 103 aa, Olisthodiscus luteus
MSGRGKGGKGLGKGGAKRHRRVLRDNIQGITKPAIRRLARRGGVKRISGLIYEETRGVLKVFLENVIRDAVTYTEHARRKTVTAMDVVYALKRQGRTLYGFGG

SEQ ID NO: 67344 - protein, 204 aa, Triticum aestivum
MKNCQLLEMLTTQSSSFMILNWMTILGLPPKKASANDQVPPNEQQQTQHKTSEDTKKLAANALAAVRDAATAASGRGKVEITEVRDFAGKDIEIKKLVDADSKEAVEKASAAGASPSAVDNILEQIRKKQKLSVLDKTKKDWGEYKAEKGVEEELGAYKKSSNQYLDRQSFLKRADYREYELERDARLSLMAKRKSESMQDDDV

SEQ ID NO: 67345 - protein, 241 aa, Brassica napus
MDSETYVKENQRNYDRLSNLPDSLLCKILSDFSTKESVRTSVLSKRWKNLWLNVPSLDLDSIKFRDDDDVFFSFMDRFLGSENEQHLERFKLIYEVCEHDASRFKSWIDAVARRRVRHLDVHNEICDDGLVKMPPSIYSCERLVNLNLYCVVLDHPESVSLPCVKILHLEIVRYDGDSTLETLISSCHVLEELTIVRDANDSLVAVRVRSQSLKRFKIECERYEIDGHAVEIGCSKTESMN

SEQ ID NO: 67346 - protein, 319 aa, Oryza sativa (indica cultivar-group)
  misc_feature (311)..(311): Xaa can be any naturally occurring amino acid
  misc_feature (318)..(318): Xaa can be any naturally occurring amino acid
MAETRRWELAAHRRLEKGKVVGVVVLDGWGEAAPDTFNCIHVADTPTLDALKKGGPERWRVIKAHGTAVGLPTDDDMGNSEFGHNALGAGQIYAQGAKLVDMALASGKIYEGEGFKYIQQSFENGTLHLIGLLSDGGVHSRIDQLQLLLKGASEHGAKRIRVHILTDGRDVLDGSSVKFVELIENDLAKLRDKGVDARIASGGGRMYVTMDRYETKVTAASDLDNDGGALAWVQDTRCRALRRRLPNNPATAPSSPAAAAQRSWSRSSAAPSWRCRRRTEAGASGGARRCIGGGVESCRLRHPAKGGGWEXSDFLAGXN

SEQ ID NO: 67347 - protein, 514 aa, Escherichia coli O157:H7 EDL933
MSVSKKPMVLVILDGYGYREEQQDNAIFSAKTPVMDALWANRPHTLIDASGLEVGLPDRQMGNSEVGHVNLGAGRIVYQDLTRLDVEIKDRAFFANPVLTGAVDKAKNAGKAVHIMGLLSAGGVHSHEDHIMAMVELAAERGAEKIYLHAFLDGRDTPPRSAESSLKKFEEKFAALGKGRVASIIGRYYAMDRDNRWDRVEKAYDLLTLAQGEFQADTAVAGLQAAYARDENDEFVKATVIRAEGQPDAAMEDGDALIFMNFRADRAREITRAFVNADFDGFARKKVVNVDFVMLTEYAADIKTAVAYPPASLVNTFGEWMAKNDKTQLRISETEKYAHVTFFFNGGVEESFKGEDRILINSPKVATYDLQPEMSSAELTEKLVAAIKSGKYDTIICNYPNGDMVGHTGVMEAAVKAVEALDHCVEEVAKAVESVGGQLLITADHGNAEQMRDPATGQAHTAHTNLPVPLIYVGDKNVKAVAGGKLSDIAPTMLSLMGMEIPQEMTGKPLFIVE

SEQ ID NO: 67348 - protein, 175 aa, Triticum aestivum
MAPTGMASSATSVAPFQGLKSTAGLPVSRRSNGASLGSVSNGGRIRCMQVWPIEGIKRFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 67349 - protein, 370 aa, Desulfitobacterium hafniense Y51
MSDLYNEGTEELLLNMGPQHPSMHGVFRMVVRLQGETVTGIEPKIGYLHRGLEKIAESRTYPQFIPYTDRLDYLASPHNNLAYVQTVEKLMGLEIPERAEYLRIILAELARFASHQVFIASAALDMAGWTAWGYPFRDRERILDLFEMMSGSRLTVNCMRIGGVSAEPPAEFWPALESFLDDMPEKLEEYFNIYMGNEIAQARMKKVGILSKEVAENLCITGPALRASGVQYDVRKAEPYGIYDRFDFEVPVLYGCDTYDRNLIRFMEMNESLKIIRQAVRDIPEGPIMAKVPKIIKPPAGEVYHRVENPKGELGFYIVSNGTPKPERVKIRAGAFVNLQCLNEIGVGTYIQDLIASFASLDAVLGEVDK

SEQ ID NO: 67350 - protein, 482 aa, Photorhabdus luminescens subsp. laumondii TTO1
MNNHYDVLIIGAGIAGIGTACHLTRKCPDKKFIILERRQTIGGTWDLFRYPGIRSDSDMMSYGYTFRPWTDTSVFADGPSIQSYIHATAKEYDIDKKIEFGLKITHTDWSNATRQWTVTAIDEISGETRQFTCCFLIAATGYYNYDEPHLPKFPGIEDFKGPVIHPQLWPEGLDYKGKQVVVIGSGATAVTLLPAMANDTKHITMLQRSPSYIFSMPERDKIAEFCKGIIPQRWIYTLSRKRNLFLFRLIYKISRHLPTLLKSFLLALARRRVGPDFDMKHLTPKYMPWDERLCLIPSNNLFKVLKEGKASIVTDHIERITENNILLKSGKELPADIIITATGLKLHFIGGIELSIDGQKQQSHDRMLYKGTLIQNIPNFACLFGYINNAWTLKVDLSADYICRLLNEMERRDATVVTPHAQPGEMQEDEHIFGALRSGYVKRAQDLLPRQGYSPNWQIPHDYKKDKQVLGQPVDDAALKWT

SEQ ID NO: 67351 - protein, 113 aa, Desulfitobacterium hafniense Y51
MDFIRMIEEEQMKKDLPAFRPGDTVRVHVKVVEGTRERIQAFEGVVIKMKGGGLRRTFTVRRVTYGVGVERTFPLHSPRIDRIEVIRRGIVRRAKLYYLRELSGKAARIRDRR

SEQ ID NO: 67352 - protein, 476 aa, Glycine max
LETAVLLALIGANSTVVAAGLLHDSLDDAFLTYDYIVGMFGAGVADLVEGVSKLSHLSKLARENNTASKSVEADRLHTMFLGMADARAVLVKLADRLHNMMTLDALPGAKQQRFAKETLEIFAPLANRLGISTWKEQLENLCFKHLNPSQHEELSSKLVESYDDAMITSAIERLEQALKDEGISYNVISGRHKSLYSIYCKMLKKKLTIDDIHDIYGLRLIVDKEEDCYKALTVVHRLWSEVPGKLKDYICRPKFNGYQSLHTVVMGEGKVPLEVQIRTKDMHLQADFGFAAHWRYKEDDCQHSSFVLQMVEWARWVVTWQCEAMSRDCSSVGYADSVKPPCKFPSHAEDCPYSYKPDCGQNGPVFVIMIENDKMSVQEFSANSTVLDLLKRSGRASSRLTTYRFPLKEELRPRLNHKPVSDPNSKLKMGDVIELTPAIPDKSLTEYREEIQRMYDRGLTVSSMGTAASTMVGSRS

SEQ ID NO: 67353 - protein, 175 aa, Triticum aestivum
MAPTVMASSATSVAPFQGVKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCAASGKA

SEQ ID NO: 67354 - protein, 622 aa, Synechococcus elongatus PCC 6301
MIAMHGVPIARRLMTEDGSLVYDPEAIARYYLNRPFAVWSRFLEILWPLFSFIFGLWFDARTGASRRNQNQRAVQLRDLLTELGPAFIKVGQALSTRPDLVPPAYLEELTRLQDQLPAFPNAIAFEFIEAELGVPPEAIFAELSDNPVSAASLGQVYRGRLHTGEEVAVKVQRPGLAERIALDLYILRGLAAWAMRNVRRVKSNLVAIADEFGLRIFEELDYRQEADNAERFAELYGQLPDIYVPSIYRQYTSRRVLTMEWIQGTKLTELQAIRNQGIDPAYLIERGVQCSLRQLLEYGFFHADPHPGNLLATPDGQLAYLDFGMMSQVEDYQRYGLIEAVVHLVNRDFQGLARDYVKLEFLTPDTDLTPIIPALAGVFKDAMGASVADLNFKSITDQLSQVMYDYPFRVPAYYALIIRSLVTLEGIAINVDPNFKVLSKAYPFIARQILTDPSPDLRASLRELLFNGGQLRWNRLENLLRNASNSSDYDSEHLIQQTVDFLLSESGQDLRDRLVEELVNSLDRLGRGALPLLRNQIRQRLGMDPEPDSTLTDLQPLLRVLSLLQQGQRFEPQRFIPLIPVLGRPEVQQMGQQVVTGLAQKALVRFIREVVVGDRRNNAIAA

SEQ ID NO: 67355 - protein, 639 aa, Thiobacillus denitrificans ATCC 25259
MCGITGIFDTSGVNAISRDLLQRMNETQHHRGPDEGGLHLEPGLGLGHRRLSIIDLSSGQQPLANEDGSVVVVFNGEIYNFQELVPELEALGHVFRTHSDTEVIVHAWEAWGEACVARFRGMFAFVLWDRNQETLFVVRDRFGVKPLYYAFLDTGEFIFGSELKSLMVHPSLGREVDPLAVEDYFAYGYVPEPRTIFKRVHKLPPGFTLTLKRGAPRALPKQYWDMPFAPVAVKDEAGAMDELVERMKESIRLRMIADVPLGAFLSGGVDSSAVVAMMATQSSTPVNTCSIGFDDPAFNEIEYAQQVADRYHTRHHVETVAADDFSLVGKLAQVYDEPYADSSALPTYRVCELARKHVKVALSGDGGDEHFAGYRRYRWFRYEERMRSIIPLGLRRPLFGTLGLLYPKADWAPKMFRAKTTFEALARDTVEGYFHGVSLLSNAQRAQLFSPAFRRELQGYQAVDVLRRHAAVAPTDDPLSLVQYLDMKTYLVGDILTKVDRASMAHALEVREPLLDHELMGWVSGLPVDLKLRGSEGKYLLKKAMEPYLPHDVLYRKKMGFSVPLAAWFRGPLAATIRTVVLGERLAGTGMFNCEFLREVVEAHQSGRRDFSVILWTVLMFDAFLGQVLGLDDTAREAA

SEQ ID NO: 67356 - protein, 229 aa, Paracoccidioides brasiliensis
MASSKAVSRLIAYRRPALLQISPQSSTHLRSTPAFSFSTSSPVSATPAGPPRQGFRLPPPKAWDQGDESALDKAGKYFLMTEMLRGMYVVLEQFFRPPYTIFYPFEKGPISPRFRGEHALRRYPSGEERCIACKLCEAICPAQAITIEAEEREDGSRRTTRYDIDMTKCIYCGFCQESCPVDAIVESPNAEYATETREELLYNKEKLLANGDKWEPELAAAARADAPYR

SEQ ID NO: 67357 - protein, 469 aa, Aspergillus oryzae
MDTLKATLLKSWSRLASILGNPSQKAPLCRLNHFRNTEEPDLYTTGGFHRVSLGDTFDHGRYAILRKLGYGQYSTVWLAQDFKHKKYVTLKLLRADCYGGPHDIFEREILSKISDMSRNSTHDGARHILPLIGDFTHTGPNGDHVCLVFDVLGHHLDFQCAKYEDGRLPVRAVKLIARQLLLGLDFLHRECGVIHTGMGIVSNTFVLYFLTGRIFPIDLKPTNILLELENPDRVISRYLEKVPPLMDTQGNAEVPLREVITTPLISEMEAPRIRIIDFGVASWRDNHLSEQIQSSALRAPEVTIGAPWDTGVDIWSLGCLIMELVQGIVPFSGEASERGTWTAEDDRLARTIEILGPFPLELLRKGSRTPDLFDEKGDLLRIPNMKSTSLERLLNGTTKPFLKPDDMPDAEVPIFINFLRACLRLILSTGVQRQSCFSMNGSDHDAIEWLKVERIEGSYETMHTSIRTQ

SEQ ID NO: 67358 - protein, 606 aa, Thiobacillus denitrificans ATCC 25259
MDGIFGWLGADGAHQDLIRQIAGGDADAAGLRRYHSAELGLAAQSRFGKADIAVEDGHAVALMGRPRFVDADLARVARETGPAAAVAQGWRSHGAGLPARMQGNFAFAVLEPQAKKACLVLDRMGAERLGYAHRGDQLVFGSSVQHVAAHPAVGRNIEPQAIYDYLYFHNIPAPRSLYRGVHKLLPGQIVTLENGRLATRFYWHADYTPHDAGFDVQRDAFRRVLDAAVRDADGPATAAFLSGGTDSSTVVGALTAARGGPVDTFSIGFDAEGFDEMAYARCAAARYDSRRHEYYLKPADIVTAIPLIAREYDEPFGNDSAVPTYFCARAAREAGFGRMLAGDGGDEIFGGNARYAKQKLFENYFRVPAPLRHGLIEPLATLPGVSDHFPLSKLKSYVRQANMGLPLRMESYNFLHRTPLDQIFAADFVAAVDPSAADAALTEVYARTASDHYINRMMHLDLKFTLADNDLRKVGTMTEAAGVEVAYPLLDDRLVALANHLPVDWKVRGQALRWFFKEALRDLLPEEIINKRKHGFGLPFGVWSTQHAPLAELVHDSLSDFKRRGWVQPGYLDHMLAMQRGPHASYYGVMIWVVMMLERWLQANAH

SEQ ID NO: 67359 - protein, 318 aa, Prochlorococcus marinus subsp. pastoris str. CCMP1986
MNDLNIEFPLDDFEELISQIGWSSLDEWFIFWNLKKEMLSINNFWDDNVKDDWIWGLALPLLSQAYKLNKKSPDRKIIGISALPGTGKTTLGKWLESISLKLKFKLSVISIDDFYLPSEEMEFAIKNNPWNVSRGFPGSHSIDLMKEKLLKWKTDGQLNVPVFDKSLRKGLGDRAHWREESPDLLIIEGWFLGVKPLSIDLDNSEKFSPPLSVFESSYRNKIQNNLDQYLDIWNMIDQIWHLKPLKFEYLNEWKSNQEKSMHFKSGSSLKGDNLSNFLRMLNVSIPHKSFDDINSDVLLMINQERKLVRVGLNQQISK

SEQ ID NO: 67360 - protein, 339 aa, Bacillus cereus G9241
MTKIFILASTLSLSFFSGLNIGNAATENFSPVTNAIVQNNDYFAEGNSKDNNKPPGNGGSQDDSGSGGNGSGGNGSGGSGSGGSGSGGNDSGGNGSGGNDSGGNGSGGNGSGGNGSDGSGSGGNGSGGNGSGGNGSGGNGSDGSGSGGNGSGGNGSGGNGSSGNGSGGNGSSGNGSDGSGSGGNGSGGNGSGGNGSGGNGSGGNGSDGNGSGGNSSDGNGSGGNSSDGSGSGGNGSGGNGSGGNGSGGNSSGGNGSGGNRRKGDSSSQGGNDSHGGNRVKGNSSSQGGNGSQGGNVKDNAKKQGDKLPNTATHYPASILMGLSTFLIGMLLFIRRKNAK

SEQ ID NO: 67361 - protein, 362 aa, Bacillus clausii KSM-K16
MNDSIPKKMKAVVAYGPKDYRLEEVDVPVIEHDKEIIVKVEATGICAGDIKAFDGAPSFWGDDTQPAYIKAPMIPGHEFIGHVVAKGDGVGDFEIGDRIISEQIVPCWECRFCNRGQYWMCEKHDLYGFQNNVNGSMAEYMKFTKEAINYKVPADLPIEQAILIEPYACSMHAVQRARIELGDIVVLSGAGTLGLGMIGAVKKSGAKTLVVLDLKDERLALAQQFGADVVLNPAKDNVVEKVKDMTDGYGCDVYIEATGHPASVEQGLSMIRKLGRFVEFSVFKDPVTVDWSIISDRKELDVLGSHLGPYCYPLVIEGIANGDLPTEGVVTHELPLERFAEGFELMKNGSNSLKIILKPQQA

SEQ ID NO: 67362 - protein, 341 aa, Escherichia coli O157:H7 EDL933
MKALSKLKAEEGIWMTDVPVPELGHNDLLIKIRKTAICGTDVHIYNWDEWSQKTIPVPMVVGHEYVGEVVGIGQEVKGFKIGDRVSGEGHITCGHCRNCRGGRTHLCRNTIGVGVNRPGCFAEYLVIPAFNAFKIPDNISDDLASIFDPFGNAVHTALSFDLVGEDVLVSGAGPIGIMAAAVAKHVGARNVVITDVNEYRLELARKMGITRAVNVAKENLNDVMAELGMTEGFDVGLEMSGAPPAFRTMLDTMNHGGRIAMLGIPPSDMSIDWTKVIFKGLFIKGIYGREMFETWYKMAALIQSGLDLSPIITHRFSIDDFQKGFDAMCSGQSGKVILSWD

SEQ ID NO: 67363 - protein, 133 aa, Bradyrhizobium japonicum USDA 110
MAAMKREALRVEPISSFLDRWKAPTSPVTRAGNMIFVAGLPPFDPDTGEIASAPIERQSEIIMEQMKLCLETAGASLDNVMKCNVYCTSTKHFAAFNAVYARYFPVDPPARIFVCTPEWFAPFDVEIDCIAMM

SEQ ID NO: 67364 - protein, 383 aa, Magnaporthe grisea 70-15
MLALRRVAAAAPVARQFSAAPRAAATFAFSRYYSSQGERVAKFTGKKDASGRYPVSLIEGDGIGPEISEAVKQIFEAAKAPVSWEPVDVTPILKDGRTAIPDAAIESIERNKVALKGPLATPIGKGHVSLNLTLRRTFNLFANLRPCRSVAGFKTPYDNVDTVLIRENTEGEYSGIEHVVVDGVVQSIKLITREASERVLRFAFQHAQEIGRKKVRVVHKATIMKMSDGLFLSVGQQVAKDFPGIEFDAELLDNTCLKMVTDPLPYNDKVLVMPNLYGDILSDMCAGLIGGLGLTPSGNIGDECSIFEAVHGSAPDIAGKGLANPTALLLSSMMMLRHMGLGEYADRIEKATFDTLAEGKALTGDLGGKAKTHEFAGAIISKL

SEQ ID NO: 67365 - protein, 112 aa, Pseudomonas putida KT2440
MSQELQIIDLVEGDGKAAVKGALITTQYTGWLADGSEFDSSWSRGKPFQCVIGTGRVIKGWDLGLMGMRVGGKRKLQVPAHLGYGERSVGAIPPNSDLTFEIELLEVLTRDD

SEQ ID NO: 67366 - protein, 113 aa, Zea mays
  misc_feature (46)..(46): Xaa can be any naturally occurring amino acid
MSGRGKGGKGLGKGGAKRHHKVLRDNIQGITKPAIRRLAMTGGVKXISGLIYKETRGVLKIFLENDIRDTVTYTEHARRKTVTVMDVCYTLKRQGRTLYSFSGYAPFPYDALM

SEQ ID NO: 67367 - protein, 397 aa, Xanthobacter flavus
MIAFRTLDDAVDLADKRVLVRVDLNVPMESGRVTDATRLKAILPTIRDITGKGGKAVLLAHLGRPKGRDESQSLAPVAKALEGELGRKVAFASDCIGDEAKSAVSRLASGEVIVLENTRFHAGEEKNAPDFIEALASLGDIYVNDAFSTAHRAHASTEGLARKLPAYAGRSMESEIEALTKALEAPQRPVLAVVGGSKVSSKLELLGNLVKKVDILVIGGGMANTFLAALGKKVGKSLCEHDLANTARDILKKAEAAGCEIVLPVDAVVATEFKANAAHRVTSVDDVKDDEMMLDAGPETVGIVKQKLDGAKTVVWNGPFGAFEMTPFDAATVAVARYVGDLTHKGRLLSVAGGGDTVAALNHAGTAERFSYVSTAGGAFLEWLEGKALPGVEALRR

SEQ ID NO: 67368 - protein, 464 aa, Zea mays
  misc_feature (163)..(163): Xaa can be any naturally occurring amino acid
MTPPASTSGKRAVAIDEPLLPESSAGGRHGGGASVSGAVFNVSTSIVGAGIMSIPAAMRVLGVVPAALLIAAVAALADVSVEFMLRYTGRGWGGGGKDEAATSYAGTMGDAFGRAGAALLNVFVALTTTGTLVVYLIIIGDVMSGSVGGGDEHAGVLQELFGXQWWTGREFVLLVTAVFVLLPLVLRRRVDSLRFTSAISILLAVVFMLISSGIALYALFKGTATMPRMFPDFSRLSSPFELFTAVPVIVVAFTFHFNVHPIRAELSKTSDMKVAVRVSLVLCAAIYAAVGFFGFLLFGDATMADVLANFDRSSGAGVPQALNDAARLSYALHLVLVFPLLLFSLRVNVDELLFPGRRPLAADTRRFVSLTAVLMAVLYVLAIAIPSIWTLFEYSGSTFAVTISLIFPGAIVLRDVHGIAKRKDKVLAATMIVLAVVTSSIAIASNIMSSISDEDRGGHVAGRR

SEQ ID NO: 67369 - protein, 492 aa, Mycobacterium bovis AF2122/97
MMSASWLRHRVSERGLIATAEQLWADSFRLALVAAHDDGDSLRVVYLFLAGYPDRRVELEYVVPADNPEIRSLAYLSFPAGRFEREMADLYGIRPVGHPKPRRLVRHAHWPDWHPMRTDAGPAPEFTDTGAFPFLAVEGPGVYEIPVGPVHAGLIEPGHFRFSVAGETIVRLKARLWFVHRGIEKLFHGRPATAAVDLAERISGDTSAAHALAHSLAIEDALGIELPHEIHRLRALIVELERLYNHAADLGALANDVGYSLANAHAQRIRENLLRRNAAVTGHRLLRGAIRAGGVALRALPDTDELAALAVDLAEVATLTLANSVVYDRFAGTAVLHPDDASALGCLGYVARASGLRSDARVEHPTIVLPITEIGAPDGDVLARYTVRRDEFAASAALAQHIVESHTGPIEYAATLHPVGAPSSGIGIVEGWRGTIVHRVEIDVDGRITRAKVVDPSWFNWPALPVAMADTIVPDFPLANKSFNQSYAGNDL

SEQ ID NO: 67370 - protein, 108 aa, Ashbya gossypii ATCC 10895
MSMSLMRPTTAPSEGEAPKKKFQIKKWIAVAFWSWDIAVENCAICRNHIMEPCIQCQPNAMTDTENECVAAWGTCNHAFHLHCINKWLLTRNACPLDNKTWQFAKYGK

SEQ ID NO: 67371 - protein, 494 aa, Bacillus clausii KSM-K16
METIGALAKKAMLQHADNVAVSDEDGTLTYGQLKKRACQLAHALLQSGLNKGDRVATLMSNRKEHIEIDAAIAFAGLVKVPVNYRLHPKEATYIIEHAGAGVVIGERQLLAGLSANVERIDVEEAYEPFLQMQSDDFPDVAVGEDDLFAIMYTSGTTGKPKGAMLTHRNMIAGALSLIQACEITYGDTIGHVAPLTHGTNFLAQTAWFYGLKQVVFKKFEPSGFIDELEKQQVTVMFMVPTLVNLMVHDPCFDPVKLRSLKSINMAGAPIAVPKLQKALTALGPKLAETYGLVEAPMAITIMPKQQLGARPSSCGATGPFAEVKIVAPDGEEAPVGDIGEVACRGSLVMKGYWQNETATAEAIKDGWFYTGDLGRLDDKGYLHLMDRAKDVIITGGLNVYPREVEEVLNQYPAVKETCVFGAPDEKWGERICAHVVLQAGAAPVTEAALIAHCTEHLARYKKPKVIEFVHELPKNSYGKIMRKTLRNQYKKAGV

SEQ ID NO: 67372 - protein, 509 aa, Zea mays
MIANGLRKSSAASSQVSKLVKYIASAGSLQGGHSLSEPSARHYSSEPSLQATEENGFKGHSMLAPFTAGWQSTDVHPLVIERSEGSYVYDSNGKKYIDALAGLWCTALGGNEPRLVKAATEQLNKLPFYHSFWNRTTKPSLDLANDILSMFTAREMGKVFFTNSGSEANDSQVKLVWYYNNALGRPDKKKFIARSKSYHGSTLIAASLSGLPALHQKFDLPAPFVLHTDCPHYWRFRLPDETEEEFSTRLANNLENLVLKEGPETIAAFIAEPVMGAGGVILPPKTYFEKIQAVLKKYDILLIADEVITAFGRLGTMFGCDMYNIKPDLVSIAKALSSAYMPIGAILVSPEITDVIYSQSNKLGSFAHGFTYSGHPVSCAVAVETLKIYKERNIVEHVNKIAPRFQERIKAFSGSPIVGEIRGLGLILGTEFVDNKSPNDPFPAEWGVGSIFGAECEKRGMLIRVAGDSIMLSPPLIMTPNEVEEIISKFGDALKATEERIGELKSRKN

SEQ ID NO: 67373 - protein, 332 aa, Acinetobacter sp. ADP1
MNSLNTNNEFSLQELQKESVMGVMGTETQREVRVIDLSDFEQRKYEIADQLWDAAVEIGFFQVSHHGIPQQDIEHAFGLAEQFFALPREVKAQYPLKRNSGWESKAQIRPSTKTPDQKESYQVTRPRMTGLWPTQQELPDFKEQVLNFESQCWSVGMKILSCFAYKMGFSEDFFTLAHDPSKETYQSTLRMLHYYAVDPAFKDELGLWRAGAHTDFDCLTLLFQQKGQGGLQVCPGKEMENRAWTSIEPREDVITCNIGDMLMRWSDDVLPSNFHRVKNPADHEYQGARYSLAFFCQANEDVLIQSPKGKYPDITAKDYLAQRVSANFSGKY

SEQ ID NO: 67374 - protein, 201 aa, Prochlorococcus marinus subsp. pastoris str. CCMP1986
MSSKLRVGVAGPVGSGKTALVETLCIALKKRYKIAVVTNDIYTKEDANFLIKKKILEEGRIVGVETGGCPHTAIREDCSLNKNAVMDLENKYDPLDFIFVESGGDNLAASFSPELVDLSIYVIDVSAGDKIPRKGGPGITRSDLLLINKIDLADMVGANLNIMQNDTNMMRDGKPWFFTNLSSGSGVDNVIKYLVAQIPNI

SEQ ID NO: 67375 - protein, 892 aa, Oryza sativa (indica cultivar-group)
MVSSRFVAVFLLVALAPAARGQGGGGGNSSAPAASPPGPFVPRDNILLDCGATGQANDTDGRLWTGDTGSKYLPANLAAAAATAQDPSVPQVPYLTARFSAAPFTYSFPVGAGRKFLRLHFYPANYSNRNAADALFSVSIPDPNITLLSNFSAYQTALALNFDYLVREFSVNVTASTLDLTFTPEKGHPNAFAFVNGIEVVSSPDLFGSSNPMEVTGDGSGTPFPIDAGTAMQTMYRLNVGGNAISPSKDTGGYRSWEDDTPYIPFASFGVSYANDTNVPINYPDSIPQYVAPADVYSTARSMGPDNNVNLQYNLTWAMQVDAGYQYLVRLHFCEIQSGISKINQRTFDIYINNQTAFSGADVIAWSTGLGIPVYKDFVVFPMGSGPMDLWVDLHPNVKNKPQYYNAILNGMEVFKLQLTNGSLAGLNPVPSIVPTASGGNSGKKSSVGPIIGGVIGGLVVLALGCCCFFVICKRRQRAGKDSGMSDGHSGWLPLSLYGNSHTSSSAKSHTTGSHASSLPSNLCRHFSFVEIKAATNNFDESLLLGVGGFGKVYRGEIDGGATKVAIKRGNPLSEQGVHEFQTEIEMLSKLRHRHLVSLIGYCEEKNEMILVYDYMAHGTLREHLYKTQNAPLSWRQRLDICIGAARGLHYLHTGAKHTIIHRDVKTTNILLDEKWVAKVSDFGLSKTGPTMDHTHVSTVVKGSFGYLDPEYFRRQQLTDKSDVYSFGVVLFEVLCARPALNPTLAKEEVSLAEWALHCQKKGILDQIVDPHLKGKIAPQCFKKFAETAEKCVSDEGIDRPSMGDVLWNLEFALQMQESAEDSGSIGCGMSDEGTPLVMPGKKDPNDPSIESSTTTTTTTSISMGEQSVASIDSDGLTPSAVFSQIMNPKGR

SEQ ID NO: 67376 - protein, 141 aa, Ralstonia solanacearum GMI1000
MAIERTLSIIKPDAVAKNVIGQIYARFEGAGLKVVAAKMIHLSRAEAEQFYAVHKERPFFKDLVDFMISGPVMVQALEGESAIVKNRDLMGATDPKKAEKGTIRADFADSIDANAVHGSDAAETAAVEVAFFFPGLNIYSR

SEQ ID NO: 67377 - protein, 347 aa, Prochlorococcus marinus str. MIT 9303
MAVVCRRITASSRTYSLSALTRCLQEEAAAIAVAAERLSSSQVEKALVLLERCGDQRAKLVITGVGKSGIVARKIAATFSSIGLMALYLNPLDAMHGDLGVVAQEDVCLLLSNSGETAELLEVLPHLKRRGTARIALVGKPDSSLARGSDVVLEASVDREVCPLNLAPTASTAVAMAIGDALAAIWMERRNISPADFAFNHPAGSLGKQLTLTASDLMVPVAKVQPLQPNTSLQDVICKLTQDGIGSGWVEDPSTAGLLLGLITDGDLRRALRDHSAENWASLSAADLMTADPITVDADLLAVEAIKQMECNRRKPISVLPVVGPDSSGNLLLGLLRLHDLIQAGLT

SEQ ID NO: 67378 - protein, 520 aa, Mycoplasma hyopneumoniae 232
MLQERSKMTKKCYITTPIYYASGRLHIGHLYTTVLAWVIRNFKKMSGFEARLFTGSDEHGQKISQLAAKANLEPQEFVDKNVENFKFLWEKFEIDYDYFQRTTNLNHKNFIKKIFLKMYEDNHIFNGEYQGLYSISDEEFLSQSQAVYQNRNYFHPVSGAKMELISEKSYFFPIKKFQKWLEDFLLENPKFIFDSKIANELRQNFLQKGLEDLSVTRKNLKWGIFLDQKFENQTIYVWLDALFSYLSVFKDQIDLENPKKSNFWTDSAQIIQVVGKEIARFHCIYWPIFLKSLNFRLPSIILTHGWLITPEGKMSKSKGNVINPLDLLKKFDPEIIKFYFVSQINTKNDSVFDENLLENFYNSFFVNTFGNLISRTIALIVKKFDQPLLFEIADLDWTDISFYEKILLSLDEFCDNFDQLEIEKAFKTVIELTKNLNGFFDIKQLWNQKNLKKLAQGLILVLNGIYAITVFLSIAMPKKTNEILEFLGINEKNFLLITKLDKFDKINFKKLEKPFFPRKN

SEQ ID NO: 67379 - protein, 520 aa, Aspergillus nidulans FGSC A4
MAKVDQKVVLIVIDGWGVAGPNSPKEGDAIAAAETPFMSGFAEENSKTAQGYTELDASSLAVGLPEGLMGNSEVGHLNIGAGRVVWQDSVRIDQTLKKGELNKVENIAASFKRAKDGNGRLHLLGLVSDGGVHSNITHLIGLLKVAKEMEIPQVFIHFFGDGRDTDPKSAAKYMQQLLDATKEIGVGEIATVVGRYYAMDRDKRWDRVEIAIKGILSGEGEESSDPVKAIEKRYTEDETDEFLKPIIFGGKDRRVQDDDTLFFFNYRSDRVREITQLLGDYDRSPKPDLPYPKNIHITTMTQYKTDYTFPVAFPPQHMGNVLAEWLGKKDVQQCHVAETEKYAHVTFFFNGGIEKQFPGEVRDMIPSPKVATYDLEPEMSAEGVGKKVEERIAEGKFEFVMNNFAPPDMVGHTGVYEAAIKGVAATDKAIGIIYEACKKHGYTLFITADHGNAEEMLNEKGTPKTSHTTNRVPFIMANAPEGWSLRKQPGVLGDVAPTVLAAMGIEQPKEMSGESLLVKA

SEQ ID NO: 67380 - protein, 53 aa, Arabidopsis thaliana
QHSKVSPTKLSSATMVSSPAQATRVAPFMRLKSAAAFRATRKANNDIASSTIN

SEQ ID NO: 67381 - protein, 322 aa, Oceanobacter sp. RED65
MSFNYIESIQRTIADERDAVDQLLKNLNHEALNTACDLLLNCQGRIVVTGMGKSGHIGNKIAATLASTGSPAFFVHPGEAAHGDMGMITEQDVVIALSNSGESSEVTTLIPLLKRLNVPLISMTGNDTSTLATGADSHINVGVEKEACPLDLAPTSSTTVALVMGDALAIALLEARGFTAEQFAFSHPGGSLGRKLLLKVKTIMHCGSQIPQVKPDTLVKDALIEMTQKGLGMTTVIDEHGQLSGIFTDGDLRRTLDKDIDFHTTPVQAVMTTGVTTIDPERLAAEALQVMEEKKINALVATENGKVAGVINMHDLLRAGVI

SEQ ID NO: 67382 - protein, 368 aa, Rhizobium leguminosarum bv. viciae 3841
MKIHAAVARAPHTPFSLERLDLEEPREGEILVRVVATGVCHTDIVMRDQHLPVPQPVVLGHEGAGIVERVGPGVAKVKPGDHVVMTFNSCGHCPSCNDHQETYCHEFFPRNFFGARADGSSGLSCEGVRVHGNIFGQSSFASHALCHERNIVKVPEDADLALLGPLACGIQTGAGAVMNALKVEPGKVLAVFGMGSVGLAAVMAARIVGASRIIAVDVNETRLALAAELGATDIVNGKASDAVAAIMALTGAGVDYSIDASGVPAVIDQCVRVLAPRGTCGIVGASPHGATLTLDLTHILSGGRRVRGIVEGDSNPDVLIPLLIDLHRQGRFPFDRLITFYDFADINQAVEDSEKGIVLKPVVRQPAV

SEQ ID NO: 67383 - protein, 538 aa, Phanerochaete chrysosporium
MLVSVDALALRTLVYELTYLLYPAVPTAAALILLQRFGNVWLPTWTIVLLSLCNVPVAHRILVWLKDGRRWPGSIDLLRQLTQTFETGFLSEMLWGYMHVLGQTFEVYILWDSNYVTSDANVIKTILATDFDNFVKGEKLDVCVRPVLGTGVFNSDGEMWKFHRSMTRPFFTRERISHFDLFDRHADATMAKMKARLAEGFAVDFQDLISRFTLDSATEFLFGQCTTGASRTEDFARAFAEAQDAVSFRLRMGWLWPDAVARADKIKRENGGRVPEVKGEIEEDETLLDHLVNVVQTKILHDEVLNIMIAGRDTTGGTLTSAVYFLSQYPEVLRRLREEILEKVGPTRRPTYDDIREMKYLRAFINETLRLYPAVPWNVRYPVKDTTIPGPHPDKPYFIPANTPVSYSVHCMHRRTDYWGPDAEAFDPDRFLDARVQRYLTPNPFIFLPFNAGPRICLGQQFAYNEMSFFVIRLLQHFDEVQLCEDALAPDCRVPDAWRGAPGRKGVERFWPKAHLTLYAKGGLWVKMREASTSEAVV

SEQ ID NO: 67384 - protein, 351 aa, Synechococcus elongatus PCC 6301
MTDATPLLGRSLPELQDWVVAQGQPSYRAKQLYQWLYERSIHNLAEISVFPKAWRQSLQAVPVGRSQIVDRSVSPSGSIKYLLRLHDGEIIEAVGIPSGDRLTVCVSSQLGCAMACDFCATGKGGFRRHLAPHEIIDQVLTVQEDWQQRVSNIVFMGMGEPLLNLDAVLAAIRCLNQDIGIGQRGITVSTVGIPGHIRRLAETKRVGDRPLQFTLAVSLHAPNQAIRDRLIPSSRHYPITDLLQECRDYVQITGRRVTFEYILLAGLNDQPEQAEQLAQLLRGFQSHVNLIPCNPIDEVEYQRPSKARVDAFADALRQQRVAVTVRWSKGLGADAACGQLRANRSTATLPA

SEQ ID NO: 67385 - protein, 557 aa, Emericella nidulans
MSVQTVSIQPFGDQKPGTSGLRKKVKIFQQENYTESFLTSIFLSIPEGAQDAFLVIGGDGRYYNSDVIQKIAKIGAAYGVKKLIVGQNGILSTPAASNLIRKRKATGGILLTASHNPGGPDNDFGIKYNLTNGAPAPEQVTNKIYEVSKSLTSYKYIDLPEVDTTTVGTRSYGPLEVEVVHSTEDYVSMMKEIFDFDLIRSFLKKHPDFKVLFDGMHGVTGPYGIDIFVNELGLPSSSTMNCIPKPDFGGGHPDPNLVYAHELVEAVDKNGIHFGAASDGDGDRNMIYGANTFVSPGDSLAIIAHHAKLIPWFQKHGVDGLARSMPTSGAVDRVAKAQGLQSYEVPTGWKFFCNLFDNKKMSICGEESFGTGSNHIREKDGVWAIVAWLNVIAGVAEQKPNETPSIASIQAEFWETYGRTFFTRYDYENVDSDGANKLIAALSEKAESTTRAHLLAAPSLGRKVVDSGNFAYTDLDGSVTKNQGLYVKFDDGSRLVVRLSGTGSSGATIRLYVEKYEGDKSKYQMATQDYLKDNVGLALELLKFKEFVGREEPDVKT

SEQ ID NO: 67386 - protein, 279 aa, Campylobacter jejuni RM1221
MQNILSSFTQEKNVCVFTNTLKISIEELEKEFLKQKLKFKKINAYCYLFDAKDKAILSSMKVFNEAHFYIQNYSSYLCALNLEVKAGQRVLDMCAAPGGKSINLANFMQNTGYLACNEMSRDRFFILQKNLKNYGVNAKVFMKDGKNIGNLCPLKFDKILLDAPCSTFAKIGFDLEKSYKEIKNIAKTQKKLLHSALKALKIGGELVYSTCTFTKEENEEVIENALKSEFKLELLDIDLENVEAKAGQSEEFAEISKCRRILPSLDYDGFFIAKLRKLC

SEQ ID NO: 67387 - protein, 302 aa, Paracoccidioides brasiliensis
MTSERESKTFLARLCEQAERYDEMVTYMKEVANLGGELTVDERNLLSVAYKNVVGTRRASWRIISSIEQKEDSKGSEKHVAIISEYRQKIETELERVCQDVLDVLDQSLIPKAESGESKVFYHKMKGDYHRYLAEFASGNKRKVAATAAHEAYKNATDVAQTELTPTHPIRLGLALNFSVFYYEILNSPDRACHLAKQAFDDAIAELDSLSEESYRDSTLIMQLLRDNLTLWTSSDGAEPEPVAAGDGKDDKTAEGEEGPATATTTDAPAPEEVAAPAAADEEPKKEGTNGVLKYGFKKNLF

SEQ ID NO: 67388 - protein, 403 aa, Acinetobacter sp. ADP1
MERIVVVGAGQAAGWAVSTLRQEGFQGEIHVVSNEHQIFYERPPLSKQVLSKEASYDSLNLFSPEQIDAFSVQWHKPDLATQIDRDHKQVILESGKILPYDKLLIATGSRARVPVNTWKDISNVVTLRDVQDCERLANLLETAKSIAIIGGGWIGLEIAATARKQGKQVHVFEYAERLCGRSVSPEVSEFLKEIHEQQGTKIHLNSKNLHLIESSDQTVQVLNHPETAQTFDCVVVGAGAEIAKELGVSAGLAVKDGIVVNCYGQTSDVDIYAAGDVAIHPVLGYCIQSWANAQNQAIAAAKSMLGVATEYSDIPWLWSDQYQFNIQILGTYQAQSNPKLIIRQSSPAQLSYLYLDEHNRLMNLIAVNDAKLVKLAKRWIQNSTVLDPKLLADPEFNVMKLKP

SEQ ID NO: 67389 - protein, 793 aa, Kluyveromyces lactis NRRL Y-1140
MSVIYRGTHSEESDGRASDSSSLSQIQLQITVKNENTISLEKDIKEEELVNESEFHDSESIDEDDGLVWKGDPTYLPNSPYPDVRFAVSIEDDPTIRLNHWRTWFLTTIFVVVFAGVNQFFSLRYPSLSIDFIVAQVICYPIGKVLAKLPDWKCRRVPFFDLNPGPFTKKEHAVVTIAVALTSSTAYAMYILNAQGSFYNMKLNVGYQFLLVWTSQMIGYGAAGLTRRWVVNPASAIWPQTLISVSLFDSLHSRKIERAVVNGWSMPRYKFFVIVFIASFVWYWVPGFLFTGLSYFNVILWGPKTRDNFVANTIFGVESGLGAFPISFDYTQISQAMSGSVFATPFYVSANTYASVLLFFVIILPCLYFSNTWYAKYMPVISGSTYDNTQSKYNVTKILNEDYSINLEKYKNYSPIFVPFSYLLSYALNFAAVIAVFVHCILYHGKDILAKLKDRRNGGTDIHARIYSKNYADCPDWWYLVLQVVMIGLGFVTVCAFDSKFPAWAFVIAILISLVNFIPQGILEAMTNQHVGLNIITELICGYMLPLRPMANLLFKLYGFIVMRQGLNLSRDLKLAMYMKVPPRLIFFIQIYATILSGMVNVGVQEWMTHNIEGICSTDQSNGFTCANGRTVFNASIIWSLPKYLFSPGRIYNPLMWFFLIGLVVPLIVYAIQRKFPKIQFAKYIHTPVFFTGPGNIPPSTPYNYSLFFSASFCLHIIRKRWGPWFKKYNYVMGAAVESGVAIAVVIIFLCVQFPGAELNWWGNNVWKNTYDHNYKKFYTLEEGQTFGHTKWW

SEQ ID NO: 67390 - protein, 551 aa, Gibberella zeae PH-1
MSAEAPAQDAPQQESRARKDSFSGKSQTSETSQTAAEFIRSQEALEADAREALPYSIDTCTKILGPLRQAVFACLTCNPPPAKEGDDWTPAGVCYACSIQCHGEHNLVEIFQKRNFTCDCGTKRIPSTSPCTLRLNEATNTRGGVHSEEPDVNNKYNHNFCNRFCGCHCDYDPFQQKGTMFQCLGLGTVETGGCGEDWYHPGCLVGMGPNWFEKMEKPKKTAPENNEEGKLTTIAEGNEEKQDPAQTAGQDKEKAAENAVEADEDEDEDVPMPPGFPEEDAFEAFLCYKCVEAHPWIKRYAGTSGFLPAVFLNQPDSEPKKEPESAKEESVHTTETAVAAEGGQDSRKRKADDDVEEPTDIKRIKSESQSGDEKPAEETTPTDKLPCKLKNLPPAPQGQFSLFLKEDFREAFCRCSSCYPHLNPHPQLLEEEEVYEPPLSDGGSQVDGDGGGSHGSGSLLERGESALRNVDRVRAIEGVMAYNHLKEQLKPFFQQFAESGQAIGAEDIKAYFAKLRGDEKGIEEAAAGAKDGEGSGSGSGDGDNRKEQSGF

SEQ ID NO: 67391 - protein, 794 aa, Kluyveromyces lactis NRRL Y-1140
MNHIKSVLSADAPVTEKVLLDVGQERSFINSSDDNLNLEDKKRGLEVNVFAARSDYLLGSQLSHEVIEDEYAGIVVEDDSAYPEVRAAVPSSDDPTLPQNTVRMWVIGMLMATVGSGLNLLFSLHSPSIVLSAFVTSILAWPIGKAWDKVMPDVKLFGRFGGPSLNPSPFNLKEHCLIQIMANVSFGGGEAYATDIFLAMNNYFEADFGWGFDIVTILATQCIGFALAGLVKDILITPASMIWPSNLVTCTFLTNLHINENHMANGWKISRLKFFFMVFIIGFVYYWFPGFIFQALSYFAWVTWIRPDNVIINQIFGASTGLGIIPLTFDWNQIAGYVGSPLVPPVSTIFSILLSMIMIFWVTVPAIHYSNVWFGKYLPISDSGSYDRFQQSYNVSKIVTPNLSFDIDAYKSYSPLYLPATFVISYGMSFASNTATLVHAGLFHGKEITGAFRNVKKEQEDIHNRLMKNYRDVPHWWYGIVFLVFFGLAIAGIRAWNTEMPVWALIFALVIAGVFLVPIGIICAVTSISVGLNVLTEFIIGYILPGKPIAMMFFKTFGYITNHQAVTYAQDMKLGHYMKIAPRLMFSAQFIATVWSSVVQVCVLKWAQGNITDVCDAHQKSHFTCPNARVFFNAAIIWGVIGPQRMFSSGQLYSKVLWFFLIGASLPLINWLVLKKWPKSPIKYLNWPVFFSGTGLIPPATPYNYGSYCMVGITFGYFIKRKWFHWWTKYNYSLSAALDISLAWSSLMIFFCLTLTNTNAPNWWGNTVIDTIDYEGTAIQSILNDGESFGLTKW

SEQ ID NO: 67392 - protein, 270 aa, Gibberella zeae PH-1
MAERNLSQIISQLKHSPSMSYTDANALLSKAKLALLKLNALTPSPSTPTQLLPLARETYEQGALFAIRARNPEAFTRYVQQLQPFYELPASVLPPNLLERNKVTGLSLLLLLTQGRYAEFHTELESLENREGGGGDVESDRYLGYPIRLERWLMEGSYDRVWKAMKSSEVPCDEYSVFSEILKNQIRSEIASSSERAYPSLPISSTKSLLFLDSEGDVISFAHHRGWIVRDGHIYFPDAAEGENGDQNKEMSQMVIENALGYARELETIV

SEQ ID NO: 67393 - protein, 303 aa, Triticum aestivum
MAHVLAAAEPLTLLKRPPPQNDGFGDDNGSTEEKAPKARRRESDPAAALAAARHGFGEHGGVNMSKLVVDNTFTPVVVSPARLGADIVVHSVSKFISGGADIIAGAICGPASLVNSMMDLQDGALMLLGPTMNAKVASELAARLPHLPLRMQEHSRRAAEFAARMRRQGLRVTYPGLPDHPHHARLRAMGNPGYGAGGMLCLDMGTEERANRLMYHLQNTTQFGFMAVSLGFYDTLMSCSGNSTSSEMDPEDRARAGISPGLIRMSVGYNGTLEQRWAQFERALALMQQQDTPAAAAKYGKPV

SEQ ID NO: 67394 - protein, 137 aa, Arabidopsis thaliana
  misc_feature (53)..(53): Xaa can be any naturally occurring amino acid
ARNPGGAHRGPNRAKEEGNHQEVVWVSFMLSSAVGVTSPVKATMVVQLTGWKXSVEFPATRRTNRAIISIEGNGGGVSCLKGWPPIGKKKLGTLFNLPDLRDVKLVKEVDYLFRTRGIPGVEFKLKHGFGYRGHGTT

SEQ ID NO: 67395 - protein, 491 aa, Ralstonia eutropha JMP134
MSLTLANAALLRSQNFINQQWRDAGLGRRLAVANPATGEVFAHVPDSDDDDAGRAADAAAEAFPAWSARPARERAQLIKRWHALILANQEDLARIISTEQGKPLKEARGEVLYGASYVEWFAEEATRICGDIVAEAVPGRKLLVLKEPVGVVAAITPWNFPLAMIARKIAPALAAGCTVVAKPAEDTPLTALALVWLAEQAGLPAGVLNIVTASRESTPNVVDAWLADSRVRKITFTGSTPVGKHLARESAGTLKKLSLELGGNAPFIVFEDADLDAAVDGLMASKFRNGGQTCVCPNRVYVHESVHDDFVERLARRVGALHVAPATDENAQIGPMINARAVDKIARHVEDAVAKGARVVTGGRRVRTADGPHYYAPTVLIDATPAMELACEETFGPVAPVFRFRDESEVIRDANDTPFGLAAYFYSNDVRRIWRVAQALETGMVGINEGAIAAEAAPFGGVKESGYGREGSRHGLDDYMHTKYLCQGQLG

SEQ ID NO: 67396 - protein, 191 aa, Erwinia carotovora subsp. atroseptica SCRI1043
MSKKVAVLLAPGFEEAEAIMVIDVLHRMKIEVTMLSCHDRLELHSYHNIRMFADALLERNQDTLFDAVVIPGGPQGTVNLAANPMVVEFIRRHDDAGKLICPLCSAAARVLGGNKLLKGRRYVCSGDLWQDVTDGVYVNEKVVEDGNLISGKGLGVSFDFAFTIATRLTGDKEDANFQVEHIDYDYWRVPA

SEQ ID NO: 67397 - protein, 326 aa, Oryza sativa (japonica cultivar-group)
MAHFQGQQHGHPAARVDEYGNPVAAGHGITGTQEAGAGGYGAAGNVAQPQHAFGGATDAGGYGRQAGYGATGTGTHDAAGYGGSGQPAYGATGTGVHDAGGLMPGHTAGHGTTGTGVHHGAGAGLPAGQTAGYGTTGVTGAQHGAGGLGTGHTAGYGTTGAHHGAGGLGTRHMAGHGATTTPDTMAYGTTGTGAPHGATAGTGAYPHAGGQFQPAREEHKTGGILRRSGSSSSSSSSEDDGMGGRRKKGIKEKIKEKLPGGNKGGQQQPTATAATGGYGAGTGHTAAAGTTTDAGGTAYTPTTQPTHEKKGMMEKIKEKLPGGGHH

SEQ ID NO: 67398 - protein, 168 aa, Glycine max
ITQRKEEMSEAAATTTSSSMMRNYPLISAIVAFAIAQFIKFFTAWFKEKRWDPKQLVGSGGMPSSHSATVTALAAAIGFHEGFGGPLFATALVLACIVMYDATGVRLQAGRQAELLNQIVYELPAEHPLAESRPLRELLGHTPPQVVAGGILGLITAGIGYLITMASS

SEQ ID NO: 67399 - protein, 379 aa, Aubrieta deltoidea
MSTTGQIIRCKAAVAWEAGKPLVMEEVEVAPPQKHEVRIKILFTSLCHTDVYFWEAKGQTPLFPRIFGHEAGGIVESIGEGVTDLAPGDHVLPIFTGECGDCRHCHSEESNMCDLLRINTERGGMIHDGESRFSIDGKPIYHFVGTSTFSEYTVVHSGQVAKINPEAPLDKVCIVSCGLSTGLGATLNVAKPKKGQSVAIFGLGAVGLAAAEGARIAGAGRIIGVDLNPKRFEEAKKFGVTEFVNPKDHEKPVQQVIAEMTDGGVDRSVECTGSVQAMIQAFECVHDGWGVAVLVGVPSKDDAFKSHPMNFLNERTLKGTFFGNYKPKTDIPGVVEKYMNKELDIEKFITHTVPFSEINKAFDYMLKGEGIRCIITMGA

SEQ ID NO: 67400 - protein, 246 aa, Ralstonia solanacearum GMI1000
MPTAVSDAAAPAQARAWIEAAERVMVLTGAGVSAESGVPTFRDALTGLWARFNPEDLATEAAYREHPRMVWDWYQERRARVSQVQPNPAHLAIAALATRKTVALVTQNVDGLHQRAGSVGVIELHGNLFANKWLDGCGKCDVATAEPGRPPRCAACGAMLRPGVVWFGERLPVVANYRAEEAANTCDVCLVVGTSGMVYPAAGLPGLAKDHGARVIVVNPEPSVLDETADLVIHQPAGVCLPAMLA

SEQ ID NO: 67401 - protein, 379 aa, Arabis alpina
MITTGQIIRCKAAVAWEAGKPLVMEEVEVAPPQKHEVRIKILFTSLCHTDVYFWEAKGQTPLFPRIFGHEAGGIVESVGEGMTDLAPGDHVLPIFTGECGDCRHCHSEESNMCDLLRINTERGGMIHDGESRFSIDGKPIYHFVGTSTFSEYTVVHSGQVAKINPEAPLDKVCIVSCGLSTGLGATLNVAKPKKGQSVAIFGLGAVGLAAAEGARMAGAGRIIGVDLNPKRFEEAKKFGVTEFVNPKDHDKPVQQVIAEMTDGGVDRSVECTGSVQAMIQAFECVHDGWGVAVLVGVPSKDDAFKTHPMNLLNERTLKGTFFGNYKPKTDIPGVVEQYMNKELEVEKFITHTVPFSEINKAFDYMLKGEGIRCIITMGA

SEQ ID NO: 67402 - protein, 379 aa, Arabis alpina
MITTGQIIRCKAAVAWEAGKPLVMEEVEVAPPQKHEVRIKILFTSLCHTDVYFWEAKGQTPLFPRIFGHEAGGIVESVGEGMTDLAPGDHVLPIFTGECGDCRHCHSEESNMCDLLRINTERGGMIHDGESRFSIDGKPIYHFVGTSTFSEYTVVHSGQVAKINPEAPLDKVCIVSCGLSTGLGATLNVAKPKKGQSVAIFGLGAVGLAAAEGARMAGAGRIIGVDLNRKRFEEAKKFGVTEFVNPKDHDKPVQQVIAEMTDGGVDRSVECTGSVQAMIQAFECVHDGWGVAVLVGVPSKDDAFKTHPMNLLNERTLKGTFFGNYKPKTDIPGVVEQYMNKELEVEKFITHTVPFSEINKAFDYMLKGEGIRCIIAMGA

SEQ ID NO: 67403 - protein, 379 aa, Arabis alpina
MITTGQIIRCKAAVAWEAGKPLVMEEVEVAPPQKHEVRIKILFTSLCHTDVYFWEAKGQTPLFPRIFGHEAGGIVESVGEGMTDLAPGDHVLPIFTGECGDCRYCHSEESNMCDLLRINTDRGGMIHDGESRFSIDGKPIYHFVGTFTFSEYTVVHSGQVAKINPEAPLDKVCIVSCGLSTGLGATLNVAKPKKGQSVAIFGLGAVGLAAAEGARMAGAGRIIGVDLNRKRFEEAKKFGVTEFVNPKDHDKPVQQVIAEMTDGGVDRSVECTGSVQAMIQAFECVHDGWGVAVLVGVPSKDDAFKTHPMNLLNERTLKGTFFGNYKPKTDIPGVVEQYMNKELEVEKFITHTVPFSEINKAFDYMLKGEGIRCIITMGA

SEQ ID NO: 67404 - protein, 379 aa, Arabis alpina
MITTGQIIRCKAAVAWEAGKPLVMEEVEVAPPQKHEVRIKILFTSLCHTDVYFWEAKGQTPLFPRIFGHEAGGIVESIGEGVTDLAPGDHVLPIFTGECGDCRYCHSEESNMCDLLRINTDRGGMIHDGESRFSIDGKPIYHFLGTSTFSEYTVVHSGQVAKINPEAPLDKVCIVSCGVSTGLGATLNVAKPKKGQSVAIFGLGAVGLAAAEGARMAGAGRIIGVDLNPKRFEEAKKFGVTEFVNPKDHDKPVQQVIAEMTDGGVDRSVECTGSVQAMIQAFECVHDGWGVAVLVGVPSKDDAFKTHPMNLLNERTLKGTFFGNYKPKTDIPGVVEQYMNKELEVEKFITHTVPFSEINKAFDYMLKGEGIRCIITMGA

SEQ ID NO: 67405 - protein, 287 aa, Arabidopsis thaliana
MSQFASGSTEVPAFSSQLSEEGSDLEGSEDEVKPKQSISRKKWTAKEDIVLVSAWLNTSKDPVIGNDQQGQSFWKRIAAYVAASPSLDGLPKREHAKCKHRWGKVNKSVTKFVGCYKTTTTHKTSGQSEDDVMKLAYEIYFNDTKKNFTLDHAWRELRYDQKWCEATSRKGDKNAKRKKCGDGNASSQPIHVEDDSVMSRPPGVKAAKAKARKSATIKEGKKPATVKDDSGQSVEHFQNLWELKEKDWDRKEKQSKHQQLERLLSKTEPLSDIDLFLKNKLITDLWS

SEQ ID NO: 67406 - protein, 379 aa, Cardamine amara
MITTGQIIRCKAAVSWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRKNTDRVGMIHDGVSRFSINGKPIHHFLGTSTFSEYTMVHSGQVAKINPEAPLDKVCIVSCGLSTGLGATLNVAKPKKGQSVAVFGLGAVGLAACEGARMSGASRIIGVDLNPKRFEEAKKFGVTEFVNPREHDKPVQQVIAEMTNGGVDRSVECTGSVQAMIQAFECVHDGWGVAVLVGVPSKDDAFKTHPMNFLNERTLKGTFFGNYKPKTDIPGVVEMYMNKELEIEKFITHTVPFSEINKAFDYMLKGESIRCIITMGA

SEQ ID NO: 67407 - protein, 379 aa, Arabis blepharophylla
MITTGQIIRCKAAVAWEAGKPLVMEEVEVAPPQKHEVRIKILFTSLCHTDVYFWEAKGQTPLFPRIFGHEAGGIVESVGEGVTDLAPGDHVLPIFTGECGDCPHCHSEESNMCDLLRINTERGGMIHDGESRFSIDGKPIYHFVGTSTFSEYTVIHSGQVAKINPDAPLDKVCIVSCGLSTGLGATLNVAKPKKGQSVAIFGLGAVGLAAAEGARIAGASRIIGVDLNSKRFDEAKKFGVTEFVNPKDHDKPVQQVIAEMTDGGVDRSVECTGSVQAMIQAFECVHDGWGVAVLVGVPSKDDAFKTHPMNFLNERTLKGTFFGNYKPKTDIPGVVEQYMNKELEIEKFITHTVPFSEINKAFDYMLKGEGNRCIIRMGA

SEQ ID NO: 67408 - protein, 379 aa, Arabis blepharophylla
MSTTGQIIRCKAAVAWEAGKPLVMEEVEVAPPQKHEVRIKILFTSLCHTDVYFWEAKGQTPLFPRIFGHEAGGIVESVGEGVTDLAPGDHVLPIFTGECGDCPHCHSVESNMCDLLRINTERGGMIHDGESRFSIDGKPIYHFVGTSTFSEYTVIHSGQVAKINPDAPLDKVCIVSCGLSTGLGATLNVAKPKKGQSVAIFGLGAVGLAAAEGARIAGASRIIGVDLSSKRFDEAKKFGVTEFVNPKDHDKPVQEVIAEMTDGGVDRSVECTGSVQAMIQAFECVHDGWGVAVLVGVPSKDDAFKTHPMNFLNERTLKGTFFGNYKPKTDIPGVVEMYMNKELEIEKFITHTVPFSEINKAFDYMLKGEGIRCIITMGA

SEQ ID NO: 67409 - protein, 253 aa, Synechococcus elongatus PCC 6301
MSFSDHFSAVAASYAKARPRYPQRWFRYLARIVPDRQRVWDCATGNGQAAIALAEYFSEVIGSDASAAQVRQARSHPRVQYLVFPAEATPLAPASLDLITVAQAAHWFDLPQFYIEAQRLLRPGGVIALWGYGLGSLNPAIDHVFNHFYRDWLDPYWPPERQWVEQAYEGLSFPFEPLPTPTFSMQCDWTLFDLLAYLRTWSGVQQFQRQRGFDPVWAIAPELQRVWGDPQRYRRITWPLFAKVGRWQPDRVR

SEQ ID NO: 67410 - protein, 107 aa, Triticum aestivum
MAKLMCLCFIILTIAVAVSADECEGDRQAMIKECAKYQKWPANPKLDPSDACCAVWQKANIPCLCAGVTKEKEKIWCMEKVAYVANFCKKPFPHGYKCGSYTFPPLA

SEQ ID NO: 67411 - protein, 307 aa, Triticum aestivum
MATLRPLTVEDVLRVNGSRRFAAALAAASPFDSLADALLAARRIWLNEVDVTGWLEAFAAHPPIGTTSSSVSKWSKEEQSAALSTATDSTAQELSEWNAKYREKFGFVFMICASGRTAPEVLAELKRRYANRPIVELEAAAEEELKITELRLAKLFSAETAAPPTSGENHISQPDKAAGSSNRTRPPITTHVLDTALGSPAAGIEVHLEMWKDASSPPSFDNKEFKGWTTLGTSITNNDGRSGQLMDIVDNVAPGFYRISFNTSKYAPSGFFPYVSIIFEIKRSQTTEHFHVPLLHSPFSFTTYRGS

SEQ ID NO: 67412 - protein, 827 aa, Gibberella zeae PH-1
MASSPMPSSPPEFNITHGVEDDDDIEEEVMIQDDIDDIDEMAEDEVDLFREGYENDYRDLEDDHYGGEGIDDEQYEDMRIDQRQQVDKVLNRRDRAIQERRGMPQVWGALDEDGDDIDLSAQPRRRRHNYDENPDDIMDTDIMSEELSLEALGDVKASSLTEWVSLPSVQRTIRREFKAFLTSYTDTSGSSVYGSRIRTLGEVNAETLEVSYEHLSESKAILAYFLANAPAEMLKLFDEVAMDVVLLHYPDYERIHSEIHVRIFDLPVHYTLRQLRQSHLNCLVRVSGVVTRRSGVFPQLKYVKFDCTKCGVTLGPFQQESNVEVKITYCQSCQSRGPFTLNSEKTVYRNYQKLSLQESPGTVPAGRLPRSREVILLWDLIDKAKPGEEIEVTGIYRNNYDAQLNNRNGFPVFATILEANNVVKSHDQLAGFRMTEEDEQNIRKLSRDPNIVDKIINSIAPSIYGHTDIKTAVALSLFGGVAKVTKGAHHLRGDINVLLLGDPGTAKSQVLKYAEKTAHRAVFATGQGASAVGLTASVRRDPLTSEWTLEGGALVLADRGTCLIDEFDKMNDQDRTSIHEAMEQQTISISKAGIVTTLQARCGVIAAANPIGGRYNSTAPFSSNVELTEPILSRFDILCVVRDTVEPEEDERLARFIVGSHSRSHPLSQAEQGSMEVEHDTQAETQGSTRKPEGEIPQELLRKYILYAREHCSPKLYHIDEDKIARLFADMRRESIATGAIPITVRHLEAIIRISEAFCRMRLSEYCAAQDIDRAIAVTVDSFVGSQKISCKKALARAFAKYTLARPGGQKKTGANSQGRRQTAAAS

SEQ ID NO: 67413 - protein, 394 aa, Synechococcus elongatus PCC 6301
MALLETRTEPMVLNMGPHHPSMHGVLRLIVTLDGENVIDCEPVIGYLHRGMEKIAENRSNVMFVPYVSRWDYAAGMFNEAITVNAPEKLANIPVPKRASYIRVIMLELNRIANHLLWLGPFLADVGAQTPFFYIFRERELIYDLWEAATGQRLINNNYFRIGGVAADLPYGWLEKCIDFCDYFQAKVDEYERLITDNPIFRRRVEGIGVISREEALNWSLSGPMLRGSGVKWDLRRVDHYECYDDFDWDVITAEEGDCFARYRVRVQEMRESLKIIRQACAGIPGGPYENLEARRMAEGKKSEWYGPDYQYVSKKVAPTFKIPAGEHYVRLESGKGELGVFIQGADDICPWRFKIRAPDFNNLQILPQLLQGVKVADIMAILGSIDVIMGSVDR

SEQ ID NO: 67414 - protein, 339 aa, Synechococcus elongatus PCC 6301
MTIRVAINGFGRIGRNFLRCWFGRQNTDLEVVAINNTSDARTAAHLLEYDSVLGRFNADISYDENSITVNGKTMKIVCDRNPLNLPWKEWDIDLVIESTGVFVTAEGASKHIQAGAKKVPITAPGKGEGVGTYVIGVNDSEYRHEDFAVISNASCTTNCLAPVAKVLHDNFGIIKGTMTTTHSYTLDQRILDASHRDLRRARAAAVNIVPTTTGAAKAVALVIPELKGKLNGIALRVPTPNVSVVDLVVQVEKPTITEQVNEVLQKASQTTMKGIIKYSDLPLVSSDFRGTDESSIVDSSLTLVMDGDLVKVIAWYDNEWGYSQRVVDLAELAARKWAA

SEQ ID NO: 67415 - protein, 375 aa, Rhizobium leguminosarum bv. viciae 3841
MDVRAAVAVQAGKPLEVMTVQLEGPKAGEVLVEVKATGICHTDDFTLSGADPEGLFPAILGHEGAGIVVDVGPGVTSVKKGDHVIPLYTPECRECYSCTSRKTNLCTSIRSTQGQGVMPDGTSRFSIGKDKIHHYMGCSTFSNFTVLPEIALAKVNPDAPFDKICYIGCGVTTGIGAVINTAKVEIGATAIVFGLGGIGLNVLQGLRLAGADMIIGVDINPDRKAWGEKFGMTHFVNPKEVGDDIVPYLVNLTKRHGDLIGGADYTFDCTGNTKVMRQALEASHRGWGKSIIIGVAGAGQEISTRPFQLVTGRNWMGTAFGGARGRTDVPKIVDWYMQGKIQIDPMITHTMPLEDINKGFELMHKGESIRGVVVY

SEQ ID NO: 67416 - protein, 1134 aa, Oryza sativa (indica cultivar-group)
MAPLCCCLLRARRLLFSFFFFAVVVVLFSSVSVAQIPVWSCGSVSEMVRNAWAGFQSIDCGGSGNYTDEVGLEWTGDEAYVGGGAGTTASISSMSGQGRRPYRTVRYFPADGRKYCYRVSVRARTRYLVRASFLYGNFDGSRVFPEFDLYVGASRWSTIVIYDESKVVTREMVALAQSGSSSLSVCLANATTGHPFISTLELRPLNASLYHTAFEAAFFLSLAARINFGAPTADPVRYPDDPYDRVWESDMARRPNFLVDAAPGTIRVATDNPVFVASGERPPQKVMQTAVVGTLGALTYRLDLNGFPGSGWACSYLAEIEDDAAATARRFKLYIPGLPEVSKPTVDIGENAPGKYRVYQPGYDNISLPFVLPFAFRKTDDSARGPILNAMEIYSYIPILPASPDAVAMDAPGGALPAAAQLGAGGRRPVCSRTLVLAHMHLIQSHRHVRNNLTGAIPPELAALPCLQEILLDNNMLTGPIPDLSACTNLTVIHLENNQLEGSVPSYLSGLPKLSELYLENNRLSGVIPRALLSRSIVFKYSGNKHLRVGKQEEEERNVVIGICALVGIGLLLAAALCYAYNVSVSGRKQQGASAGGNSKSKSIVVSAEQKKKATPVAAAGGGIDNMMAAMAARGPLEFKVRELEEATSKFARKIGSGGFGVVYYGRLGDGREIAVKDTPPQPGGVPGLLLGAPQQQLHAGVRVHAQWQPQGAAADDEHELAPAAAGGGGRGQGDRVPALRLHAGQSSTGTSRPANILLDAHMRAKVSELGLSKSTEATNSTAYTITTHVRATLGYLDPHYYVSQQLTHKSDLYSFGIILLELISGRPPILLTPGAGAMASLGPWAKSHYESGDIEAIVDPSLRGRYRDVHSVWKVAETAVRCIDADPQGRPSMPEVVKDIQEAIALEMPSSESERPAASFFSPGAGAAGARSSATVRSHDLVMDNLIATHSQRHTSMSSRRGGESGSGDSPRQWEEAKSTTPRLQPGSAGGRSAAPSAEMSSRGWGESGGGDSPQLQGDSSSCKKAKSQTPSLQPGSASEHVAASSATSVETGLEFGKVDGEAHAPRSPALGKATKALNRRAVAGGLDLDTKRSGVEIQKSKVGGLDLLVGNGFFLFYMKAVWMLVDTGDKIL

SEQ ID NO: 67417 - protein, 208 aa, Oryza sativa (indica cultivar-group)
MLLLVLALLGITVFGLAVTAGGGGTQVAGRPYREFRLADYSSWLQRHVRAERYWRPALACVLAARACDTLAAWTPLDYLRNDLTPVQSGCCKPPTACTYYDDAQQQQQQPDCYRWSNAPGVLCYGCDSCKAGVLEQLRRHWHNVTILNVVLLLLLILFYSCACCAFRNTATATSSKTIFHLHPRWEYRWYLLYLCARESQGGGMDEDS

SEQ ID NO: 67418 - protein, 142 aa, Pseudomonas putida KT2440
MWGSWSAYEPMPGLLRLLEHAQAHGIGMCVVTNAPRLNAEHMLNAMGLGQHFEHVLVAEELARPKPDPLPYLTGLQRLGVEAGQALAFEDSLPGTAAASGAGIFTVGVATTQTPERLLAAGARLVVDDFNDAALWALIERMA

SEQ ID NO: 67419 - protein, 473 aa, Bacillus cereus G9241
MMDQNQGLKRELKSRHIFMIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAALLFAINALSSRSFAEVEFWFASIKVITIIAFIILGGAAMFGFLDMKGNEPAPMFSSFTDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFGKLSKNGVPIYALIVSTIVGCLSLLSGIYAEDTVYLWLLSIAGFGAILVWASIALSNLLARRSYIKQGGDVKDLKFKTPLYPFVPLLALVLNVTVIVGMAFIPEQRMALYCGIPFMIVCLLFYRATRNKGSNLEHIEKTKTTEIESL

SEQ ID NO: 67420 - protein, 364 aa, Ralstonia eutropha JMP134
MSADNQLQFTVERHPNPTPADKIAAALVDPAFGRVFTDHMVTIRWTEGRGWHDAKVEARRPFQIDPACAVLHYAQEIFEGMKAYRGADGKISLFRPQENAKRFRASAARMSMADLPEAEFLRAVEALVDIDRDWIPGGDGSLYLRPFMFAAENFLGVRAANEYVFCVIACPVGPYFKGGKSAVTVWVSDQYTRAAPGGTGAAKCGGNYAASLIAQTEAAQKGCDQVVFLDAAEHRWIEELGGMNVFFVMDDGSLLTPPLSGTILPGITRASVIELARHEGIKVSETPYAFEAWQADAASGRVKETFACGTAAVVTAIGTVRHAGGEFNIGNGGEGEVTKRLRALLTGIQRGKEADTFGWVHHIA

SEQ ID NO: 67421 - protein, 319 aa, Ralstonia solanacearum GMI1000
MTQLDQLKQFTTVVADTGDFQAMRAYAPHDATTNPSLILKAVQKAEYRPLLEQAVRDARSDSVEDIIDAVLVAFGCEILSIIPGRVSTEVDARLSFDTAATVAKARHLIALYEARGVPRERVLIKIASTWEGIRAADQLRAEGIRCNMTLLFSLIQAVACAEAGVQLISPFVGRIYDWYKKDAGAAWDPIAQGGANDPGVQSVVRIYNYYKRFGYTTEVMGASFRNTSQIIELAGCDLLTISPELLAQLQQSDAPVERKLSPEHAHATNLVRLPADEAAFRWHMNADAMATEKLAEGIRLFAADAVKLEGLIGPLRAAA

SEQ ID NO: 67422 - protein, 228 aa, Ralstonia solanacearum GMI1000
MTQDELKALVAQAAADYVLANVPEGAVLGVGTGSTANLFIDAMAPHKARFAGAVSSSEASTRRLQGHGFAVLDLNEVDTIPVYVDGADEIDDTGAMIKGGGGALTREKIVASVAGRFVCIADGSKLVDVLGAFPLPVEVVPMARAAVARQLAALGGQPRLRMTKEGQIYQTDNGNVILDVSGLRIGEPKTLEAQINDIPGVVTVGLFAKRGADVLLLGTEAGVQRRDF

SEQ ID NO: 67423 - protein, 164 aa, Oryza sativa (japonica cultivar-group)
MENYQGQHGYGADRVDVYGNPVAGQYGGGATAPGGGHGVMGMGGHHAGAGGQFQPVKEEHKTGGILHRSGSSSSSSSSEDDGMGGRRKKGIKEKIKEKLPGGNKGNNQQQQQMMGNTGGAYGQQGHAGMTGAGTGTGVHGAEYGNTGEKKGFMDKIKEKLPGQH

SEQ ID NO: 67424 - protein, 379 aa, Brassica oleracea
  misc_feature (86)..(86): Xaa can be any naturally occurring amino acid
MSTTGQIIRCKAAVCWEAGKPLVMEEVEVAPPQKHEVRIKILFTSLCHTDVYFWEAKGQTPLFPRIFGHEAGGIVESVGEGVTDLXPGDHVLPIFTGECGDCPHCHSEESNMCDLLRINTERGGMIHDGESRFSINGKPIHHFLGTSTFSEYTVVHSGQVAKINPEAPLDKVCIVSCGLSTGLGATLNVAKPKKGQSVAIFGLGAVGLAAAEGARIAGAGRIIGVDLNPKRFEEAKKFGVTEFVNPKEHDKPVQEVIAEMTNGGVDRSVECTGSIQAMIQAFECVHDGWGVAVLVGVPSKDDAFKTHPMNLLNERTLKGTFFGNYKPKTDIPGVVEKYMNKELELEKFITHTVPFSEINKAFDYMLKGESIRCIITMGA

SEQ ID NO: 67425 - protein, 379 aa, Capsella rubella
  misc_feature (376)..(376): Xaa can be any naturally occurring amino acid
MITTGLFIRCKAAVSWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNPSRFDQAKKFGVTEFVNPKDHDKPVQQVIAEMTNGGVDRSVECTGSVQAMIQAFECVHDGWGVAVLVGVPSKDDAFKSHPMNFLNERTLKGTFFGNYKPKTDIPGVVEKYMNKELELEKFITHTVPFSEINKAFDYMLKGESIRCIIXMGA

SEQ ID NO: 67426 - protein, 186 aa, Coprinopsis cinerea okayama7#130
MVLVLVIGDLHIPHRTHDLPLKFKKLLVPGKIQQILCTGNVCDKETYDYLRTISPDVHVVKGDYDESSAFPSSVTVMHNAIKIGVIHGHQCVPVGDLDSLGAIARQMDVDVLISGHTHTDPTPSFALMDIQGNVVVTYVYQLIEGEVRVEKIEWRKEPESVANAPRSTVMPQSIPSPSPSSPQEGW

SEQ ID NO: 67427 - protein, 399 aa, Candidatus Pelagibacter ubique HTCC1002
MSIISDSLKKIKPSPTIAVTQKARELKAAGKDVIGLGAGEPDFDTPDNIKQAAIKAINDGDTKYTAVDGTAALKDAIVKKFKRENNLDYTTDQITVGAGGKHVIYNAMMATLNEGDEVIVPAPYWVSYPDMVLLAGGTPIILECNEKQGFKINPAKLEKSITPKTKWIILNSPSNPTGACYTESDIKEIAYVLANHPHVHILSDDIYEHVTYEGFKFFTIAQIDGLKERVLTMNGVSKAYSMTGWRIGYAAGPKDIIKAIAKIQSQSTTNPSSISQAAAVEALNGTQDFIKERATSFQERRNFVVKALNGIDGIECLNPDGAFYVFPSCKGLMGKKDTSGKELKTDTDFVQSLLENSGVAVVQGSAFGLEGFFRISYATSMDNLKKALEKISTFCKSLN

SEQ ID NO: 67428 - protein, 379 aa, Boechera stricta
MSTTGQIIRCKAAVAWEAGKPLVMAEVEVAPPQKHEVRIKILFTSLCHTDIYFWEAKGQTPLFPRIFGHEAGGIVESVGEGVTDLQPGDHVLPVFTGECGDCRHCHSEESNMCDLLRINTERGVMIHDGESRFSINGKPIYHFVGTSTFSEYTVVHSGQVAKINPDAPLDKVCIVSCGLSTGLGATLNVAKPKKGQSVAIFGLGAVGLAAAEGARIAGAFRVIGVDLNPKRFDEAKKFGVTEFVNPKDHDKPVQQVIAEMTDGGVDRSVECTGSVQAMIQAFECVHDGWGVAVLVGVPSKDDAFKSHPMNFLNERTLKGTFFGNYKPKTDIPGIVEMYMNKELELEKFITHTVPFSGINKAFDYMLKGESIRCIIPMGA

SEQ ID NO: 67429 - protein, 650 aa, Ralstonia solanacearum GMI1000
MSPLNFPSDRPIDLACLGRVAVDLYAQQIGSRLEDARSFQMYLGGSSGNVAFGVARLGLKTAMISRVGDEQMGRFLRETLEREGCDTSQLQTDPERLTALVLLGLKDRDTFPLLFVRENCADMAVRADGIDEGFIAGCRALAITGTHLSTPTTREASLTALAYARRHGAVRILDIDYRPVLWGLTSRGAGEHRYVPDAHVTRQLQQALGEFDLLVGTEEEFLIAGGVPRDLMASLRAVRQISGAVLVVKRGALGCCVIEGAVPERIEDAPTFPGERVEVLNVLGAGDAFLSGLLSGLLRGKGWAESARIANACGAIVVSRHACSAAMPTPAELAHWFGGSRHPGVDADRELAHLHRVTVARPHWDDLCVMAFDHRSQFYDLAVQAGAGESRIKTLKQLLVRAAEQVERERALHGHVGVLIDGGAYGSDALASATGRGWWVGRPVELPGSRPLRFDDTRSVGSALIHWPTEQVVKCLVHYHPDDPATLRVDQEQKVLELWEATRESGNELLLEIIPPRPFTLAGTEDDAVLRTVARVYNLGVRPEWWKLAPMSADGWTQLEALITERDAHCRGAVILGLNQPLQYLVDSFRSATNPIVKGFMVGRTLWADASLKWLRGDISDQAFIDEVAGNFAQLADAWLGRRADARSAA

SEQ ID NO: 67430 - protein, 479 aa, Erwinia carotovora subsp. atroseptica SCRI1043
MSTTQKRMYINGEFVENRSGKWIDVVNPATEQVISQVPEGSADDAKRAIDAAEAAQPSWEALPAVERGVWLHKIAAGIREREAELTDTIIAEGGKTHGLAQTEVLFTADYLDYMAEWARRYEGEIIQSDRPNENIFVFRKAIGVTTGILPWNFPFFLIARKAAPALITGNTIVIKPSEITPNNAVIFAEIIHKIGLPKGVINFVTGYGPTVGQELAGNPKVGMVSLTGSVAAGIATMTAAAQNVTKVSLELGGKAPAIVMDDADLDLAVKAIVSSRVINSGQVCNCAERVYVQKGIYDEFIIRIKAAMEQVTFGNTAEKKTLDMGPLISAAALQRVEDKVAKAVSQGAKVLLGGKSESGTGYFYPPTLLVNVTQEMPIMHEEVFGPVLPVATFDTLEDAIAMANDSEYGLTSSIYTQNINTAMKALKGLKFGETYINRENFEAMQGFHAGWRKSGVGGADGKHGLQEYLQTHVAYLQFH

SEQ ID NO: 67431 - protein, 379 aa, Boechera stricta
  misc_feature (366)..(366): Xaa can be any naturally occurring amino acid
MITTGQIIRCKAAVAWEAGKPLVMEEVEVAPPQKHEVRIKILFTSLCHTDVYFWEAKGQTPLFPRIFGHEAGGIVESAGEGVTDLQPGDHVLPVFTGECGDCRHCHSEESNMCDLLRINTERGVTIHDGESRFSINGKPIHHFVGTSTFSEYTVVHSGQVAKINPDAPLDKVCIVSCGLSTGLGATLNVAKPKKGQSVAIFGLGAVGLAAAEGARIAGASRVIGVDLNPKRFDEAKKFGVTEFVNPKDHDKPVQQVIAEMTDGGVDRSVECTGSVQAMIQAFECAHDGWGVAVLVGVPSKDDAFKSHPMNFLNERTLKGTFFGNYKPKTDIPGIVEMYMNKELELEKFITHTVPFSEINKAFDNMXKGESIRCIITMGA

SEQ ID NO: 67432 - protein, 475 aa, Thermoanaerobacter tengcongensis MB4
MANSTSSYLWRKKTLEMVLSETEAEQFKLKKTLTAIDLIALGIGAIIGTGIFVITGVAAAEKAGPAIVLSFILAGLACAFAAISYAELASMFPIAGSTYNYAYIAMGEFLAWIIGWDLILEYVFALPAISLGWSGYFTNLLGSIGINIPAWAANSAWQAPGTGGLINLPAIGILLAIAILNYIGVRETATVNNIGVAFKVFVVLFFIFTAVWYVKPANWSPFLPYGWAGVFHGAAIIFFAYIGFDAVSTAAEETKNPAKDMPIGILGSLGISTLLYIAVSAILTGVVSYTELNDPAPVAKALNLIGLNWARGLVSLGAIVGITTVLLVMFYGSTRIIFAMSRDGLLPPIFSKVHPKYRTPTLAIYLITIATTLVAGFFPIGVIAELVNIGTMLAFVLTSIATIVLRYTQPDLPRKFRAPGMPWTGILAIAFVLSLMVSLPWETWVRLIVWFVIGLFIYFGYGRHNSILAKQQTQH

SEQ ID NO: 67433 - protein, 379 aa, Boechera fendleri
MITTGQIIRCKAAVAWEAGKPLVMEEVEVAPPQKHEVRIKILFTSLCHTDVYFWEAKGQTPRFPRIFGHEAGGIVESVGEGVTDLQPGDHVLPVFTGECGDCRHCHSEESNMCDLLRINTERGVMIHDGESRFSINGKPIHHFVGTSTFSEYTVVHSGQVAKINPDAPLDKVCIVSCGLSTGLGATLNVAKPKKGQSVAIFGLGAVGLAAAEGARIAGASRVIGVDLNPKRFDEAKKFGVTEFVNPKDHDKPVQQVIAEMTDGGVDRSVECTGSVQAMIQAFECVHDGWGVAVLVGVPSKDDAFKSHPMNFLNERTLKGTFFGNYKPKTDIPGIVEMYMNKELELEKFITHTVPFSEINKAFDYMLKGESIRCIITMGA

SEQ ID NO: 67434 - protein, 329 aa, Arabidopsis thaliana
MMRSFVSLISLLLLLSFSSSVLSTKKSSFQKLPVPGNRTGPEAFAFDSTGKGFYTGVTGGKILKYLPKKGYVDFAQITNSSKSSLCDGALGTTNVEKCGRPAGIAFNTKTGDLYVADAALGLHVIPRRGGLAKKIADSVGGKPFLFLDGLDVDPTTGVVYFTSFSSTFGPRDVLKAVATKDSTGKFFKYDPSKKVVTVLMEGLSGSAGCAVSSDGSFVLVGQFTKSNIKRYWIKGSKAGTSEDFTNSVSNPDNIKRIGSTGNFWVASVVNSATGPTNPSAVKVSSAGKVLQTIPLKDKFGDTLVSEVNEYKGQLYIGALFGPFAGILKL

SEQ ID NO: 67435 - protein, 147 aa, Burkholderia xenovorans LB400
MTSVAQLLKTKPNNTTVFTVGADDSVYDAIKLMAEKGIGALVVTDGDSIAGIVTERDYARKVVLLDRSSKATPVRDIMSKAVRFVRPDQTTDDCMALMTERRMRHLPVIENDRLVGMVSIGDLVKNIIAEQQFTIQQLEFYIHGERP

SEQ ID NO: 67436 - protein, 379 aa, Turritis glabra
  misc_feature (6)..(6): Xaa can be any naturally occurring amino acid
MITTGXIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCRHCHSEESNMCDLLRINTERGGMIHDGESRFSINGKPIYHFLGTSTFSEYTVVHSGQVAKINPDAPLDKVCIVSCGLSTGLGATLNVGKPKRGQSVAIFGLGAVGLAAAEGARIAGASRIIGVDLNSKRFDQAKEFGVTEFVNPKDHDKPVQQVLAEMTDGGVDRSVECTGSVQAMIQAFECVHDGWGVAVLVGVPSKDDAFKSHPMNFLNERTLKGTFFGNYKPKTDIPGVVEKYMNKELELEKFITHTVPFSEINKAFDYMMKGESIRCIITMGA

SEQ ID NO: 67437 - protein, 379 aa, Olimarabidopsis pumila
MITTGQIIRCKAAVAWEAGKPLVMEEVEVAPPQKHEVRIKILFTSLCHTDVYFWEVKGQTPLFPRIFGHEAGGIVESVGEGVTDLQPGDHVLPIFTGECGDCRHCHSEESNMCDLLRINTERGGMIHDGESRFSINGKPIHHFLGTSTFSEYTVVHSGQVAKINPDAPLDKVCIVSCGLSTGLEATLNVAKGKKGQSVEIFGLGAVGLAAAEGARIAGASRIIGVDLNSKRFDQAKEFGVTEFVNPRDHDKPVQQGIAEMTDGGVDRSVECTGSVQAMIQAFECVHDGWGVAVLVGVPSKDDAFKTHPMNLLNERTLKGTFFGNYKPKTDIPGVVEKYMNKELELEKFITHTVPFSEINKAFDHMLKEESIRCIITMGA

SEQ ID NO: 67438 - protein, 379 aa, Halimolobos perplexa var. lemhiensis
MSTTGQIIRCKAAVAWEAGKPLVMEEVEVAPPQKHEVRIKILFTSLCHTDVYFWEAKGQTPLFPRIFGHEAGGIVESVGEGVTDLQPGDHVLPVFTGECGDCRHCHSEESNMCDLLRINTERGGMIHDGESRFSINGKPIHHFVGTSTFSEYTVVHSGQVAKINPDAPLDKVCIVSCGLSTGLGATLNVAKPKKGQSVAVFGLGAVGLAAAEGARIAGASRIIGIDLNPKRFDEAKKFGVTEFVNPKDHDKPVQQVIAEMTDGGVDRSLECTGNVQAMIQAFECVHDGWGVAVLVGVPSKDDAFKSHPMNFLNERTLKGTFFGNYKPKTDIPGIVEMYMNKELELEKFITHTVPFSEINKAFDYMLKGESIRCIITMGA

SEQ ID NO: 67439 - protein, 303 aa, Rhizobium leguminosarum bv. viciae 3841
MKFEGIYTPAVTPLDQNGQIDRAGFAAVLESLIEAGVHGIIVGGSTGEYYAQSSQERFELAAYAREVIGTRLPLIIGTGATRTEDSVEYAKAAKEIGADAILVSSPPYALPTERENAVHALTVDRAANLPIMLYNYPARMGVMMGEEYFSRLGKSRNVIAIKESSGDMGNLHLLARKFPHIALSCGWDDQALEFFAWGAKSWVCAGSNFLPREHVALYEACVLEKNFDKGRAIMMAMLPLMDFLECGKFVQSIKHGCELIGLNVGSVRAPLRPLNSEEKRTLQTVVATLKRTVAQITSGVNHA

SEQ ID NO: 67440 - protein, 379 aa, Arabidopsis halleri
MITTGQSIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 67441 - protein, 379 aa, Arabis hirsuta
MITTGQIIRCKAAVAWEAGKPLVMEEVEVAPPQKHEVRIKILFTSLCHTDVYFWEAKGQTPLFPRIFGHEAGGIVESVGEGVTDLAPGDHVLPVFTGECGDCPHCHSEESNMCDLLRINTERGGMIHDGESRFSIDGKPIYHFVGTSTFSEYTVVHSGQVAKINPDAPLDKVCIVSCGLSTGLGATLNVAKPKKGQSVAIFGLGAVGLAAAEGARIAGASRIIGVDLNSKRFDEAKKFGVTEFVNPKDHDKPVQQVIAEMTNGGVDRSVECTGSVQAMIQALECVHDGWGVAVLVGVPSKDDAFKTHPMNLLNERTLKGTFFGNYKPKTDIPGVVEKYMNKELELEKFITHTVPFSEINKAFDYILKGESIRCIITMGA

SEQ ID NO: 67442 - protein, 505 aa, Rhizobium leguminosarum bv. viciae 3841
MHEPLTASEYKAIAAGLQFPTNAFIDGAFRPANSGQTFTSTNPATGEVLAEIAACDATDVDAAVSKAKQAFDDGRWRLRSPGERKAVLLKLARLLEDNRHELAVMESLDSGKPVGECQTVDVPDTIHTIRWHAELIDKLYDNTAPVGANALTMIVREPVGVVGCVLPWNFPLLMLAWKIGPALAAGCSVIVKPAQETTLTTLRVAELAHEAGIPAGVFNVVTGGGKEVGEPIGMHMDVDMVAFTGSTPTGRRFLRYAADSNLKRVVLECGGKNPAVVLDDAEDLDLVAEQVVNGAFWNMGENCSATSRLIVHSKVKDELLKRIGAYMREWKTGDPLDPANRIGALVSKAHFEKVKSFLDDARKEKLTVTHGGETHGGIFIEPTVVEGVTPASRLFQEEIFGPVLSVTTFNSLAEAIALANDTNYGLTASVYTGSLRNAIKLSREIRAGVVTVNCFGEGDASTPFGGYKESGFGGRDKSVFAHDNYCELKTIWIDVSERSVDETIR

SEQ ID NO: 67443 - protein, 198 aa, Campylobacter jejuni RM1221
MIISAKFITSLVKFDENLSSNFSEVAFLGRSNVGKSSLINSLCKQKNLAKSSATPGKTQLINFFEVICKRNEEKFNINFIDLPGFGYAKVSKNLKEIWNQNLDEFLKLRTSIKLFIHLIDSRHTHLEIDVNLNDYLKRFLRPDQKILKVFTKCDKLNQSEKAKLKNEFKDSILVSNLNKFGLDSLEDIIINQTLGLDK

SEQ ID NO: 67444 - protein, 479 aa, Myxococcus xanthus DK 1622
MDAKGLRTFLEIPYDELEERNLKVKEQRLKHTASEKLRDERIEYLTKERAIKAVTVCFTDLEGRLHMLDYDKKFLIKSADNLTFDGSSIRGFSAQQESDLRLNIDWSAFYWLPSDIFGPGKVLVFSEVHERDGTQYHSDLRGRLKLLTESMYQKDGTVVHAAPEIEGFLFKGRDAEHHFHEKGHFDFISTGGYYHSLPGDVLRTFIDKVAEAQRAMGFQNEKDHPEVAPSQFEINFSYSEALIAADQIQLYKLLSRQVAAQLDCTASFLPKPVTGVNGNGMHMNLSLSKGGKNLFHDQNGPDGLSPMGWDFIDRLLTSANDICLTLNSSVNAYRRLDPHFEAPNQIKASANNRGAMVRIPFGNERSARIECRSVAPDANPYLVLYTLLRTGLEGPQPQEDAEAKRSRTRFLPDNIFDAIRIFKGSQFVASILGEGVQSKFAELKTTTAERSPKQLGTRVKYSEVKFHHEVTNQFLWNQF

SEQ ID NO: 67445 - protein, 297 aa, Corynebacterium diphtheriae NCTC 13129
MTQETFTATTRVKRGLADMLKGGVIMDVVTPEQARIAEDAGASAVMALERVPADIRAQGGVARMSDPDLIEGIVNAVSIPVMAKARIGHFVEAQILESLGVDFIDESEVLSPADYVNHIDKWNFDVPFVCGATNLGEALRRITEGAAMIRSKGEAGTGDVSEAVKHLRTIRGEINRLRSMDEDQLYVAAKEIQAPYDLVREVAATGKLPVTLFVAGGVATPADAALVMQMGAEGVFVGSGIFKSGNPAARAAAIVKATTMYDDPAAIAEVSRGLGEAMVGINVADVPAPHRLAERGW

SEQ ID NO: 67446 - protein, 384 aa, Oryza sativa
MAETKIEGPTIAVKLFVDKERSRVLFAESDKDFVDVLFGFLTLPLGTVVRLLGRQSQVGCLDELYKSVEDLSADYFHTKACKAMLMKPHDTAAEQCCLLKVKVDDTDQSAVYVCRDANCSANGDCGVTSVAGSVCKCGKVMEYIGEWPQDGGSTAAAGSDGGVFVKGCYKFIVTDDLHVAPAATSLMMSIFDKYGVRDPANLEQKILQLNAEKITCLLKRSLTSKQTLTGYYFDVPNPNDEANLYVLPESLYSEQDAEVDHKLNNMKIKVLQRKNNTSLLYAEVGEDFVDLLFGLLSIPLGSILKTYGKWSSNGCVDNIYMSIDGSAKGCMNPERQMLLASPNVASFFGCSATNMLIQLGEAAPKQRNISGCFKCFKIAGFWPL

SEQ ID NO: 67447 - protein, 376 aa, Zea mays
MGASGKWIKSLVALKAPEKAAGHKGGRKWRLWRSSSATSRASAGEGSALASESSSASADSFNSVLAAVVRAPPRDFLLIRQEWAAVRIQTAFRGFLARRALKALRGIVRLQALVRGRRVRKQLAVTLKCMHALLRVQERARERRARSSADGHGSQGQDALNGCASSTKDAMEQWCDRHGSVAEDFSYLDGWMATKPWETRSTERNHSDSQLAKHCEEPNLPASKLSDASSVKIRRNNVTTRVSAAKRPPPSSVLSAASSDSAYGDKSPRSRPSVTLTSATTNTVLASEARSDSGDTGGPNYMSLTKSAKARLSGCSGSSHHRSFQRPRSGDMSRVTLSSIDTQSNAGSEISVTSKRLNSMSLNLKGRSLDKENEED

SEQ ID NO: 67448 - protein, 309 aa, Bacillus cereus G9241
MQCIETNNLQQLLEQVKPYTKKGKLATYIPELGNANPDDLGIAIFHKETEYIHAGNSQTLFTLQSISKVITLALALLDRGEEYVFSKVGMEPTGDPFNSIIKLETTSPSKPLNPMINAGALAITSMLAGKDNEEKMDRILHFVREITDNPTINYSSKVANSELETAYLNRSLCYYMKQNGIIDCDIEELMDLYTRQCAVEVNCIDLARIGLIFAMDGYDPYKEKQIIPKHITKICKTFMVTCGMYNESGEFAIRVGIPAKSGVAGGIFGCVKGEMGIGIFGPALDANGNSIAGFKILELLSAQEGWSIF

SEQ ID NO: 67449 - protein, 456 aa, Saccharomyces cerevisiae
MSDKPIDIQYDKQATPNLSGVITPPTNETGNDSVREKLSKLVGDAMSNNPYFAAGGGLMILGTGLAVARSGIIKASRVLYRQMIVDLEIQSKDKSYAWFLTWMAKHPQRVSRHLSVRTFYIQHDNGSVSTKFSLVPGPGNHWIRYKGAFILIKRERSAKMIDIANGSPFETVTLTTLYRDKHLFDDILNEAKDIALKTTEGKTVIYTSFGPEWRKFGQPKAKRMLPSVILDSGIKEGILDDVYDFMKNGKWYSDRGIPYRRGYLLYSPPGSGKTSFIQALAGELDYNICILNLSENNLTDDRLNHLMNNMPERSILLLEDIDAAFNKRSQTGEQGFHSSVTFSGLLNAQDSVTSSEETITFMTTNHPEKLDAAIMRPGRIDYKVFVGNATPYQVEKMFMKFYPGETDICKKFVNSVKELDITVSTAQLQGLFVMNKDAPHDALKMVSSLRNANHIF

SEQ ID NO: 67450 - protein, 413 aa, Pyrococcus horikoshii
MGGGNLNIEEIIEKVANGEIKFYQVEKYVNGDKRLATEIRRKALEKRLGIKLHHIGYYSIDPNELIGRNIENMIGVVQIPMGVAGPLKINGEYAKGEFYIPLATTEGALVASVNRGCSALTEAGGVVTTLIDDKMTRAPLIRCPNARRAREVAKWVEENLDYLQEKAVSKVTRHGKLRGVKPFIVGNNLYLRFEFETGDAMGMNMVTIASEEIMKVIEEEFPDVRYLALSGNLCVDKKPNAVNFILGRGKTVIAEAVVPRKIVEKKLKTTPELIAEVNYFKNLVGSAQAGSYGFNAHFANIVGAIFLATGQDEAQITEGAHGITIAEVTPDGDLYISITMPSLEIGTVGGGTRVPSQREALEIMGVAGGGDPPGINAKKFAEIVAGAVLAGELSLLAAIAAKHLARAHKMLGR

SEQ ID NO: 67451 - protein, 379 aa, Arabis hirsuta
  misc_feature (183)..(183): Xaa can be any naturally occurring amino acid
  misc_feature (372)..(372): Xaa can be any naturally occurring amino acid
MITTGQIIRCKAAVAFEAGKPLVMEEVEVAPPQKNEVRIKILFTSLCHTDVYFWEAKGQTPLFPRIFGHEAGGIVESVGEGVTDLAPGDHVLPIFTGECGDCPHCHSEESNMCDLLRINTERGVMINDGESRFSIDGKPIYHFVGTSTFSEYTVVHSGQVAKINPDAPLDKVCIVSCGLSTGXGATLNVAKPKKGQSVAIFGLGAVGLAAAEGARIAGASRIIGVDLNSKRFDEAKKFGVTEFVNPKDHDKPVQQVIAEMTDGGVDRSVECTGSVQAMIQAFECVHDGWGVAVLVGVPSKDDAYKTHPMNFLNERTLKGTFFGNYKPKTDIPGLVEKYMNKELEIEKFITHTVPFSEINRAFDYMLKGEGIXCKITMGA

SEQ ID NO: 67452 - protein, 379 aa, Arabis hirsuta
  misc_feature (317)..(317): Xaa can be any naturally occurring amino acid
MSTTGQIIRCKAAVAWEAGKPLVMEEVEVAPPQKNEVRIKILFTSLCHTDVYFWEAKGQTPLFPRIFGHEAGGIVESVGEGVTDLAPGDHVLPIFTGECGDCPHCHSEESNMCDLLRINTERGVMINDGESRFSIDGNPIYHFVGTSTFSEYTVVHSGQVAKINPDAPLDKVCIVSCGLSTGLGATLNVAKPKKGQSVAIFGLGAVGLAAAEGARIAGASRIIGVDLNSKRFDEAKKFGVTEFVNPKDHDKPVQQVIAEMTDGGVDRSVECTGSVQAMIQAFECVHDGWGVAVLVGVPSKDDAFKTHPMNFLNERTXKGTFFGNYKPKTDIPGLVEKYMNKELEIEKFITHTVPFSEINKAFDYMLKGEGIRCIITMGA

SEQ ID NO: 67453 - protein, 379 aa, Arabis soyeri subsp. subcoriacea
MITTGQIFRCKAAVAWEAGKPLVMEEVEVAPPQKHEVRIKILFTSLCHTDVYFWEAKGQTPLFPRIFGHEAGGIVESIGEGVTDLAPGDHVLPIFTGECGDCPHCHSEESNMCDLLRINTERGGMIHDGESRFSINGKPIHHFVGTSTFFEYTVVHSGQVAKIIPDAPLDKVCIVSCGLSTGLEATLNVAKPKKGQSVAIFGLGAVGLAAAEGARIAGASRIIGVDLNSKRFDEAKKFGVTEFVDPKDHDKPVQQVIAEMTDGGVDRSVECTGSVQAMIQAFECVHDGWGVAVLVGVPSKGDAFKTHPMNFLNERTLKGTFFGNYKPKTDIPGVVEKYMNKELELEKFITHTVPLSEINKAFDYMMKGESIRCIITMGA

SEQ ID NO: 67454 - protein, 379 aa, Boechera lignifera
MSTTGQIIRCKAAVAWEAGKPLVMEEVEVAPPQKHEVRIKILFTSLCHTDVYFWEAKGQTPLFPRIFGHEAGGIVESVGEGVTDLQPGDHVLPVFTGECGDCRHCHSEESNMCDLLRINTERGVMIHDGESRFSINGKPIYHFVGTSTFSEYTVVHSGQVAKINPDAPLDKVCIVSCGLSTGLRATLNVAKPKKGQSVAIFGLGAVGLAAAEGARIAGASRVIGVDLNPKRFDEAKKFGVTEFVNPKDHDKPVQQVIAEMTDGGVDRSVECTGSVQAMIQAFECVHDGWGVAVLVGVPSKDDAFKSHPMNFLNERTLKGTFFGSYKPKTDIPGIVEMYMNKELELEKFITHTVPFSEINKAFDYMLKGESIRCIITMGA

SEQ ID NO: 67455 - protein, 176 aa, Salmonella typhimurium LT2
MAGESYILMGVSGSGKSLIGSKIATLFSAKFIDGDDLHPAKNIDKMSQGIPLTDEDRLPWLERLNDASYSLYKKNETGFIVCSSLKKQYRDILRKSSPNVHFLWLDGDYATILQRMQRRAGHFMPPDLLQSQFDALERPCADEHDIARIDVNHDIEHVTEQCRLAVQAFRQALSAS

SEQ ID NO: 67456 - protein, 379 aa, Boechera lyallii
MSTTGQIIRCKAAVAWEAGKPLVMEEVEVAPPQKHEVRIKILFTSLCHTDVYFWEAKGQTPLFPRIFGHEAGGIVESVGEGVTDLQPGDHVLPVFTGECGDCRHCHSEESNMCDLLRINTERGVMIHDGESRFSINGKPIHHFVGTSTFSEYTVVHSGQVAKINPDAPLDKVCIVSCGLSTGLGATLNVAKPKKGQSVAIFGLGAVGLAAAEGARIAGASRVIGVDLNPKRFDEAKKFGVTEFVNPKDHDKPVQQVIAEMTDGGVDRSVECTGSVQAMIQAFECVHDGWGVAVLVGVPSKDDAFKSHPMNFLNERTLKGTFFGNYKPKTDIPGIVEMYMNKELELEKFITHTVPFSEINKAFDYMLKGESIRCIITMGA

SEQ ID NO: 67457 - protein, 211 aa, Zea mays
  misc_feature (93)..(93): Xaa can be any naturally occurring amino acid
MASHDHHHSHSHDDHHHHSHGDGGGHAAGGSWVGEDGRVWHSHDGLAPHSHEPIYSPGDFTKRAPPLASRDFADRAFTVGIGGPVGTGLIWVXKTALMLALCRFLRDKYSLAAVTNDIFTKEDGEFLIKHGALPEERIRAVETGGCPHAAIREDISINLGPLEELSNLYKADLLLCESGGGIFFYLIQNKCRSFLLLCMLESTPERQPCRL

SEQ ID NO: 67458 - protein, 1129 aa, Petroselinum crispum
MSSSRPANSSSNPGRANQNARVVLTTLDAKIHADFEESGNSFDYSSSVRVTSAVGENSSIQSNKLTTAYLHHIQKGKLIQPVGCLLAVDEKSFKIMAYSENAPEMLTMVSHAVPSVGEHPVLGIGTDVRTIFTAPSAAALQKAVGFTDINLLNPILVHCKTSGKPFYAIAHRVTGSLIIDFEPVKPYEVPMTAAGALQSYKLASKAVNRLQALPGGSMERLCDTMVQEVFELTGYDRVMAYKFHDDDHGEVTAEVTKPGLEPYFGLHYPATDVPQAARFLFLKNKVRMICDCRANSAPVLQDEKLPFELTLCGSTLRAPHSCHLQYMENMNSIASLVMAVVINDSDEVVESSDRNSVKSKKLWGLVVCHNTSPRFVPFPLRYACEFLAQVFAIHVSKELELENQIVEKNILRTQTLLCDLLMRDAPLGIVSQSPNMMDLVKCDGAALLYKNKVYRLGATPSDYQLRDIVSWLTEYHTDSTGLSTDSLYDAGYPGALALGDVVCGMAVVKITSHDMLFWFRSHAAGHIRWGGAKAEPDENHDGRKMHPRSSFKAFLEVVKTRSTTWKEFEMDAIHSLQLILRKALSVEKAVAAQGDEIRSNTDVIHTKLNDLKIEGIQELEAVTSEMVRLIETATVPIFAVDADEIVNGWNTKIAELTGLPVDQAMGKHLLTLVEDSSVGTVVFLLALALQGKEEQGIPFEFKTYGSREDSVPITVVVNACATRGLHDNVVGVCFVAQDVTSQKTIMDKFTRIQGDYKAIVQNPNPLIPPIFGTDEFGWCSEWNQAMTELSGWRREDVMNKMLLGEIFGIQTSCCHLKSKEAFVNLGVVLNNALTGQISEKICFSFFATDGKYVECLLCASKKLHGEGTVTGIFCFLQLASQELQQALHIQRLTEQTAMKRLKTLSYLRRQAKNPLCGINFVREKLEEIGMGEEQTKLFRTSVHCQRHVNKILDDTDLDSIIDGYLDLEMSEFRLHDVYVASRSQVSMRSNGKAIQVVDNFSEEMMSETLYGDSLRLQKVLADFMSVCVNLTPVGGHLGISVTLTEDNLGQSVQLVHLEFRITHTGAGVPEEAVSQMFGSDSETSEEGISLLISRKLVKLMNGDVHYLREAGKSTFIITVELAAASKRES

SEQ ID NO: 67459 - protein, 379 aa, Arabidopsis lyrata subsp. lyrata
  misc_feature (374)..(374): Xaa can be any naturally occurring amino acid
MITTGQIIRCKAAVAWVAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGGTLNVVKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTLPFSEINKAFDYMLKGESIRCXIPMGA

SEQ ID NO: 67460 - protein, 1115 aa, Ipomoea nil
MENYGKAVTFSSSATSNLNTGKAIAQYNADAKLMAEFEQSRESGKSFDYSRSVIHAPQNVTEEEMTAYLSRIQRGGLIQPFGCMLAIEEPSFKIVGFSENCFDLLGLKSGVEPPERMSLIGIDARTLFTLSSRASLAKAVASREISLLNPIWVHSKINQKPFYAVLHRIDVGIVIDLEPANSADPALLLAGAVQSQKLAVRAISRLQSLPGGDIGTLCDTVVEDVQKLTGYDRVMVYKFHDDSHGEVVSEIRRSDLEPYLGLHYPATDIPQAARFLFKQNRVRMICDCNAQPVKVLQCEELKQPLCLVNSTLRSPHGCHTKYMANMGSIASLVMAVVINSSESMKLWGLVVCHHTSPRYVPFPLRYACEFLMQAFSLQLYMELQLASQLAEKKILQTQTLLCDMLLRDAPFGIVTQTPSIMDLVRCDGAALYYNGKCWLLGVTPTETQVKDIAEWLLHNHGDSTGLSTDCLSDAGYPGAPLLGDAVSGMATARITSKDFLFWFRSHTAKEVKWGGAKHHPEDKDDGGRMHPRSSFIAFLEVVKSRSLPWEDSEINAIHSLQLIMRDSLQGIGENYMKSVSSPQQNDSDGVRFYELSSMALELVRLVETATVPIFGVDSSGLINGWNAKIAELTGLQANVAIGKYLIDDVTHEDSHETFKALMCRALQGEEDRNVEVKLLKFGNHPTKEVVYLVVNACTSRDYKNDIIGVCFVGQDITPEKAVMDKFVRLQGDYEAIIQSLNPLIPPIFASDENACCSEWNAAMERLTGLVKCEVIGKRLPGEIFGGLCRLKGQDALTKFMILLYQGISGHDTEKLSFGFFDRKGNFIDVFITANKRTDERGNIIGCFCFLQTMAVDHPQISARDIEDDRECLSTLKEFAYIQQQMKNPLNGIRFTHKLLEGTVTSDHQKQFLETSEACEKQILSIIENMDSGGIVDGNRVELKTEEFVIGNVIDAVVSQVMIPLKEKNLQLLHDIPDQIKSLPIYGDQIKLQLVLSDFLLSIVRHAPSPDGWVEIRVSPGLKLIQDGNVFIHIQFRMTHPGQGLPSALIEDMVRGGTRWTTQEGVVLHLSQKLVRMMNGHVHYVREQQKCYFLIDLDFKTQKPRSRESSMDTKAD

SEQ ID NO: 67461 - protein, 379 aa, Boechera parishii
MSTTGQIVRCKAAVAWEAGKPLVMEEVEVAPPQKHEVRIKILFTSLCHTDVYFWEAKGQTPLFPRIFGHEAGGIVESVGEGVTDLQPGDHVLPVFTGECGDCRHCHSEESNMCDLLRINTERGVMIHDGESRFSINGKPIHHFVGTSTFSEYTVVHSGQVAKINPDAPLDKVCIVSCGLSTGLGATLNVAKPKKGQSVAIFGLGAVGLAAAEGARIAGASRVIGVDLNPKRFDEAKKFGVTEFVNPKDHDKPVQQVIAEMTDGGVDRSVECTGSVQAMIQAFECVHDGWGVAVLVGVPSKDDAFKSHPMNFLNERTLKGTFFGNYKPKTDIPGIVEMYMNKELELEKFITHTVPFSEINKAFDYMLKGESIRCIITMGA

SEQ ID NO: 67462 - protein, 379 aa, Fourraea alpina
MITTGQIIRCKAAVAWEAGKPLVMEEVEVAPPQKHEVRIKILFTSLCHTDVYFWEAKGQTPLFPRIFSHEAGGIVESVGEGVTDLQPGDHVLPIFTGECGDCRHCHSEESNMCDLLRINTERGGMIHDGESRFSINGKPIYHFLGTSTFSEYTVVHSGQVAKINPDAPLDKVCIVSCGLSTGLGATLNVAKPKKGQSVAILGLGAVGLAAAEGARIAGAARIIGVDLNPKRFEEAKKFGVTEFVNPREHDKPVQEVIAEMTDGGVDRSLECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 67463 - protein, 379 aa, Arabidopsis lyrata subsp. petraea
MITTGQIIRCKAAVAWEAGKPLVMEEVEVAPPQKHKVRIKILFTSLCHTDVYFWEAKGQTPLFPRIFGHEAGGIVESVGEGLTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVVKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTLPFSEINKAFDYMLKGESIRCIITMGA

SEQ ID NO: 67464 - protein, 502 aa, Coprinopsis cinerea okayama7#130
MPKTYTHKFDTQAYKGSSTISTGLFINGEWVDPVQGDEIDIVNPATGEVITKVAIGTKADVDKAVAAARKVCAYKTTWGLKASGSERARLLNKLADLIEKNLEELAALESLDVGKVYANAKVMDIGGAVIVFRYYAGWADKIQGTTVESGDTKLNYVRREPYGVCGQIIPWNFPMVAPALATGNTVVLKPSEVTPLTALRFADLVVEAGFPPGVVNIVNGYGHTVGAAIAEHPNIDKVAFTGSTLTGRRILKAAADSNLKPVTLELGGKSPTIIFDDADFEQALKWTTAGIYSNMGQVCTAGSRIFVQEGIYDKFVESFAAVAKGFGQATGDPFAEGTKHGPQVSQTQFDRVLSYIESGKKEGATAIVGGDKHGDKGYFIQPTIFTGVTKDMKIAREEIFGPVASVFKFKTEEGELSFVIELANDTVYGLAAYVFSENISRGIRVAHALEAGSVAVNSTVPFDVGMPFGGYKQSGIGRELGQYAIDTYTQNKAVHVNIGLRI

SEQ ID NO: 67465 - protein, 379 aa, Arabidopsis lyrata subsp. petraea
MITTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVIEKYMNKELELEKFITHTLPFSEINKAFDYMLKGESIRCIITLGA

SEQ ID NO: 67466 - protein, 156 aa, Myxococcus xanthus DK 1622
MDRTGGAWAVIHADSLPKVAAFLKNDPELEFKLFGSIDAVDRLHLAENDPRFEVVYFLYSLKRHEHVRLKVRVSEANPVVPTLVPLFRGANWWERLTFDFYGIRFDGHPDLRRILLYDEFEGHPLRKDYALRDRQPLIPERPIKDIFRGPGTSGLS

SEQ ID NO: 67467 - protein, 215 aa, Kluyveromyces lactis NRRL Y-1140
MSASFVTVRSKAISLESQTDSLLTKYSSFAQTTSSEPSGQETQLQEKLEKILNQRQETVESLQRIADSESNISTSKLSQLQRHRETLQDNWQTFRDIRSSIQQERNRLNLLFSVKKDLQNSASDNQNEYIQDEARRVENSHTVVDSLIDQAYETREQFMSQRVFLQRSSDRILQTLQHIPLINNVISKINTRRKKNAVILASLISICILVLFFTA

SEQ ID NO: 67468 - protein, 458 aa, Triticum aestivum
MAARAQNNVAAAQQQNRALGGGGGGVPAMGKQQKAAMAGRPDPKNTRRALGDIGNFEANNRRAPLGDIANVVNARAAEGKPQPHEPVNRPVTRNFGAQLLKNAQEKAKNPAARPAVRRAHHVKPPPPPPEHVIEISSDSDVTKSEAGSVSSVRKYSRKKVVTTLSHVLSARSKFAAGITEEPAIQDIDKLDGDNQLAVVDYIEDIYKFYKVAENECLASDYMDSQVEINAKMRGILIDWILEVHQKFDLMPESLYLTVYIIDMYLSLQSVLRRELQLVGVSALLIACKYEEIWAPEVNDFILISDSAYTREQILKMEKAILNRLEWNLTVPTPYVFLVRFAKAACSSDHKNDKEMENTVFFFAELALLQYGLVQSKPSMVAAAAVYAARLTLKKTPLWTDTLKHHTGFTEAQLMDAAKILVASHSTAPDSKLKVVYKKYSSEKLGGVALRPPATDLCK

SEQ ID NO: 67469 - protein, 388 aa, Bacillus cereus G9241
MIKNPKVLILTAHYGNGHVQVAKTLEQTFRQKGIKDVIVCDLFGESHPVITDITKYLYLKSYTIGKELYRLFYYGVEKIYDKKIASWYANFGRKRLKLLLQAEKPDIVINTFPIIAVPELKKQTGISIPVYNVLTDFCVHKIWIHREVDRYFVATDHVKKVMVDIGVPAEQIVETGIPIRSSFELKINPDIIYNKYQLCKNKKILLIVAGAHGVLGSVKELCQSFMSVPDLQVVVVCGKNEALKQDLLGLQEKNPDALKVFGYVENIDELFRVTSCMITKPGGITLSEAAALQVPVILYKPVPGQENENAMYFERKGAAVVIRDDSEVFAKTEALLQDDMKLLQMKEAMKSIYRPEPADHIVDTILAENHVEPNHIPIKSPALAQSFT

SEQ ID NO: 67470 - protein, 332 aa, Oryza sativa (japonica cultivar-group)
MSSRMAGSAILRHVGGVRLFTASATSPAAAAAAAARPFLAGGEAVPGVWGLRLMSTSSVASTEAAAKAEAKKADAEKEVVVNSYWGIEQSKKLVREDGTEWKWSCFRPWETYTADTSIDLTKHHVPKTLLDKIAYWTVKSLRFPTDIFFQRRYGCRAMMLETVAAVPGMVGGMLLHLRSLRRFEQSGGWIRTLLEEAENERMHLMTFMEVANPKWYERALVITVQGVFFNAYFLGYLLSPKFAHRVVGYLEEEAIHSYTEFLKDLEAGKIDNVPAPAIAIDYWRLPANATLKDVVTVVRADEAHHRDVNHFASDIHYQGMELKQTPAPIGYH

SEQ ID NO: 67471 - protein, 281 aa, Oryza sativa (japonica cultivar-group)
MAASTPAASRERRWSLAGKTALVTGGTKGIGRAIVEELAGFGVRVHTCSRHDADLQDCLRRWNAADGGGLGGGAAAPVTASVCDVSVRGDREALVAAARAALGGRLDILVNNVGQTLFGAAAACAAEDYARIMATNLESCFHLAQLAHPLLLGAGGAAASVVNISSVAGFIAYPALSVYSATKGAMNQLTRSLAAEWARDGIRVNCVAPGGVRTDIAGSSGVALEPGAARAMEEREAARVVMGRIGEPEEVASLVAFLCMPAAPYITGQVICVDGGRTITA

SEQ ID NO: 67472 - protein, 344 aa, Xanthobacter autotrophicus Py2
MKGLVYRGPGKKALEEVPHPRIEQPTDAVVKILRTTICGSDLHILKGDVPTVKPGTVLGHEGVGVIEEVGQAVSAFRKGDHVLISCISSCGRCEYCKRGMYSHCSVAGWMLGHTIHGTQAEYVRIPFADTSLHRIPDGMDEEALVMLSDILPTGFECGVLNGKVQPGSTVAIVGAGPVGLAALLTAQFYSPAEIIMIDLDDNRLEVALTFGATKTVNSGRENAVERVMALTGGIGVDTAIEAVGIPATFVLCQDIVAPGGTIANVGVHGTKADLHLERLWAHNITLTTRLVDTVTTPMLLKTVQSKKLDPQRLITHRFALADILEAYETFEKAAQTRALKVIIG

SEQ ID NO: 67473 - protein, 544 aa, Ralstonia eutropha JMP134
MPTDFDSGLGRNAANFVPITPIDFLVRAAEVYGDRPAIVHGPVRQNWRDTYVRARRLASALARAGVGKGDTVAALLPNTPAMVEAHFGVPMAGAVLNALNIRLDAANLVFMLRHGEARVLLADTEFADLARQMALEIPGLKVIAVEDALGPQAERFGDTDYESFLASGDPEYAWKMPDDEWDAIALNYTSGTTGDPKGVVYHHRGAAMNAISNILEWDLPKHPVYLWTLPLFHCNGWCFPWTIAARAGVNVCLRKFEPRLVFDLMRDEGVTHYCAAPIVHTALVNAPPSWREGLRGPVRGMVAGAPPPAAVLAQMEAMGFELTHVYGLTEVYGPAAVCAEQDGWDSLSQEERAVKKARQGVRYHLQSGVAVLDPDSMQPVPADGETIGEIMFRGNICMKGYLKNEKATREAFAGGWFHTGDLGVCMADGYIKIKDRSKDIIISGGENISSVEVEDALYRHPAVLAAAVVAQPDAKWGETPCAFVELKDGASATAEELMAHCRTLLAGFKVPKAVYFGPLPKTSTGKIQKFELRRKVKSDSAIDV

SEQ ID NO: 67474 - protein, 318 aa, Synechococcus sp. RS9917
MGPEHQPAFAIDAVPGLADLLTALEVGDAGRWLERWQQRGGAAFQHQAWGHPVAEPWVWAIALPLLTALERHCRAGERRLVGLSGLPGCGKSTLARWLASAAADLDLPVAVVSIDDFYWPGEQLEQAMAGNPWGVPRALPGSHDLELLNASLERWRRSGELRMPQFEKSLRGGRGDRSGWQQQTAQVVLLEGWFLGACPGHASTESFEAISALALSEAERQGRAQALNQLVHYQPIWDRLDDLWHLKAPSPSASRRWKEEQERAMEQRTGIRLPAEELEGFVRMIETAIPETVLQNPRDVAVVVHLTETRRVREVQLR

SEQ ID NO: 67475 - protein, 322 aa, Brassica napus
MFFDGYHYPGTTFEHSYRCYPASFIDKPQIESGDKIIMPPSALDRLASLHIDYPMLFELRNAGSERVSHCGVLEFIAEEGMIYMPYWMMQNLLLQEGDIVRVRNVTLPKGTYVKLQPHTTDFLDISNPKAILETALRNYSCLTTGDSIMVPYNNKKYFIDIVETKPANGISIIETDCEVDFAPPLDYKEPERPKAPAAAAKALAKAEEVVAEPEPKFNPFTGSGRRLDGRPLSYEPPSSSSSSSKDKQPAVANGNGQSSVASGSERAARQAQGKLVFGANANRAPKEAPKVGAGKETKKEEEEKKEESKFQAFTGKKYSLRG

SEQ ID NO: 67476 - protein, 471 aa, Ralstonia solanacearum GMI1000
MSQSIADVMKLVKENDVKFVDFRFTDTKGKEQHVSVPVSHFGEDKFESGHAFDGSSIAGWKGIEASDMLLMPDANTAHIDPFYEEPTLVMTCDVIEPSDGKGYDRDPRSIAKRAEAYLKSTGLGDTAYFGPEPEFFIFDGVTWNVDMQGSFVKIHSEEAPWSSGKEFEHGNSGHRPGKKGGYFPVAPIDTFQDIRSEMCLILESLGIPVEVHHHEVAGQGQNEIGTKFSTLVQRADWTQLQKYVIQNVAHTYGKTATFMPKPVVGDNGSGMHVHQSVWKDGQNLFAGNGYAGLSEFALYYIGGIIKHARALNAITNPGTNSYKRLVPGFEAPVKLAYSARNRSASIRIPYVANPKGRRIETRFPDPLCNPYLGFAALLMAGLDGVQNKIHPGEAADKNLYDLPPEEDAKIPTVCSSLDQALEYLDKDREFLTRGGVFTNSMIDAYIELKMEEVTRFRMTTHPVEFEMYYSL

SEQ ID NO: 67477 - protein, 379 aa, Arabis procurrens
MITTGQIIRCKAAVAWEAGKPLVMEEVEVAPPQKHEVRIKILFTSLCHTDVYFWEAKGQTPLFPRIFGHEAGGIVESIGEGVTDLAPGDHVLPIFTGECGDWPHCHSEESNMCDLLRINTERGGMIHDGESRFSINGKPIHHFVGTSTFSEYTVIHSGQVAKINPDAPLDKVCIVSCGLSTGLEAPLNVANPKKGQSVAIFGLGAVGLAAVEGARIAGASRIIGVDLNSKRFDEAKKFGVTEFVNPKDHDKLVQQVIAEMTNGGVDRSVECTGSVQAMIQAFECVHDGWGVAVLVGVPSKDDAFKTHPMNFLNERTLKGTFFGNYKPKTDIPGLVEKYMNKELEIEKFITHTVPFSEINKAFDYMMKGEGIRCIITMGA

SEQ ID NO: 67478 - protein, 585 aa, Gossypium hirsutum
METHRRSSTNSIRSHKPARPIALEDDSTKASDALPLPLYLTNAVFFTLFFSAVYFLLCRWREKIRSSTPLHVVTFSEIVAILASVASFIYLLGFFGIDFVQSLVLRPSADVWATEDDEVESEVLLRNEDARHVPCGQALDRSIRSLQPPEPIVTAEKVFDEMPVTVMTEEDEEIIRSVVCGMTPSYSLESKLDDCKRAAAIRREALQRITGKSLSGLPLDGFDYESILGQCCEMPVGYEQIPVGIAGPLLLNGREYSVPMATTEGCLVASTNRGCKAIHLSGGATSVLLRDGMTRAPVVRFGTAKRAADLKLYLEDPENFETLACVFNRSSRFARLQSIKCAIAGKNLYLRFSCFTGDAMGMNMVSKGVQNVLDFLQTDFPDMDVIGISGNFCSDKKPAAVNWIEGRGKSVVCEAIINGDVVTKVLKTSVESLVELNMLKNLTGSAMAGALGGFNAHASNIVTAVYIATGQDPAQNVESSHCITMMEAVNGGKDLHVSVTMPSIEVGTVGGGTQLASQSACLNLLGVKGASKESPGANSILLATIVAGAVLAGELSLMSALAAGQLVKSHMKYNRSSKDVSKVSS

SEQ ID NO: 67479 - protein, 379 aa, Arabis procurrens
MITTGQIIRCKAAVAWEAGKPLVMEEVEVAPPQKHEVRIKILFTSLCHTDVYFWEAKGQTPLFPRIFGHEAGGVVESVGESVTDLAPGDHVLPIFTGECGDCPHCHSEESNMCDLLRINTERGVMIHDGESRFSIDGKPIYHFVGTSTFSEYTVIHSGQVAKINPDAPLDKVCIVSCGLSTGLGATLNVAKPKKGQSVAIFGLGAAGLAAAEGARIAGASRIIGVDLNSKRFDEAKKFGVTEFVNPRDHDKPVQQVIAEMTDGGVDRSVECTGSVQAMIQAFECVHDGWGVAVLVGVPSKDDAFKTDPMNFLNERTLKGTFFGNYKPKTDIPGLVEKYMNKELEIEKFITHTVPFSEINKAFDYMLKGKGIRCIITMGA

SEQ ID NO: 67480 - protein, 628 aa, Gossypium hirsutum
MEASRRSAVKPVIVLKPSKRFPLVEDTPGKASDALPLPLYLTNAVFFTLFFTVVYFLLSRWREKIRASIPLHAVTFPEIVAIFAFVASLIYLLGFFGIDFVQSLIIRPSGDVWSGEDYEEENEVLLHEEDARTVPCGQALDCSVPSLPHMARNVTAQRLFDEKPVRVATEEDARKVSCGQAVDCSLHSLPPRPPIVTSQKLFHEKTVIVTTEEDEEIIKSVVAGTLPSYSLESKLGDCKRAAAIRREALQRLTGRSLSGLPLDGFDYESILGQCCEMPVGYVQIPVGIAGPLLLNGREYSVPMATTEGCLVASTNRGCKAIHLSGGATSILLKDGMTRAPVVRFSTAKRAAELKFYLEDPENFDTLAVVFNRSSRFGRLQSIKCAIAGKNLYLRFTCSTGDAMGMNMVSKGVQNVLDFLQTDFPDMDVIGISGNFCSDKKPAAVNWIEGRGKSVVCEAIIEGDVVRKVLKTSVESLVELNMLKNLTGSAMAGALGGFNAHASNIVTAIYIATGQDPAQNVESSHCITMMEAVNDGKDLHISVTMPSIEVGTVGGGTQLASQSACLNLLGVKGASKDVAGANSRMLATIVTGAVLAGELSLMSALAAGQLVKSHMKYNRSSKDMSNLSS

SEQ ID NO: 67481 - protein, 379 aa, Arabidopsis thaliana
MSTTGQIIRCKAAVAWEAGKPLVIEEVEVAPPQKHEVRIKILFTSLCHTDVYFWEAKGQTPLFPRIFGHEAGGIVESVGEGVTDLQPGDHVLPIFTGECGDCRHCKSEESNMCDLLRINTERGGMIHDGESRFSINGKPIYHFLGTSTFSEYTVVHSGQVAKINPDAPLDKVCIVSCGLSTGLGATLNVAKPKKGQSVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 67482 - protein, 379 aa, Pseudoturritis turrita
MITTGQIIRCKAAVAWEAGKPLVMEVVEVAPPQKHEVRIKILFTSLCHTDVYFWEAKGQTPLFPRIFGHEAGGIVESVGEGVTDLQPGDHVLPIFTGECGDCRHCHSEESNMCDLLRINTERGVMIHGGESRFSINGKPIYHFLGTSTFSEYTVVHSGQVAKINPEAPLDKVCIVSCGLSTGLGATLNVAKPKKGHSVAIFGLGAVGLAAAEGARISGASRIIGVDLNPKRFEEAKKFGVTEFVNPRDHDKPVQQVIAEMTDGGVDRSVECTGSVQAMIQAFECVHDGWGVAVLVGVPSKDDAFKTHPMNFLNERTLKGTFFGNYKPKTDIPGVVEKYMNKELEIEKFITHTVPFSEINKAFDYMLKGEGIRCIITMGA

SEQ ID NO: 67483 - protein, 379 aa, Barbarea vulgaris
MITTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPEAPLDKVCIVSCGLSTGLGATLTVAKPKKGQSVAVFGLGAVGLGAAEGAKMAGASRIIGVDLNPKRFEEAKKFGVTEFVNPREHDKPVQQVIADMTNGGVDRSVECTGSVQAMIQAFECVHDGWGVAVLVGVPSKDDAFKTHPMNFLNERTLKGTFFGNYKPKTDIPGVVEMYMNKELELEKFITHTVPFSEINKAFDYMLKGESIRCIITMGA

SEQ ID NO: 67484 - protein, 266 aa, Oryza sativa (japonica cultivar-group)
MTAANLDSEMGLIGEMMVQYPYVTIDVEFAGVVHHPPYTGSRPTPDEIYAALKSNVDEVPAVQIGITLSDAEGNLPTRSSSSPEQEIAWEVVFSDFDAGRDPHVVDSVEFLKNQGIDFDLARQIGVTSTAFGEKLLAILPPPSRRGELTWSAFGGAYDMGYLLKMLTGGQPLPETRQQFMQLVKSRLGGGRIFDSKYLVEHDRQDLRNAGLRHTADVLGVRQQEGVKMLAGHKSVVAAAIFATIRSQGVSPPAWSYRWNFIVHIYL

SEQ ID NO: 67485 - protein, 269 aa, Triticum monococcum
MDVADIASPSGQQEQGHRTVSSEPPKRPAGRTKFHETRHPLYRGVRRRGRVGQWVCEVRVPGIKGSRLWLGTFNTAEMAARAHDAAVLALSGRAACLNFADSAWRMLPVLAAGSFGFGSASEIKAAVAVAVVAFQRKQIVLPVAVAVVALQQKQVPIAVAVVALQQKQVPVAVAVVALQQLPVPVAVAVVALQQQQIILPVACLAPEFYMSSGDLLELDEEQWFGGMEAGSYYASLAQGMLVAPPDERARPESGEQSGVQTPLWSCLFD

SEQ ID NO: 67486 - protein, 345 aa, Coprinopsis cinerea okayama7#130
MGLKSTDTPPNRLNPKGYKWAEHISTRLNTGLRPLTPILLIILFTSLFNQSPLGTHFYSWLNHHYTPFQINAYWSFGVTSIVYWVGGLVFLVGDLFQPRFLHQYKIQPAQHVSWGDYKKIMWVVARNQVGICFDYYLLVALPLSILNAYISPLPTGFPLPGTLETIWTYIFCLACEEIGFFYVHRTLHAPIFYKRFHKMHHEFVAPVAFASTYCTLTEHLFSNILPIILGISLLKAHWSLMIMFFSSLELATLSSHSGYNLPFNNNALQHDWHHFFYTENYGPTGLLDSLHGTNRVFKAWMGELRRRDGGGRVKEGEEVLREGRRELATGEVRGVTPPEMVDKED

SEQ ID NO: 67487 - protein, 229 aa, Glycine max
  misc_feature (138)..(138): Xaa can be any naturally occurring amino acid
SSRIGSSTRRQKGDNSSQLRSAPPRKKREMATETKVQELGGITDVHGAANSVEINNLARFAVEEQNKRENSVLEFVRVISAKQQVVAGVNYYITLEAKDGLIKNEYEAKVWVREWLNSKELLEFKPVNVSSTPIGGIXRVTANSLEIDILARFAVDQHNKKENANLEFVGVIRAKQQVVEGFIYYITLEAKDGETKNVYETKVWVRSWLNSKEVLEFKPISINPLSVSV

SEQ ID NO: 67488 - protein, 572 aa, Arabidopsis thaliana
MVGGGGGSSGRGGGSGSGSSKQQRGFSMNPKDYKLMEEIGHGASAVVYRAIYLPTNEVVAIKCLDLDRCNSNLDDIRRESQTMSLIDHPNVIKSFCSFSVDHSLWVVMPFMAQGSCLHLMKTAYSDGFEESAICCVLKETLKALDYLHRQGHIHRDVKAGNILLDDNGEIKLGDFGVSACLFDNGDRQRARNTFVGTPCWMAPEVLQPGNGYNSKADIWSFGITALELAHGHAPFSKYPPMKVLLMTIQNAPPGLDYDRDKKFSKSFKEMVAMCLVKDQTKRPTAEKLLKHSCFKHTKPPEQTVKILFSDLPPLWTRVKSLQDKDAQQLALKRMATADEEAISQLIDDDDLEESKEDEEILCAQFNKVNDREQVFDSLQLYENMNGKEKVSNTEVEEPTCKEKFTFVTTTSSLERMSPNSEHDIPEAKVKPLRRQSQSGPLTSRTVLSHSASEKSHIFERSESEPQTAPTVRRAPSFSGPLNLSTRASSNSLSAPIKYSGGFRDSLDDKSKANLVQKGRFSVTSGNVDLAKPTAQPQTIKEHSSHPTSSSPIMPQLQHLFQQNSIQQVRNIH

SEQ ID NO: 67489 - protein, 483 aa, Halobacterium sp. NRC-1
MREAIPAVIETVLGAADGDIDAVAFSRGPGLGPCLRIVGSAARALAQALDVPLVGVNHMVAHLEIGRHQSGFQQPVCLNASGANAHVLAYRNGRYRVLGETMDTGVGNAIDKFTRHVGWQHPGGPKVETHARDGEYTALPYVVKGMDFSFSGIMSAAKDAVDDGVPVADVCRGLEETMFAMLTEVAERALALTGRDELVLGGGVGQNDRLRGMLEAMCAARGASFHAPEPRFLRDNAGMIAVLGAKMAAAGATIPVADSAINSQFRPDEVSVTWRDPESPARDPGADAVRQGAEATVTFADDAVIKERAPKAYRHDRLDDRLRRDRTVLEARLTSDARRQGVPTPLVRDVDVPAATITLQHVGDADLRDALSPARVRAVGRHLATIHDGGFVHGDPTTRNVRVGAERTFLIDFGLGYYTDAVEDYAMDCHVFEQSLVGTAADADALVAAFEDAYEEAAASGRVLDQLRAVEGRGRYQDDPETA

SEQ ID NO: 67490 - protein, 167 aa, Corynebacterium diphtheriae NCTC 13129
MSTAVKVVVMGVSGSGKTTVGTLLAERLGVEYRDGDDLHSQANIEKMASSIPLNDDDRWPWLAQVGEWLAAQLAGGVIGCSALKRSYRDVLRRECPEVVFVHVYGSREVLLERMNHREGHFMPASLLDSQFATLQPLENDEVGHVFDVTDSPAQIADAAARWLSERS

SEQ ID NO: 67491 - protein, 96 aa, Glycine max
  misc_feature (17)..(17): Xaa can be any naturally occurring amino acid
DSSMISYPADTTDNPAXAEMTAPFTDLNALHVLPTIKTNNELTSIASNPGKLLCMQVCTPLVNKKFETLSYLPDLDDATFEDEPEYLLMNGWIPCL

SEQ ID NO: 67492 - protein, 288 aa, Prochlorococcus marinus str. MIT 9303
MIDGHHSPLLRKQSPYPHWQYLHPESGDRLRIVPERGGLVTDWCCNGHELLYFDQERFADPEKSIRGGIPVLFPICGNLPGDLLPLPSGEFILKQHGFARDQPWELQLLEDHSGVKLSLADSEETRAVYPFAFLLEMVVRPIRNALEIEVNVHNRSQTAMPFSFGLHPYFKVTDLSQVRLEGLPNSCLNHLQMAEAETAIQLAALTEGVDFLTRPEGPVTLVDEASWRSLQLQHENPMDLTVVWTDPPRQMLCLEPWTGPREALISGDRKLEIEAGGKQRLCCGYFSS

SEQ ID NO: 67493 - protein, 447 aa, Chlorobium limicola
MADPNHRNSLTITDNRTGKSYELPIENGTVRTMDLRQIKASEDDFGLLGYDPAFLNTCSCKSQITFIDGEKGILRYRGYPIEQLAEKSSFLETAYLLIKGELPDKERLAVWTYNIRHHTMTHANLTKFMDGFRYDAHPMGILVGTVGALSTFYPDAKQVSEEESRKLQVRRLIGKIPTLAAMSFRHSLGFPYVLPDNDLSYAGNFLSMMFRMTEQKYEPNPVLEKALDVLFILHADHEQNCSTNAVRSVSSSMVDPYSAIAAGCAALYGPLHGGANEAVIRMLEGIGSVDNIPAFIKSVKSGEGRLMGFGHRVYKNYDPRARIIKKIAFEVFEETGRNPLLDIAIELERIALEDDYFVGRKLYPNVDFYSGLIYQAMGFPTDMFPVLFAIGRTPGWLAQWIEHVKDPEQRIARPRQIFLGAPCRDYVPLDERPSRGDDEEKFGICRL

SEQ ID NO: 67494 - protein, 425 aa, Rhodospirillum rubrum ATCC 11170
MDYFSYRNGQLHAEDVALAAIAEAVGTPFYVYSAATLERHFRVFSDAFAGQPITLCFATKTNGNKAVLALLAGLGAGADVVSQGEMEHALAAGVPAGRIVFSGVAKTKAEMAAALEAGIFQINVESEPELEALSEVAQALGKTAPVALRINPDVAAATHDKIATGRKENKFGIDWTVAPAIFAKAAGLPGIAVKGVAVHIGSQILDLDPFRRAFERLRELVLALRADGIALERVDLGGGLGIPYHRDDPASPPPAEYAALARRIFGDLGVHLVAEPGRLIAGNAGMLVSRVVYRKQGETRTFLILDAGFNDLIRPAMYDAFHDILPVTAAAENAVLTPVDVVGPICESGDIFARQRPLPPIAAGDLVAFATAGAYGASMSSTYNGRPLVPEVMVSGDRFAVVRRRPSVAEMTALESVPPWLAKQA

SEQ ID NO: 67495 - protein, 452 aa, Pseudomonas putida KT2440
MNAPFDQLSTWLKEHRITEVECVISDLTGIARGKIAPTAKFLHERGMRLPESVLLQTVTGDYVDDDIYYNLLDAADIDMVCRPDPTAVYQIPWAIEPTAIVIHDTFDKQGNPIELSPRNVLKKVLKLYADKGWQPIVAPEMEFYLTKRCEDPDLPLQVPLGRSGRAESGRQSFSIDAANEFDPLFEDVYDWCEIQGLDLDTLIHEDGPAQMEINFRHGDALDLADQITVFKRTMREAALKHNVAATFMAKPITDEPGSAMHLHQSVVDIATGKPIFANEDGSMSQLFLHHIGGLQKYIPKLLPMFAPNVNSFRRFLPDTSAPVNVEWGEENRTAGLRVPTSSPEAMRVENRLPGADANPYLAIAASLLCGYLGMVEQIDPSAPVQGRAYERRNLRLPITIEDALQHMEDCETVQQYLGKQFVQGYVAVKRAEHENYKRVISSWEREFLMLSV

SEQ ID NO: 67496 - protein, 578 aa, Magnaporthe grisea 70-15
MDGNPQAFTIYTFFQLLINYLSGERALIIMTHGREPVEHLWPMNYVMSRVDISDPYSFLAIKRGILQYAWLKPTLALAAVIMKATGTYKEGYLGLDSGYFWSGLVYNVSMTICLYCLALFWVCMHDDLKPFRPVPKFLCIKLIIFASYWQGFFLSILVWLGAITDKVEGYSPDNLAAAIQDFLICIEMPIFAVAHWYAFSWHDFANDAIEEARMPVKFALRDSFGIRDLIEDSKETFKGDKYGYRGFDSRDKIMAHESSKSRLARVKAGMRYERGGKGKYWIPSPGEITSDVNPYTPLLGGKNGNGGGQSNSPGGPSRTSSSSNVHEDSGIIGDDKLDPEEELLYDKARKLEYGDWNYPVIIANVPRRPWETSRPSPQSGRSRTSLPAPSSFSANGRGLKERDQRQDDEGAVVAKKSKGKGKAKPRAAAQSGRSTSPQETPRPAVEAQAKPDLSEIDFDVSKMSSTDENNTSSVAPQSESESNHWEDESEPAVISPKYDIDEEDMRNLFERLNGYHEEPEGKTTRPIYWRPHFPENLLRKGTSQGSPLIARSTVEPVAQFVALQCTLWVQAKITLDQV

SEQ ID NO: 67497 - protein, 243 aa, Zea mays
  misc_feature (103)..(103): Xaa can be any naturally occurring amino acid
SGLSGSSAIVCAALSCLLDFYNVRHLIKVEMRPNLILNAEKELGIVAGLQDRVAQVYGGLVYMDFSQGHMDKLGHGIYMPLDVNLLPPLYLIYADNPSDSGKXVHSTVRQRWLSGDDFITSRMKEVAQLALDGHKALLQKDYTELARFMNKNFDLRREMFGDDVLGALNIKMVDVATQRGRSVQVHWQRRRSGGAVPRWGFAGGASPQGMPGGRLCSTASESCPLGADGRGAVKFIISFLVER

SEQ ID NO: 67498 - protein, 418 aa, Ralstonia solanacearum GMI1000
MAIVDVKVPQFSESVEEGTLISWKKKPGEAVTVDEVLVEIETDKVVLEVPAPSAGVLAEVLVADGATVTSEQLLAKIDTEGKAGAAAPAAAAPAPAAAAPAPVAAAPAAAAATGGVAMPSAAKLMAEANLSAGQVAGTGRDGRITKGDVLGAVAGGAKPAPAAAPQAARPALQQVAAPVDFAVLGDRPEERVPMSRLRARIAERLVQSQSTNAILTTFNEVNMKPVMDLRAKFKDQFEKTHGVKLGFMSFFVKAAVHALKKYPVINASVDGNDIVYHGYFDIGIAVGSPRGLVVPILRNADQMSLADIEKKIAEFGQKARDGKLTLDDLTGGTFSISNGGTFGSMLSTPIINPPQSAILGVHATKDRAVVENGQVVVRPMNYLAMSYDHRIIDGREAVLGLVAMKEALEDPARLLLDL

SEQ ID NO: 67499 - protein, 231 aa, Oryza sativa (japonica cultivar-group)
MAEVGVIPVLPEPGPTTISAPRHTAADARGAPETESYNRAVQRLKDGSGKGSATEADARCGCSRATSRWCRSYANFSADSAESYGNMMKNKVLGTDGSDGDMPAAQMPAFAYLHLNHDYGDDDKMFFCDDDQRLVMRTDTYIVPSLFLVTTFQDELDALFPERGAVFHYLGRYLFPQANHTAVLQRVPRAGVAAAGRRPGARLRPPARRSRRTSSSSSSSRARGRRSCYRR

SEQ ID NO: 67500 - protein, 501 aa, Oryza sativa (japonica cultivar-group)
METRELWVLAAALAVSLLYYLAALMRYAGGGCSRSSRPPLPPGPTPLPLIGNLLSLRGVLHHRLASLARVHGPVMALRLGLTTAVVVSSRDAAAEAFTKHDRRLAARVVPDSNRAHGFSDRSIIWLPSSDPRWKALRGIQATHLFSPRGLAAVRSVRESKVRDIVAYFRSRAGEEVVFGEAIYSGVLNLVSSSFFSVNMAGVGSEEAHGLRELVEDLVEAIAKPNVSDLFPFLRQLDLQGLRRRTEERMARAFGILDGIIDRRLANRTHGDRHGDFLDALLDLVSEGKMARDHVTIMLFEVFGAGSDTMSVSLEWAMAELLRNPRAMRKARAELEDAAAVVEESDAARLPYLQAVVKEAMRLHPVGPILLPHRAVEDGVEIGGYAVPRGAMVIFNAWAIMRDPAAWERPDEFVPERFMETTTAIDFRGKEYEYLPFGSGRRLCPGLPLAERVVPFVLASLLRAFEWRLPDGVSAEDLDVSERFNTANVLAVPLKVVPVIVN

SEQ ID NO: 67501 - protein, 274 aa, Hyoscyamus niger
MAGESEVYINGNNGGIRWSLKGTTALVTGGSKGIGYAVVEELAGLGARVYTCSRNEKELQQCLDIWRNEGLQVEGSVCDLLLRSERDKLMQTVADLFNGKLNILVNNAGVVIHKEAKDFTKEDYDIVLGTNFEAAYHLCQLAYPFLKASQNGNVIFLSSIAGFSALPSVSLYSASKAAINQITKNLACEWAKDNIRVNSVAPGVILTPLIETAIKKNPHQKEEIDNFIVKTPMGRAGKPNEVSALIAFLCFPAASYITGQIIWADGGFTANGGF

SEQ ID NO: 67502 - protein, 474 aa, Oryza sativa
MKNMKFLTDKRPPSLVVAEALQLLVVIVVAAWDREPHLSLPCSAPPDPPLSSSLPFLLPWKRSQGASRRRPSPRLHNHRPAVGSAQVGSAPDGSAVSLLHLLLRRLRRFHDPRRPLALPPSSPLARARRWDPSGSKDCKIVRGIIDAVAKIIGTSELQISLCKEMVEWTRAEKRTFLRQRVEARLAALLLENQEYTDALTLLTDLIKEVRRLDDKLLLVDIDLLESKLHFSLRNLPKAKASLTAARTAANAIYVPPAQQGTIDIQSGILHAEEKDYKTAYSYFFEAFEAFSALEDPKAIFSLKYMLLCKIMVNQADDVAGIISSKAGLKYLGPDVDAMKAVADAYSKRSLKYFETALRDYKSQLEEDPIVHRHLSSLYDALLEQNLCRLIEPYARVEIAHIAEMIELPVDHVEKKLSQMILDKKFAGTLDQGAGCLIIFEDPKTEAIFPATLETISNVGKVVDSLYMRSAKIMA

SEQ ID NO: 67503 - protein, 500 aa, Oryza sativa (japonica cultivar-group)
MENSQMWLLWGALSVALFFYFSTLRRRYAGGKPLPPGPTPLPLIGNLHLVGGGTFHHKLRDLARVHGPVMTLKLGLATNVVISSREAAIEAYTKYDRHLAARATPDTFRACGFADRSMVFIPSSDPQWKALRGIHASHVFTPRVLAAVRPIRERKVGDLIAYLRAHAGEEVLVGHAMYTGILNMVSFSYFSVDIVDMGSQMARELREVVDDIILVVGKPNVSDFYPFLRPLDLQGLRRWTTKRFNRVFSIMGDIIDRRLAHIRDNKPRHDDFLDSILELMAAGKIDRVNVLNMLFEAFVAGADTMALTLEWVMAELLKNPSVMAKARAELRDVLGDKEIVEEADAARLPYLQAVLKEAMRLHPVGALLLPHFAMEDGVEVGGYAVPKGSTVLFNAWAIMRDAAAWERPDEFVPERFVERTPQLDFRGKDVEFMPFGSGRRLCPGLPLAERVVPFILASMLHTFEWELPGGMTAEELDVSEKFKTANVLAVPLKAVPVLIK

SEQ ID NO: 67504 - protein, 477 aa, Vitis pseudoreticulata
MYETDVGIITGKTFPTFDPRTGEVIANVAEGDAEDINRAVSAARKAFDEGPWPRMSPYERSRILLRFADLAEKHNDELAALETWNNGKPYEQAAKAELPLFVRLFRYYAGWADKIHGLTVQADGPHHVQILHEPIGVAGQIIPWNFPLMMFAWKVGPALACGNTIVLKTAEQTPLTALFAAKLFHEAGLPPGVLNIVSGYGPTAGAALASHMDVDKIAFTGSTDTGKIVQELAAKSNLKPVTLELGGKSPFIVCEDADIDQAVELAHFALFFNQGQCCCAGSRTFVHESVYDEFIEKAKARALSRTVGDPFKKGIEQGPQIDPEQFAKVLRYIKSGVESNATLECGGGRIGSKGYFVQPTVFSNVQDDMLIAKDEIFGPVQSILKYKDLDEVIRRANSTRYGLAAGVFTKNINTANTLTRALRVGTVWVNCFDVFDAAIPFGGYKMSGVGREKGIYNLNNYLQVKAVITPLRNPAWL

SEQ ID NO: 67505 - protein, 173 aa, Brassica napus
MGTYLSSPKTEKLSEEGENDTLRYGLSSMQGWRATMEDAHAAILDVDDKTSFFGVYDGHGGKVVAKFCAKYLHQQVLSNQAYGAGDIETSLQRAFFRMDDMMQGQRGWRELAALGDKMNKFSGMIEGFIWSPRSGGDVNNQPDNWPLEDGPHSDFTGPNCGCTACVALIKDKK

SEQ ID NO: 67506 - protein, 281 aa, Arabidopsis thaliana
MAADNAYLMQFVDETSFYNRIVLSHLLPANLWEPLPHFLQTWLRNYLAGTLLYFISGFLWCFYIYYLKINVYLPKDAIPTIKAMRLQMFVAMKAMPWYTLLPTVSESMIERGWTKCFASIDEFGWILYFVYIAIYLVFVEFGIYWMHRELHDIKPLYKYLHATHHIYNKQNTLSPFAGLAFHPVDGILQAVPHVIALFIVPIHFTTHIGLLFMEAIWTANIHDCIHGNIWPVMGAGYHTIHHTTYKHNYGHYTIWMDWMFGSLRDPLLEEDDNKDSFKKAE

SEQ ID NO: 67507 - protein, 828 aa, Escherichia coli CFT073
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGKYDKEGEFTPITWDQAFDVMEEKFKTALKEKGPESIGMFGSGQWTIWEGYAASKLFKAGFRSNNIDPNARHCMASAVVGFMRTFGMDEPMGCYDDIEQADAFVLWGANMAEMHPILWSRITNRRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEELLAKKPELRGKTLYEVLYATPEVSKFPVSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 67508 - protein, 211 aa, Vibrio vulnificus CMCP6
MSFKTAEVSSLAERINWEKVDGLVPAIVQDFQSSQVLMMGYMNQEALVKTGETGQVTFFSRTKERLWTKGETSGNVLQLVNMSLDCDNDTLLVKVNPIGPTCHTGTTTCWDGDPQEESQMVWLHQLEQLLAARKSAGPDSSYTASLYARGTKRISQKVGEEGVEVALAATSGDKAELVCESADLIYHLLVLLQDQGLSMNDVINKLKERHK

SEQ ID NO: 67509 - protein, 239 aa, Thiobacillus denitrificans ATCC 25259
MPKGKSKSAARLPVFDLNGRDGVPDVRIVGFKAHNLIRMAAMGLPVPQGFVMGTDWCGAIRNGEGVKVHLPDALQSGIRDLERATGLGFGSARRPLLVSVRSGAPVSMPGMMETVLNVGLNDVSLAGLLRLTGDHRLVWDSYRRLIQAFAEIVAVIPAEPFEAALDATLRRAGADVARQLDFQALRDLAHIYLDLYHGHTGREFPQDPFEQLWMACRRLKALLGKVISNCIKFWKALET

SEQ ID NO: 67510 - protein, 357 aa, Vibrio vulnificus CMCP6
MSKQQKILFIDRDGTLIVEPPVDFQVDRLDKLKLEPFVIPSLLSLQDAGYRLVMVTNQDGLGTDSYPQEDFDAPHNMMMEIFESQGVKFDDVLICPHFEKDNCSCRKPKLGLVKEYLQAGKVDFQNSFVIGDRQTDLQLAENMAIRGIQYNPEIMGWKRILKDLTVKARVAEVVRTTKETDIKVFVNLDEQGGNAISTGLGFFDHMLDQIATHGGFQMVCKVEGDLHIDDHHTVEDTALALGQALKEALGDKRGIGRFGFSLPMDECLAQCALDLSGRPYLKFDAQFSREQVGDLSTEMVVHFFRSLTDTLACTLHLSSAGNNDHHIIESLFKAFGRTLRQAIKVEGTELPSSKGVL

SEQ ID NO: 67511 - protein, 193 aa, Coccidioides immitis RS
MAEIRRKLVIVGDGACGKTCLLIVFSKGTFPEVYVPTVFENYVADVEVDGKHVELALWDTAGQEDYDRLRPLSYPDSHVILICFAIDSPDSLDNVQEKWISEVLHFCSGHPIILVGCKKDLRHDARTIEELHKTSQKPVTPEQGEEIRKKIGAYKYLECSARTGEGVREVFECATRAALLAKTEKKKKLCKIL

SEQ ID NO: 67512 - protein, 360 aa, Glycine max
MAHNSDSATSNLLLLCSENSSTCFDDDGLECDAADGSNSRISHHEGGGGSELLLACFVAQSEEAVRAMVEREKEHLPRDDYLMRLRSGGLDLDLLGVRKEALDWIWKAHSYLGFGPLSFCLAVNYLDRFLSVFELPRGVSWTVQLLAVACLSIAAKMEEIKVPQSVDLQVGELKFLFEARTIQKMELLVLSTLRWKMCAITPCSFIDYFLGKITCEQHPAKSSISISVHLILGIIRGIDFLEFWPSEIAAAVAASVLKESQVIEIDKAITDLLVVEKGRVLKCVELIRDLSLINVAASLGSKVPYVPQSPIGVLDAGCLSYKSDELTVGSSCPNSSHNTSNPNPTKRSKPDEPSNGTSNS

SEQ ID NO: 67513 - protein, 669 aa, Prochlorococcus marinus str. MIT 9303
MVAATASLDTLCINSIRMLAVDAVNKANSGHPGLPMGCAPMGYTLWDQFLHHNPKNPQWFNRDRFVLSAGHGCMLVYSLLHLTGYDSVSIEDIKQFRQWGSRTPGHPETFETPGVEVTAGPLGAGISNAVGLAIAEAHLAAKFNKPEAKIVDHFTYVVMGDGCNQEGISSEACSLAGHLKLGKLIALYDDNHITIDGRTDVSFTEDVLKRYEAYGWHVQHVANGDTDVNAIAKAIAAAKAVTDKPSIIKVTTTIGYGSPNKSDTAGVHGAPLGEEEATLTRQQLGWNYGPFEIPQEAYDQYRKAIDQGARLESEWNQALANYRSQYPNEAAEFERMLRGELPKGWDKDLPTYTPEDSGLATRKHSQICLGALGPNLPELIGGSADLTHSNYTDIKGETGSFQPETPEKRYLHFGVREHAMAAILNGIAYHNSGLIPYGGTFLVFADYMRGSMRLSALSELGVIYVLTHDSIGVGEDGPTHQPVETIPSLRAMPNMLVFRPGDGNETSGAYKLAIQNRKRPSSLCLSRQGMANQANSSIENVALGGYVLEDCEGTADLILIGTGTELDLCVQAAKQLSAAGHKIRVVSMPCVELFEEQSSAYKQEVLPNAVRKRIVVEAAESFGWHKYIGIDGDSVTMNSFGASAPGGTCMEKFGFTVENVVAKSKALLN

SEQ ID NO: 67514 - protein, 478 aa, Ralstonia solanacearum GMI1000
MSKQFDVLVIGAGPGGYIAAIRAGQLGLNVACCEDNAYDDPKGEPRLGGTCLNVGCIPSKALLASSEEFENVNHHLADHGITVDGARVDVAKMLKRKDDIVGKMTKGIEFLFRKNKVTLLKGHGKFVGKTDAGYQVEIAGKAGTEVVTAKHVIIATGSKARHLPGVPVDNVTIADNEGALKFGEVPKKLGVIGAGVIGLELGSVWRRLGSDVTILEALPSFLGAADESVAKEANKLLNKQGLKINVGVKVGEIESSAKGVKVNYTDATGAAQVLECDKLIVSIGRVPNTDNLGLDAIGLATDQRGFIEVDDHCATKLPNLWAIGDVVRGPMLAHKAEDEGVAVAERIVGQKPHIDYNCIPWVIYTFPEIAWVGKTEQQLKAEGREIKAGQFPFMANGRALGMGASDGFVKVIADAKTDEILGVHVVAANASDLIAEAVVAMEFKAAAEDIGRICHPHPSMSEVMREAALAVDKRQLNM

SEQ ID NO: 67515 - protein, 326 aa, Gibberella zeae PH-1
MRARFKGPAGTGILELPDDATVQALFDEIRMKTGISKFGVRYGLPMAMKSLEATQGDQIARSLGLHGETLTIVPEESSSAPVETVPTGTPQSQVTASKTSKKNESPEDVNVPWPQREGTLQEYSEAVLGSPPSQYCRSIQDPDRWGGGIELSILSSIFDIQICTFDVQTQSKIEFGEEKQDRCILVYSGIHYDRVAFSCTDPPYNSPTLPPEYDQAVWPTGDDDVLKKTKELIQKLNKAHYYTDTNGLILRCDVPGCDWIGSGQLEGQKHAEATGHVDLSEIQDEGDSILRKCDAPGCDFIGQGDKAVRQHRADTAHQSFSVIHDA

SEQ ID NO: 67516 - protein, 820 aa, Methylococcus capsulatus str. Bath
MSKPKLVLVGNGMAGVRTLEELLKLAPGKYDITVFGAEPHPNYNRILLSPVLAGEKKLDDIILNDEDWYAGHGITLHKGKTVVAIDRGRRRVRTEDGTVADYDRLLLATGSTPFILPVPGRDLEGVVGFRDIRDVERMLEASEKHRHAVVIGGGLLGLEAANGLKKRGMNVTVAHLLDTLMERQLDKPAAALLQRALENSGLSFKLEAQTEALLGEGRVRAVRFKDGSEIPADLVVMAVGIRPNIELAKAAGIHCERGILVSDTMQTFDPQVYAVGECVQHRGELFGLVAPLFEQAKVCANHLAEFGIARYRGSVTSTKLKVTGIDLFSAGEYQGGPGFEELLFQDPSRGVYKKLVVRDNKVAGAVLYGDTVDGAWYFQMMRDGTDISAFREHILFGQAHVGDSGHGAESHAARLAEDAEVCGCNGVCKKTIVDAIIQKKLFTLDEVRAHTKASASCGSCTGLVEQLLQSTLGSDYSVSPAKKPLCRCTDLTHEEVREAVRTHGPKTIPQLMGALGWRTPDGCHTCRPALNYYLLCQWPGEYRDDPQSRFINERVHANIQKDGTYSVVPRIWGGVTNPRELRAIADVAEKFRVPCVKITGGQRIDLLGVPKARLPAIWAELGKHGLVSGHAYGKSLRTVKTCVGKEWCRFGTQDSTTLGIELEKMTWGSWTPAKVKMAVSGCPRNCAEATIKDFGVVAVDSGWELHVGGNGGVKVRATDFLCKVQTDEEVMEYAAAYLQLYREEARYLERTAHWIERVGLPYVHSRIVDDAEGRKALRARFLESQRKAQIDPWAERAQGAERHEFEPLTLRERNNHACIA

SEQ ID NO: 67517 - protein, 162 aa, Glycine max
  misc_feature (20)..(20): Xaa can be any naturally occurring amino acid
  misc_feature (85)..(85): Xaa can be any naturally occurring amino acid
MPSPSDHHRPQPKPNPNLLXLFLKPIIMLLLTSLFFLFFGFAAFLLLNLFLLGGAFHRLRFRPSVTTAPTSSNGLPPREINKLPXFVCLDAFHNAQWCRKLAACGHVFHRRCVDTWLLKVAACPTCRTPVGFNAGATVHDPPQRSDHLHTCGTDSNALTTLL

SEQ ID NO: 67518 - protein, 934 aa, Pichia jadinii
MFYHGASANQHWIAVDDLSKVPVDVDHYNVVPFQFRRAGEYKEPVLSGIVELDEVKFVVSQSDAAEQWQQLTAEDGTVWRSRAYHGKLGKYSDMAVGAFNKVLNLVRGAETFDIALVTCAYIAMFYTLFNLFARMRAVGSKVWLGLSTLVSSFFAFLFALYITTRVLDLSIPFLSLSEGIPFFVAVVGFNNKILLAEKVLQNQLNAQSSKNDAPTVLYQALREQGPLLLRDHLFMITAFLGCSFYASYLDGLKNFCILAALILAFDILTTSTFLSAILSLKLEINQIHRSTLLREQLEDDGLTETTVDDVLKSNSLAGTKTFTDAPSTLVTVAKVAGVSVFFGLHFYGFGSAWLSDLSAGNETNDTFTLYDAVADQIPIGSNGTLVTLFPTRFFLPEKLSTQIEAVVLSFIGLISTAARDKYISKFILFAFAVSASINVYLLNVARIHTTRLEDAIELKKPKKKASKTAVSVPKAVVVKDSETTKSSEILHSSSESESEQSSRPLEQVIELYKDGKVKTLVDDEVVSLVTAGKLPLYALEKQLGDNLRAVAIRRKAISDLADAPVLRSNKLPYLHYDYDRVFGACCENVIGYMPLPVGVAGPLIIDGKPYHIPMATTEGCLVASAMRGCKAINLGGGVTTVLTKDGMTRGPCVKFPSLKRAGQCKLWLDSDEGQEEMKKAFNSTSRFARLQHLQTALAGDLLFIRFRTVTGDAMGMNMISKGVEYALKQMTEVFGWDDMMVVSVSGNYCTDKKPAAVNWINGRGKSVVAEASIPKDAVVKVLKSSVKAVVDVNVNKNLIGSAMAGSVGGFNAQAANMVTAVYLALGQDPAQNVESSNCITLMTETEDGDLKVSVSMPSIEVGTIGGGTILDPQGSMLELLGVRGPADVPGENARQLAKIVASIVLSGELSLVSALAAGHLVQSHMQHNRAAAKK

SEQ ID NO: 67519 - protein, 483 aa, Oryza sativa (indica cultivar-group)
MSLGYAEKLSYREDVGNVGMPEIFDSPELLHKKIEELAVMVRESKHLVVFTGASISTSSGIPDFRGPKGVWTLQRSGKGVPGATLPFQRAVPTLTHMALVELEKTGRLKFVISQNVDSLHLRSGLPREKLAELHGNSFKEICPSCKKEYLRDFEIETIGLKDTPRRCSDKNCGARLKDTVLDWEDALPPEEMDAAKEQCQTADLVLCLGTSLQITPACNMPLLSLKNGGRVAIVNLQATPKDKKASLVIHGLVDKVIAGVMYMMNLRIPPYIRTDFVQISLRNSVKKKCVRWTLRVTSIHGLRAPLPFLRSVEVSFPERPDMKPVVLKEQPFSLQRETSMNRPFVMLLTFNFSDGCGCSSSSIEWPVDFLKQKDSFVRDRSLVLQELQHAAEHRSRAGQHAILEREGVPRAETSIHALVTNIVRYDTEDSKAAVPMATWMNSNGSLSKRHMDAIGCNPASSKKQKLVANRHRRKGLNPATQKV

SEQ ID NO: 67520 - protein, 879 aa, Methylococcus capsulatus str. Bath
MSPQFRQTVHTTCPYCGVGCGVLATVTDAGVKIQGDPDHPSNFGRLCSKGSALGETLSLGTRLLHPEIGGIRTGWDEALDTVAGRFRETLERYGPDSVAFYVSGQLLTEDYYVANKLMKGFIGSANIDTNSRLCMSSTVAGHKRAFGEDLVPGCYEDLELADLVVLVGSNTAWCHPVLFQRILAARRADPKRRIVCIDPRRTATAEAADLHLPIRPGTDVLLFNGLLHYLRHNDCLDFEFIERHTEGYAAALNMAKETAPTVPSVAAGCGLAESEVAQFYRLFAANERTVTLWSQGVNQSTQGTDKVNAILNVHLATGRIGKPGAGPFSLTGQPNAMGGREVGGLANQLAAHLDLDDPGHRRQVQEFWRSPRIADRPGYLAVDLFRAIGEGRIRAVWIMATNPAVSLPDVHAVRRALSACPFVVVSDCERDTDLSRFAHVQLPALAWGEKDGTVTNSERRISRQRAFLDAPGEARPDWWIIAEVARRMGFGAAFDYRSAADIFAEHIALSRIAGAEKRRFDLSGLQTAYDELAPTQWPVDAGNPQGTPRLSFDGRLTFVAVRPQAPAHAPDTGYPLILNTGRIRDQWHTMTRTGKTQRLTGHLPEPFAEVHPIDGSRLELTDGALARLESRYGSALVRVRFSAGQQPGTVFTPMHWSESNSRQGLVNALVNPAVDPVSGEPEFKHTPVRVVPYRPRWYGFAIARRRIEFPDAAYRVVIPARHCWRHELAGEVLSEDWQRWARERLGPEGDGWDDWLEFADPRAGRYRCAWIVQGRIEFALFVSPSHELPPRDWLVSLFGQDALSETARAGLLAGRPLSADDDRGRIVCACFAVGENTLRRTIASETLTTAEQVGTSLKAGTNCGSCLPEIHALLAEAQH

SEQ ID NO: 67521 - protein, 378 aa, Haemophilus influenzae R2846
MEIKQINSTIKSRAAVAFAPNQPLQIVEIDVEMPRKGEVLIRNTHTGVCHTDAFTLSGSDPEGVFPVVLGHEGAGVVVAVGEGVLSVKPGNHVIPLYTAECGECEFCLSGKTNLCVSVRDTQGKGLMPDGTTRFSCQGKPIYHYMGCSTFSEYSVVAEVSLAKINPEANHEQVCLLGCGVTTGIGAVHNTAKVQEGDSVAVFGLGAIGLAVVQGARQAKAGRIIAIDTNPAKFELAKQFGATDCLNPNDYDKLIKDVLLDINKWGIDHTFECIGNVNVMRQALESAHRGWGQSIIIGVAGAGQEISTRPFQLVTGRVWKGSAFGGVKGRSELPQMVEDSMKGDIQLEPFVTHTMPLDQINEAFELMHEGKSIRTVIHY

SEQ ID NO: 67522 - protein, 442 aa, Oryza sativa (indica cultivar-group)
MAKNNVKAESMARPSPVEASGGLVMRDITGGGGELRVQIAANSGGQGGKVVGAAPEKWLNRFVRMVALMERTGNALGTLAFTWATVVLLGGYPKGTHNVVKNQVQQASWLQSAPISFQGFRPQESWMHSPNQVVGSASSHGSESASQCPARQEENNLVNIEESSDNSQETGRRGTRVNWTEEENLRLLSSWLNNSLDSINGNDKKGEYYWRDVAAEFNGNASSNNRKRTVVQCKTHWGGVKKDIAKFCGAYSRARRTWSSGFSDDMIMEKAHALYKSENNDKTFTLEYMWRELKDQPKWRRILEEDSKNKRTKISESGAYTSSSNQETEEETSRKEKRPEGQKKAKAKLKGKGKKPAPSPLGDQPSQDFVLFNEAVKLRAEAVLKSAEATTKSAEAKKEQTRMEKYQTYLKLLDKDTANFSDAKLKRHEAVLEKLATELAEE

SEQ ID NO: 67523 - protein, 500 aa, Coprinopsis cinerea okayama7#130
MPSTFSYQWDTPAYKGKTEFNTGLFINGQFVDGSNKTTIDVVNPTNGKVITSISEGVEKDVDLAVEAAQKAFETTWGLNVSGSQRSELLWKLATLMEQHHEELAAIEATDNGKTFAWAKGTDVAFSINVIKYFAGWADKITGQTIETDERKLIYTRHEPIGVVGQIIPWNFPLLMLAWKIGPALATGNTIVLKPSEFTPLTAIRMCSLIQEAGFPPGVVNIVTGYGNTVGAAISSHPKIEKVAFTGSTLVGRKIMEAAAKSNLKNVTLELGGKSPNVIFNDADIDQAVNWAVHGLFWNHGQACCAGSRIFVQSGIYDEFLKRFTAKAAAIRVGDPFGVEVDQGPQVSQIQYDRIMGYIDSGKADGATVHLGGKRHGQEGYFIEPTIFTDVKPDMKIVREEIFGPVGVLIKFEDEADVIRQANDTVYGLAAAVFSQNINRAIETAHKMQAGTVWVNCANQLHANVPFGGFKQSGIGRELGEYALHNYTNVKAVHVNIGHVM

SEQ ID NO: 67524 - protein, 171 aa, Solanum sogarandinum
MANPRVFFDLTIGGASAGRVVMELFADTTPKTAENFRALCTGEKGIGKMGKPLHYKGSTFHRVIPGFMCQGGDFTAGNGTGGESIYGAKFKDENFVKKHTGAGILSMANAGPGTNGSQFFICTAKTEWLDGKHVVFGQVVEGLDVIKKTEAVGSSSGRCSKPVVVADCGQL

SEQ ID NO: 67525 - protein, 449 aa, Streptococcus agalactiae 2603V/R
MSKQYDYIVIGGGSAGSGTANRAAMYGAKVLLIEGGQVGGTCVNLGCVPKKIMWYGAQVSETLHKYSSGYGFEVNNLNFDFTTLKANRDAYVQRSRQSYAANFERNGVEKIDGFARFIDNHTIEVNGQQYKAPHITIATGGHPLYPDIIGSELGETSDDFFGWETLPDSILIVGAGYIAAELAGVVNELGVETHLAFRKDHILRGFDDMVTSEVMAEMEKSGISLHANHVPKSLKRDEGGKLIFEAENGKTLVVDRVIWAIGRGPNVDMGLENTDIVLNDKGYIKADEFENTSVDGVYAIGDVNGKIALTPVAIAAGRRLSERLFNHKDNEKLDYHNVPSVIFTHPVIGTVGLSEAAAIEQFGEDNIKVYTSTFTSMYTAVTTNRQAVKMKLITLGKEEKVIGLHGVGYGIDEMIQGFSVAIKMGATKADFDDTVAIHPTGSEEFVTMR

SEQ ID NO: 67526 - protein, 387 aa, Kluyveromyces lactis NRRL Y-1140
MFRSAILRAGKVSPRTIVQPQLFGTQRVAWTGFSSIRFNSSDSSAVSDAAAGAASKVSEIQTQLPSFDENTIETVSQVGQVIGDASNQIGYLSSIGMAKSWLWPPDLIQNVMEQIHFYAGLPWWATICVTTVLARVLLFPLYVKYSDTLGRTSKIKPEMDKVNADLMACSDTTKAQQIAMKRRKLLSENGIKNRYLIVPVVQIPIAISFFTSIREMCLYPVDGLATQGIAWFQNLTLADPYLGLQCLTAAMFVALARKGGESGAQQFSPQMKKVFTYLPILTIPVTMNLSAGVVLYLAVNGVCSMIQTLLLRNQTARKFLNIAEVVNHPAPENQGPQKGVFESFRENIQKAKDQAEKRAMMKEQDDKMKDLAKKEKENQRIKIVRKK

SEQ ID NO: 67527 - protein, 379 aa, Bacillus anthracis str. A2012
MKVGQQVALMKVDGSVKQFRVTKLFGYMGLKRQEIEEAKAGDLVAVSGMEDINVGETVCPVEHQDALPLLRIDEPTLQMTFLVNNSPFAGREGKYITSRKIEERLRSQLETDVSLRVDNTESPDAWIVSGRGELHLSILIENMRREGYELQVSKPEVIIKEVDGVRCEPVERVQIDVPEEYTGSIMESMGARKGEMLDMVNNGNGQVRLTFMVPARGLIGYTTEFLTLTRGYGILNHTFDCYQPVHAGQVGGRRQGVLVSLETGKASQYGIMQVEDRGVIFVEPGTEVYAGMIVGEHTRENDLTVNVVKMKQQTNIRSATKDQTSTMKKPRLMTLEESLEYLNDDEFCEVTPESIRLRKKILDKSERERAAKKKKSVEA

SEQ ID NO: 67528 - protein, 377 aa, Glycine max
MMACQDWPEPVIRVQALAESGLTTIPERFIKPKSQRPTNNNNYAPKVNFSQIGHHENTTTTNNNNTNIPVIDMKHIYGGDERRRAETLRLVSEACREWGFFQVVNHGVSHELMKGAREVWREFFQQPLEVKEVYANTPLTYEGYGSRLGVNKGAILDWSDYFFLHHMPCSLRDQAKWPALPTSLRNIISEYGEQVVMLGGRILEILSINLGLREDFLLNAFGGENDLGACLRVNFYPKCPQPDLTLGLSPHSDPGGMTILLPDENVSGLQVRRGEDWITVKPVPNAFIINMGDQIQVLSNAIYKSIEHRVIVNSNKDRVSLAFFYNPRSDIPIQPAKELVTKDRPALYPPMTFDEYRLYIRTRGPSGKAQVESLTSE

SEQ ID NO: 67529 - protein, 451 aa, Brassica napus
VDPASEKLYGEFLVNAQGEDVVAGIRTPEDLDTMKRLMPQAYAELVENCDILEGHYKDMMDIEFTVQEERLWMLQCRAGKRTGKGAVKIAVDMVGEGLVDKSTAIKMVEPQHLGRLLHPQFHDVSGYREKVVAKGLPASPGAAVGQVVFTAEEAEVWHSQGKNVILVRTETSPEDVGGMHAAEGILTARGGMTSHAAVVARGWGKCCIAGCSEIRVDENHKVLLIGDLTINEGEWISMNGTTGEVILGKQALAPPALSADLETFMSWADSVRRLKVMANADTPEDATAARKNGAEGIGLCRTEHMFFGADRIKAVRKMIMAVTTEQRKASLDVLLPYQRADFEGIFRAMDGLPVTIRLLDPPLHEFLPEGDWMLIVQELAAETGMKEDVILSQVEKLSEVNPMLGFRGCRLGISYPELTEMQARAIFEAAASMQDQGVTVLPEIMVPLVGT

SEQ ID NO: 67530 - protein, 288 aa, Brassica napus
LLRIREIATPEEEVALIEDYVSDSVDHHGFPAGKLSTGGWRSAWYIIGVEVGERFAYFGIASNLITYLTGPLGQSTATAAVNVSTWSGTASMLPVLGAFIADAYLGRYHTIVVASLIYILGLGLLTLSAFLILIRISEQRNDTVKSFFWVNILFFCSLYMVAIGQGGHKPCVQAFGADQFDSGDSKERISRGSFFNWWFMTLSAGITLSFLVVVYVQDNVSWALGFGIPCVFMVMALALFLLGRKTYRYPRGNHTEKKNAFARIGRVFVAAYKNRKLNLSDSSLSQSL

SEQ ID NO: 67531 - protein, 499 aa, Clostridium perfringens SM101
MEIFSSNSIRNMDKDYIEKFNMPSIVLMENAIIKFLENIDLTKESFTIISGRGNNGGDALGIARHLLNKGKKVYVHILEKEKEGSVDYKTNLTILENLGCYINSISNNKDLEILKNNIINSEIIIDGIFGTGLNKEIAGIYFDTIKCINENSKFTVSIDVPSGINSDDGSICGIAIKANKTISFQVYKLGFLNYKSFEYLGDLKIVDIGIPKSIVYKNSNNMRFIDKEYIRNIFPYRNKYGHKGTYGRSLIFAGQKGFIGAAYMVGEAAIKTGAGLVTVFTHKDVQSELSIKLNEGMTGTYNSKEEYEEFIGGADVIAFGPGMGNNDLTFEVLNNICNLYSGALVIDADGINVLERKKYILKEFKGDIVLTPHPGEMARLLGIEIKDVERDRIGIAKKFAKENKVTVLLKGYNTIITDGDKVFVNPTGSSAMASGGMGDTLTGIITSLISQGVNSFDAAILGAYIHGYIGDELSKENFTVSAMEIIKNIPNKIKELINF

SEQ ID NO: 67532 - protein, 799 aa, Xylella fastidiosa Temecula1
MALNGASYLNENILWLHELRLTDLARVGGKNSSLGEMIGNLTALGVSVPGGYATTAAAFKAFIAYNNLSKRIYDKLATLDVEDVKALTAAGKEIRDWVIDAPLQPELEKDIRDAYDTLSKDNSGNDVAVAVRSSATAEDLPDASFAGQQETFLNVIGADQVVHKIKEVFASLYNDRAIAYRVHHGFKHEDVFLSAGIQLMVRSDISASGVLFTLDTESGFREVVFVTASFGLGEMVVQGAVNPDEFYVYKKTLKAGKPAILRRTLGTKLVRMVYSDAPGERVKIEDTPTELRHCFAISDADVQELARQALIIEQHYGRPMDIEWAKDGISGKLFIVQARPETVKSRSHTTQIERFALQQPGQILTEGRAIGQKIGSGTARVVNSLEDMHHMQPGDVLVADMTDPDWEPVMKRASAIVTNRGGRTCHAAIIARELGVPAVVGTGNALSIIQDGQPITVSCAEGDTGYIYAGKLPFERTTTDLGHMPPAPLKIMMNVANPERAFDFGQLPNAGIGLARLEMIIAAHIGVHPKALLEYHKQDADTKQKIDAKIAGYPDPVSFYVNRLAEGIATLTASVAPHTVIVRLSDFKSNEYAHLIGGQHYEPQEENPMLGFRGASRYVDPSFSDAFALECKAVLKVRNEMGLDNLWVMIPFVRTLEEGRKVIDVLRQNGLKQGENGLKVIMMCEVPSNALLADEFLDIFDGFSIGSNDLTQLSLGLDRDSSIVAPLFDERNPAVKKLLSMAIKAARSKGKYIGICGQGPSDHPDLAEWLMQEGIESLSLNPDTVVDTWLRLAKLKTVH

SEQ ID NO: 67533 - protein, 374 aa, Aspergillus nidulans FGSC A4
MAFFFNRGRSRQPSDVVRSIKDLLLRLREPSTASKVEDELAKQLSQMKLMVQGTQELEASTDQVHALVQAMLHEDLLYELAVALHNLPFEARKDTQTIFSHILRFKPPHGNSPDPPVISYIVHNRPEIIIELCRGYEHSQSAMPCGTILREALKFDVIAAIILYDQSKEGEPAIRLTEVQPNVPQRGTGVFWRFFHWIDRGTFELSADAFTTFRARYLATNFDYFFAQFNTFLVQSESYVTKRQSIKLLGEILLDRANYSVMMRYVESGENLKLCMKLLRDDRKMVQYEGFHVFKVFVANPDKSVAVQRILINNRDRLLRFLPKFLEDRTDDDQFTDEKSFLVRQIELLPKEPIEPSRSAREPSRSTANTTTVA

SEQ ID NO: 67534 - protein, 512 aa, Oryza sativa (japonica cultivar-group)
MEKLKSELWMTAVATCMSLLLYLTILRRRHASGGRSLALPPGPTPLPLIGNLLCLGGIFHQTLAKLARVHGPVMTLKLGLTTAVVVSSAEAAREAYTKHDQRLAARPVPDAFRANGFSERSIVFSPSSDPQWKNLRGIHATHIFSPRALAALRGIRERKVRDIVGYIRTVAGEEMCVREVVHNGVLNLISTSFFSMDMADVRSESARGLRGLIEDIIATVAGPNVSDFFPFLRQLDLQGLRRQTGSHLGIVFGLLDDIIDRRMAETRDHPDKQRHGDFLDALISLASAGKIPRYHITYLLFDVFAAGADTMTTTVEWAMAELLRNPRVMAKVRAEVTDALGGRESFDEGDAASLTYLQCVFKEAMRLHPVGSILVPHLAVQDGVEIGGYAVPKGTTVIFNAWAIMRDPAAWESPDQFLPERFLHKEESSSPPLELRGKDYEYIPFGSGRRLCPGLPLAERAVPFILASLLHAFEWRLPDGMSPDDMDMTEKFATANVLATPLKAVPVASHTS

SEQ ID NO: 67535 - protein, 166 aa, Triticum aestivum
  misc_feature (114)..(114): Xaa can be any naturally occurring amino acid
MAMAASWWALLMAVVAAAAAGCGEAAPTAAAEAAHDVLQSHGLPRGLLPAGIAAFTHDPATGRFEAVLESPCTARTEVGLRYNVTVAGQITYGRIAELSGVDAQDLFLWFAVRXFRVDVPSSGVIYFVVGVLYKHLPLSFFEARPPCVPPSLSSCNHIRFRDTDHW

SEQ ID NO: 67536 - protein, 305 aa, Sulfolobus shibatae
MPLDPRIKKLLESGFVVPIGKASVDEVRKIFRQLASAAPKAEVRKVEDIKIPGSETSINARVYFPKAKGPYGVLVYLHGGGFVIGDVESYDPLCRAITNACNCVVVSVDYRLAPEYKFPSAVIDSFDATNWIYNNLDKFDGEMGIAIAGDSAGGNLAAVVALLSKGKLDLKYQILIYPAVGFDSVSRSMIEYSDGFFLTREHIEWFGSQYLRSPADLLDFRFSPIIAQDLSGLPPALIITAEYDPLRDQGEAYANRLLQAGVPVTSVRFNNVIHGFLSFFPLIDQGKDAIGLIGSVLRRTFYDKS

SEQ ID NO: 67537 - protein, 368 aa, Burkholderia xenovorans LB400
MKTYRIATIPGDGIGKEVVPAGRRVLEAIAARSDAFGFEFENFDWGGDYYREHGVMMPADGLDAIRHQDAILFGSAGDPHIPDHVTLWGLRLKICQGFDQYANVRPTRILPGIDAPLKRCGPQDLDWVIVRENSEGEYAGVGGRVHQGHPIEVATDVSMMTRAGVERILRFAFRLAQSRPRKLLTVITKSNAQRHAMVMWDEIAVQVSKEFPDVRWDKELVDAATARMVNRPATLDTIVATNLHADILSDLAAALAGSLGIAPTANLDPERRYPSMFEPIHGSAFDIMGKGLANPVGTFWSVVMMLDHLGEHAAARQLMAAIERVTADPSLHTGDLGGTATTAQVTDAVCAILAAGSPAVPAASVKAA

SEQ ID NO: 67538 - protein, 420 aa, Arabidopsis thaliana
MNSLPRRFGKNHGYLDRDYRNGRRSGSDSDEELKGLSHEEYRRQKRLKMRKSAKFCFWENTPSPPRDQNEDSDENADEIQDKNGGERDDNSKGKERKGKSDSESESDGLRSRKRKSKSSRSKRRRKRSYDSDSESEGSESDSEEEDRRRRRKSSSKRKKSRSSRSFRKKRSHRRKTKYSDSDESSDEDSKAEISASSSGEEEDTKSKSKRRKKSSDSSSKRSKGEKTKSGSDSDGTEEDSKMQVDETVKNTELELDEEELKKFKEMIELKKKSSAVDEEEEEGDVGPMPLPKAEGHISYGGALRPGEGDAIAQYVQQGKRIPRRGEVGLNAEEIQKFEDLGYVMSGSRHQRMNAIRIRKENQVYSAEDKRALAMFNYEEKAKREAKVMSDLQRLVQRHMGEEVGPNHDPFGAGKTEEDDD

SEQ ID NO: 67539 - protein, 615 aa, Oryza sativa (japonica cultivar-group)
MASISGAAAAAPSSSGASCGLRLRRDHLPRSSHFRLARPSSITDVSRSCSSSSSSPPRSLSSKQSGHADVLAHGAVDKDPIRLWNRYVEWLYQHKQLGLFVDVSRIGFTEEFLRRMEAPMGRAFAAMRELEKGAIANPDEGRMVGHYWLRNPALAPNSFLRDKIETTLERILAFASDVISAKIRPPSSPAGRFTQILSIGIGGSSLGPQFVAEALAPDNPPLMIRFIDNTDPAGIDHQIAQLGPELASTLVIVISKSGGTPETRNGLLEVQKAFRDAGLEFSKQGVAITQENSLLDNTARIEGWLARFPMFDWVGGRTSEMSAVGLLPAALQGIDIKEMLVGAAQMDEETRNTEIKENPAALLALCWYWASDGIGSKDSLLLLSRYLQQLVMESLGKEFDLDGNRVNQGLTVYGNKGSTDQHAYIQQLREGVHNFFVTFIEVLRDRPPGHEWELEPSVTCGDYLFGMLHGTRSALYANDRESITVTVQEVNPRAVGALVALYERAVGLYAYLININAYHQPGVEAGKKAAGEVLALQKRILLVLNEASCKDPAEPLTLDQIADRCHCPEEIEMIYKIIQHMAANDRALIAEGNCGSPRSIKVYLGECNVDDDMNS

SEQ ID NO: 67540 - protein, 454 aa, Halobacterium sp. NRC-1
MTNGDSSSSALTDNERAVLDDIEAQGIDFLRLQFTDILGTVKNVSIPAHQAEKAFTEGIYFDGSSIEGFVRIQESDMRLDPDPETFAVLPWRSNGDGGSARLICDVVDREGNAFAGGPRQVLKNVLARADDMGYSVSIGPEPEFFLFEKDDDGNATTTAHDQGGYFDLAPKDLASDIRREIIFTLEAMGFEIEASHHEVARGQHEINFKYDDALTTADNIATFRAVVRAVAEQHDVHATFMPKPIGEINGSGMHSHISLFDEDGENVFADNDDEFNLSETAYQFMGGVLEHAPAFTAVTNPTVNSYKRLVPGYEAPVYIAWSGVNRSALIRVPDAAGVSARFEIRSPDPSCNPYLALAAVIAAGLDGIDTDADPGDAVREDIYEFDEDKRDAYGIDTLPGHLGDAVTALESDPVMQDALGEHVCEKFAEAKRHEYAEYKASVSEWETDRYLEKF

SEQ ID NO: 67541 - protein, 524 aa, Oryza sativa (japonica cultivar-group)
MADMKQEEISHPPMDQLQGLEYCIDSNPSWGEAIALGFQHYILCLGTAVMIPTLLVPLMGGNAHDKAKVVQTMLFVTGINTMLQTLFGTRLPTIIGGSYAFVIPVISIIKDPSLAQITDDHTRFIMTMRAIQGALIISSCIQIILGYSQLWGICSRFFSPLGMVPVVALVGLGLFERGFPVIGRCVEIGLPMLVLFVALSQYLKHVQVRHFPILERFSVLISIALVWVYAHILTASGTYKHTSLLTQINCRTDRANLITSADWIDIPYPLQWGPPTFSADHAFGMMAAVVVSLIESAGAFKAAARLASATPPPPYVLSRGIGWQGIGLLFDGLFGTGTGSTVSVENIGLLGSTRIGSRRVIQISAGFMIFFSILGRFGALFASIPFTMFAAIYCVMFGYVGAVGLSFMQFTNMNSMRSLFIIGVSLFLGISIPEYFFRYTMSALHGPAHTRAGWFNDYINTVFSSPPTVGLIVAVILDNTLEVRDAARDRGMPWWARFRTFRGDSRNEEFYTLPFNLNRFFPPS

SEQ ID NO: 67542 - protein, 506 aa, Pseudomonas putida KT2440
MTQYAVARLAQLDEHRPLRVQAGSEELILVRQGEQVHAYQGNCPHAGAPLDEGVVCGGLLVCPWHKATFAVDDGVVCEPPALADLRRYKAWIKGDEVWVDDQPLPATEPPRHSDARCFVVVGAGAAGSAAVATLLAHGFAGRLVWIDQERQPAYDRTALSKFVIAGQMPPDEVPALLEADALRKGQLERKYGKVRTLNSQKRQVTLADGQQIDYDACLLATGGKALRPDIPGADLPGVFTLRSLEDAARLLDAAEPGQPVVIVGDGFIGLEAASALRKYGVQVHVVSRHEVPLARQLGERIGRCIRALHERKGITFHGPTEVERIEGLDKVEAVQLTNGERLQTPLVLLGTGVRPATAFLQGVPLGEDKSVRVDAEMRAADGLWAAGDIATFPLTGRPVRIEHWRLAQQHGVIAAANMLGEQRRYADVPFFWTYQHGRTYEVLGHARDWNRIEFVGEPEKGDFVALQCVDERVEAVIAKGYSDAMATLSQRLKRPLSLQEAWALIG

SEQ ID NO: 67543 - protein, 346 aa, Candida albicans
MTPNGSRRHSAYMGSPRSQHSSTMETGYNPYEAVQKKQELYQNNNGNSPTVIIEEDPYIPNYKELSLANKKTNYNMKIVVVGDGGCGKTCLLLAYTQNKFPSIYVPTVFENYVTAVQSPNGKTVELALWDTAGQEEYDRLRPLSYPDVDILLVCFAVDNEVSLENVKDMWFPEVNHYCPGIPIILVGTKSDLLSDMNHDASIRVAKEIGAIGLIFTSAKTMFNVRTVFNFALNHFQRNMELQEQYEKTLGSRKRISRVLGGSNGGSGNHSRHHSRNYSNVSNNRRGHLKNTSYDSTALLDQPLTEDTYVKNPYGNFGYKANVESPYNQDEFAFTRERKKKKKCVIL

SEQ ID NO: 67544 - protein, 127 aa, Halobacterium sp. NRC-1
MKRPIETADAPAAVGAYSQAATDGDVVFTAGQIPMTPDGELIADEPIDVQTRQSLENVKAILEAEGLNMQDVLKVSVFMDDMDDFDAMNAAYKEYFQDNPPARSAVEVAALPKGVGVEIEAIAAQRD

SEQ ID NO: 67545 - protein, 203 aa, Oryza sativa (japonica cultivar-group)
MFSLAYGLWKYIFNKTEFHVLILGVDKAGKTTLLEKIKSIYLKGEGLTPDRIVPTVGLNIGRIEDANAKLVFWDLGGQVGLRTIWEKYYQEAHAIIYVIDAAAASSFEDAKSALEKVLRHEDLKGAPLLIFANKQDLPGVITDEELARYLQLKELDERPYKFQAVSAYDGRGIKSGIDWVVEQMERSKRTEVLRARAGFTGQI

SEQ ID NO: 67546 - protein, 330 aa, Candida albicans SC5314
MGTMSEDSELIEQVIEQPDSLIISPPSDSSSSSSYNHIQPFVYLESTATTQTNHNVLLILNQKITIDLISLWKKCEIIVCADGGANSLYEYFNDNNHHHHHENLQRSDYIPDYIVGDFDSISPDVKTYYESHGSKIIRQSSQYYNDFTKSIHCIQLHYQLNHTKENWFESIDEVDGLAKLWNGLNNSSDVVVDIDITIYVLNAIGGRFDQTVQSINQLYIMNEDYPKVTVFFITTNDIIFLLKKGVNYISYKNRLMFHKDNGSSPTPTCGLLPLSNKTPIILNSYGLKYDMRNWKTEMLGQVSSSNRISGETGFIVECSDDIVMNIEIDV

SEQ ID NO: 67547 - protein, 339 aa, Pseudomonas putida KT2440
MATTTMTMIQALRSAMDVMLERDDNVVVYGQDVGYFGGVFRCTEGLQNKYGKSRVFDAPISESGIVGTAVGMGAYGLRPVVEIQFADYFYPASDQIVSELARLRYRSAGEFIAPLTLRMPCGGGIYGGQTHSQSPEAMFTQVCGLRTVMPSNPYDAKGLLIASIECDDPVIFLEPKRLYNGPFDGHHDRPVTPWSKHPHSAVPDGYYTVPLDKAAITRPGNDVTVLTYGTTVYVAQVAAEESGVDAEVIDLRSLWPLDLDTIVESVKKTGRCVVVHEATRTCGFGAELVSLVQEHCFHHLEAPIERVTGWDTPYPHAQEWAYFPGPSRVGAALKKVMEV

SEQ ID NO: 67548 - protein, 629 aa, Brassica napus
MSSTYARFDTVFLLSRFAGAKYSPLWPSSSSSSHSSLLSSGIHLRAKPNSRLRSVTGASSSSSGPIIAGSESIEIKSLPTKPIEGQKTGTSGLRKKVKVFMQDNYLANWIQALFNSLPLEDYKDATLVLGGDGRYFNKEASQIIIKIAAGNGVGKILVGQEGILSTPAVSAVIRKRKANGGFIMSASHNPGGPEYDWGIKFNYSSGQPAPESITDKIYGNTLSISEIKVAEIPDIDLSHVGVTKYGNFSVEVIDPISDYLELMEDVFDFDLIRGLLSRSDFGFMFDAMHAVTGAYAKPIFVDNLEAKPDSISNGVPLEDFGHGHPDPNLTYAKDLVDVMYRDDGPDFGAASDGDGDRNMVLGNKFFVTPSDSVAIIAANAQEAIPYFRAGPKGLARSMPTSGALDRVAEKLKLPFFEVPTGWKFFGNLMDAGKLSICGEESFGTGSDHIREKDGIWAVLAWLSILAHRIKDKKPGEKLVSVADVVNEYWATYGRNFFSRYDYEECESEGANKMIEYLRDIVAKSKAGENYGNYVLQFADDFSYKDPVDGSVASKQGVRFVFTDGSRIIYRLSGNGSAGATVRIYIEQFEPDVSKHDVDAQIAIKPLIDLALSVSKLKEFTGREKPTVIT

SEQ ID NO: 67549 - protein, 459 aa, Pseudomonas putida KT2440
MQQIIQTTLLIIGGGPGGYVAAIRAGQLGIPTVLVEGQALGGTCLNIGCIPSKALIHVAEQFHQASRFTEPSPLGISVASPRLDIGQSVTWKDGIVDRLTTGVAALLKKHGVKVVHGWAKVLDGKQVEVDGQRIQCEHLLLATGSSSVELPMLPLGGPVISSTEALAPKTLPQHLVVVGGGYIGLELGIAYRKLGAQVSVVEARERILPTYDSELTAPVAESLKKLGIALHLGHSVEGYENGCLLASDGKGGQLRLEADQVLVAVGRRPRTKGFNLECLDLKMNGAAIAIDERCHTSMHNVWAIGDVAGEPMLAHRAMAQGEMVAEIIAGKARRFEPTAIAAVCFTDPEVVVVGKTPEQASQQGLDCIVAQFPFAANGRAMSLESKSGFVRVVARRDNHLIVGWQAVGVAVSELSTAFAQSLEMGACLEDVAGTIHAHPTLGEAVQEAALRALGHALHI

SEQ ID NO: 67550 - protein, 414 aa, Oryza sativa (indica cultivar-group)
MGWKAPTRIQAEAIPFALQGRDVIGVGQTGSGKTAAFALPIIQALLEHEHRPRFLACVLAPTRELAIQIAKQFEALGSAISLQCSVLIGGIPRTSQTISLAKRPHVVVGTPGRLLDHLTNTKGFSFNKLKYLVLDEADDLLKVDFQKAVDDILNVIPKERRTFLFSATMTEKVKKLRRACLKNPVKVEVASKYSLVDTLRQDLYVVPAKYKDCYLIHVLNKMPGSMIMVFVRTCESTRLLALMLRNLRFKAISISGQMSQDKRLGALNRFRTRDCNILVCTDVASRGLDIQGVDVVINYDFPLNSKDYIHRVGRTARAGQSGYAVSLVNQFEGEFFKLTEQFLGGEEIPARKVDADEIMILHERIYDSKRIALKTMNESGYHKRMRRRMEDDEEEVEEAPVSSRSRSLKKSRRR

SEQ ID NO: 67551 - protein, 456 aa, Haemophilus influenzae R2846
MTKHYDYIAIGGGSGGIASLNRAASYGKKCAIIEAKHLGGTCVNVGCVPKKVMFYGAHIAEAINNYAPDYGFDVEVKKFDFSKLIESRQAYISRIHTSYNNVLAKNNIDVINGFGKFVDAHTIEVTLADGAKEQVTADHILIATGGRPYRPNIKGQEYGIDSDGFFALTELPKRAVVIGAGYIAVELSGVLNSLGVETHLLVRRHAPMRNQDPLIVETLVEVLAQDGIQLHTNSTPSEIVKNADGSLTVKCDGQSDVTVDCAIWAAGRVPATDKIGLENAGVETNEHGYVKVDKYQNTNVKGIYAVGDIIENGIELTPVAVAAGRRLSERLFNNKPTEYLDYSLVPTVVFSHPPIGTVGLTEPQAIEQYGAENVKVYKSSFTAMYTAVTQHRQPCKMKLVCVGKDEKVVGLHGIGFGVDEMIQGFAVAIKMGATKADFDNTVAIHPTGSEEFVTMR

SEQ ID NO: 67552 - protein, 213 aa, Zea mays
MAAASAITAVSGVVLPQTFLSHRSPPPQVLAVASSFHRLSLCASHRRITHIIPRADASAEAGEPEPVTTSAESEEEVAEGSVAVAEAEEPTPPSKPKVKFGEIIGILNKQFIEEAEKVKTVPDLRPGDIIELRMQRPNKRRLSLFKGIIIAKHKAGVHTTIRVRRIIAGVGVEITFPVYSPRIKEITVIRHKKVRRAKLYYLKDKLPRFSTFK

SEQ ID NO: 67553 - protein, 177 aa, Triticum aestivum
LDLCDAFFKGVCFLPLRGEKRKGGLPRGGGPFPSSRGPAVGRVPRGGNLQPKFSGLTLFCPSHQDSVSNRYTSPLVPASPNPNHAVRSTPRGERSDMPATPTIIGALLGLGTQMYSNALRKLPYMRHPWEHVLGMGLGVVFVNQLVKFDEKVKVDLDKMLERAKHANEQRYFDEDDD

SEQ ID NO: 67554 - protein, 400 aa, Roseovarius nubinhibens ISM
MRYSKTITGLTGGGSDGWDIYRKARRMQRDGTEVTMLTIGEHDIRTDAQILDALHRFAHAGHTGYTTFDGEPELKDRIATRLSERTGVPTTPANVLIVPGGQGGLFAAHHAICDPGDTALYIDPYYTTYPGTIRTVGAIPLAIEARPRHGFQPQPEDIARAADAAGNARSLLVNTPNNPTGVVYTRKTLEGIAEICTDKGLWLLSDEVYDTQVWNGDHLSPRALPGMAERTLVIGSMSKSHAMTGSRVGWVVGPEEAIAHMANLATHTTYGISGYIQHAAAFALDLGPAFEEQIAEPFRRRRDLVMAQMEGQNAARPIPADGAMYVMVDIRSTGLSGEAFADGLLDRHHVAVMPGESFGQAAAGHVRVALTVADDLLVAAVARLVELAAELAAQHAEPAQ

SEQ ID NO: 67555 - protein, 402 aa, Arabidopsis thaliana
MFPMSSTSRSSAANNRKDPPRKKNKETPSPVTREPTSIDSLPNDLLLNCFARVSRMYYPALSRVSKRFRSIVTSPEIYNTRSLLNRTEKCLYLCLRFPFDNNTHWFTLYQNPNRTVSDKVFLQIPSPQYPLTLSSNLVAVGSNIYRIGGTVGDDSCPLGFDREPSSKVSILDCRSHTWRDGPRMRLNRRSSTTSVVDGKIYVTGGTEDTDNPSHWIEVFDPKTQSWGTVTNPHIVKVWEEVCYRRAVKSIGHDGKLYLSGDKYVVYDPDEGKWNSVEEHWLIGYAIGSSNCVVDNILFYWDQGVFKWYDSKVSSWKQLKGLEGLPDDFSQREYCKLVDLGGKMAVLWDKWEYSGVCMIFCAEISLEKRDGDEIWGKVEWFDTVLEVGASCSLKSADALSASV

SEQ ID NO: 67556 - protein, 156 aa, Zea mays
MAAAAAAPASVAPSSPKAAGDNRKTVVSVDASELEKHVLAVDDSSVDRAVIARILRGSRYKVTAVESATRALELLALGLLPDVSMIITDYWMPGMTGYELLKRVKESAALRGIPVVIMSSENVSTRITRYLEEGAEGFLLKPVRPADVSRLCSRIR

SEQ ID NO: 67557 - protein, 376 aa, Halobacterium sp. NRC-1
MSDELKKGLEDVLVAESDLSFIDGDAGKLVYCGYAIEDLARTASYEEVLYLLWHGDLPTRSELDAFRADMASHREIDDDVLALVENLAAADADPMAALRTAASALSAHDDTAGGSDPDDARESGKRITAKLPTIVAAFTRLRNGDDVVAPRDDLGHAANFLYMLNGEAPDDVLADVFDQALVLHADHGLNASTFSGMVTASTLADVHAAVTSAIGTLSGSLHGGANANVMRMLKEVDDSDKDPLSWVQDALANGERVMGFGHRVYNVKDPRAHILSERSEELGAAAGDTKWYEMSVAIEDYMADEKGLAPNVDFYSASTYYQMGIPVDIYTPIFAMSRVGGWVGHVLEQYDDNRLIRPRARYVGAEDRDSTPLDER

SEQ ID NO: 67558 - protein, 204 aa, Triticum aestivum
THASDDLSDSDDDDTSSRASDASSDFSTPPPASASKAARAATPASVVDDIDHHLRNLQLKYSEPISPNPSPAPNPGASASASAVNAVKLYLHIGGSTAAARWVNSDRLAAVSFVRSGEGASDPDEDDEPTGPWFLVVGSKIRAKVGPELQLKTFPVQRRVDFVADGVWALKFLHADGYGDFNAKYQSCLFENSYGVEATDEGRA

SEQ ID NO: 67559 - protein, 519 aa, Medicago truncatula
MASSESNSQMKVVHGDAGYILEDVPHLSDYVPNLPTYPNPLRSNPAYSVVKQYFVHMDDTVPQKVVVHKDGPRGVHFRRAGPRQKVYFRSDDVIACIVTCGGLCPGLNTVIREIVCGLSYMYGVDKVLGIDGGYRGFYSKNTITLTPKVVNDIHKRGGTILGTSRGGHDTGKIVDSIQDRGINQVYIIGGDGTQRGAAVIYEEVRRRGLKVAIAGIPKTIDNDIPVIDRSFGFDTAVEEAQRAINAAHVEAESVENGIGVVKLMGRYSGFIAMHATLASRDVDCCLIPESPFYLEGKGGLYEFITKRLKESGHMVIVIAEGAGQDLLTESMQDMDQKDASGNKLLQDVGLWISHKIKDHFAKENKMAIVLKYIDPTYMIRAIPSNASDSVYCTLLAQSAVHGAMAGYTGFTAGLVNGRHTYIPFNRITEKMNNVVITDRMWARMLSSTNQPSFLKPKDVHQIMKAGQSPTQLLEGSNCNGGGEEAKKVEQIPTQLMEGDKSKDNQKSRNLADSDSCIKK

SEQ ID NO: 67560 - protein, 250 aa, Methylococcus capsulatus str. Bath
MRRPLVVGNWKMNGRSASVARLLNDILAGIGDCKAEVGVCVPFVYIPQASEILKGTKVMLGAQNVADHNSGAFTGEISAGMLREFGCELAIVGHSERRLLYGESNELVASRYEQAIQGHLKPILCVGETLEQREQGRTLAVIGAQIDTVFEFAGVQSLEHAVIAYEPVWAVGTGRSATTGQAQEVHYHIRSLIARWNPEVAQAVQIIYGGSVKPENSAELFAMPDIDGGLIGGASLDARAFLSICHSVSV

SEQ ID NO: 67561 - protein, 647 aa, 'Chlorella' ellipsoidea
  misc_feature (613)..(613): Xaa can be any naturally occurring amino acid
MAAFLNSHLLAGWRPVLPVPARPHVHASASNGNGVATAPLPTITDIYGTTAALGPDMNAAGAYSMPAKEAEPVSPEVQALIDEQGIDFELSGLKYLSNEGRLKALAKKATKVEKMKNKKSGDRIWSDISELAALVRSGEKTWEELNLDDVDVRTKWAGLFHRKKRAPGTFMMRLKVPNGEITSKQLRVLGEQLKPFGDELGVGDITSRANFQLRGIPMAETDNVIKAVQGCGLSNVMTGMDNVRNMTGSPIAGIDPHELLDIRPLNYEINNMITNYGKGNHELSNLPRKINLALSPSRDDFPHVFINDVGLQAIRHPETGEVGFNVELGGYFSIKRNTQSINGNTYLRQDQVVAYCKALLEFFRDAGNREDRQKAGLMWLVEACGVDNFRKNVAQRMGLDDLPGHVHVEYPDVWKRRDVIGFHPQKQDGYYWACACVPSGRITADDYLAFAEIADRYGNGTARATVECNILFPFIPESKLEDLKKEPLFQKFSLEPKPLTRGLVSCTGAQFCGVAIIETKQRAMAIAAKLENELDIPQTVRMHWTGCPNSCGQVQVADIGLMGGPARHEGKAVEGVRIFTGGKVGEGASLGAEIEKGVACNDEVLLPKLREIXINQYGRHREEDGSLQDGDWRAGRPRLGPSRMTVL

SEQ ID NO: 67562 - protein, 382 aa, Thermus thermophilus
  misc_feature (234)..(234): Xaa can be any naturally occurring amino acid
MRGLSRRVQAMKPSATVAVNAKALELRRQGVDLVALTAGEPDFDTPEHVKEAARRALAQGKTKYAPPAGIPELREALAEKFRRENGLSVTPEETIVTVGGKQALFNLFQAILDPGDEVIVLSPYWVSYPEMVRFAGGVVVEVETLPEEGFVPDPERVRRAITPRTKALVVNSPNNPTGAVYPKEVLEALARLAVEHDFYLVSDEIYEHLLYEGEHFSPGRVAPEHTLTVNGAAXAFAMTGWRIGYACGPKEVIKAMASVSSQSTTSPDTIAQWATLEALTNQEASRAFVEMAREAYRRRRDLLLEGLTALGLKAVRPSGAFYVLMDTSPIAPDEVRAAERLLEAGVAVVPGTDFAAFGHVRLSYATSEENLRKALERFARVL

SEQ ID NO: 67563 - protein, 1117 aa, Adiantum capillus-veneris
MSSTRHSYSSGGSGKSKHGRRIAQTSANAKLYAAYEESSESGSFDYSQSVSAGKEGISSQLVTAYLQRMQRGGLVQQFGCLIAVEEETFRVLHMCEAPEMLDVATQAVPTMGQYSRLCIGADVRTLLSPASASALDRVIGVVDVSMFNPITVQSRSSGKPFYAILHRNDVGLVIDLEPIRPDDASITGGALQSHKLAAKAIARLQSLPGGDIGLLCDSVVEEVHELTGFDRVMAYKFHEDEHGEVVAEIRRTDLEPYIGLHYPATDIPQAARFLFMKNRVRMICDCRLPPVKLIQDKTLSQPMSLTGSTLRAPHGCHTQYMANMNSISSLVMAVIVNDSDDDSAGHSSQGIKLWGLVVCHHTSPRYVPFPVRSACEFLMQVFSLQLNMEVGMAAQVREKHILRTQTLLCDMLLRDAPIGIVSQSPNIMDLVTCDGAALYYGKKCWLLGTTPTEAQIVDIAAWLLDCHKDSTGLSTDSLAKTGYPEASCLGDAVCGLAAAKITATDFLFWFRSHTAKEVRWGGARHDPEERDDGRRMHPRSSFKAFLEVVKQQSLPWEDVEMDAIHSLQLILRGSFQDIDDSNTKTMIHARLNDLKLQGLDELSTVASEMVRLIETATAPILAVDGQGLINGWNGKVAELTGLSFETAMGKSLAKELVHEESKTIVERVLHLALEGEEEQDIEIHLRTYDQHKQKGVVILIVNTCCSRDVSNNVVGVCFVGQDVTGQKLVLDRFIRIQGDYKAIVQSLNPLIPPIFGADEYGFCSEWNAAMEKLSNWRREEVLGKMLVGEIFGLQMVCCRLQGQDVVTKLMIVLNDAVNGQESEKFPLVFYDRNGRRVEALLIASKRTDADGRITGVFCFLHTASPELLQALIIKRAKEKVDKELSYVKEELKKPLEGLAFTRTVLEGTNLTIEQRQLIKTNAWCERQLRKILEDDLNNIEEGYMDLEMSEFFMGSVIDAVISQGMAASRGKGVQILTEIPNDVKLMCLFGDQARLQQVLADLLFCAINHATTTNEDEKDWVTIKVSRTKTRLDDGVHLMHFESRISHSGQGISEALVEEMTNKSQKWTPEGLAISISCTLIRLMNGDVKYTTDAGNKCFLVTIQFPLAHRDDATSVR

SEQ ID NO: 67564 - protein, 394 aa, Roseovarius nubinhibens ISM
MAWKTLDDMDLAGKRVLTRVDINVPVENGKVTDATRIERIAPTVEHILSQGGIPVLIAHFGRPKGKVVLDMSLRIVLPALEAALGHKVGFVETLEGAENLTGEARAAEVLLLENIRFYPGEEANDPEFAARLAGLGDIYCNDAFSAAHRAHASTAGVAEHLPSCAGRLMQAELQALEAALGAPERPVVAVVGGAKVSTKLDLLGNLVDKVDHLVIGGGMANTFLAAQGLNVGASLCEHDMADTARQIMVKAGAAGCEILLPADVVVAREFAAGAENEVVPAHACPEDAMILDAGPQSVARVAAVLAKAKTLIWNGPLGAFEIAPFDTATNAAAQEAARLSREAGLISVAGGGDTVAALNQAGAAEDFTYISTAGGAFLEWMEGKTLPGVAALGG

SEQ ID NO: 67565 - protein, 354 aa, Glycine max
MSPSNGLHNGGGGGSGGGGGNGVSYIEHQVSKLDTLAGVAIKYGVEVADIKRMNGLATDLQMFALKTLKIPLPGRHPPSPAPGPHDEPAKSGEASIERKPLRIGQSAMKEPLQSLELKPPQPNISPAMSILQKFYGLKSSNSRDTLNGTEMAVYLSSNSDHSSGEWLPKASPILDLPSASNDYPRSTNLVYDLLTGDDEYVPLAEIGDTGVEKSDEKSVRRRQKAEVDNGTSTPEKIMKEGNGNGSNGLSSNGKTLAMRPKSASRAALFPESESGWLDSIPVGLGESIFTDGFSGVRKSSSASSLREQEKNNSAAAWPPAIWSLKPDLQAAISKPIFDGLPIPISGRRSKAALD

SEQ ID NO: 67566 - protein, 323 aa, Arabidopsis thaliana
MAALSEKEAEAYLDARPRYPIDWFKKIAARTQDHKFAWDVGTGNGQAAIGLVEHYENVVATDINEAQLQRAIKHSRISYHHTPTTISEDEMVDLLGGENSVDLIVAAQAVHFFDLNVFYNVAKRVLRKEGGLIAVWVYNDIIISHEIDPIMKRLVDSTLPFRTPIMNLAFDGYKTLTFPFETIGMGSEGKPITLDIPHKLSLKGFIGFLRSWQPAMKAKEKGVELINEDLITKFEEAWGDETQVKDVFYKAHMIVGKIPEEKFESDQVLSNKGRLLLETEVGRNQKRPQPSDEGDRQSKKQNTSEDDACKDKPSSVFSTHYRF

SEQ ID NO: 67567 - protein, 1679 aa, Aspergillus nidulans FGSC A4
MSELWYQRPAAGWDEALPVGNGRLGAMVYGRTDTELLQLNEDSVWYGGPQNRLPEDALKCLPRLRELIREGAHKEAERLARRAFFASPNSQRHYEPLGTLFLEFGHPCEEVTGYRRSLDLNEGITHVHYEHNGVQYHRQVIASYPDNVLAMRVQASRCSEFLVRLSRLSELEYETNEFLDDLVVDGQSIKMHVTPGGKDSNRACCMVAIRCGSDDQEPIKVDCVGKNLIINARDALIVIVAQSTYRCDDADLDRATVADLEAVLASSVEDIWARHITDYQSLYGRLELNLGPDATDIPTDQRILHVRGPELVAIYLRYSRYLLISCSRPGRKGSSDRVLPATLQGIWNASFHPPWGCRYTININLQMNYWPANVGNLLECEEPLFALLERLAVTGTETARKMYGCRGWTVHHNTDLWADTAPVDRWMPATLWPLGGAWLCTHVWERFLFNGNKAFLKRMFPVLRGCVEFLQDFLVDDVSGQYKVTNPSLSPENTFRDEKGQEGVLCEGSTIDIQLVRAVLKAFVESLEVLGYSQDELLPSVHDTLRRLPPARIGSKGQLQEWMFDYDENEPGHRHVSHLWALYPGNDINLETTPELAKACAVTLQRRQAAGGGHTGWSRAWLLNLHARLRDADECAEHLERLLAQSTLPNLLDTHPPFQIDGNFGGGAGILEMLVQSHEDGIIRLLPACPLAWRSGRLRGVRARGGFELEFEWKDGVIRGPEASAFFYTSHSRCEDSTTYGKHNALGISTIMDLTSVQDLKGALRNDFFHGYATAAAQVEGAWNKDGKGPSIWDTFGHTPGKVKDNSNADDAVRFYDFYREDVALMKSYGVNAYRFSLSWSRIIPLGGADDPVNEQGIKYYQDLVDELLNNGITPFVTLFHWDVPQALEDRYGGMLNQERFIPDFVRYARVCFERLGPKVRHWITFNEPGVYSLAGYAAGVHAPARSSFRELNEEGDSSTEPFIVGHTELVTHGHVSKLYREVFQPQQKGTIGITLHGNWSEPWDEDDPRDQEAAERAREFEIAWFADPLYKTGDYPASMRAQLGDRLPRFTPEESKLVLGSSEFYGMNSYTTFFVQHKDTPPDINDHKGNVIVHDTNSKGVSRGEESDTPWLRTAPTGWRKLLNWIWNRYHVPIYVTENGTTAKGETAPTPEVLIDTFRMRFFEGYVGGLARAVKEDGVDIRSYFAWTFTDNWDRKGPIQMVEIFRRSYASTVRPATAPRPSPNVKHVRENAELYAQNCRDRNYPAHAEYPFKIQQLSEELRQIDKQLMPFRSRIKALERTIGRLQNPATGPEEKEQEPAIRAEAQQLKNESAALITRRELCDEQIHDLALSLPNLTSPHTPVGLEPALVEYLNFDPQSPPAWVSSPDPLRSHVSIGTDLGLIDFTSAATTTGWGWYFLTGDGALLEQALIQYSLSVARRHGWTPISPPSIVWSYLTEACGFQPRDQNNEQQIWAIEQAEKDKAKPPRSLAATAEIPLAAMHARNELDPAALPIKLVGPSRCYRAEAGSRGVDTKGLYRVHEFTKVEMFGWADSSPTSSSPTSDDLFEGLLTVQKEILTSLQLPCRILEMPTSDLGASATRKRDIEALFPSRMRGNGLEDAWGEVTSASICTDYQSRRLGTRVRGVKSVFPHTVNGTAVAVPRVLAAILENGWDAERKVVVLPEVLRPFMGGAEVIGK

SEQ ID NO: 67568 - protein, 589 aa, Brassica napus
MSLPETKTQTLLDAWDFQGRPADRSKTGGWASAAMILCIEAVERLTTLGIGVNLVTYLTGTMHLGNATAANTVTNFLGTSFMLCLLGGFIADTFLGRYLTIAIFAAIQATGVSILTLSTIIPGLRPPRCDPTTSSHCVQANGIQLTVLYLALYLTALGTGGVKASVSGFGSDQFDDTEPKERSQMTYFFNRFFFCINVGSLMAVTVLVYIQDDVGRKWGYGICALAIVLSLSIFLAGTNRYRFKKLIGSPMTQVGTVLVAAWRNRRLELPSDPSFLYDLDDVIAAEGSMKSKQKLPHTNQFRSLDKAAIKDQEMAMTQNVYNKWTLSTVTDIEEVKQIVRMLPIWATCILFWTVHAQLTTLSVAQSETMDRHIGSFEIPPAAMAVFYIGGLLLTTAVYDRLAIPLCKKLFNYPHGLRPLQRIGLGLLLAAMGMAVAALVEIKRLRTAHAHGPTVKTLPLGFSLLIPQYLIVGIGEALIYTGQLDFFLRECPKGMKTMSTGLLLSTLALGFFFSSVLVTIVEKVTDKAHPWIADDLNKGRLYNFYWLVAVIVALNFLVFLVFSKWYVYKEKRLADLGIELEDEPDIPMGH

SEQ ID NO: 67569 - protein, 70 aa, Triticum aestivum
AATTSLMAGVSTLTSMSAILGEMLGSGRATPRLLQLYAPYVVFAVIAILRGLCSCSAPPSPASSARKKRV

SEQ ID NO: 67570 - protein, 638 aa, Streptomyces verticillus
MRPVCGIVAIRSADGGLDGGELTAPMADLRPRGPDGEGTWVSPTGRAALGHTRLAVIAPDAGRQPVAGPDGTVRLVVNGEFYGYREIRAELRAAGCRFRTGSDSEIALHLYLRDGRRALERLRGEFAFVLWDERRATLFAARDRFGVKPLYYTERDGRLYVASTVRALLSCGAPARWDTAAFAAHLQLGLPPDRTLFAGIRQLPPGCHLIADAHGTRVTPYWDLDYPPAGELAARGSLDDHLDAVRERTDEAVRLRTVADVPLACHLSGGLDSSAVAASAARHTRLTAFTVRFDDPAFDESAVARRTAAHLAIDHREVASERAHFADHLRDVVRAGEMVQENSHGIARYLHSAHIKKAGFTAVLAGEGGDELFLGYPQFRKDLTLSLSADARDKADRGYARLVAAGLLPPYLRTLLGTLGFLPSWIVDRHLAVTQPVAALLRPDFAAELARADAAAPLLAAGAGLLAGRAPAHQATYLFAKTWLPGYLLAAERLDAAQAVEVRLPLFDHHLFDLVRHTPPAWYDKDGTGKYPLRAAMRHRLPREVTEGRKQGFLAPPMADDDTLLDALRERLAGPGAGDDPFFDPHAVRALLDRLAAAPPGQRSGGEKLLQLVASTAELADEFGLTTAPSGQKGGNGG

SEQ ID NO: 67571 - protein, 245 aa, Myxococcus xanthus DK 1622
MDSLILDSNTWLLVLTGAGVSAESGVPTFRGMSGLWEDQPVEAVASPEGFRKDPALVWRFYSERRKAAAAVHPNPGHEALVAWERHLGDRFLLATQNVDGLHTRAGSQRVVEMHGNLFKTRCSRCGRPPFEDATVYPAGAVPECDACGKLLRPHIVWFGEYLDPADIQRIEDFSLRAATSGGRFVFLAAGTSGAVYPAAGIVDQVRKAGGKTWLVNLDPAENSNRFEHRIVDKSGEVLPTLAKLA

SEQ ID NO: 67572 - protein, 237 aa, Zea mays
  misc_feature (86)..(86): Xaa can be any naturally occurring amino acid
  misc_feature (138)..(138): Xaa can be any naturally occurring amino acid
MTMKSSSGGGHVIGVPVTSKAHGIEEVSRDPSFGKGAGDHLAVSLTHPSPYASFGYKHTGSKGQVTHWVSKLSRRAQGFREHVTLXGPKLSETVKGKLSLGARILQAGGVERVFRQAFSAADKGERLLKALQCYIYTXTGGPIAGMLFVSTRKVAFRSDRPITVTSPGGGGDTARVTYKVAIPLRRIRRVRPSENVHRPEEKYIHVSTVDGFEFWFMGFVSYQRSCKYMQQAVSEMR

SEQ ID NO: 67573 - protein, 198 aa, Brassica napus
LRMQKGLVPTKFFADMLRIAKILKASPSCVANLEKRIGMQLDQAALEDLVMPSFSHTMETLYDVDSVQRILDHFLSTDQIMPADVGSPCSSVDDGNVIGSPRLITPMTAVAKLIDGYLAEVAPDVNLKLPKFQALAASVPEYARLLDDGLYRAIDIYLKHHPWLAETERENLCRLLDCQKLSLEACTHAAQNERLPLR

SEQ ID NO: 67574 - protein, 429 aa, Arabidopsis thaliana
MVNPEENNRNLVVKPITEILQDDDKRSRKFGVEMKRQNRRALGVINHNLVGAKAYPCVVNKRRGLSQRKQESCDKKKLDSLHPSISRSQEETKKLKPSGNEFGDCIFIDEEEEKNEEVTLDQPMPMSLEEPYIEFDPMEEEVEMEDMEEEQEEPVLDIDEYDANNSLAAVEYVQDLYDFYRKTERFSCVPLDYMAQQFDISDKMRAILIDWLIEVHDKFELMNETLFLTVNLIDRFLSKQAVARKKLQLVGLVALLLACKYEEVSVPIVEDLVVISDKAYTRTDVLEMEKIMLSTLQFNMSLPTQYPFLKRFLKAAQSDKKLEILASFLIELALVDYEMVRYPPSLLAATAVYTAQCTIHGFSEWNSTCEFHCHYSENQLLECCRRMVRLHQKAGTDKLTGVHRKYSSSKFGYIATKYEAAHFLVSDSH

SEQ ID NO: 67575 - protein, 432 aa, Gloeobacter violaceus PCC 7421
MVTSAFQTAQSHRLFAEAQQLMPGGVNSPVRAFKSVGSEPVFIERAEGAYLWDVDGNRYIEYINTWGPSIVGHSHPEVISALREALPKGTSYGAPTRLENQMARTVIDAIPAVEMVRFVNSGTEATMSALRLARAFTGREKIIKFEGCYHGHADMLLVQAGSGVATLGLPDSPGVPKSTTAATLTAPYNDLAAVEALFKQYPSDVAGLILEPVVGNAGCLVPEIGFLEGLRDLTHAHGTVLIFDEVMTGFRLSYGGAQARYGIEPDLTCLGKIIGGGLPVGAYAGRREIMQMVAPAGPMYQAGTLSGNPLAMTAGIKTLEILQRPGTYERLEGLSARLADGLLAAAREAGHAATGNRVGAMFTLFFTEGPVRNFADAKRSDLQKFARFHRGMLERGVYLAPSQFEAGFMSLAHTEEDIDYTVAAARTVLAAL

SEQ ID NO: 67576 - protein, 319 aa, Klebsiella pneumoniae
MLSKQALLQAYRKMREIRTFEERLHQENTSGDIPGFIHLYTGEEAIAVGVCENLTSADFIGSTHRGHGHCIAKGCDIHGMMAEIFGKDSGLCRGKGGSMHIADLSKGMLGANAIVGGAPPLAIGAALTAKTLKTGNVGVSFTGDGGSNQGLVFEAINMAVVLQLPAVFIFENNGYGEGTGHDYAVGGRDIARRAAGFGLPAVTVDGTDFFAVYEATSEAVKRAREGGGPSVIEAKAFRWHGHFEGDPALYRAEGEVQRLREQHDPLKIFTAKVKQHITQEELAAIDEEVEALVNDAVLKARAAAYPAPEDLLTDVYVSY

SEQ ID NO: 67577 - protein, 339 aa, Klebsiella pneumoniae
MTIKTYREAVKEALAQEMERDERVVLIGEDLRGGHGGNAPEEAKIEAFGGVLGVTKGLWTQFGSDRVIDTPITESAIIGMAAGAAATGLRPVAELMFMDFFGVSHDALYNQAAKFRYMFGGKARAPLVMRGMIGAGFSAAAQHSQSPYNIFATTPGLKVVVPSTPYDVKGLLIQSIRDDDPVVFCEHKMLYDLKGEVPDEIYTIPLGVANYTREGEDVTIIALSAMVHKANQVADKLAREGISVEVVDPRTISPLDEEGILESVASTGRVVIVDESAARFGFAHDVAALIASQAFHFLKAPVLLVTPPHTPVPFSPALEKLWIPGVERIEAAVRQVLED

SEQ ID NO: 67578 - protein, 291 aa, Methylococcus capsulatus str. Bath
MIQGSIVALATPMEPDGRLDVPGLRRLVEFHIEQGTDAIVAVGTTGESATLDEEEHTEVIRLVVEQAAGRIPVIAGTGANATTEAIRLTARAKAVGADACLLVTPYYNKPTQEGLYRHYLAVAEAVDIPQILYNVPGRTGCDMLPATVGRLAQVPGIVGIKEATGKLERLAEIRALCPEGFALYSGDDATACEFCLSGGNGVISVTANVAPRLMQEMCRAAIAGDRATAEAINRRLEALHHDLFIESNPIPVKWALHEMGLIQEGIRLPLTWLAASCREAVRQAMRQAGVL

SEQ ID NO: 67579 - protein, 391 aa, Pseudomonas viridiflava
MEQQCDVAVLGLGAMGAATLYQLAREGADVLGIDQYAPPHTQGSSHGDTRITRLSVGEGPQYLPLVRNSHRIWRELEAMTGEPLFEQCGVLVMTSSPAYDPQDPEDFTHKTIALAREYGVRHEVLSAEDIRERFPQFSPVLDTAIGYFEPDGGFVRPERCIAVQLQLAGKLGARIRLNETVTRLQAHGDQVRVTTDQGSIIANKVVVSAGMWSSHLLGEPFTDLLRVCRQQLFWFALEDTVAFAPVSPSFILTHGPREVDINYGFPPLPGEGSMKIATEQYLHASQARELDRSVSAEDERTMFQTQVSGKFAGIKADVVKSSVCAYTVTPDYHFIIDDHPHLKNVTVVSACSGHGFKHSAGLGLALAQRCLRGTSEVDLSAFSLKRFGKTA

SEQ ID NO: 67580 - protein, 117 aa, Clostridium perfringens SM101
MHNERNHKSNRKEQIREDLTQFNIGDTIKVHVRIKEGNRERIQVFEGTVIKKQNGGLRETFTVRRVAYGVGVERTFPINAPIIDKIDVVRRGKVRRAKLFYLRDRVGKAAKVKELTR

SEQ ID NO: 67581 - protein, 339 aa, Haemophilus influenzae R2846
MAIKIGINGFGRIGRIVFRAAQHRDDIEVVGINDLIDVEYMAYMLKYDSTHGRFDGTVEVKDGNLVVNGKTIRVTAERDPANLNWGAIGVDIAVEATGLFLTDETARKHITAGAKKVVLTGPSKDATPMFVRGVNFNAYAGQDIVSNASCTTNCLAPLARVVHETFGIKDGLMTTVHATTATQKTVDGPSAKDWRGGRGASQNIIPSSTGAAKAVGKVLPALNGKLTGMAFRVPTPNVSVVDLTVNLEKPASYDAIKQAIKDAAEGKTFNGELKGVLGYTEDAVVSTDFNGCALTSVFDAEAGIALTDSFVKLVSWYDNETGYSNKVLDLVAHIYNYKG

SEQ ID NO: 67582 - protein, 188 aa, Haemophilus influenzae R2846
MAGTSAAMLGFAPANVLAAPREYKLLRAFESRNTCTYCAVSCGMLLYSTGKPYNSLSSHTGTNTRSKLFHIEGDPDHPVSRGALCPKGAGALDYVNSESRSLYPQYRAPGSDKWERISWKDAIKRIARLMKDDRDANFVEKDASGKTVNRWATTGIMTASAMSNEAALLTQKWIRMLGMVPVCNQANT

SEQ ID NO: 67583 - protein, 808 aa, Haemophilus influenzae R2846
MTNNWVDIKNANLIIVQGGNPAEAHPVGFRWAIEAKKNGAKIIVIDPRFNRTASVADLHAPIRSGSDITFLMGVIRYLLETNQIQHEYVKHYTNASFLIDEGFKFEDGLFVGYNEEKRNYDKSKWNYQFDENGHAKRDMTLQHPRCVINILKEHVSRYTPEMVERITGVKQKLFLQICEEIGKTSVPNKTMTHLYALGFTEHSIGTQNIRSMAIIQLLLGNMGMPGGGINALRGHSNVQGTTDMGLLPMSLPGYMRLPNDKDTSYDQYINAITPKDIVPNQVNYYRHTSKFFVSMMKTFYGDNATKENGWGFDFLPKADRLYDPITHVKLMNEGKLHGWILQGFNVLNALPNKNKTLSSMSKLKYLVVMDPLQTESSEFWRNFGESNDVNPAEIQTEVFRLPTTCFAEEDGSIVNSGRWAQWHWKGCDQPGEALPDVDILSMLREEMHELYKKEGGQGIKSFEAMTWNYAQPHSPSAVELAKELNGYALEDLYDPNGNLMYKKGQLLNGFAHLRDDGTTTSGNWLYVGQWTEKGNQTANRDNSDPSGLGCTIGWGFAWPANRRVLYSRASLDINGNPWDKNRQLIKWNGKNWNWFDIADYGTQPPGSDTGPFIMSAEGVGRLFAVDKIANGPMPEHYEPVESPIDTNPFHPNVVTDPTLRIYKEDREFIGSNKEYPFVATTYRLTEHFHSWTAQSALNIVAQPQQFVEIGEKLAAEKGIQKGDMVKITSRRGYIKAVAVVTKRLKDLEIDGRVVHHIGLPIHWNMKALNGKGNRGFSTNTLTPSWGEAITQTPEYKTFLVNIEKVGEA

SEQ ID NO: 67584 - protein, 257 aa, Coprinopsis cinerea okayama7#130
MLHTASLLHDDVIDESALRRGAASAPSAFGNKQSVLGGNFVLGRASAALSRLGDPEVTQLIAGVLSNLVEGEILQLKEIQLDGSPETASQRRQDAWNIYLHKTYLKTASLMAKGARSAVVLGGCKEGEIWKEIAYAYGRNLGIAFQLVDDVLDYESASATLGKPGGADLELGLATGPALYAWEEYPEIGELICRKFEQPGDVERARDLVLRSSGVERTKALAQEYASKAREVLQEIPDSDAKAALEVLTERVVGRRS

SEQ ID NO: 67585 - protein, 399 aa, Rickettsia akari str. Hartford
MSIISTRLNSIKPSPTLAVVKKTLELKKSGIDIIALGAGEPDFDTPDNIKEAAIKAIQDGFTKYTNVEGMPLLKQAIKDKFKRENSIDYELDEIIVSTGGKQVIYNLFMASLDKGHEVIIPAPYWVSYPDIVALSTGTPVFVNCGIEHNFKLSAEALERSITDKTKWLIINSPSNPTGASYNFEELENIAKVLRKYPHVNVMSDDIYEHIIFDDFKFYTLAQIAPDLKERIFTVNGVSKAYSMTGWRIGYGVGSKTLIKAMTIIQSQSTSNPCSISQMAAIEALNGPQDYIKPNALNFQKKRDFALSILKRVKYFECYKPEGAFYLFVKCDKILGHKTRSGKIISNSNDFAEYLLEEAKVAVVPGIAFGLEGYFRISYSTSMEEIEEACMRIERACNAL

SEQ ID NO: 67586 - protein, 363 aa, Roseovarius nubinhibens ISM
MSDTTTILGIESSCDDTAAAIVRVGGAVPEILSSVVDGQTELHDAYGGVVPEIAARAHAEKVDLCVRAALDTAGIGLGQVDAVAVTAGPGLIGGVMSGVMCAKGIAAGAGLPLIGVNHLAGHALTPRLTDAVEYPYLMLLVSGGHCQFLLVEGAEEFTRLGGTIDDAPGEAFDKVARLLALPQPGGPSVEAEAALGDAARFKLPRPLLDRPGCDMSFSGLKTAVLRARDGEMQEGRLSRRVRADICAGFQASVCDVLGEKTRRALEIYLEQAPARPVLAVAGGVAANGPIRARLMQVAEAAGAAFVAPPLRLCTDNAAMIAYAGAERFARGHRDGMDLAARPRWPLDKASPAMLGSGKKGAKA

SEQ ID NO: 67587 - protein, 352 aa, Glycine max
  misc_feature (93)..(93): Xaa can be any naturally occurring amino acid
MSNLPTTQGKAIPDASDYKGRPAERSKTGGWTASAMILGGEVMERLTTLGIAVNLVTYLTGTMHLGNAASANVVTNFLGTSFMLCLFIGFFVXSFLHRYRTIAIFAAVQATGVTILTISTIIPSLHPPKCNGDTVPPCVRANEKQLTVLYLALYVTALGTGGLKSSVSGFGSDQFDDSDDDEKKQMIKFFNWFYFFVSIGSLAATTVLVYVQDNIGRGWGYGICAGAIVVALLVFLSGTRKYRFKKLVGSPLTQFAEVFVAALRKRNMELPSDSSLLFNDYDPKKQTLPHSKQFRFLDKAAIMDSSECGGGMKRKWYLCTLTDVEEVKMILRMLPIWATTIMFWTIHAQMTT

SEQ ID NO: 67588 - protein, 350 aa, Cryptococcus neoformans var. neoformans JEC21
MPSSLDNTRRHVQVFAERVGAVAGSEFPGHYPGEDHSWNLQKFKQDLVASVQRLTPSTIEFDLVGVDASIANALRRTLIAEVPTVAIEEVYVWNNTSIMQDEVLCHRVGLVPLKIDPRSLRYRPSANSQPHEHDTVVFDLRVRCDRRPNVDRSETDPKKMYFDSNVYSGMLKWVPSGDQKKKFKGKAPRPVNDDILLVKLRPGQQVDLHCFARKGVGADHAKFSPVATASYRLLPHIILRGPIPKEHQQKFKGCFPPGVIEIEKDENGEDQCVVKNPRKDTVSREVLRHPEFQDLVQLARIRDHFIFNVESAGQYSPEELVPEAIKILLGKIKDVEEGLDKLFATEGQAA

SEQ ID NO: 67589 - protein, 114 aa, Escherichia coli
AQQNILSVHILNQQTGKPAADVTVTLEKKADNGWLQLNTAKTDKDGRIKALWPEQTATTGDYRVVFKTGDYFKKQNLESFFPEIPVEFHINKVNEHYHVPLLLSQYGYSTYRGS

SEQ ID NO: 67590 - protein, 714 aa, Treponema denticola ATCC 35405
MMNMNDLSFFQGKASPLGAKLSCDGVNFSVFSRNAKEIVLHLFENVEDSEPIISYKLDPQINKTGDVWHVFVSGLKSWAFYLYTADGEFSPSAGFLFDENNYLLDPYARLISSHSVFNSEQTFNQKDSKASGGKNQHKRTAKGFPKCVVIDDREFDWQGDKPLNIPLQKCVIYEAHVKGFSFLNDKISPTKRGKYSGLVELIPYLKDLGITSLELLPVFDFDENENMNINPKTGVRLKNYWGYSTIAFFAPKALYAEDPGNAVNEFKFMVREFHKAGIEIILDVVFNHTAEGNENGPVFSFKGFDNSIYYHLEDNKFYYKNFSGCGNSLKTSEIPVIKFILDCLRYWVTEMHVDGFRFDLAPVLARDKTGSIDLNSFMIQAIADDSVLRSTKIIAEAWDAAGAYMVGKFPGRWAEWNDLFRNSVREFWLQPNPDIRHLATRVTGSADLYSQKGRRPYQSINFVCCHDGFTLCDLLSYSEKHNEENGENNRDGSNENLSYNHGIEGSASVEIERMRMRSAKNILTTLILSAGTPMINMGDEVFRTQNGNNNAYCQDNEMSWFDWELLNENKDLLEFTKKLINLRKTHFSFLRKHFFTGASKINGTPSDITWFDYNAQKPNWNVPSNFLAFLIDGNKINLESDEDDNDFYVMTNSYNNDITVRLPPPSSGGKIWHRLIDTSYTDGKDFLDEEHTEQIMNQQIYVVLSRTTVVLIAK

SEQ ID NO: 67591 - protein, 852 aa, Cryptococcus neoformans var. neoformans JEC21
MSTPPFLPLVTSQDTTLLPSLALITPVLIPSDHLEQIRQSLPANASYYVQANDNDDLIALLDGGAEKLVVTPQQLGAGGAGIPKERLILQVSEEELSTSKRFAQQTGGILIISCVPHNAKSLALPGVDVFLQLPEVQPLRILNLIRSSRPSSYVIPSSYLSIESSTTAEKISIPEAFLAPIISDRPDGLFPTIVSSYSHSTTPLGLVYSSIESVKESILTQKGVYQSRKHGLWRKGETSGAVQQVTGIKLDCDNDALIFEVVQHGSGFCHLPQSTCFGNLSGIAKLSDTLTSRLASAPEGSYTKRLFTDEKLLRSKIMEEAEELCDAQTKEEVAFEAADLVYFALTRCVSKGVSWRDVEAALDKKALKVTRRKGDAKPKWEEKTREVVNENGEAKPTVPEPTKLPETESEDVPIKMRAVTLSTLSVLEQKDLLLRPVLNSLAMIDKVKPIVERVRQEGDAGLKAMTKQFDRADLSSNVLLPPFETPGEDVLPKDVREAIDVAYNNVKEFHQAQNEKEPLVVETMPGVTCSRFARPIARVGVYVPGGTAILPSTAIMLGVPAQVAGCKTIVLATPPRQDGSISPEVLYVAKLTGVTCILKAGGAQAVGAMAYGTDEVPKVDKIFGPGNQWVTAAKMLVQNDTDALVAIDMPAGPSEVLVIADYTANPVFVASDLLSQAEHGVDSQVILLAINLTPEHLAAIEAEIDRQARALPRVKIAREAIKKSVTVEVKDLEEAVKFSNEYAPEHLILHLEKAEEVVAEIENAGSVFVGPFSPESCGDYASGTNHTLPTNGFARQFSGVNTLSFQKHITSQIVSAEGLKKLGPYVIRLAEREGLEAHANAVRVRLAELNKQ

SEQ ID NO: 67592 - protein, 397 aa, Rickettsia akari str. Hartford
MLSKLNKPALFALIFYPIFIISLVVKYSFNYGIGRTEVIFIIASYYINNITVGIGLHRLWSHNAYKINKCAEFVLIMLSAGTLQGPALSWASNHYKHHAKTDTDQDPHSPLKFDSKVLGFLWSHIGWMLVGSGSYKSIDRITWAKHGKNNLLKWQLKYYWQIAAFMNIVVPLFIGYLVDGTIQSAYAGFVFMGLGRFLQQQATFCVNSLCHFAGSKKYYKGTAGDIWWMALFLLGENWHNYHHAFPSDYRNGAKWYHLDVHKWIIFLMSKIGLASELERTTKVRIQAKMQETLSYLSEKQKQKLTLMQAKIDHLLENLCLKIKELEESSITIKGQFKKSFVEIQESLKILAEQISSATQITEKPSEKLLKIVNKKIIDAEQSIYRLYNQFNTLKVSS

SEQ ID NO: 67593 - protein, 674 aa, Bacillus anthracis str. Ames
MTQNINQLAVNTIRTLSIDAINAANSGHPGLPMGAAPMAYALWANHLNHNPNHPKWFNRDRFVLSAGHGSSLLYSLLHLAGYDVSIDDLKNFRKLNSKTPGHPEFGHTSGVEATTGPLGQGIANAVGMAMAEAHLAAKFNKDGHSIIDHNTYALVGDGDLMEGVAYEAMSMEGVAYEAMSMAGHMKLGKLIVLYDSNEISLDGELNIAFSEDMQKRVESAHWQYVRVEDGNDVDAITKAIQLAKDNTDQPTLIEIRTVIGYGSPKVAGTNKAHGNPLGLEEATATKQVYGWHYEEDFFVPEEVTAHFNELKQKGIEKERGWNEQFNLYRESNPALADELEKAIIGEVLIEAKDILSFDSEKTISTRVASGEAINHYVKSIPSIFGGSADLSHSTMTDIKGEAVYAVESYAGRNIYFGVREHAMGAAANGLALHGGVKPFVSTFFVFNDYLRPSIRLAALQKLPVTYVFTHDSIAVGEDGPTHEPIEHLAALRAIPGLTVIRPSDANETASAWAYALQQTEGPVVLVLSRQNLPVFHETKANIENLSKGAYVLTQTNENPDVILIATGSEVSLAASAKAKLEEDNVSVRIVAMPSWELFDRQSKEYKESVLPSSVTKRVSLEMGVSLGWERYVGQEGNILSIETFGASGTGAEVMNLFGFTTENVVQITKNVLNS

SEQ ID NO: 67594 - protein, 186 aa, Capsicum annuum
MMNANGFSGVEKEYIRKHHLHQPKENQCSSFLVKHIRAPVHLVWSLVRRFDQPQKYKPFVSRCIAQGDLEIGSLREVDVKSGLPATTSTERLELLDDEEHILSFRIIGGDHRLRNYSSIISLHPEVIDGRPGTLVIESFVVDVPQGNTKDETCYFVEALINCNLKSLADVSERLAVQDRTEPIDQV

SEQ ID NO: 67595 - protein, 189 aa, Brassica napus
MAMGSKRKTPPGILLLRRVRGRNWSPKTFRYAILLITFIAYACYHASRKPSSIVKSVLHPEPSTKPPQQEHINMRPWPLGNVFVKEEETDVLWRRGSANKGWEPFNGKGGTSRLGEIDVAFLACYSIGMYVAGHLGDSLDLRLFLTWGMIGTGFFVGLFGMGYFWNIHAFSVLSCDAMAAGLFQATGCR

SEQ ID NO: 67596 - protein, 440 aa, Triticum aestivum
MTMMAMPEAPCLCARPSLAARARRPGSGPAPRLRRWRPNATAGKGVGEVCAAVVEAATKVEDEGEEDEPVAEDRYALGGACRVLAGMPAPLGATALAGGVNFAVYSGGATAAALCLFTPEDLKADRVTEEVPLDPLMNRTGNVWHVFIEGELHNMLYGYRFDGTFAPHCGHYLDVSNVVVDPYAKAVISRGEYGVPARGNNCWPQMAGMIPLPYSTFDWEGDLPLRYPQKDLVIYEMHLRGFTKHDSSNVEHPGTFIGAVSKLDYLKELGVNCIELMPCHEFNELEYSTSSSKMNFWGYSTINFFSPMTRYTSGGIKNCGRDAINEFKTFVREAHKRGIEVILDVVFNHTAEGNENGPILSFRGVDNTTYYMLAPKGEFYNYSGCGNTFNCNHPVVRQFIVDCLRYWVTEMHVDGFRFDLASIMTRGSSLWDPVNVYGAP

SEQ ID NO: 67597 - protein, 103 aa, Glycine max
MSGRGKGGKGLGKGGAKRHRKVLRDNIQRITKPAIRRLARRGGVKRISGLIYEETRGVLKIFLENVIRDAVTYTEHARRKTVTAMDVVYALKRQGRTLYGFGG

SEQ ID NO: 67598 - protein, 110 aa, Saccharomyces cerevisiae
MSSQIIDRPKHELSRAELEELEEFEFKHGPMSLINDAMVTRTPVIISLRNNHKIIARVKAFDRHCNMVLENVKELWTEKKGKNVINRERFISKLFLRGDSVIVVLKTPVE

SEQ ID NO: 67599 - protein, 406 aa, Glycine max
MATLFQGLGVVNPSLASSNSNKFHLPSRTSLSERKDGIFVVRSDATRVSSQVLKAGARKHELLVTNAVATKEGRPAASTSKSGHELLLFEALREGLEEEMERDPCVCVMGEDVGHYGGSYKVTKGLATKFGDLRVLDTPIAENSFTGMGIGAAMTGLRPVVEGMNMGFLLLAFNQISNNCGMLHYTSGGQFKIPIVIRGPGGVGRQLGAEHSQRLESYFQSIPGIQMVACSTPYNAKGLMKAAIRSENPVILFEHVLLYNLKERIPDEEYVLSLEEAEMVRPGEHVTILTYSRMRYHVMQAAKTLVNKGYDPEVIDIRSLKPFDLHTIGNSVKKTHRVLIVEECMRTGGIGASLTAAITENFHDYLDAPIVCLSSQDVPTPYAGTLEEWTVVQPAQIVTAVEQLCK

SEQ ID NO: 67600 - protein, 427 aa, Rhodococcus erythropolis
MSIVIIGSGQAGFEAAVSLRSHGFSGTITLVGDEPGVPYQRPPLSKAYLHSDPDRESLALRPAQYFDDHRITLTCGKPVVRIDRDAQRVELIDATAIEYDHLILATGARNRLLPVPGANLPGVHYLRTAGEAESLTSSMASCSSLVVIGAGFIGLEVAAAARKKGLDVTVVEAMDRPMARALSSVMSGYFSTAHTEHGVHMRLSTGVKTINAADGRAAGVTTNSGDVIHADAVVVGIGVVPNIELAALTGLPVDNGIVVDEYLRTPDENISAIGDCAAYPIPGKAGLVRLESVQNAVDQARCLAAQLTGTSTHYRSVPWFWSEQYESKLQMAGLTAGADTHVVRGSVDSGVFSIFCFLGTRLLGVESVNKPRDHMAARKILATEMPLTPEQAADTDFDLKLAIARHKDTHKDEVASADIGERQVVAS

SEQ ID NO: 67601 - protein, 629 aa, Desulfovibrio desulfuricans G20
MCGIAGYCGACGVADTTEKECAGRLEALLAGIVHRGPDDAGITCAHNVAIGMRRLSIIDLAGGHQPMLSGDGRYALVFNGEIYNFRELRSELAEAGYSFATNSDSEVLLKGYMAWGRGVLDRLDGMFAFAVHDRHAGTVFLARDHLGIKPLYYIHLGGVFAFCSEPAPLLELPQVRRRLDHDALAAFLSFKYVPAPDTFIKDIKKLAAGHTLEYSPRGDMLRTERYWQLQGREGSSDAGELAERLTRAVDSQMVSDVPLGVFLSGGIDSGLLTWAAAGQGGEHFTGGYTVAFDETGRKKGLRAGGSFDESRLAALSAAHLGVPLSSTTLASPAQATLDDWIRRFQEPFANTSIPANFLLCQWVARHVKVALNGSGADELFGGYDRYYAVHPPAALRALHCAAPLLRRVADMLPVGGGKNSLVHRARRYLAGCALAPAQKHAGSIRLFTDTQLAAIAPGVVPATFVQDAFAGAPQGSLLYKATWTDMQTMLPDDYLTLVDRTSMAASLEVRVPFLARDFVQYAFSLPPAAKIAGWKKKTALRALAAKHLPEDIARQPKMGFESPVGRWFRDGLGEALCRQLAQSPLQNIISVRGVQALAQSHSAGQVDAAKPLLALYTLVRWMDMYRVEL

SEQ ID NO: 67602 - protein, 461 aa, Triticum aestivum
MGKAARWLRGLLGGGGKKEQGKEHRRPATSTAPHGDRKRWSFCKSTRDSAEAEAAAAAAALSGNAAIARAAEAAWLKSLYNETEREQSKHAIAVAAATAAAADAAVAAAQAAVEVVRLTSKGPTSTVLAVAVAEPRGRASAAVKIQTAFRGFLAKKALRALKGLVKLQALVRGYLVRKQAAATLQSMQALVRAQACIRAARSRAAALPTNLRVHPTPVRPRYSLQERYSTTEDSRSDHSVAPYYSRRLSASVESSSCHGYDRSPKIVEMDTGRPKSRSSSLRTTSPGASEECYAHSVSSPLMPCRALPRIAAPTARHFPEYEWCEKARPATAQSTPRYASYAPVTPTKSACGGYTYSNSPSTLNCPSYMSGTQSSVAKVRSQSAPKQRPEEGAVRKRVPLSEVIILQEGRASLSGGTQRSCNRPAQEEAFSFKKAVVSRFDRSSEAAERERDRDLFLQKGW

SEQ ID NO: 67603 - protein, 138 aa, Brassica napus
HASAQQTLNVSWDSQRNTLPKTSDNGRESSSASPIPTDVIVDIFSRLPLKSIAMCRCVSKLWASVLRLPHFTELFLTKSSSCPPQLLHARVTNSELFLFSSASPHPDENSSSPPVVASRHMKLSFGGFGEISCGRPVY

SEQ ID NO: 67604 - protein, 370 aa, Prunus armeniaca
TNEVPSIANYDRKSEVKTFDDTKEGVKGLVDAGITKVPRIFHLPVDQYPINNTCDSEPTKTQLRIPVIDLEGLEYDNSPTKRKETVAKVGEASETWGFFQIANHGIPVDVLEEIKNGVRGFFEQDTEVKKKYYTRDRFRPVIYNSNFDLYSAPATNWRDTFLCNMAPNPPKPEDLPQVCRDILVEYSKQVMKLGKLLFELLSEALGLKPSHLNDMDCSLGLQILGHYYPPCPQPELTLGTSKHADNDFITVLLQDHIGGLQVLHQNTWIDVLPVPGALVVNIGDLLQLISNDRFRSVEHRVLANRACPRVSVACFFSTGFLALPRIYGPIKELLSEDNLPKYRETTVKDYNAHHYNKGLDGTCALTHFKL

SEQ ID NO: 67605 - protein, 211 aa, Geobacter metallireducens GS-15
MITTLLEGNRRFVAETFEKEKELFVELTRGQKPTVLWIGCSDSRVPVNTITQTKAGEVFVHRNVGNIVAANDWNLSAVLEFSINHLKIPDIVICGHYGCGGIQALDEENSDDKYIPIWLINAYKAKERVDEKLRALHIDIPHEQRMKLIVEENVRLQLEHLREYPFVRRAVEEGKLTLNGWVYDMGNGEIRIVATESAPRIGKGTCSIKIK

SEQ ID NO: 67606 - protein, 444 aa, Gloeobacter violaceus PCC 7421
MPADIPSPNQMIAPLETRTDARGHLMIGGCDVVDLAQRFGTPLYILDEATLRAACTQYVEAFKRHYAGDFRVLYASKAWSNLAICAIVHRCGLGIDAVSAGEVHTALRAGVPGELVYLHGNNKSEAEILLAAEVGATVVADNWLDLEILSAISAECPVRVMVRVAPGIDIHTHEYIRTGHLDSKFGFDPSELAAVLAYLARIPSLRAVGLHAHIGSQSFELAPHGDAAQLLLEWYPKALALGLSDFNELNVGGGLGIRYTDDDDPPAIDEWVGTICQAVTRTCNTYNLPLPKLLCEPGRSLVGPACATAYTVGSTKTIPSIRKYFSVDGGMSDNPRPITYKALYTAVVANKMHDGRREKVTVAGKHCESGDVLLRDVELPPLERGDCLVVFSTGAYNCSMASNYNRIPRPAAVLVSDGEATLIVKRESPDDLLRCDCLPERLQT

SEQ ID NO: 67607 - protein, 419 aa, Magnaporthe grisea 70-15
MAPPAAITPVTPGTPEPSLNKGGPDTNLTAAAIGHKMSQASEYQELDASKLIYNLTTSPRALPDYDTAAAGSETVCTDHMVTANWHAATGWSAPTIKPYGPLSLMPTASVLHYATECFEGLKAYRGYDGKLRLFRPDRNANRMLMSSVRIALPSFPPEALEKLLIALMAVDGPKWLPRERPGTLLYLRPTMIGTQAQLGVQAPNQAMLFITASYFPTMDSPAGGMRLHTSPEDMVRAWVGGFGYAKVGANYGPSLLATKEAKSRGFHQILWLYGPEGYCTEAGASNFFVLMKNKQTGRLEIVTAPLDDRVILGGITRMSVLELARSRLGDEVDVVERRYTIDEVFEAYAEGRIVESFASGTAYFVCPISLIHHRGKEVSIPMGEDGQGGKYTLKLKQWLKDIMYGNEQHEWGVVVPEEQ

SEQ ID NO: 67608 - protein, 301 aa, Zea mays
METSKSPQSSKNSHIVVPSDSNGPRFDNDGFSSEAASNQMVVFNSEAGDKEQDELGENRLQKSIITRGISPSIGAFTVQCAKCFKWRLIPTKEKYEEIRERIIEEPFVCKRAREWRPDVTCNDPEDISQDGSRLWAIDKPNIAQPPRGWERQIRIRGEGGTKFADVYYTSPTGRKLRSLVEVDRFLQENPEYGAQGVTLAQFSFQIPRPLRQDYVKKKPKLINPSDEASMVASKSFQPEEVKPIAWAVATKHEGDASEEASLTDEAPTSEVMLARKRKAGSSLSVEPNHLSDELEPKLEDA

SEQ ID NO: 67609 - protein, 549 aa, Mannheimia succiniciproducens MBEL55E
MQNINPTSTAAWKALEAHKGTLENTTINDLFQQEKNRFADYSLTFNNEILVDFSKNKITRETLNLLRRLAKECALDEAKEAMFSGEKINRTENRAVLHTALRNRSNTAVLVDGKDVMPEVNEVLAKMKAFSERVISGEWKGYTGKAITDVVNIGIGGSDLGPYMVTEALRPYKNHLNMHFVSNVDGTHIAEVFKKTNPETTLFLVASKTFTTQETMTNAKSARDWFLATAKDEKHVAKHFAALSTNAAEVEKFGIDTDNMFGFWDWVGGRYSLWSAIGLSIILSVGFENFEALLSGAHEMDKHFRNTPIEQNIPATLALVGLWNTNFQGAQTEAILPYDQYMHRFAAYFQQGNMESNGKYVGRDGKVISNYQTGPIIWGEPGTNGQHAFYQLIHQGTTLIPCDFIAPAKTHNPLADHHNKLLSNFFAQTEALAFGKTKETVEAEFLKAGKSLDEVKDVVPFKVFAGNKPTNSILLQEITPFSLGALIAMYEHKIFVQGVIFNIFSFDQWGVELGKQLANRILPELSGDEQVTGHDSSTNGLINQFKAWR

SEQ ID NO: 67610 - protein, 728 aa, Oryza sativa (japonica cultivar-group)
MAAAAVRSVSPPTWEERPPVPSPPHKRKRAMGHAAHASPLERQVHILAHDAVQWHEPDMQPLVVVVVQIRKLGTRPSDLTVIFVHRKSGSSYPFQSTKTAPSLCALLMWVTKRLGITVLIVLFPLLIVHHLIVNSPVSGPSRYQVIHSNLLGWLSDSLGNSVAQNPDNTPVEVIPADASASNSSDSGNSSLEGFQWLNTWNHMKQLTNISDGLPHANEAIDNARTAWENLTISVHNSTSKQIKKERQCPYSIHRMNASKPDTGDFTIDIPCGLIVGSSVTIIGTPGSLSGNFRIDLVGTELPGGSGKPIVLHYDVRLTSDELTGGPVIVQNAFTASNGWGYEDRCPCSNCNNATQVDDLERCNSMVGREEKRAINSKQHLNAKKDEHPSTYFPFKQGHLAISTLRIGLEGIHMTVDGKHVTSFPYKAGLEAWFVTEVGVSGDFKLVSAIASGLPTSEDLENSFDLAMLKSSPIPEGKDVDLLIGIFSTANNFKRRMAIRRTWMQYDAVREGAVVVRFFVGLHTNLIVNKELWNEARTYGDIQVLPFVDYYSLITWKTLAICIYGTGAVSAKYLMKTDDDAFVRVDEIHSSVKQLNVSHGLLYGRINSDSGPHRNPESKWYISPEEWPEEKYPPWAHGPGYVVSQDIAKEINSWYETSHLKMFKLEDVAMGIWIAEMKKGGLPVQYKTDERINSDGCNDGCIVAHYQEPRHMLCMWEKLLRTNQATCCN

SEQ ID NO: 67611 - protein, 373 aa, Triticum aestivum
  misc_feature (212)..(212): Xaa can be any naturally occurring amino acid
PRLPTTFPEVFNNFGILLGYVSNFAFARLPVHLSWRAMFLVGAVPPVFLGFAVLAMPESPRWLVMRGRIEDARRVLLRTSDSPEEAEERLLDIKKVVGIPADATDADDVVAIVRANEAARGQGVWKELLINPSRPVRRMLVAGLGLMFIQQATGVDCVVMYSPRVFEKAGMKNRTNSLGASMAVGACKTFFIPIATLLLDRVGRRPLLLASXAGMAIFLFTLATSLLMLDRRPESEAKALGAVSIVAMLSFVASFASGLGPVAWVYCSEIYPLRLRAQAAAIGTGLNRLMGGATTMSFLSLSEAITIAGSFYLYACVAAAGWVFMYFFLPETMGQSLEDTGKLFGKDMDDGDTDDGAVVHHERKRSTELITQQ

SEQ ID NO: 67612 - protein, 481 aa, Triticum aestivum
MAAFVLFLCLLVPLVLACAVRARKKGAGGRSSSGGGGGKKGGSSSLPLPPGSMGWPYVGETTQLYSSKNPNVFFARKRNKYGPIFKTHILGCPCVMVSSPEAAKFVLVTQAHLFKPTFPASKERMLGPQAIFFQQGDYHAHLRRLVSRAFSPEAIRGSVPAIEAIALRSLGSWEDLQVNTFQEMKTYALNVALLSIFGEEEMQYIEELKQCYLTLEKGYNSMPVNLPGTLFHKAMKARKRLGAIVAHIISARRERERGSDLLGSFMDGREALTDDQIADNAIGVIFAARDTTASVLTWMVKFLGDNPAVLKAVTEEHAEIAREKALSGEALSWADTRRMRLTGRVIQETMRVASILSFTFREAVEDVEYQGYLIPKGWKVLPLFRNIHHNPDHFPSPEKFDPSRFEVAPKPNTFMPFGNGTHSCPGNELARLEMLVLCHHLATKYRWSTSKSESGVQFGPFALPINGLPMTFTRKDDKNKA

SEQ ID NO: 67613 - protein, 556 aa, Ostreococcus tauri
MMRQRETKEAVARRTLAEFETQIEETARRTGDATTRARVERMLKRLPKQYAMDVNFIEDVLAHAELLGRVEQELQAMGVSSVYCSVREVEVGRAAFGSHEDMMDTDGGIEQLNVTADNGIPIRADSPAGKPRGPTFGSSLQMTSSLGGDPSRGSAGMYEVAVAAGNKPRLLSRVSAVLFDVGLNIAEAHVFCTDDGLALDIFVVTGWKRGEEAAVGHAVQTALDAADFSDIVPASRNASAATPSADEGRMSAGSHGRSTSNDSVSIDGGEWELKESQLVFNEKIASGAFEVAIKVLKSNAQEGNAGNETMREFAQELSILRRVHHKHIIQLIGALTKQKTMCLVTEFMHGGNVLQFVQEHALKLHEIIRFSLGVAMGLDYLHKINIIHRDIKTANLLLDENSVVKIADFGVARLQPTDGSTMTAETGTYRWMAPEVIAHGFYNEKADVYSYGIMVWELESGGEVPYPGYTPLQAAVGVVQRGLRPAISTSCNPKLAQVMQSCWLADATQRPGFEQIISLLKSIDTQKAETDGKHGFFDRLRSVSFKSKKNAPARSS

SEQ ID NO: 67614 - protein, 528 aa, Arabidopsis thaliana
MVIGAAARVAIGGCRKLISSHTSLLLVSSQCRQMSMDAQSVSEKLRSSGLLRTQGLIGGKWLDSYDNKTIKVNNPATGEIIADVACMGTKETNDAIASSYEAFTSWSRLTAGERSKVLRRWYDLLIAHKEELGQLITLEQGKPLKEAIGEVAYGASFIEYYAEEAKRVYGDIIPPNLSDRRLLVLKQPVGVVGAITPWNFPLAMITRKVGPALASGCTVVVKPSELTPLTALAAAELALQAGVPPGALNVVMGNAPEIGDALLTSPQVRKITFTGSTAVGKKLMAAAAPTVKKVSLELGGNAPSIVFDDADLDVAVKGTLAAKFRNSGQTCVCANRVLVQDGIYDKFAEAFSEAVQKLEVGDGFRDGTTQGPLINDAAVQKVETFVQDAVSKGAKIIIGGKRHSLGMTFYEPTVIRDVSDNMIMSKEEIFGPVAPLIRFKTEEDAIRIANDTIAGLAAYIFTNSVQRSWRVFEALEYGLVGVNEGLISTEVAPFGGVKQSGLGREGSKYGMDEYLEIKYVCLGDMNRH

SEQ ID NO: 67615 - protein, 372 aa, Geobacter metallireducens GS-15
MAEKRDYYEVLEVHRNASDTEIKKAFRKLAIQYHPDKNPGDKESEEKFKEITEAYEVLSDSQKRAQYDQFGHAGLGAGGFSSGGFGGFGAGTPFGDIFGDIFGDIFGGRPRGSRGRRGDDLQYNLELSFEEAAFGVEKEILVPFGKRCDECGGSGAKPGTEPKVCPTCRGAGQVRFQQGFFSVSKTCSHCNGEGRVVENPCPTCRGNGMVRDTKTLSVKVPAGVETGTRLKMTGEGGQGTKGGGNGDLYVAIAVKEHPIFTREDNDVICEIPISFVQAALGCEMEVPTLDGKVSMKVPEGTQSGRIFRLRGKGVPQLQGYGRGDQMVVVKVETPSNLNKRQRELLEEFARISGEDAHPMKKNFFDKVMDLFS

SEQ ID NO: 67616 - protein, 751 aa, Halobacterium sp. NRC-1
MPDGDAPDVTPLYEAWSLHGADRYATGDLRARSRYLGLEHDDLRACLTQAADVVDVPAEDGRGTVVPLHAPDTPEPTDEYVVWDPDSDAVGYFDESFGISGAHSRVPLDDVVATAIAHRVRFWHPARAPGGDTDPDGPLAAATVPDGVPPTDPLAGRDRRAFFDTLRETVRGERAAERDQTRDAHADADLRRLVDEHAVDGPFVLVSTTAHSDRPADVRVQYAPDDGAPADIDLVAAFDLYPDNRVLVDAFHDALPFPARVASVDGPLVTLQPTWERVTDPEGVATTLADADPFWLRGLLNPVPYTRRLDAIDAVWETPAKRRLLTGQRPLSFSRPPNRRHADLALDDHQQRALAWAVAADDVACIHGPPGTGKTRTLAAVVAESVARGERVLVTAHSNQAVDTLLVGDSTLDAADDGSLHGVLGDDPTVDIARHGRHSRNRVVDDHYRQRGVDAADVVAATTNGAATFDQNAFDLAVVDEATQASRAATAIAVNAADTLVLAGDHRQLPPYGVREGGAGEMRPSLFETLIDRYGDDVAVLLARQYRMHDAIAGFPNEAFYGGRLETAAVAADRAVDGLPPVAVVDVAGQERRDERGASVRNAAEASVVADRVDTIRRAGVEPGDLGVIAAYSDHVSAIRGVLADRGLDRPALTVDTVDSFQGGERDAVVVSFARSNDAHDAGFLEHPAAGPRRLNVALTRARRHLSLVGDWATLTDPASHRSPAASCADVYADLYDTLADHADARLFNRR

SEQ ID NO: 67617 - protein, 281 aa, Medicago truncatula
MYRENGLLFPWSYLHNFSQELHQLEDYCRNQKFNASMSDLVQFSAMSEYDFAAEGDLFKAPEPMIEESGIDLDPMTAAISMISCGEDVKSTDISILQNEQLLSDVFYDCKKDLFEKAGMESPLSEILEIKVPLLNIDENIIQENKPLPDMPLLLKSVSSGSLSSMDWMHGSAAMKPAFLGISGIDFDAVYGMRRSFSEGDIKTFGNANMNVVQSPVERPFFTSNCSSEERLQKLSRYRNKKTKRNFGRKIKYACRKALADSQPRVRGRFAKNEETDQAKKE

SEQ ID NO: 67618 - protein, 330 aa, Methylococcus capsulatus str. Bath
MLLAGDVGATKTVLGLFDCWGDRLVSLSEAIFASTDYASLETVVAAFLDGQEERRPEVACFGVPGPVSEGRCEITNLPWVLSERELAAATGVSAVRLLNDVQAMALGMAYRLGEDDWVELNPGAGRPRSGNVAVIAAGTGLGEAILYWDGERYHALPTEGGHSDFAPNGPLEEGLLAFLRDRFCGHVSYERILSGSGLANLYDYLRHAGVAPESEALHAALASAPDRAPIIAEWALERRDALCTAVLDLFAAIYGAEAGNLALKSLALGGVILGGGIAPKILPVLQAGRFMAAFTAKGRLSPLLGRLPVRVAIHPQPALLGAAHAASAML

SEQ ID NO: 67619 - protein, 138 aa, Rickettsia akari str. Hartford
MNIIDHFEQENIAKLTANKQIPDFKAGDTVKVTVKVLDRSIEKDGKEKLTERFQAYEGLVIAKRNRGITSSFLVRKISHGEGVERRFMTYSPIVHSINVVKYGVVRRAKLYYLRNRSGKSARIKERHIHIAKTKTVKA

SEQ ID NO: 67620 - protein, 95 aa, Nicotiana tabacum
MRGVLVDWLVEVAEEYKLLSDTLYLAVSYIDRFLSTKVIPRQKLQLLGVSSMLIASKYEEINPPHVEDFCYITDNTYTKEDVVKMEADVLQSLKF

SEQ ID NO: 67621 - protein, 388 aa, Ostreococcus tauri
MWGDAGGDGVQISEIDSGEFVPGRGGRYSVMTPEDSWNVAVGDRRAPSPAIGWHDEEGSSSDALHTEFLINPDDVRLQERIAVGGFAEVFRGTWQGTVVAVKQLLERTSEVKEKLEQEVQVLAKLRHPNLLLFMGYCVDPPLICTEFMRRGSLHTILKAGKPLEPARNHAIALAVARGMSYLHSRSPPILHLDLKSPNILVDEKWRVKIADFGLARMRQTTQMSAKSQFHGTPEWMAPEMLRAEDYDEHADSYSYGVVLWELITAHKPWEDLHPMQIVAVVGYSGRSLELPSEGFPESSHPLTALLADIFTRCARRDPSARPLFPAILTDLERARDLARARAEAAGADKTAARIPPRPDTESVDRRALGVQLEYISLADAVASTDASS

SEQ ID NO: 67622 - protein, 447 aa, Shewanella sp. MR-4
MIKKFFQTGADRPIMDETPEKIRSIYKKYQWQVFIGLVFGYAMFYVVRMALSVVKKPMLDSGVVTIEELGLMGSAFFFTYAIGKFSNGFLADYANIGRFMSVSLMLSSITCMAMGMGVAGLFFVILWGMNGWFQSVGSAPSCVSIFQWYSPKQRGSVYSVWGGSRNIGEAISWILTASLVSFFGWKIGFVGAGIAAFAAAACMLILLKDRPRTYGLPDPATAYGEEPESVKGHDPAAIRKAQLFVLRQPVVWIIALACAAMYSSRYAMSSWAVLYLQSEKNYSLIDAGVAMSSYPIAGFFGAILSGLISDKIFNANRHIPTFLYGLANIIGMSLLFWGSESRMMDAFGLGLIGFSIGGLVVFLAGLTACDLMPKNAVGAVKGFIGLFSYLAASVQEIVSSKLILVTEVAGVKHYDFGSAQYFWLGTSVLSIVLAASVWRAKKVTVVD

SEQ ID NO: 67623 - protein, 399 aa, Rickettsia prowazekii
MSIISTRLNSIKPSPTLAVVKKTLELKKAGVNIIALGAGEPDFDTPDNIKEVAITSIKDGFTKYTNVDGIPLLKQAIKNKFKRENNIDYELDEIIVSTGGKQVIYNLFMASLDKGDEVIIPVPYWVSYPDMVALSTGTPVFVNCGIENNFKLSVEALEHSITDKTKWLIINSPSNPTGAGYNCKELENIAKTLRKYPNVNIMSDDIYEHITFDDFKFYTLAQIAPDLKERIFTVNGVSKAYSMTGWRIGYGAGSKALIKAMTIIQSQSTSNPCSISQMAAIEALNGTQDYIKSNALNFQKKRDLALSILEEVTYFECYKPEGAFYLFVKCDKIFGTKTKSGRIIANSNNFSEYLLEEAKVAVVPGIAFGLDGYFRISYATSMQELEEACIRIKHACNAL

SEQ ID NO: 67624 - protein, 515 aa, Geobacillus kaustophilus HTA426
MFTPYQHEPLTDFTVEKNQRAFQMALEEVSNHLGKEYLLVIGGKRITTTEKVVSINPANKEEIVGIVSKADKRLADQAMEAALKAFETWRKEKPEARAHILFRAAAILRRRRHEFSAYLVKEVGKPWKEADADTAEAIDFLEYYGRQMITLQHGVPVLSRPGERNTFHYIPLGVGLVISPFNFPLAIMAGTTVAAIVTGNTVILRPSDRAPIVAAKFVEVMEEAGLPPGVLNYLSGGEAEVGEYLVEHPKTRFISFTGSRAVGCRIYERAAIVQPGQKWIKRVIAEMGGKDAIIVDKDADLELAAQSIVVSAFGFSGQKCSACSRVIVLEDVYEQVLNRVVELTKQLIVGDPEKPSTFMGPVIDETAYNKVMHYIDIGKQEGKLMTGGEGDSSKGFFIQPTVFANVDPNARIMQEEIFGPVVAFTKAKDFDHALNIANNTEYGLTGAVISRNRPNFEKAREEFHVGNLYFNRGCTGAIVGYQPFGGFNMSGIDSKAGGPDYLLLHMQAKTVSEAF

SEQ ID NO: 67625 - protein, 153 aa, Oryza sativa (japonica cultivar-group)
LLAVDAAATASPAATRGRGRFAYAWVGNAAEQCPGECAWPFHQPAYGPQAPPLVSPNADVGMDGIIINLATLLAGAVTNPYGGGYFQGPTEAPLEAVTACTGMFGAGAYPGYPGQLPVDAATGASYNAVGVAGRRFLLPAMWDPKTSQCSTLV

SEQ ID NO: 67626 - protein, 384 aa, Staphylococcus aureus subsp. aureus MRSA252
MISNKLANIPDSYFGKTMGRKIEHGPLPLINMAVGIPDGPTPQGIIDHFQKALTIPENQKYGAFHGKEAFKQAIVDFYQRQYNVTLDKEDEVCILYGTKNGLVAVPTCVINPGDYVLLPDPGYTDYLAGVLLADGKPVPLNLEPPHYLPDWSKVDSKIIDKTKLIYLTYPNNPTGSTATKEVFDEAIAKFKDTDTKIVHDFAYGAFGFDAKNPSILASENGKDVAIEIYSLSKGYNMSGFRVGFAVGNKDMIQALKKYQTHTNAGMFGALQDAAIYALNHYDDFLEEQSNVFKARRDRFEAMLTKADLPFFHAKGGIYVWLETPPGYDSEQFEQFLVKEKSILVAPGKPFGENGNRYVRISLALDDQQLDEAAIRLTELAYLYE

SEQ ID NO: 67627 - protein, 446 aa, Triticum aestivum
MAATIQSVKARQIFDSRGNPTVEVDVCCSDGTFARAAVPSGASTGVYEALELRDGGSDYLGKGVSKAVDNVNLIIAPALIGKDPTAQTELDNFMVQQLDGTKNEWGWCKQKLGANAILAVSLAICKAGASIKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWVHYAKMTEECGEQVQIVGDDLLVTNPTRVAKAIKEKSCNALLLKVNQIGSVTESIEAVKMSKHAGWGVMTSHRSGETEDTFIADLAVGLSTGQIKTGAPCRSERLAKYNQLLRIEEELGAAAVYAGLKFRAPVEPY

SEQ ID NO: 67628 - protein, 562 aa, Bacillus cereus ATCC 14579
MTTTTTVKSDIEIAQEASMKKIQEIAADLNILEDELEPYGHYKGKLSLDIFKRLQDEKDGKVVLVTAINPTPAGEGKSTVTVGLGQAFNKIGKKTVIALREPSLGPTMGLKGGAAGGGFSQVVPMEDINLHFTGDIHAITTANNALAAFIDNHIQQGNTLGIDTRKIVWKRCVDLNDRALRNVVIGLGGPVQGVPREDGFDITVASEIMAVFCLATDIQDLKARLSRIVVAYNFANQPVTVKDLGVEGALTLLLKDALKPNLVQTLENTPAIIHGGPFANIAHGCNSVIATTMAAKLGDYVITEAGFGADLGAEKFLDIKARAAGIKPEAVVIVATIRALKMHGGVAKDQLKEENVDALAKGMENLQKHVETIQSFGVPFVIAINKFITDTDAEVTYLQEWCNERGYAVSLTEVWEKGGQGGVDLAEKVLKEIEKGENNYAPLYELELPLEEKIRTIAQKVYGAKDIEFAPKARKQLAQYEGEGWSNLPVCMAKTQYSLSDDVTKLGRPSDFIVTIRELKPSIGAGFIVALTGTMLTMPGLPKQPAALQMDVNEDGKAVGLF

SEQ ID NO: 67629 - protein, 304 aa, Zea mays
  misc_feature (261)..(261): Xaa can be any naturally occurring amino acid
MQVHDPCPQLHSKPRAALYCTVLLERERRLRRWNLVMGDAYAKRVLLTAAGDTVSRGIACTLTKHGCRLVLLGDEGALAATEEEARRCGVGGGCVELVGLDFKACGEAAADAAVDRAWRCFAGLDAFVNCYSYEGEVQDCLSISEDEYRKTIKVNVITPWFLMKAIAKRFQDTKSGGSIVFLTQIIGAERGLYPGAAAYGTSLGAIHQLVRLCAMELGKHKIRVNAACRGLHLQDKFPVSVGKEKAEKATAEVMPLRRWLXDPEKDLASTVLYLVGDESRYMTGTTIFVDGAQSIVRPRLRSFM
